United States Patent 9,012,723 (ISOLATED NOVEL ACID AND PROTEIN MOLECULES FROM SOY AND METHODS OF USING THOSE MOLECULES TO GENERATE TRANSGENE PLANTS WITH ENHANCED AGRONOMIC TRAITS) - sequence listing, part 15

SEQ ID NO: 72669 - DNA, 345 bp, Glycine max
  misc_feature (153)..(153): n is a, c, g, or t
  misc_feature (181)..(181): n is a, c, g, or t
  Peptide Sequence Number=SeqID_164354
atgaaactcaaaggaattgacgggggcccgcacaagcggtggagcatgtggtttaattcgatgcaaagcgaagaccttaccaggcttgacatgccgcgaatcctcttgaaagaaggggtgccttcgggaacgcggacacaggtggtgcatggnctgtcgtcagctcgtgcctttggaaccnctgagcagactgccggtgataagccggaggaaggtgaggatgacgtcaagtcatcatgccccttatgccctgggcgacacacgtgctacaatggacgggacaaaggatcgcgatcccgcgagggtgagctaactccaaaaacccgtcctcagttcggattgtag

SEQ ID NO: 72670 - DNA, 50 bp, Glycine max
  Peptide Sequence Number=SeqID_164355
atggcgaattcgtcagattccattgtgtcttccacaattggatctgctaa

SEQ ID NO: 72671 - DNA, 363 bp, Glycine max
  Peptide Sequence Number=SeqID_164356
atgggtgacatacatgaaaggcttattagggttctcatgcgcacatgtcactcgtcgtgggtgacatatactggagtcacaatgctaggagaagggctcaccaagggtggaccttgggttttaagagcttcagagagtacaacattgggtttggagtgtaggtcagctgaagtagaacttcaggttagctatgaccctgaaggaaccttcccagttgggaccaagctttcccgctcagggatcttttctggcttcacctcggactcgccatacgagggccctgaggatgactctattagctacctttgcttgtctgttagtctaaggatgttcgacagagatgactacgtgcttgatgcctag

SEQ ID NO: 72672 - DNA, 498 bp, Glycine max
  misc_feature (480)..(480): n is a, c, g, or t
  Peptide Sequence Number=SeqID_164357
atggttaaggaggagtgtaaggaggtaaatgtctcctccaagaggacacttgttagcactaccacacctcttgggcttgaagttattcctcaagtaaaggagttgttggatgagggtttggttcataagagcttaaatctttgtgctttgttagtgcccaaaatagttattattaggcaccaaatccctaagataggtggtatgatgaatatgtttagtgatgcaaccctctttggcaaaatcacccatgaacctaacactttcaagattcatgtgcatagggactctttaggtagtgatcaaggggttcccatgctccctaagagaataaaggttattcctaagtggcccactgcaccaagtataagggaaatttggggcttccatgacttaacaaacttctacaaaaggtttgtaccatatttttctatacttgtagcaccactcattgagttggtgaggaaccatgttccttcatgngaagatgcccaggaaaag

SEQ ID NO: 72673 - DNA, 510 bp, Glycine max
  Peptide Sequence Number=SeqID_164358
atgacgttgctacaaagcaacattttgcctcgtgaccacaactctgacctccccctgctgaagtgtcagttggtttatgccatcctgacacaggtgagtgtgcatgtggctcatctcatatctgacgctatttatcagtttgcagggattgtacccatgagacaccttgtggacccgaagaagtccaacagggtcctagggtttcttgctctgattacgggcctttatcagttctatggagtgcccgtcgcccccaacaaggtcatccggccgcctattaacaaggccttcattgagaaatactgcacccctaggcaggcgcagggccaggcaccacaacaactagaggaagaccaacagctagctgcaaatgcgccatcaccgcctcaagaggaggtaccgtctctgaggtccatctctgatcacctacggaggatagaactccagatgcataggtacatgcatcacgtgactagccagcaggcgactaatcacagagggcaggtgtag

SEQ ID NO: 72674 - DNA, 297 bp, Glycine max
  Peptide Sequence Number=SeqID_164359
atgttatcaaagagaaaaactctagacgagggtttactgttatcaagcaagtcggagacccatcatgaccacagattcacctccactccttatgttcccatggacctgggtatagggccccttttcaactcacctccccagtggagtcgccaactgtcgcaacctacccttcagcgagagggcgatgcggggctcactggtgcgtcttccaaggaaggaaaacgcgcggagtcaccaccaacgtttattcgaggaaaacgtcagaaaaactggaaaggtgtggtctacgaactttaa

SEQ ID NO: 72675 - DNA, 294 bp, Glycine max
  Peptide Sequence Number=SeqID_164360
gttgcgacagatatctctgaagatactgacatccttgtaatattgggaaggccattcatgttgaccacaagttgcatagttgatatggggaagaggaagctggagctaggttttgaagatcaaaaaattgattttgatttgtttgttgaaaacaaacctgctctagaacacaatgtctacttacaggtaatggaaggaggtcaagaggttctgaaacccactaagctggccaaggatgagctaagccaacttcaattcgatctgaatttggctaagcttcagccggatcgctaa

SEQ ID NO: 72676 - DNA, 305 bp, Glycine max
  Peptide Sequence Number=SeqID_164361
atgggatcgagtcaggcgccttggcttaaaaagaggttctatcaggtcaatatcaagagtctaggagtcgccagtctgaaagagttaggacaattgatgggacaactccaacgacaagcctttcgcaaagcctatggtaagatctgggacctaactttggcggagatcttcacggaggccgctgcctccctcgcccaatattatgaccagcctttgaggtgcttcacctttggggacttccagttaacacccacggtggaagagtttgaagagatcctgggatgccctctaggaggaaggaaacc

SEQ ID NO: 72677 - DNA, 208 bp, Glycine max
  Peptide Sequence Number=SeqID_164362
cccatctataaacatattcagttggattggctcggagaatccatgggtgggagttcttctcagactgttgcctttgaatgagtggagccacctcttggcctctcctgccagtgaaaatgagaacaggctgagtctgatagctttatctggtacaccggcaatcataacagtattgcaaatctctataaatgttgccaagtatgcatag

SEQ ID NO: 72678 - DNA, 953 bp, Glycine max
  Peptide Sequence Number=SeqID_164363
atgaaagtgatgtacttccttgttgccgtcttagctttggcattctcagttgcctcggcctatgaccccagtcctctccaagatttttgtgtgacagtcaatggcaccaaagatggtgtgtttgtgaatggaaaattctgtaaagaccctaagcttgtgaaagcagaagatttcttcagacatgtggaacctgggaatacctccaacccaaatggtgcacaagtgactcaagtgtttgttgatcagctaccagcattaaacacgcttggcatatctttggctcgcgtagattttgcaccaaagggtttaaaccctccccacactcaccctcgaggcactgaaatccttatagtcactgagggtactctctatgttggatttgttacttccaatcaagatggaaatcgcctcttcaccaaagtgctgaacaagggtgatgtgtttgtgttcccaattggtctcattcatttccaacggaatgtgggatatggcaatgcagttgccattgctgctcttagcagtcaaaatccaggaactatcactattgcaaatgttttgtttaaagccaatcctccaatttcttcagaggttcttactaaagcattccaagttgacaagaaagtaaggcaacatagcatgattgcatttccgaaaatggttttggaggagttaggtgcggctaagattgaaagtggcactaaactctatttatttaacttggatcatggagttgccgacgatgatatcaagattgggagatcaaagggaacaacagaagttgtgttcgtgaggcactctaatgctttagcagccatcaagaaatacaacaatatgagtgatggaaagctattgcaaattgagtttgttggaacatatgcatgttcagctactccggttgtcacgcctctttgtcaaactaacttaatgggaagaccaaatgatgtccatttacg

SEQ ID NO: 72679 - DNA, 2445 bp, Glycine max
  Peptide Sequence Number=SeqID_164364
atggatctcacacagagcatgcgggtgctagctatcataggaacaataacacacaatgaagcaactctggcaagtgagttaaattacaccataaacaaggttcctacattgtctctaacttctccaacagcaaggacaaagttattatctcctcaattgccacacttcatccaaattggcgatgatgtcaggattcacatgcaatgcgttgcagccatagtaggagaattcagatggaaaaaggtgacagtaatctatgaacttaataattggctttcctctgatccagggatgctacttgacctcacctatgctcttagacaagttggttctgagattgacaatcatttagctttgccttccttgtcctctctatcagacccaaaatcaaacattgaaaatgagcttaaaaagctcaaaagcaaaagtaacagggtcttcttgattgtgcattcttctttagagctggctaacatactttttgagaaagcaaagcaaataggtttgatggaaaaaggttctgtgtgggttatatcagatggggttgttggccttcttgattcagttaacccatctgctatctctaacatgcagggagtaattgggtttaagacaaacttcatggaagtgagtgagacatttagacagttcaaattcaaatttcaaagaaactttgcctcggagttccccgaggaagagaaaattaatccaagtttcttcgcacttcaattgtacgatgcaacctgggcgattgcacaggctgcaaaggaatcacaagggaagtttactcctgaacaattgttcaaaaattacctctccaggaatgacaaattacagcaatcaccaaccttcaatataattaatgtgataggtaaaagttatagagacttggcattatggtctccaaaactaggtttctccaagaaccttattacacagcagctaacagaggtgaacacagatactacttctactaaagttttgagtactgtttattggcctggaggcttacagtttgttcctaagggatcgactcgcagcaccgaggagagaactctgcaaataggagtgcctgcaaatggtgtctttcgtcagtttgtgaatgtgacacatgatcagaacacaaataacacttctataactggtttctcaattgatgtctttaaagctgttgttaatactttgccttatgacttgaaatacacgtttgttcccttcaatgggtcttatgatgaaatggtagagcaagtccacaataagacattggatgctgctgtaggagacacagcaataatggcatatagatatcatttagtcgacttcacacaaccttacattgaatctggccttgacatggtggttaaagagaaatcagcaaaatcaaaagaaacatggatttttttggatgtatttacaaaagagatgtggttgatgatagttgcattgcacatttttgtgggatttgttatttggttcatagaacggcgacacaatgcagaactaaaaggattggggtccatgctttggtttctagtcagcgtgatattctatgcacacagagaaccaattacaagccccctggctcgaactgtgttggcaccatggctatttgttatactcattgcaactagtacattcacagcaagtttgacttccatgatgactgtttcgcaactagagccatctgtgttagatatccaaacccttcaggaaagaaattcccctgtcggttgtaatggaaattcgttcattgtgaagtacctgattgacatactaaaattcaagcctgagaacatcaagaaaattaactctataggtgattaccctgctgcgtttcagaacaaggatattgaagccgctttctttgttacccctcatgctaaaatctttctggcaaagtactcgtgcaagggcctcatcaaagcagggagcacgttcaagcttggtggttttggttttgtttttcccaagggttcgactttggctactgacttatccgaggcattgctgaaagtgatagagaaacgagaaacagaacaactagaaaaagatatgctattgataggaggcaatgccaattgctctccttccgagagcaaggcaaaaggtaggtcatcaacaggatttcagcctttccttggcctatttttaatctgttcttctgttgctattctggcattgttatataatatgatttgtgtgttcaagattagtgtagagatcttctctagctacatgcatgtaacattaacaaaattaaagagtatgtggagatgcacaaccacatgttttacttggagctgttcaagactccaatcagggagtatgagaagtattagtactgccacagtaacaagaaatgccgaggagactgtcattagtgatcagcaaagcacaatgaatgttgagcttattgatgtagtattggctgctcatgcttcgtga

SEQ ID NO: 72680 - DNA, 213 bp, Glycine max
  Peptide Sequence Number=SeqID_164365
atggcgagtataaagatgcaccaggaagagggcaacgagcaaaaagcctcacctgggacagtggtggccggaaaagaagaaagggtcgtcgaaaatcggataagaagcagaaaggtcgaccgggatgtggaaagaagggtgacaagtagagaggtccaccagaatgcggaaaaaaagtggaagaaatcgccggaaaaagtgccgcgagtataa

SEQ ID NO: 72681 - DNA, 1834 bp, Glycine max
  Peptide Sequence Number=SeqID_164366
atggtgatatcgaagagtaggctgtctgggggttattttgggaatgcactagatactgctggtgaatctgagggttctggtagctcgggaagaatagataccgaaattacagtttcggaggattcgagtatccccacgaggaaatgtattagtttgaattcgagtcgccatgatgcgtttggtgctcccgtgcaagttgttcccttgtcgaatatgccactttctcagagaaaagatctggtgcaaaggttgaggtctgagcttgagcagattcggctgcttcagaagaaaatcgaacagcagaggacgaatggtgttgcattgtcgtcctccagtgatattctcagctgtagtaatgggaataatgggcatcgagtggaaagggataaaaagccatcaatgtccagttctgcaccggggaataaagtgaagccgtcgggtaataagaatcagaagtctcgtggatggaaccggggttcttctgggaagtttgagtctgcagtgcagtctgcttcaccgtccactgcgaatgctatgttgatgaaagattgtgagttgctgttgaaacggttgatgagtcaccagtatgcttgggttttcaagacccctgtggatgtggtgaagttgaatcttccggattatttcactattattaagcgtccaatggatttgggaacagtaaaaagcaagttagctgctggagaatatgctggtccactggaatttgctgatgatgttaagcttacattttcaaatgcaatgaactataatccgtctgggaatgatgtccatctcatggctgataccctcaataaatattttgagttgagatggaaagcaattgagaagaaactgccaaaaagtgatgttctgccaatacctgcaaagccagacaatagtgaaggtgtaaaaactaaaagacaagcgcctccttcaaaaaagaggaaaattgcctcattaccccctcaacctaaagttatgccacctacaaagaaggttatgtcggatcaagagaagcatgatctaggtcgagaattggagtctcttctgggagaaatgcctatgcatatcattgatttcttaaaagaacatagttcaaatggtagagaatgtggagatgacgagattgagatcgatattgatgatctcagtgatgataccctgttcacattacgaaagcttttggatgactttttgcaagagaagcaaaagaacaaagcaaaagttgaagcatgtgaagtagaggtgttgaatgattctggaccaagcaattcctcattgcaaccatttaaaggtaatgatccagcggatgaagaggtggacattggtggaaatgagccccctgtgtcaagctattctcatgtggagattgaaaaggatacaacttacagagtgaacaaaagcctaagcccaggcagctcaaatgatacagactctgatagttcttctgatagcgaagccgatgatgttaaagcaagtccagcaaatgtagcaaaggcaccagaaaatctgggttctgaagctcagttggatgaaatgaccatggctgctgctactcttgaaagaaatcaatctgttagtggcttagatcaacttgaggataactctcagcataagccaagttcttttgattctgattgccaacaagatggggacagtgctccaactgagagacaggtctcacccgataaactttatcgagctgctgtattgaagaaacgatttcttgataccatcttgaaagctcgagaaaagacactcacacagggtgaaaagggggatcctgagaaattgcgccaggaaagggagaaactggagatggagcaaaagaaag

SEQ ID NO: 72682 - DNA, 135 bp, Glycine max
  Peptide Sequence Number=SeqID_164367
atgcctggtagtgtgagaagcatcgttgatctatgcaaatttgagtctgagaccttcatagcgaggcaacgcaacagagttccagcgatgagaagggagaaggtgacgaaagggggagtgacgtcaatgtattaa

SEQ ID NO: 72683 - DNA, 194 bp, Glycine max
  Peptide Sequence Number=SeqID_164368
gaagagggacgtgcctggggccaccactagtagatgcgcctggcaggctaccactagtggacgtgcctggggccaccactagtagatgcgcctggcaggctaccactagtggtcgcgcctggggcccaccactagtggtcgcgcctggcaggccaccactttcacctctgtcccatcgtcctgtcaagtcatga

SEQ ID NO: 72684 - DNA, 1455 bp, Glycine max
  Peptide Sequence Number=SeqID_164369
atgatgaatgtaaactatacgcatgtctatttagacgaggatcaaaactttcttttcacttcttatgatcaacttggattcgtgggccctacacgtattagtcttgatatattggcttactcattattgtatttgccattgctgattaaacagactgaagaggaattacagaggcagaaggcaattaatgattggcttccaattacttcttcaaggaatgcaaaatggtggtactctgccttccacaatgtcactgccatggttggtgctggtgttcttagtctcccatatgccatgtctgagcttggatggggtcctggtgtaactgtactaatcctgtcatggatcatcaccctgtacactctatggcaaatggttgagatgcatgaaatggtacctggaaaacgttttgataggtatcatgaactggggcagtatgcctttggggagaagctaggactttatatagtggtgcctcaacaacttgtggtggaaattggggtgaacattgtctatatggttactgggggaaaatccttgcaaaagttccatgacactgtgtgtgacagctgcaaaaagatcaagttgaccttcttcattatgatctttgcctctgttcactttgtactgtctcacctgcccaacttcaactccatttctggtgtatctctggcagcagcagttatgtccttgagttactctacaattgcctgggcagcttctgctcataagggtgttcaagagaatgtagaatatggttacaaagctaagagtacatcaggaacagtctttaacttctttagtgcccttggggatgttgcttttgcctatgctggacacaatgtggtgttggaaatccaagcaacaattccatctacaccagagaaaccatccaagggtcctatgtggagaggagtggttgttgcttacatagttgtggctttatgctacttcccagttgcccttattggttactggatgttcggcaatacagttgaagataacattctcatcagtttagagaaaccaaaatggcttattgcaatggctaatatgtttgttgtgatccatgttattggaagttatcagatttatgcaatgccagtgtttgacatgattgaaactgtgatggtgaagaaattgaactttaaacctagtatgacacttcgttttattgtacgcaatctgtatgtggcattcacaatgttcgttgctattaccttcccattcttcggtggtctcctaggattttttggaggatttgcttttgcaccaacaacatactttctcccctgcgtcatgtggcttgcgatctacaaaccaaggagattcagcatgtcttggtgggccaactggatctgcattgtgtttggcctattgttgatgattttatcaccaattggaggattgaggtcaatcataattagtgccaaggactacaagttctactcataa

SEQ ID NO: 72685 - DNA, 216 bp, Glycine max
  Peptide Sequence Number=SeqID_164370
atggcttcctcgaatggaaattttccagcatctatgcctgttctcgtagatgaaactaatctttcgatttcaagatgtgataaagtggtgcaagaaggggttaaagaacttgacaagaacccaactgatgcacaaaaagtggctcactgtgatttgatgaaaaaagatacaaagacattgtttattattcatcagtgtgtatgtagatgcagataa

SEQ ID NO: 72686 - DNA, 1412 bp, Glycine max
  Peptide Sequence Number=SeqID_164371
tggagtgtgagagagaaatgccaagtgtggctgtgaagctctacagcgtgttcttcaagttcctcttgaagcaccgtctgcagaaccgaatccaaaccacttccgaccactccgacccgttcggggtcactacccgacccgaagaatcggtggctccggcgaacccttctttctccgacggcgtcgccaccaaagacatccacatcgatctcttaacctctctctccatccgaatcttccttcccgaatccgctctcacccctcccgagcctcactccaaacctaggcccgatcccgagcctcgttccgcgcgcgccaaccccgtttcgcggcggaatagctatgggccgcctcttcgggaggagctccggagcaacagcttcggagggagatccggtgtggatggattgaacctgatgtcggacggggtgtaccggggctacgcgccggggaagcggggggagcagcggaggctgccggtgatgctgcagttccacggcggcgggtgggtgagcggcgggagcgattcggtggcgaacgacgcgttctgccggcggatcgcaaaggtgtgcgacgtggtagttgtggcggttgggtaccggctggcgccggagaaccggtacccggccgcgttcgaggacggcgtgaaggtgctgaattggctggcgaagcaggcgaatttggcggagtgtagcaagtcgatggggggtgggaagagtggagggcatggtgttggtggggagtttaagaaatcggattctcataagcatattgttgattcatttggggcttctatggttgagccttggttggctgctcatgctgatctttcaagttatggtttatgtttaaaagcttgggtaggacaagggatgcctgagttgggatttgcgagttgtggtgccaatattgcagactatgtggctcgaaaagctgtggaaggaggcaaacttctggaacctgtcaaggtggtagcacaggtcctgatgtatccatttttcattggaagtgttcccacacgttctgaaataaaattggcaaactcttacttttatgacaaggccatgtgtatgcttgcctggaaacttttcctacctgaggaggaattcagtttggaccatccagctgctaatccccttgtcccaggccggggtcctcctttaaagttgatgcctccaacattgacagttgtggccgaacatgactggatgagggatcgtgccattgcttactcagaggagctccggaaggtgaatgttgatgcacctgttcttgagtataaggatgcagtacatgaatttgcaacccttgatgtccttctgaaaagccctcaggcccaggtttgtgctgaggacattgctatatgggcaaagaaacatatttcacttcgaggtcatgaattctcatattga

SEQ ID NO: 72687 - DNA, 1134 bp, Glycine max
  Peptide Sequence Number=SeqID_164372
atgaaggttgtgtacttccttgttgccatcttggctttgacatcctctcttgtctctgcctctgaccctagtcctcttcaagatttttgtgtggcagccaaagaaaaagatggtgtatttgtgaacggaaaattttgcaaagaccctaagcttgtcaaacctgaagatttcttcctacatgtggaacccgggaacactgacaacccaaataatgcacaagttactcctgtgtctgttgatcaactaccgggactaaacacgcttggcatatctttggctcgcatagattttgcaccaaagggtataaaccctccccacactcaccctcgagccaccgaaatccttttagtccttgaaggaactctctatgttggatttgtcacttccaatcaagatggaaatcgtctctttaccaaagtgttgaacaagggtgatgtgtttgtgttcccaattggtctcattcatttccaactcaatgtgggatatggcaatgctgttgccattgctgctcttggcagtcaaaatgcaggaactatcactattgcaaatgctttgtttaaagccaatccacctatttctcctgaggatggatctatcgagaaggagccaccggataagaacgacgacaatactagacaaaaatatgtttcttttagggataagacaatggtgaatcggcctacaccacctgcaaagcctagggtggatttactaaaggaaaagttggataggattgactctgaggatgggaatcccttgaagtcgatggatgcctttgtcatcaagatggttgacattgggaatcaatacttcatggtgaagtttgatcgtgaagaggatcaactcaaggcaaagattgaaagaacacttgtgtggactcacttttctggactgaatttggtgttttatgacaagagtattttactagtaatggcaatgatgattggcaaaatgaaggttactatgaatactttggatgcgtgccagtataaaggtttgcctagggtttgtggtacttgtgaatgttatggacatcttacaagggagtgcaagcagttcccaatgcaaattgctaaagatggtgtaggtgattctccgtcacaacctataacggcttcttcatcgatggtttga

SEQ ID NO: 72688 - DNA, 99 bp, Glycine max
  Peptide Sequence Number=SeqID_164373
atgttagcttcaccgtctgggatgtgggaggacaggacaagattccaccattgtggagacactactttcagaatacaaaaggtcttatctttgtggtag

SEQ ID NO: 72689 - DNA, 255 bp, Glycine max
  Peptide Sequence Number=SeqID_164374
atgtccaatcaaaagagcacagagtcaaccatcaagaatctagaagtccaagtgggacaattggcaaagcaactagcagaccgaccgtcaagcagctttggagccaacacagagaagaatcctaaggaggagtgcaaggctgttatgactagaagcaaaatggtgagcatgaatgaaggtgagaagaggataggtgaagaaaaacaacaactggtgactgaaccaaaaattgacccagttggtgtctatgaatga

SEQ ID NO: 72690 - DNA, 387 bp, Glycine max
  Peptide Sequence Number=SeqID_164375
atggcacaaaaactttcaggcaaaaattcaaagtctaactatggaaactacctaaggaaacatatggaggatgagtgctctgaggccactatcccagagccatttactacagaggaggaggcagacgacacacagacgacacaggtagctgctgccactcctgagagatctcttgaggccattttagagccctcaacaccatcagtggatccatcttcaccccaacacgcaacaaacccttccactcctgtcttagagatacctgagggccagaccacaccagtcctgactctggatacttctcctccagctactccagtgcttcatctgacagacgaggaggatgtgcagacacaggacactcaagaccagtcacatgaattttga

SEQ ID NO: 72691 - DNA, 408 bp, Glycine max
  Peptide Sequence Number=SeqID_164376
atggtagaaccctcaaagaagagaaagggttcatcctccaccaccaccgctgtaggccaatgccgccacgacacatccggtgacccaccaacaccaccttctccttctttttcttctccagcgtcaaaggtgcatcaatctctattttattctttgacaaaactgagcagtcagggtgttccttttgagggcactctagttgatgattggaagcatgtctattctagtcatgatgcctgtaaaatggtctgtaatgactatgctgatatgacaggcagattgcttgctggctcatttacctttgaatgtcgcattatgcattatatcctttgtcgcattttgcttccatggtccacaaatcttgcccaggcctctgaggaggatttagtcttgctatgggctctttaa

SEQ ID NO: 72692 - DNA, 255 bp, Glycine max
  Peptide Sequence Number=SeqID_164377
atgggtgttaaacattttgaggtggtcaaacgaaggtcgcgtgccgacaaacaatggtccccatacgaaattaggatccttccgaaaaggaatgtgaagctgtacattacagaatttgatgaattcaggagagaaattgagaggaggaattggcacaaggagctcactaacttctctgaagggagcattaatgtggcattagtgaaggaattctatgccaacctttatgacattgaagatatatcaccaaagcag

SEQ ID NO: 72693 - DNA, 327 bp, Glycine max
  Peptide Sequence Number=SeqID_164378
atgggtaatcgattacagggtctaaaaattgaaacaggacattcagtagcctctggtaatcgattaccaatggtgtgtaatcgattacacagtgttatatgctactggttccaatgtgcaaaggctgttgaaattcgtttttgggcactgattgtgatgtcagtgcagttgatccatgattgcgttgtgatggagtgcctagagggtgtttgggagaccctcgaaggcaatgagaggtgtcgattccgtggcacaattcgactcactgctacttcactagtacatccggagcaacccgcacgcacacttcaacagcctgtggagtga

SEQ ID NO: 72694 - DNA, 324 bp, Glycine max
  Peptide Sequence Number=SeqID_164379
atggaagcgcagacacgaactccacaaacgcgaactggacaatgtggttgcagtcatggaagcgcagcccagtttgcgacaaacacgaactcaggcagaaggagaaacaacaataacgccctgggagtaccctttccgggactctttcctttcctacttttcttcgacctgcgaaatggcaaaggcgatctccacaaacacgatatccataatgtggttgcagtcacggaagcgcaggccagtttgacacaaagacgatctcaggcagaaggagaaagaagaagaacgatagggttcaagcgcgcgggttgtgcaatttcataa

SEQ ID NO: 72695 - DNA, 1067 bp, Glycine max
  Peptide Sequence Number=SeqID_164380
ggctacaagcgctcaccttcaaggactacacatcttcaccatcagagggatacacgctcttgccttcaaagggatggatgccctcgccttacgagggctatacgtccttaccttcagaggactacatgtcctcgccttcagagggctacaaggctacacgtcctcgccttcataggattgcacgtcctcgtcttaagagggctacatgccctcgcctagccttcagagggctacacgccctagacttcagaagaaaacacatcctcgcctttcgagggctacacaccctcgcattcagaggactacacgcgctcgcctttagaagactacatgtcctcttgcatgtcctcgccttcgtaggactagacgtcctcgccttcataggactacacgccctcaccatcagaggagcacacgtcctcgccttcagagggctacacgccctcgtcttcagaggactacacgtcctcgacttcagagggctgcatgccctcgccatcagagggctacatgtcctcgcctttagaaagctgcacgtccttgccatcagagggctatacaatctcgccttcagagggctgcacgcccgcacattcaaaggactacacgtcctccccttcagagggctacacgccctcgcttatagaggactacacgtccttcccgaaagagtagggctacacgtcctcgccttcagaggattgcacgtcctcgccttcagagggctacacgccctcgccttcagaggactatacatcctctccttccgagggctacacgcccttgccctcagaggagtgcacgtcctcaccttcagagggctagacttcctcgcctttagaggactgcacctcctcgcctttagaggactacacatccttgccttcagaggactacacgtccttaccttcagaggactacacgtcctcgccttcagagggctacaagccctcgccttcaggggactacatgtccacatcttcagagggctacacgccctcgccttcagaggattacacgtcttcgtcttcagagggctacatgatctcgccttcagaggactacac

SEQ ID NO: 72696 - DNA, 93 bp, Glycine max
  Peptide Sequence Number=SeqID_164381
atgggtgaagacgtcatttttccatttctggttaaggaaggtaaagagagtgagatgccaccaccatggaagttgcttgagctattcagatga

SEQ ID NO: 72697 - DNA, 270 bp, Glycine max
  Peptide Sequence Number=SeqID_164382
atgttggttcatcaaaatgaaaacagtgtagaggatgacaaggaaggtagaattggtgtcggggatgcaccggtggctccgggacgtggtgttctagttgccgcagcggaggtatatggtcaagaaggattccatagtcagatagttgttgcttcatccataatatctgtgcacaacaactgccggcagaaatatattccgcttctgcagtggatgaaacaacactattttgtttcttactatgccaagagactagagcagatccaatga

SEQ ID NO: 72698 - DNA, 153 bp, Glycine max
  Peptide Sequence Number=SeqID_164383
atggcagctcgtggtgaccactggtggtcgtgggtggtggaggaggagatctcgcttagcgagatcgtctcactaagcgggaatccacttttggcgctaagcgcgacaattcgcgctcagtgcaattctctctcaggtagaaattgcgcatag

SEQ ID NO: 72699 - DNA, 558 bp, Glycine max
  Peptide Sequence Number=SeqID_164384
atgacggaaccatcaaagaagcgaaaagggattgcgacttcatccacagtcactagaacacgaagccacaaaacatccaaggagcaaacatctcaaattcctccctcaatatcatctcctacgttgttttcctcgaaagaacaatgtatccggtacaattctcttttctcttctcgttccattatcgaccctaagttcgtagacttagctttctttgatgatgaagtgtttgattgctttcaagcatttcaaaattttggtttaattcagtttatctccatgaaacttcctttttaccctgaattggttaaagctttttattcaaacttggaaattcaagaagattccttgatttctaaagtgtataagattaagatgatcatagaccattcccttttcttggatctcactcaattatcaagtgacggtgtaccatctaagggttcacttgatgatgagtggaagtttgatttctctgtgtctgatgccccccggatggtttgcaccaaaccaagcagatatgatcggaaggcttcttgcctgttcattggcatttga

SEQ ID NO: 72700 - DNA, 303 bp, Glycine max
  Peptide Sequence Number=SeqID_164385
atgacacttccctttgccgttgcacccaatcgtctctgcccagcagagaagaattccgcaccactgaacgaccaacatcatcttgatactaccgaattcgttcctctcggtcgacgaaagaatgaccataatttgtctctgcgtgccaacgggctcgcttgcctctggttgacaaaaagctgtgcggatgaccataatttgtctccgcgtgccatcagactcgatcgtctctggatggcgaaaaggtgtgcggatgaccataatttgtctgcgcatgtcatcgggctcgccgcctctggatga

SEQ ID NO: 72701 - DNA, 153 bp, Glycine max
  Peptide Sequence Number=SeqID_164386
atgggtcgcttagcgggtttcacaaaaaacaacactaggcttagcgacacaggagtgtcgcttagcggaaattgctacggcttagcaaacaggaacgctcagctcagcaaatgccgcaaggattttcgcttggcgcaggagattctggcttag

SEQ ID NO: 72702 - DNA, 306 bp, Glycine max
  Peptide Sequence Number=SeqID_164387
atgccgcatgaggcccaacttccaaccaacataaggtgtgctttggtgaaggtgaaggggtcggtgttcattgttgcagtagttggttcgtcggcggcggcatacgagatagacgaagatcaatggatgtatgacactataatgtctgaagaagttgatatgaatgatcaaaatgaacaagaatgtggtgtgaatgaaccacatgttgattgttcgaatgcattcaatacttctcaggtgtttagcagccgagatgatgttttgcagtgggctcgatctgttgctcatgaaaacggatttgtggca

SEQ ID NO: 72703 - DNA, 462 bp, Glycine max
  Peptide Sequence Number=SeqID_164388
atggcattagcgcgtgacttttgtaaggaaacaacccatggggcattttggtttgtacatattttgtattcattcccgaaaaaggctagagtaattgccccacagtatgtcctaagcctaggaactaaaattgtatgcacaaagaacacaagaggagatgcatatcgggtattagaaattccaagatgtgcacatgtgcaatttttggtaccccaaaatgctttgagtatgcatgtatgtaaatttagccaaggagatgtgtgtgatgaaatggccccgaggaagcttgcctcaaagaggtccaggaaggacaaggcagccgaaggaactagttccgctccggagtatgacagtcaccgctttaggagcgctgtacaccagcagcgcttcgaggccatcaagggatggtcgtttctccgggagcggcacgtccaactaaagacgttaaagaagcgctactag

SEQ ID NO: 72704 - DNA, 705 bp, Glycine max
  Peptide Sequence Number=SeqID_164389
atgctgaaaatcgccgataccacttttacctcgcgcctgttcaccggcaccggcaagttcgccactccggcgttgatgctggaggcgctggcggcctccggctcacagctggtgaccatggccatgaagcgcgtcgatctgcgcggcggcaacgacgccattttggcgccgctgcagcagctgggcgtaaggctattgcccaacacctccggcgccaaaaccgccgccgaagcggtgttcgccgcccggctggcgcgcgaagcgctcggcacccactgggtgaagctggagatccatcccgatgtgaaatacctgctgccggatccgatagaaacgttgaaggcggcggaaacgctggtgaaagacggttttgtggtgctgccctactgcggcgccgatccggtgctgtgcaaacggctggaagaggtgggttgcgcggcggtgatgccgctcggcgcccctatcggctccaaccgcggccaaggtgccggtggtggtcgacgccggcatcggcgcgccgagccacgcgctggaagcgatggagctgggcgccgacgcggtgctggtgaataccgccatcgccgtggcgcgcgacccggtgcaaatggcacgggcgtttcgcctggcgctggaggccggccgagctggcgcgcagcgccggattgggtgcctgccagcacgctgcggccgcctccagcccgctga

SEQ ID NO: 72705 - DNA, 342 bp, Glycine max
  Peptide Sequence Number=SeqID_164390
atggctggtatactcttccttttgaaacaacaaaatagtttagaggttacgagtgtcattattttggggacgccacatattccgtggcatgatccgactcactgctacttcattggcacatccagaggaacccgcacgcacgcttcagcgaactatggagtggatactacctacacctactccatatcgactagtggagccagtccaagtgatagagagggtgatgaggacccactccctgatgtggattctctagaggatgtcatgtcagcatctgaggcagactctacggaggagagcggccctggagggacagcgactagtggagactcttcatcatag

SEQ ID NO: 72706 - DNA, 637 bp, Glycine max
  Peptide Sequence Number=SeqID_164391
cttatcgatccttctcgctaagccatttatgtccagtagtgttgtcgcactaagcgcatttggccgtgctaagcgcaatttggtttttgttgtggaattgggctcagtgagcctgctcgctaagccaattctgcagaaaaattttgatctgtgtcaatttgctaagcgggctaagcgcatctgtcgcgctaagcgcccaatggcttctaggaaaaggaaagccatagcttccaggccccagcctcactatgatacttacagactcacctatgaggacacctggaactgctgtgctgacaacattcttggccagaacatccttctggaaaggaacgcaaagctttttgtcacaaagtttgatgagttcaggatagagctagtcagaagaaactggcacaggacgctgaccaacctcatggaggggagcatagatgtggctctcgtgaaggaattttatgctaatcgttatgacccgaaggataagtttccaaagcaagttagggtcagaggacatttaatcaagtttgatgcggattccctcaacacttttttggagactccggttgttctagagccaggggagactcttcctgcttactccaggttctgcagactgagaccagaccctcaggagctg

SEQ ID NO: 72707 - DNA, 1302 bp, Glycine max
  Peptide Sequence Number=SeqID_164392
atgcggaagctggcccaccagacatcgctgccgggcagatgctgcagcggatcatggttgccggccgggctgccgaacaggcgcacgccctgcatgcccgcacgcggctggccgcgccacaggaaggtgaccagggagtgcccctcggacaggggctcgaccatgggtgttccttcctcctgcacgcgccgccagaaggcgtcggcagccacaccagcacccgcgccgcgctggattgcctgcgccagagcccgcagccgcgggctttgcagtgccggaggctcggaggtggccgaggccttgttgccggcaggcgccaggctggaggtcagccgcagcgcgaagcgccccgcttcttgcgcctcaccgccggaacgggggtcagccagggccacacgcctggccaccagccgctgccgtccggctccctccgtgacccacatcagcgactgcgcgccgccatcggcccgcgccaggcggcgcaggtgccggccctggacatcctccaggtccagggccacgccctgcccctcgaattcaccctggaccacatggccggcaggcagatcgacgcgccagaactcgcgcccaccggcagccaggacccctgtggccgcctggcccggcgccagcgtgcccggccgtgcggccagggcctgccgcgatgcggctgccgtcatgtcttcggcggcatggacggctgcgcccagcaggcacagcagcgaggcggccacgcacaggccttgtcgtgcagcttgcgccatggcgtcagaagtccaccgtggccgagacacgcaccgtgcgcgggccgcccgtggtggcgaagttgtcgttgaaactgccggcccagtaggacttgtcgaacaggttctccaccgtggcgcggaaggtgacgggtttggccgcgatgcgggtggcatagcgcgcgcccacgtccacgcgggtccagctgggcatcttcagcgtgttggccgaattcacccattgcgcgcccgtgtagatcaggcggccggtgagcgtggcgcccggcagcgcgggcacatcccactcgccgcccaggttggccgtccagcgcggcacgccgtagacgccgtagccgtcgcgcgcgccgccctgggtcttgctctggatggcctgcgtataggccaggccgcccagcacgcgcgtgccgcgcagcggctcgccgaacacattccactccagccccggttgcgctgctcgccatccatcagcaggcggttggtcgcggtctcaccacggacgaaggccgctcgatctgggacagcgagaccgtctgcgtga

SEQ ID NO: 72708 - DNA, 549 bp, Glycine max
  Peptide Sequence Number=SeqID_164393
atggtttctacatggccatcaaaggtctatttatatgtgacttggaacatgaatttgctcagaatttttcagaacaaaaaggttttatcctctcaaaaagcaaaatcttcttatcctcttaagattccttgggcaatacacttgcaattcaataagcaattatttgagtgctcaaattgttcaatctatctttttcaagagagatttcttcttctcttcactctaattctcaaaaagggattaagagaccgagggtctcttgttgtaaagaaatatgaacacaaaggaagggttgtccttgtgtggttcagaacttgtaaagggattttacaagatagtggaactctcaaacaggttgcttgtggactggacgtaggcacaagggagaattataagcaattgggcttgaatccggaattgggctttgatgcaatcctccctaggaagggaccaatcactagaaccatgagcaagaggctccaagaagattgggctagagctgctgaagaaggccctagggttctcatgaaccttagggtagatttctga

SEQ ID NO: 72709 - DNA, 351 bp, Glycine max
  Peptide Sequence Number=SeqID_164394
atgggtgaagtagaggaggtgcaagagcagatgaaggccaacatggaggccatgaaagagcaaatggccacaatgatggaggccatgaggagcatgaagaggataatggaagccaatgcggttgcagttgctgctactagcgctgttgctaagcgtacactcccagtgaggatgacaataactccgctcccatactcattgagagtcgacaacctcgtcatgtacatgtctctcaatccatgggggaggcacatgaaaattctccaccacaatctagtcgacttcgagcattgcctcggatatgccactgaagggcaagcagttggtggtatacccctgcaaaacacttag

SEQ ID NO: 72710 - DNA, 198 bp, Glycine max
  Peptide Sequence Number=SeqID_164395
atgagggaaaatgaaaatgaaattgtgacgttagcatcacctgttggaacaatagtttatggcaaactgaaaaaattattggctgagtcacggacaatgtcgctttctttaagacgtttcgtggcactgtcaaaaattgtgcaagcagactatcaaccacgacgtccccaggataaaacagctcagatcactgtataa

SEQ ID NO: 72711 - DNA, 3975 bp, Glycine max
  Peptide Sequence Number=SeqID_164396
atgtcgcctgaagtatttattagtgcaggcgttccatgctgcaggttagtacaaaatgccggggaatttgttgtgacatttccaagagcctatcacacagggtttagtcatggttttaattgcggagaggctgcgaacattgcaacacctgagtggctgaggtttgctaaagatgctgctattcggagggcttcactaaattatcctcccatggtttcacatttccagttactttatgaccttgccttagctttgtgttctagaattcctgcgggcatcagtgctgaacctcgtagttctcgtcttaaagataagaagaagggtgaaggagaaactgtaattaaagaactatttgtccaggatgtcctacagaacaatgatctgcttcattttcttgggcaaggatcagctgtagtacttcttcctcgtagctctgttgacatttctgtttgctcaaaattacgtgttggatcccagcaatctattaatgtaagcaattctgagggaatgcattcttcaaaaggttttgtttctgatgatctggcattcaacaggagtcatggaatcaagcaaggaaaaagtttctattctgtgaaagacaagtttagtacgttgtgtgaaagggacaggatttcctcttttgatgtaaatgataacataagcatttcaagttctaatccacttcaaagagacactgaaagagaaacttgtcaaggagatgggttgtcagatcagagactgttttcatgtgtcacatgtggaatattaagcttttcctgtgttgctattgtacagcctagagaaccagcagctagatatcttgtgtcagctgattgcagtttctttaatgattcggttgttggttctggaatatctaaaaataaatttactattgcccgtgaagaagcaattattcctgagccaaatatttatacaggcagaaagatatcaataacttttttgaagaggcagatcttatcaataatgagtccgcatcctaggtatcttccatgcctatgtcttatgctcattaggaaacatgtctatttatttggatggatgaaaaagaatgtccaagatggtatacatgatgttccttttcaatcttctcaggttgctttaaatatggtaagtgaaaatggcaatacagctcttgcattattggcttcagcatatggaaattcttctgactctgaggaagatcagattgcggttgacagtcatgaatcaaatgtgataaactctgcttcagaaagtttactttcttacactcgagattcccatgctagtcccatgactgcacttgataggggagattatattccttcaaagagttccagctatgaggattttatacatcgtagattagagtgttttgaaaacacaaggacggtggctaattccacctctaattgttcccaagatgctcataatgctgaaaggtcattgtctaacaatgctatgatggttccctttgataataaaaaagcttcgatggtgctacaatctgatgaagactcatccagaatgcatgttttttgtcttgagcatgctgcagaagcagagcagcaacttcgcccaattggtggagccaacctattgctcctatgtcatccagactatcccaagatagaggctgaggcaaaaatggtggcagaagatttgggtattgattacatgtggaagaatattgaatacagtcatgcttccaaggaggatgaggagaagatccagtcagctctggatagtgaggaagctattcctgggaatggtgactgggctgtaaagctaggaatcaatctcttttatagcgcaaatcttagccgttctcctctttatagtaagcagatgccttacaattctgttatatactctgcatttggttgtagctctccagcaagctcacctgtagagccaaaggtctaccaaagaagggtcaacaggcagaaaaagattgttgctgggaaatggtgtggtaaagtttggatgtccaatcaggtccatccccttttagcgaaaagagattttgaagatattgaggatgagaaactcttaatagggttgatattacctgatgataaaattgaaagatcagaaagtacacccaaaagcgaagctactagcagaaaatcaggtaagaaaaggaaaaagacagcagagaatggacggttcaggaaaggaagttatgctaacaaaaatctactttcagataattccactgaagataaacccaacttgcttccaaggagcattcttcgaagtaagaaagtcaggcatgttgagagagactgtgctgctttgaaagggggttattctcctccatatcatcatagaaaaccttcaaacaaccaaacaaacttcactgaaagttatgcagtttctgatgattcgcttgatgatgatgatcacatgcagcaaaggaggaatgttaaaattgaaaaggctaaatttatggacaatgatgtggtttcaaatgatacgatggacaatgattctgattggcagcagagggaagacgttagcagcaagcaagttgaagatacggagggagatgcaatttcagaggattctttggatgttggttctcttcagctgcaaaggaagacttccaaaggcaagcatccaaaatacattggtgaagaagatataatttctgatgaccaaatggagagtcattttcaaaagaggcaaaagagaattcctgaaagcaggcagggcaaataccttactggaaaagatataatatctgatgaccaactagagctgaaaatgaagaagcagcaacggaggaatcctaaaagcaggcaagccaaatacctcaatgaagaggatattgcatcagatgaccaattggagggccattatcgtagatatcaaagaaagaatcctaaaggcagacaggccacatgtgtagcaggggaagatcaaatgtctgatgaccaattggagaatcattgtcagaagcagcaaacaagtttctataggaaaaggcaaaacaaaggcattgaaagagaggttaaaaatgaaatgtctgatgaccacttggaggaccattttctgaagcagcagcaaagatttcctaagagcaggcgaaacaaacacactgataaagaagacacggatgacttagctgagaataattctcatctgctgcgtagaactcctaaaaggaagcaagctaaatgcatggaagacgatgatatgaattcagatgatgaaatggaagatgatcagcagctgaggaggactctccgaagtaaacaagctaaaccaaagacacttcaacagatgaaacaagctaattccctccaagcgaaaaagcaggcatctcggcccataaaacagtgctctcggatgcttgtgaaatcaaaggctcctcagcaaattaaacagccttctcatttgccgaataagcaatctaataacacccaggaatttagtttagatatggaagaggaggaagaaggtggacctagcacacgccttaggaagagagccacaaaagctcaggaatctgaaagaaaattgaaagacaagcaaacaaaaaggaagaaggtgaagaatgctgcagctgcaaaggtttcagttggccatgccaaaatgaaggatggggaagccgaatatcagtgtgatattgatgggtgcactatgagttttgggtcaaaacaggagctgatgcatcataagagaaacatctgccctgtaaaagggtgtgggaagaagtttttttcacacaagtatctggtgcagcatcgtcgagttcatgaggatgagcgccccttgaagtgcccttggaagggatgcaagatgactttcaagtgggcatgggctcgtacagagcacattcgagtccacactggtgcacgaccttatgtatgtgctgagccagattgtggacaaacattcagatttgtttctgatttcagtcgtcataagcgaaagactggtcattcagcaaagaagaattgtcaatag

SEQ ID NO: 72712 - DNA, 318 bp, Glycine max
  Peptide Sequence Number=SeqID_164397
atggccaacaatgtcaactgtggaatacagggaagcaacagatttctcatgcattgtgttaaggcattgcatttgattgacaacaaggaaagcatgattcaaggatcacattggctaggggtttcaaaaccaccacatggacacagaatccaagctgctaacagcagaaaaggaaggcttgtgctgaatttgaatgttttggaggcaatgaagatgccgaacatggttgaaatggtgactttaatggagggagggaggtctgagatgagtgtgcatttcaactggaatcaggatcagtttggttctattcagttttga

SEQ ID NO: 72713 - DNA, 465 bp, Glycine max
  Peptide Sequence Number=SeqID_164398
atgtatgattgcatgattatgattagaactagagggttaggttgtaccttagatagagttataggtagagccctggggagagaggatcatcatgatgcagatgatgtttcccagcgacgaaggcctacaatatccgcacgtaggcaaagacaagctgcccctattgctgaggatgatcctgtggtgacagaagacgtacatgcacatgctgaagaagctgttgatgatgctgagggattttcaggtgggccgtgtgacccatcagtgctggctgactatggtgaccatgttgcagtcatcgtatggaatggagagttatcctcccatgaaaggaaggttcaaaaatttgggaggcctactccaaaaattgaagggctagtcgctgccacaagattaagtcctttgatcgcatgttcagtagacactggtgatcgaggacttatatccgctttcttggagaggtga

SEQ ID NO: 72714 - DNA, 372 bp, Glycine max
  Peptide Sequence Number=SeqID_164399
atgcagtggttctttatgatttctcatctgttcatgacaccggcacaatctgctgatccggccaaatatccacctatgacgcaggatgacacatttgtggagtcacatatccttgaggtcctagtggcaccagcagcagcaccggcacatgccccttctaatgtggagcagcctaaacatgcaatgataaataatgaggcttgtcaagcaatcgcagaaaggttggagcgtttgttcaacctaaggatagtcactgcaagcacaaaaatacatgaggtcatggaagaatgcctaaggatcactagggatgtcacaccagatgataatgtttatgttagttcgcgacgaaggcagcgcacagatcagccatag

SEQ ID NO: 72715 - DNA, 2928 bp, Glycine max
  Peptide Sequence Number=SeqID_164400
atgacccagtttgttgttctactgataacccagtccctgttgagggagaatcttgatacatggaacattttagctagagctagggatgagggacgccttttttctaagatagtatggcctaatgatcctgaaattaaagagcttgtaaagaggttgcatcttcttcttactgtaaaggactctgctgctaatgttccaaaaaatcttgaagccaggagaagattagagtttttctcaaattcattatttatggatatgccttcagcaaagcctgttagtgaaatgttgccattcagtgttttcactccatactatagtgaaactgtgctttatagtacttccgaattgcaaaaagagaacgaagatggcatatctattcttttctatcttcaaaagatatttccagatgaatgggaaaactttcttgaaagaattggtcgaggagcatccactggggacgcagaacttcaagaaagttccagtgactctttggagcttcgattttgggcttcttatcgagggcagactcttgcgaggacaggtaacaagttcttagcagctttctggagagcagatcactgggaggtagttgcatatgaacattttgcattgcagtttgtgattctgattttcattctaatgaagtttgacatggatatttgctggcaatctgttgtgtcaatagtggacaattattctcaaaacaacttcattacaagtcaagattttgaatcatctcgtgaagcacgggcacaggcagatttgaagtttacttatgttgtatcgtgccaaatttatggtcaacaaaagcagcggaaggcaccagaagctgctgatattgctttattgttgcagagcctcaagggtggtgatttagcctcatattgtggtggagggatttgggtagaattcattgggaatgaggcgctccgggttgctttcattcatgttgatgaaagtacaactgatgtaaatacttcaaaagtgttttattcaaagcttgtcaaagctgatataaatggaaaagatcaggaaatatattctattaaacttcctggagatcctaagcttggggaaggaaagcctgaaaaccaaaaccatgccatcatcttcactcgtggtgaagctgttcaaactattgacatgaatcaggacaattatcttgaagaagcaatgaaaatgaggaatcttctggaggagttccatgcgaatcatggccttcgccctccaagcattcttggagtgagggaacatgtttttacaggaagtgtctcttccttggcttggtttatgtcaaatcaagaaactagctttgtaaccttggcccaacgagttttagcaaatcctctcaaaatcgcaccagtgtcgctggtgttaaccggagttgcatcaatattggtggaagccatggaaatggatcagagtgctctggataccatattcattgttgggccacctgcatttgccacgcttaaggttggaagttttgggcatgaggaggagtgttggaaagctgccttacttgcagcctccattgttgggttcaccgagcctgccttagttgcagcctctttgggggttggaaaaggaagggatgttgggttaaaccagattgccctctttgaggggaaagtggcaggtggtaatggagagcaagtgcttagcagggatatttacaggcttggacaactttttgatttcttcagaatgctttctttcttcttcacaactgttggttattatgtctgcaccatggctttttctggtcttgatgaagatgtctcgaagaatgcaaaattgcagggtaacacagcacttgatgcagctttaaatgctcaatttttggtccagattggtgttttcactgcagtaccaatgataatgggttttatacttgaattaggattgctgaaggctgttttcagtttcatcacaatgcaactacaattgtgttctgtcttcttcactttctcattgggaactagaactcattattttgggcgtaccattctccatgggggtgcaaaatatcgtgctactggtagaggctttgttgttcgtcacataaagtttgctgaaaattacagactatattctaggagccactttgtcaaagcgcttgaggtggcattgcttcttatagtttatatcgcatatgggtatgcagagggaggtgctgttacgtatgttttgctaactcttagcagttggttccttgtcatttcttggcttttcgctccttacattttcaacccctctggtttcgagtggcaaaagactgtggaagattttgatgattggacaagttggcttctttacaaaggaggagtaggagtaaaaggagataatagttgggagtcttggtgggacgaagaacagacaattttgagtgcaaggttcttcttgtttcaatatggtgttgtgtataagctgcatcttaccggaaacaatacatcacttgcgatagtttggagtctcggcatgtgggattctgttcgtgagtttgctagaatgtacgatgctggaatgggtatgatcatttttgcaccaatagcatttttatcgtggtttccattcatttcgactttccaatctcgccttctcttcaatcaagccttcagccgtggtcttgaaatctctatcatccttgctggaaataaagctaacgttgagagtgccgctttggtggaggtgaaagtgttatgggtcagtggtgattgttgcggtggttggttcgtcgtcgaaggtgaatgtgttaataatgcggtatgggctttagaacagtttcgaggtttatttctaagacgtgatgcccttcctggagttattgtgactgacagagacctagcattgatgaatgccgtgaaaactgtattccctaagtgtacaaacttattgtgcaagtttcacatcaacaagaatgtcaac

SEQ ID NO: 72716 - DNA, 270 bp, Glycine max
  Peptide Sequence Number=SeqID_164401
atgaaagctctggtccagacgaggtcatttttactcaaagaccaaaaacctaaaggagagagaagaggaaggcacaagatcacacgagagttcgacgagacgactggtggcaatcaggcgcgattctggcctcgggaaggcggcgcgtggcggtcacgcgccggtgtttggcaagcactggagcggcacgtggctgcccttctggtcaagcgatcagttaggctgggttgcgctcttcgaggcgcacagaaccctgtagtcgtcggttga

SEQ ID NO: 72717 - DNA, 345 bp, Glycine max
  Peptide Sequence Number=SeqID_164402
atggctaaagagttggatgctattttggatcatggagaagctgcacctgcagtcagctgcataactgatgatggttctgcaaaattccttgagaaaataatttgccctatttatcaaacgctagatgcaaaatacaatatttcagttaaatattcattccctcaaatatctatcagttccattgaatctctcttctttccagtgttgtcaatagtggatcatgttcttagtattcagatttcagagcttaacatggaggaactagtgacttgggagacgatatatgcacaggagacacttggggctggggattcaaaaagaaatagaacactgggcagcgattga

SEQ ID NO: 72718 - DNA, 1740 bp, Glycine max
  Peptide Sequence Number=SeqID_164403
atgggttctgatctttatatccctcctgcttttagtagtactgtgtcagacttggttaataagaaaattgctctcaatgattcaagtgagcggcaatggaatgtaaaagtatcagggtttaatggttcttttgctttcatggaaggatggagtactttttcattgaatcatggggttaaagttggatatcttctggtattcaattacgttaaggatttgcactttgatgtcaagatctatgatccatctgcttgtgaaaagcttaattttcctaaaacaagaaatcagaagaaaagaagtagggggagaagtggctctccagttagagattgtatgttggttggtcaagaatccaatgccttagttgtcacccaacattatgtgccgaaaatgaaaagccagcgcagtgaggttgacttagtagtacgaaaaaatggtgaagagagtggccaacttatgtgcatatcagaactccatgaagacccatgttattcgacaagcctagaatttgaccagagccatggtgttaatgggaccatgaaaattgtgaatggagatttaaaagtttctaatgttgattacggatctcacatatttgaaaatgatgcaatcgtatgtagtaaagatactatgtttgaagggatattcagtatggcagctgccttagatatatctgaatttgaaatgtctgggagaagtacttctctaggtgaggcagacaaaagcacacatgacaagacttcaactttgaatattgaagaaaacaaagagagcaaagccatcatgtacagcggggaagctcaagagtgccaattttccaatgtcttagaaagtgatcaggctgcaatatccaaaaaggaacctgctttgcatattgatggttcttgcaataccaaaaacaagttcaatgagatctcaaatcacttagatacttatatccacaatggtgaaatgaagaaattgcctgtggacaagactcccaaactgtacagttccgtggataaattgaatgtaacagggttgccaaaggagactaagggaaagttggatcactattctgacccatttaatcaagataatgagagtcactttaaaactgcacctcctctcatgtccaacggggaagctcaagagtgccaattttctgagggcttagaaagtgatcaagcagcaatatccaaaaaagaacctgctttgcatatttgtggttttagtgacaccaaacagaacttcgatggaatctcaaatgacttagatggtcatatttacaatggtgaaatgaagaaattgcctatggacatgactcccaaattgtgtggttccatggataaattgaatataacagagttgccaaaggagattaaggactctgacatatctaatcaagatgatgagagccactttaaaactgcaccccctctctcctgtgtggtgaccaatgataatgataatgtttcccttaaattgcccgaatacctgcctttgactcgcagggtaaaaccattcacgcataagaagatggtagtgttacttcgggattcacagatgagattgtggcctgtcttttaccatgaacaacctcggttactgacacatggatggttagattttagcagagctaataacattcaacctgaagatgagtgtatttttgaggttgagcctgaccctgagagcaggtatcaacgtatcttagcttacatcctaggctcctataccacaatgacttcgcggcaatga

SEQ ID NO: 72719 - DNA, 249 bp, Glycine max
  Peptide Sequence Number=SeqID_164404
atgtctgtacaggtcagaacagggctgcgcaacctctgcagatatgagtttgctgaaaatggccagaaaaaatgcaatgccgcattgttgctggagaaaggacataatcaccctgggattttgaatactgtccaacgcctgctctcagtatggtctaagaaagaatttgtgcaaacagcacctattgagcaacaagtttgtatcctttttaattgtactaatgtactgagtgaaaagcatgtggaatag

SEQ ID NO: 72720 - DNA, 3126 bp, Glycine max
  Peptide Sequence Number=SeqID_164405
atggcggcggcagcggtggcggaggtgaggaaggccccacggccgggcaagggcgggtacgaagcgcacggcctgagcgaggaggaggcgcgagtgcgcgccatcgcggagatcgtcagctccatggtggacctctctcacaaaggccagaacgtggacctcaacgcgctcaagtccgcggcgtgccgcaagtacgggctctcacgcgcgcccaagctcgtggagatgatcgcggcgctccccgacgccgagcgcgagacgctcctccccaagctccgcgccaagcccgtccgcaccgcctccggaatcgccgtcgtcgcggtcatgtcgaagccgcaccggtgcccgcacatcgccaccaccggcaacatctgcgtctactgccccgggggacctgactccgatttcgagtacagtactcagtcttacactggttacgaaccaaccagcatgcgcgcaattcgtgcgaggatagatcagcttaagcgtttgggtcatagtgtagacaaggttgagtttatcttaatgggaggtaccttcatgtcacttccggctgattaccgtgattactttataagaaatcttcatgatgctttgtctggacacacatctgctaatgtggaagaggctgtggcatactctgagcatggggcaaccaagtgtattggtatgacgattgaaacgaggccagattattgtcttgggcctcacttgcgccaaatgctttcttatggttgtacacgattggagattggagtccaaagcacctatgaggacgttgctcgagacacaaatagaggacacactgttgctgctgtagcggattgtttttgcctggctaaagatgctggtttcaaggttgttgctcacatgatgcctgaccttcctaatgttggtgttgaaagggacatggaaagtttccgggagttttttgagagccccatgtttagagcagatgggcttaaaatatatcctacacttgtaattcgtggaactgggctttatgagctctggaaaactggcaggtatagaaactatccacctgagcaacttgtggacattatagcaaggatccttgcaatggtacccccatggacacgtgtttatagagttcagcgggatattcccatgcctctggttacctctggggttgagaaaggaaatctgagggagctagcattagctcgaatggatgacctgggattgaaatgtcgtgatgttcggaccagagaagctggaatccaggatattcaccaccaaattaagccagaagaggtggagcttgttcggcgtgattatatggcaaatgagggttgggaaacatttctatcatatgaagatacacggcagttcataactggccttgttccttctttaattgcaaatcaagagggatgtgtctcaaacacagcaatgaccttgtgtgaactctctgcttgtaaacaggatatccttgttggtttgttgcgactgcgaaaatgtggccgcaacactacttgtccagagcttatggggaagtgttctattgttcgtgaactccacgtttatggaactgctgtaccagttcatggacgggatgctgacaagctacaacaccagggttatggcacacttttaatggaggaggcagaacgtattgcttgcagagaacacagatcaacaaaaatagctgtaatttcaggggttggcacacgccattattacaggaaactgggatatgagcttgaaggaccttacatggcaatcaccaacaccttcttcacaagcagcacgacacatgttcgacacaatgcccctctcaaccccaccaccccaccacccccttcttcagcctacattcacctccctttctgccgcaaacgctgccactactgcgacttccccatcgtcgcccttggctccgcctcgacccaaaccaacgacgaccctcgtgtctccaactacatccactggctctgccgggaaatcagtgccaccaatgtggaccaacctgctgatgccagcaccatcacaccccttaaaacggtctactttggaggcgggacaccctcgctggtgcctcctaggatggttgcctcggttttggacactctgaggttgaagtttgggcttcgtgaggacgccgaaatatcgatggaaatggacccgggcacgtttgatgctgagaagatgcgagagatggtggtgctgggagtgaatagagtgtccttgggagttcaggcgtttcaggaggagctgttgagagcttgtgggagggcacatgggctgaaagaggttcatgaggctattgatgttgtcaagttgtgtggagttgagaattggagtattgatcttatatcttcattgcctcatcagacgagtgagatgtgggaggaaagtctaaggctcgccatcgagtcacaaccaactcatgtctcggtttatgacttgcaaattgagcaaggcacgaaatttggacgattgtactccccaggggaattcccaatgccttctgaaacacaatcagctgagttctataagatggcttcaagaatgctttctgatgcaaattacaaccattatgaaatcagcagctactgcaagagtggatatgagtgcaaacacaactttatctattggaagaacaagcctttctatggctttggccttggctctactagctttgttggtgggttgaggttttcaagaccaagaaaggtgaacgattacattaattttgtgcagaatctagaaaatggattagtaaatagctctgttaaaggccacattagtggcaaggacacaatcatggatgtggtgatgctgtccctaagaactgcacaaggcatagacttaaagagtttccaagaatcgtttggcagctctgttgttttgtctttgcttgaggcttataaaccttatgttgagagtggacttgtggtttgcttggacgagcataggagaaccattagaatagatgaccttaattcttctttgagcaaaactaatgcagagggaagggtggcttatataaggctaagtgatccagaaggtttccttttatcaaatgagttgatagcccttgcttttggggttattgactcttggaaggatatgcctccgtacaaggaagcagaagctacttga

SEQ ID NO: 72721 - DNA, 2295 bp, Glycine max
  Peptide Sequence Number=SeqID_164406
atggctagcagtgttgctttggcattgtctaaaactattgatccaaagaatcctctgtaccttgaggatagctgcagcggggagacaattgattgggaatttggattcactatccccaagaaagggaatctggctgcctcaaattgtggaggaaaaagtgttgaggggacaaaaatatctactgtgtcaggtccagagagggactttgattccccttccaataaagagaaaagtattaatgtaaagggcagaaagaagttattggactttaatgggcttgatccagatgagattattgatctagcatcactgaatcttgaatcagacgataatcatgaggatgttgatgacagtgcaagtgagaattcatattcttcaaatgattcatctttacagccgtatgatttgtcagatgatgactcagatttgaaaagaaaaatttcacagttggctgatgtagttgcagctcttagaaaatccgatgatgccgatggggtggaaagggctattgatgtagctgaaaagctcataagagcatccccagacgaactaaaacatgcagcaagggatctgaccagaactcttgttcaggttcgttgctctgatatagctttagaaggtgcagaagaatcaactgaagacaaaagacaaagatcattagttgccttagcagtcacctgcccatttgaatcacttgagacactaaacaagcttctgtattcacctaatgtagatatcagtcagcgcattatgatactagatgtcatgactgaagcagctcaggagcttgctgaatcaaaaattatgaaacccaaacatcagattagttcccttatttcagttgtttcagatacccgaccttggttcctacctagcagcacagggactcctggagctggttcctggaaagagatctcaggtactggctcttttttgaattggtcaaatagctatgagagggaacttcccacaaaacccaatcagatcaagaaagggaaaacacgccagtggagcctacaatctcccgcacaacaaaaccagatggagtattctcataataagtttcccatgtatgctgctgcattcatgcttcctgccatggagggatatgataaaaaaaggcatggtgtggacttgcttggcagggattttattgtcttggggaaactcatttatatgcttggggtctgtatgaaatctgtagccatgcatccagaagcttctgtactggctccttccctcctgaatatgttaagatccagagaggtatgccatcaccgggaagcatatgtgagaagagccgtcctttttgcagctgcatgtgtattggttgcccttcatcctacttacatttcatctgccttactcgaaggaaatgttgaaatttcaactggccttgaatggattcgcacatgggcacttgatgtagccgagtcggacacagataaagaatgctatacgatggctatgacatgtatacagctccatgttgagatggctcttcaaacttcccgagcattggagtcagtaagaaattcactcaaggcagacccgtcattgtacttctcagttgtttctgtgaagcaagaaagaaaaatcaacttaggatggagaaacaagaaaacaaaggttttaaaagatgtgatggaaagtgatttttggagcaatgttccccagcgattgcgaacaaagaggaagagtaaattcaatggcaaggaagcactttctacacccaaggtagtgctttctaaatcgaaggaaacaatttctagatccaataaagcactttctacactcaaggaagctctttctagacccaataaagcactttctacacctaaggaagtgctttctacactgaaggaagcactttctagacccaaagaaaagctaaacagtggagattttgatatttacttgaaggccgctccatctaaagacaaggtgcttacttggattaaaaaggaacctattttctccaagtcatatgtttttgttcctatagtctgctggggtcattggagccttttgatcctgtgccattttggtgaaagcttggaatcaaccaccaaatcacgatgcatgttgttgctggattctcttgaaatgaccaatcctagacggctcgaacccgagattagaagatttgtattagatatttataaaacagaggacagacctgaggctaagcatcttgtatctcaaattccttttttggtgcccaagcatgcacctgataattttagcatggagggatatccttactttgtaagttatctcatttgctgttcttga

SEQ ID NO: 72722 - DNA, 618 bp, Glycine max
  Peptide Sequence Number=SeqID_164407
atggctgctgcaactgccccaagattcatcaagtgtgtgaccgttggcgatggagctgtagggaagacctgcatgctcatttgctataccagcaacaaattccccacgaaagtaacccagttgttatcttgtgaagcttcaccattgggtttatctgattttgcttccccctatgttgatcatcaggactatatccccactgtgtttgataatttcagtgcaaatgtggttgttgaaggcataactgtcaatttaggcctttgggatacagctgggcaagaggattacaacaggctgaggcccttgagctacaggggggcagatgtctttgtcttggctttttctttagttagtcgcgcaagctatgagaatgtgctgaagaagtggatccctgaactccagcattttgcccctggcatcccattggtattagttggcacaaaattggatctgcgcgaagacaggcactatatggctgatcatcctggcttggtgcccgtgactactgagcaaggtgaggaactccgtaaacatattggagctacctactatattgagtgcagctcaaaaactcagcagaaactagctttcctctccacttatgatgcatcatactga

SEQ ID NO: 72723 - DNA, 717 bp, Glycine max
  Peptide Sequence Number=SeqID_164408
atgtcatggggcatacgtacacctattgtggctacgatatatttatcagaacgctttccgagacttgggtcagagtggaagctacgcatagggagctgctgtcctaattgttggatatatgagcatttttcctctattgttgagtctttgacggatccagactatgatgaaatgtcaccatatgcctgccggtggatttctacgaaggccttttcaaagtcattaccagcatcgatgtaccgaaaacgtctagatggactcacgattgttgatgtttactggatgccttatgatgaccaccgtatagtgtgggattttgatctgatttcatgcttttcatgtcatatccgatggggtcccgttgtcgctaaacaccgactagagagggtggtggggcaatttggatatgttcaaaccattcctccacagactacgggttcaatgttatcatttgaagatattgacgacaagtggatgcatttctctgactatcttgcaccaatgggacaaatttgtgttgtgctaagacaatgtgcatctgattacatgcactggttcttcatgatttctcatccattcatgacaccgacacagcttgctgatctggtcagacatccatctgtgacgcaggatgacacatatgtggagccacatatccctgaggtcctagtggcaccagcaacaacacctgcacatgccctttctgatgtggagtag

SEQ ID NO: 72724 - DNA, 333 bp, Glycine max
  Peptide Sequence Number=SeqID_164409
atgtatgtgtgtgaaaatttgcagattatggttagaactagagggttaggtcgtgccttaggcagggtaatagatagagccctggggagagaggatcattgtcattcagatgatgtttcccaacgacgaaggcctacaacatctgcacataggcaacgagaagctgcctctgttgctaaggatgctcctgatgtggctgacgtgactgaagacgtattccgacatgccaaagaagttgttgatgatgctaaggggtttcttgatgggtcgtgtgacccattagtgatgactgcctatggtgaccatgttgcagtcatcgtatggaatgaagag

SEQ ID NO: 72725 - DNA, 1065 bp, Glycine max
  Peptide Sequence Number=SeqID_164410
atgttggaatgctatgatccatcagagtcccagattgttgttatagtgtgctacataagggcattaatagatgctacatcctctgacagcagtcttgaggaagagtcaggggttagaatggtggctttatttgatcacgaggaagttggatctaactctgcacaaggagctggctctcctgttatgctaaatgctgtgacaaggcttctggagaaagcagtacaattaagctaccttgtatctgccgatatggcacatgcactacacccaaattacatggaaaagcatgaagcaaaccatcagcccaaactacatggaggacttgtcattaaaaccaacgctaaccaacgctatgcaaccaatgttgtcacatccttcatattcagggagatagcatcaaaacataaacttcccgttcaggactttgtggtgcgcaatgacatgggttgtggttcaaccattggtcctattcttgctagtggcataggtattcgcactgttgatgtaggtgcaccgcagttgtcaatgcatagcatacgagaaatttgtgctgttgatgatgtgaagcattcatatgagcatttcaaggcattttacgaagaattttctcatgtcgatgaactcttggaaagtatgcaagccgggacattggagccagaagttgcattcctcaatgctttacttattccagatattttccctgttctagcagctgcacacaaaacacttgtagccaagtctcgagactctttgaccacacgcactcttcattcagagcttgtttacaactactcagggtctaagcatattactgaatctttgaaaagatgcggcatctctgacagcacaacttgtatccttgctgctcgatttgatgctagtcctgatgagataaaagctatagggaagctcattaacggcaaagagattgacctggaggagctagaagggagagcaaaccaatcccagatacaaaagatttacaagatatcttcctcggaacttggagtatcatcacttgctgatgcaataacttgtcgtatagctgctcgtgatgccctgtga

SEQ ID NO: 72726 - DNA, 366 bp, Glycine max
  Peptide Sequence Number=SeqID_164411
atgccctcttcctgttatctaccatcccttactgccaaggaagtggctgaagttttatcagaaaaattctcaaacttcatggatttccatcataaaaagttattgagagatacagggttttctcagaaccaaactcaagttctgttctacctaccatccttaatccaaggtagtcagcaagtgtctagagacatatttgcaatatttgacaagatcagactgaaatccatatctgaacctgctttatacaggggtaattacctacatttcacttgggtgtgcattaggaaaggatgtaggggatcagggtctcaaatgcacaacgtagagggcatgaccattagtaatataacagactgccagtga

SEQ ID NO: 72727 - DNA, 777 bp, Glycine max
  Peptide Sequence Number=SeqID_164412
atgacactgcgtcgattgcggcattttattgctgatttgccagaaaaacttaaatgggctactgaagctgcatggattcttgctcttgcttattttatcgcatacctggagacactggctatttccaatatctgtttcaccatcactgcaccgtcacctccttcctccccagacatcaccacaaccgccaacaccaccatacccacccagatgagcccgccactgaccatcaagcctcaaacgcgcaccgctgccacgtccaccagtcagagtcgcacgccaccaagtttgaatcaaccttataggagaacacaccataacccgtgcctattaaatgttgagcatcgttactgcctcgtgatcccaacacccagatctgttattgttgttgggtttgggtttctggaagttatggaggcgccggcggagttcccttattatcaattcgtggatcgcgactctatgtataaagttggatctttgttttatgccatctactttattgtgagcttcccaatgtttttaaggatagatgagaaacctggcgataaatgggacttgcctagagtggctgttgatgctttgggagctgcaatgctggtcacaataatacttgatttgtggcgcatctttctgggacctattgttccgatagcagacacaaaacagtgtcctcaagctgtagacaaggcaggatatactgtattcattgcgggtatggagattcatgtcattgaaaaagatagctttgtggtggtggacttcgtgatttgttaa

SEQ ID NO: 72728 - DNA, 891 bp, Glycine max
  Peptide Sequence Number=SeqID_164413
atggtgctcaaccttcccattcctatccgatatgagacttcgtctcatgcttatattccaacagtcattccagcattggattccaatacaccaatttttgcatcttcctttacattggaggaacatggtattttcgttccatctagactcaaagtatttagaacaaggaagaagtttgtggctgggccatttgagatagaacccatcagggtgacccattctattcctgattgttgtggactagttcttcgctgttctgatggtactattcttcacactggggactggaagattgatgaaacaccacttgatgggaaagtttttgatcgtgaagctttagaggaactctctaaagaaggagtgacattgatgatgagtgattcaacaaatgtactctcacctggaaggacaattagtgaatctgttgtggcagatgctttgttgagacatatttcagcatctaaaggaagggttattactacccaatttgcatcaaatctacatcggcttggtagtgtgaaagctgctgctgatttaactggcagaaagttggtatttgttggcatgtctttaaggacgtatttagatgcagcttggaaggatggaaaggctccaattgatccatccactctggtgaaagcagaggatattgatgcttatgctccaaaggatctgctaattgtaacaacaggttctcaagcagaaccacgtgctgccttgaacctttcatcttacggaagtagtcatgctttcaaactaaccaaggaagatgttgttttgtattcagctaaggttatccctggtaatgagtctcgtgtgatgaaaatgctaaaccgcatatcagagattggatcaacaattgttatggggaaaaatgaagctcaaaattaa

SEQ ID NO: 72729 - DNA, 1278 bp, Glycine max
  Peptide Sequence Number=SeqID_164414
atggctgttttgagccgatgtggggtggaatgtgaaggactagagaccttgtgcattaaggatcagacacttagtattgaaaatgcagagaagatagttggttgggctttaagccgccatctcatgcagaatgctgaaactgatcctgatgcaaagcttgtgttgtcttgtgagagcatccagtatgggattgggatcttacatgctatccagaatgagtcgaaaagcctgaagaagtctcttaaggatgttgtaacagaaaacgagtttgaaaagaggcttttggctgatgttattccacctaatgacattggtgttacttttgatgatattggagctcttgaaaatgtcaaggatactttgaaggaattggttatgcttcctttacagaggcccgagctattttgcaaagggcaattaaccaagccgtgcaagggtatcctattatttggtccccctggaacaggtaagacaatgcttgcaaaggcagttgctaccgaagctggtgcaaatttcatcaacatttccatgtcaagtatcacatctaagtggtttggtgagggtgaaaagtatgtcaaagctgttttttccctggctagtaaaattgctcctagcgtgatatttgttgacgaagttgatagcatgttgggcaggagggaaaatcctggggagcatgaggccatgcgaaagatgaaaaatgaattcatggtgaactgggatggcttacgcacaaaggatactgagcgagttcttgtgcttgcagccactaataggccttttgacctagatgaggctgtcattcggaggctgcctcggagattaatggtaaatttgcccgatgctccaaatagagcaaaaatattaaaagttatactggcaaaagaggacttgtcttctgatattaatatggatgcaattgcaagtatgactgatggatattccggaagcgatctaaagaatttgtgtgtaactgctgcacaccgtccaattaaagagatattagaaaaggagaaaaaggaacaggctgctgctgtatcagaaggtagacctgctccagcattaagtggaagtgcagatatccgatctttaaacatggaagatttcaaatatgctcatcaacaggtctgtgcaagtgtttcttctgaatccataaatatgaccgagcttcaacaatggaacgaactatatggtgaaggtggttcaagacctgcgtatatgaagctttttgccagcctcataatgcttgcggggcttgatgctgagctatttcgtctataa

SEQ ID NO: 72730 - DNA, 708 bp, Glycine max
  Peptide Sequence Number=SeqID_164415
atgctcgataatggggtgctgttggcagtgaagaggatcaaggattgggggatttccaagcaagattttgagagaaggatgaatttgatagcccaagtgaagcatccacgcgtattgccacccgttgcatactattgctctcagcaagagaagctcctagcatataaatatctgcagaatggtagtctcttcatgttgctctatggatctcaaagtggccactcttttgactggggaagcagactaaatgttgctgctaagatagctgaggctttggcatatgtgcatgaggagtttcttgagaatggaatagcacatggtaacttaaagtcaagtaacattctgtttgtccattctcacaacaaaggtctcaaaagcaaagatctaattgcatccatcttcaaagctgatgtacatgcctttggttcgatacttctcgagctgctgacagggaaagtaattaaaaatgatggatttgatctagtcaaatgggtgaattcagtggtcagagaggaatggacttttgaagttttcgacaagtccctaatctcacgaggtgcttctgaagagagaatgatgagtttgttgcaggtagcactaaaatgcgttaatccttctcccaatgataggccaagtatgagccaagttgcagagatgacaaattctttgatagaggaggaagaaaaatccatatcctttgacacatga

SEQ ID NO: 72731 - DNA, 1065 bp, Glycine max
  Peptide Sequence Number=SeqID_164416
atgcacacctttttcattgatgtgcaattgaagcattttttcactggcaacactgggttatcctccaaggaagctgagctgctcaaagatggatttagtgctgacaaatcctgtggctatgctaaacaaagtcctacagccacagacatggccaggtgcatggatccatcagctagtgaaccagaaacgcctaactcctcaaatgcacctactccatatggctttgagtctcaacctaagttggaagctgataatgtaccatctacctccgggacagctaaaaattgtgtgtttaaactaggtgacagggtaaaatatagttcatcttctgggggcttgtatcagcttcagactatttcttcaagcaatcgcatattcaggggtccagctaatggaagtcgggggaaggttgtcttactttttgatgataatcccttgtcaaaaattggcgtaagatttgataaacccatacctgatggagttgatcttggaggtttgtgtgagcctggtcaaggatttttctgcaatgtgactgatcttcgattagaaaacagtggcattgaagaacttgacaaattacttattaatacattgtttgaggttgtggttagtgagagcagagatgcacctttcattttgttcatgaaagatgcagagaagtctatagttggaaatggagatccattttcatttaaaagtaggcttgaaaatcttccggacaatgtggtcgtaataggttcacacactcacactgacagtcgaaaggagaagtcacatcctgggggtttgctttttacaaagttcggaagtaatcagactgctcttcttgatttggctttcccggatagttttggaagattgcatgacaggggaaaggaggccccaaagccaaacaaaaccttaactaagcttttcccaaataaagtgacaattcacatgccacaggatgagacacttctagcatcttggaagcaacaactcgatcgagatgttgagactcttaaaattaaaggaaatttgcacaacttacgcacagctagtaccagtggtactgaaagtacatag

SEQ ID NO: 72732 - DNA, 828 bp, Glycine max
  Peptide Sequence Number=SeqID_164417
atgagtaatgttgaagttagggtgagtgaaattgagggtccagttgagatggatgataagagtgacagtgagagtaagtcggatgtatacctcgatgatagtgaggaagatatgattttaggtttagatgatggttttggtgattatgcaactatgaacttgactccaaaagaagtaattgagaagttgaataatgatttgcaacatggagtcaatcctacattcactaaagacatggagggagactataaaaaattaggaaagaacttcaaatttcagttggaaatgaagtttaactctttagttgactttaaggatgcaatgagagagtatttgattcttattagaatggagctcaagcttggagagcaaagaaaatggcttaagaggacgttgatggagatgcagcaaagccatgttgcttgttgtatagcgggatgtcagccatttattggtgtttatggttgtcatttgaagactaagtatggagatgttcctgttgaaatagaaaatgaaaatgacaaccaagttcctcaaaatggcaatgaagatgttggccatgcaaatgatgaagttgctagaggtgggaatagaggttcaaaagtgaacatcactacagaaattgatgcagcaactgaaattgttgcttataacaatcaatttgacttcacccttgataatgcaaagaagttgacatcaaaggatgacaacaaaattggagcattgagaaacaagcacaatcacaacaagaatggaaacaacgacaaaaatgacattaacaaaggtgacaaggggaaagcatgtagaagtgacatgctacttaattag

SEQ ID NO: 72733 - DNA, 810 bp, Glycine max
  Peptide Sequence Number=SeqID_164418
atggagcaaacgatatggggtcatttgccggtgctggtaagggcaaattcgaaagaatctattgaatacattcttcaagcactttggagaacaagaaaaactggtcttggcactaccgaacgatgcatcatccaagaaatgctccagctccaaaatgaatctgatcttgacccacttctggtttgcctccgaatgttaatcaggaggtgtgtttatgagaacactagcaaggaggatattccaaagctgttccccagtgaggttctgcctgaattgcaaaaactgttgatgcttttgttgcacaagtttcagcaagagtggcaagaagatgtgatgaaagatcagactattgtgcctcaattaaagactatgacatggaatatggcaaatctggataaagaatctgcagaccctgcagctgttatcaatctgaagctacagaatgatgctctatttcactcaggagagcaagatatgaagttccagttggctacagattctatagatatgatgctgaaagccatgcactgtattagagaccagttttctactgtggagaacatagatgaaagacccaggcagggggaatcaaaagttgatcaatctttggtggggagatgtgttatcattcgggctaaagcctcaactgaccagatcatttggcgagttgggttttcacttgttcttcctttgttttctcaactgaactggtgcaaacacaagcacgatgcctgcacatccattgtggattactttgcaagtgcaaaacataatgtgcattggattactggtttagaacttggagcataa

SEQ ID NO: 72734 - DNA, 711 bp, Glycine max
  Peptide Sequence Number=SeqID_164419
atgccaatgtcgcgtacaaaagtgttctttgaggaaacctgtttagcatcaaaagatgctatgccttttgatttactaaagaagaagatgttttcgagattaaatacaatggggattagaattaagaaaacttacgaagaggaatggtcttatatcccagttggtggatccctaccgaacacagagcaaaagaaccttgcatttggtgcaactgccagcatgtttttatccacagggtactccgttgtgagatctttgtcagaagctccaaaatatgtttcagtaattgcttctattttgaaagataatcatgccaaggacatcattactcaaaaaagaagaaaggagaatctatctatgcaagatttttcctttggactattttcaggaggattatctaatccaagacttgtggcagtttccaattccatatcatttgcaaatcctaaagcacctgtgtatccgcgccttgctctaggaaggtcttgggatgaaatgacagttacatggacaagtggatatgacatagatgaaggccttttgttgaatggggtcccaaaggaaaaaagcaagcacacactactagaaaaagttgtttttacgatgctgattctaaattggttgatagaaaaccgtcttagaaagaaatgcgatgacatttttgtaaataaatacaattattctaagacgattttgcaaaaaccgccttag

SEQ ID NO: 72735 - DNA, 222 bp, Glycine max
  Peptide Sequence Number=SeqID_164420
atggtggtggcggcggtgttggtaatgacatttagtgatggtgatagtaatgttaatggtactagtgatgatagtaatgacaatgataataatgttggtgatgttggttacaacaacgttggtattgagttagttgtgatgacgatcacatgtgtaatagcattggtgaatcatacttatgatcaagacaaaaagtatcctcaaaagttttacagcccatag

SEQ ID NO: 72736 - DNA, 1614 bp, Glycine max
  Peptide Sequence Number=SeqID_164421
atgaggagagaaaaactgataacagaaaaattggaaaatataacaagtaacatagtgatctggttcgtgattccggcagtgaaagattcgacggcggctcatatttttcctctgcaacggagaatcttgaagactagcgggcttattgccaaaactgccttggcaggggccttatacaatcttggttcctacatgctagccagccatgttttaggagcttcatggtacgtttcgtcaattcagcggcagtacgagtgttggagaataacatgcaaaaaggagatgaacagaacgcattctccatcttgcaacccttcgtttctcgactgtggtaccatcaccaactacgaaaggcaagcttggttcaaacgaaccagagttctcagtgattgcgatgccctcaatgacaaaaacgagtttcagtttggaatgttcgctgatgctttcactgatcatgtctcctcatcaagattctttcagaaatacttttactgcctctggtggggtttgaagaatctaagttcatacgggcaaaatcttcagactagcacttacagtggtgaaacattgttttccagtttcatatgcatcgcaggtctaattctgtttgcgcatctcattggtaacatgcagaattatctgcaatcctcaactgctaaagttgaagagtggagacttaaacagaaagacacagaagagtggatgaatcaccgtcagcttccaccagaactgcaacaacgtgttcgcaggtttgttcaatataaatggcttgccaccagaggagtagacgaagaagccattttgcgtgctttgcctctggaccttcgccgccagattcagaggcatctctgtctcgacattgttcgtcgagttccattttttggccaaatggatgaccagcttctagatgcaatatgtgaacgccttgtttcatcgttaaacacaaaagacacattcatcgtccgcgaaggagatccagtgagagaaatgcttttcatcatcagagggcaagtagagagttccactaccgatggtggaagaacaggattcttcaactccatcaccctaagacctggtgatttttgcggtgaagaattgctaacatgggccttgatgccctcctcatcaagtctcaaccttccatcttccactcagacagtcaagactctcaccgaagtggaagcatttgccctaagagccgaagacctcaaattcgtcgccagccaattcaagcgcctccacagtaagaaattgcagcacgcttttaggtactattcgcatcagtggagggcttggggggcacattttatacaagctgcgtggagacgccaccgcaagaggaaattggcgatggagttgctggagaaggagaacttgtactacacaaatgtaatggaagatgatgatgaagaagaaggtagtgcaggtgagagttcaatggcagggcatgctcagaattttggggccacatttttggcttcgaaattcgctgcaaacactaagaaaggggcagttaaaaaggtgactattaatcttccagatgctggtagtttgaagatgcctaagatgttcaaacccacggaacctgatttctcaatattccatgatgattag

SEQ ID NO: 72737 - DNA, 246 bp, Glycine max
  Peptide Sequence Number=SeqID_164422
atggccaccgaaccaaaagcagccactgaggacgtcaagattgatctcttcgaagacgatgacgaatttgaagagtttgaaatcaacgaagtgatggtatttgaaagttcttcagagtgggatgacaaggaggaagggaaagaagtgactcaacagtgggaggatgattgggatgacgatgatgttagtgatgatttctctcttcagttgagaagggagttggagagcaacaccgagaagaactaa

SEQ ID NO: 72738 - DNA, 147 bp, Glycine max
  Peptide Sequence Number=SeqID_164423
atgggggaagggtggttacggtggcgccttccggaagatccatttaggattcttccggaacttctggaagatttccggaagaagggttcttccggaagaactggtcttccggaagtagttcttccgggaagtttccggaagaattga

SEQ ID NO: 72739 - DNA, 162 bp, Glycine max
  Peptide Sequence Number=SeqID_164424
atgtctgaagaagttgatatgaatgatgaaaatgaacacgaaactgatgtgaatgaagaacaacatgttgattgttcggatgcattcaatatttctcaggtgtttgttacccgagatgatgtttatgagagaaaagacttcatttgtgttaattggttgtaa

SEQ ID NO: 72740 - DNA, 273 bp, Glycine max
  Peptide Sequence Number=SeqID_164425
atgtacaacaacaaacatgttcttaatgaagacattatcattgccatcaagaatatgctaaagaacaacaaccattatgcgcagaagtttagaatggcgagtgataaactacaatcttcaatagtctctaacctaaagcttaaactcatttatgataggcagtcagatggaagattatacaatttgccaaatactgctgaagttgctgctttgattgttggtgacgagcacacaagtaaccacatggatatcataatagaaatgcaaacatga

SEQ ID NO: 72741 - DNA, 171 bp, Glycine max
  Peptide Sequence Number=SeqID_164426
atgatcgggacgcgatacgtggcggattcgtcaatgccacttgcgaaacagtggttccgccagtcaacctggcgatacagctcaggtaggcatgtagggctaggcacgcagggtgcaggtggtggtggctggtggtgggtaaacacttctagggcagttgaatactcttga

SEQ ID NO: 72742 - DNA, 363 bp, Glycine max
  Peptide Sequence Number=SeqID_164427
atgaacgaaggaaatgatgggtttgtgagagcagatcagattgatctgaagagcatcgatgagcagctcgagaggcacctcagcaaggttctgatgaagcagaaggaagaggacgatgctggctctgatcattctcgtcactctagctcctttgccactgcaactaagttcaaaagtgttgcgggtagtgctggcgccactaccttcaagaagcagaggcaggagtgggaaattgacccttctaacctcatcatcaagagtgtcatagccaggggaaccttcggcactgtccaccgcggcatctacgatggccaagatgttgctggcaagttcgatccattaaaacatgcatgctttttttaa

SEQ ID NO: 72743 - DNA, 1756 bp, Glycine max
  Peptide Sequence Number=SeqID_164428
atgaaaaaggtcacccaccatattatccacgcaccaagcccaagagtgttgggcgtgaaggggaataggaaagagaggagagctagagtaaggttacgagagacagagggtcccgatctgatcatcgaagggctagcaacaggacagcgtcaatcacacatgcgagtgaactggagagaccataaggacgtcacttccttttactttacgaggttccctgaagacgcaacagcaaaggagttatggatccattttaaacagcaaggagatgtgagggagggggtgcgaaatgtgcaacaacttcaacagcatttggacaacatggttttcagaggattgaagatgaatgttaacgttcctagatatgggagagtaaagaaaggagaatcacaaacaggagagagggggagagcagagacaagtcaagcacaaaagggaagaacagaaacgtaccagaacagggtaccagaaaagaagatgggaactcagcgatggtcatatgcggaggtggtcaacagaaatatcccaaagtcagctccgaggagaacaccagccaatctcgagtgtatcggttccaatgacacatctgaggtgaacttggagaccctgacgacgggcaaaagatggctcaaggaggcctgggtgggtagactgaaaaatttggcaagctttgacaacatagaagaagacatatggtgggatagcggacaaaatatatcaccaaagtacattggtgatgatatggtcctgctattggggctcacagaagagaacgcagggaaattggtaaatgaagaagatgaaggttggggtgatctgttctattccatagagaagtggaatccaagcctacgccctggtgagatggtggagacggacgagagtttagaggatcaaaggaggctcgatgtcgcgaggatactagtcaaaacccaacgtaaacctcttattcaacacacggcaaatgttcacattcaggggatgactttcccggtacacattgtggaggagagtgggccgttcggagttacaaggcagataagtagggactgtgacttcagctcatcagaggaaatccactctgacgaaggcgacgacgatctatggtctgaaagcgacttgcagggatggcggcaaaaacctcgtatacggagcaacgaggtgaaaatacgagcagaagcggagggagagaccttcatggcagtagatacggaggaggcggcgtcggagggagcgttgatggccgaggaagacaagtgcagaggaccaagtgacgtcgcgcaatcaaaaactcaaaggggagcctcatcccagacggcgatgatgggtgcggcggaggacacgggcggtggcgacgagagatcaccgcgcgggaaggaaaaacggcgagtcaggcatgcgtgtcggtcaggaggatcggcggtggtcttaggggatgagcttcgaaacgacgcagcttctgggacgacgaacggcaatgacccaaaggacaaagctattgtccaatgggtcgtgaaacaagcggaccaagctctgacaggcgttaaatgccttcagaccagtgacagggagcattcagagatgcaggaagaagggaagacagaattaggggaagaagaagaccttgggggggatgtcaactctgacgacattggcaacttgcatgaaaatggtatgaaggagcagacaagaaacgttggtggactggcgtacgaggaagaaaaggcagattttgaactctcctcaccaaagacat

SEQ ID NO: 72744 - DNA, 330 bp, Glycine max
  Peptide Sequence Number=SeqID_164429
atggttaatccaatcgttccacctcaatttctcacagaggatgatcggatcatggatcgtattaatcctgagtatgaagcctgggaagtgcaagaccaaacgttgcttgtttggcttcaatcaacactctcaaagtctatcatttctcacgtgctagactcgaaacacttttgtcaggtatgggagaagattcatgagcatttcggtcttcacaccaagtctagggcacatcaactgcaaacgtcaatgcgtgttgtctcactcgaagggaaaacggtggacgaataccttcacaaaatcaaaaactatgtagacgagtggttcacatga

SEQ ID NO: 72745 - DNA, 360 bp, Glycine max
  Peptide Sequence Number=SeqID_164430
atggaaaactctagactagattactgcattccaaatatggtgactggagatccttggctgaaggaacaagaggcagcaatgaatctctatggtggttgggaatcaaattttatttggaggagacccttatttgataatgaagttgacacgactgatggatttttgggagagacagcacagactgtagtccagccacatagagcagatatctgggtgtggaaacctgatccaaatggccaatactcaacacaaagtgcgtacaatctattgttgggggaatcaagggaggagaacctggatggagcttttgaggaattggggaaactaaggatcccaaccaaaacatcattttttgcatag

SEQ ID NO: 72746 - DNA, 3369 bp, Glycine max
  Peptide Sequence Number=SeqID_164431
atgatactcaaatttcacgacgatccaacggtgaacgggttcgagatcgtcgtttttctgagactggtctctattgtcagctgtgttttatctttgtgctcttgttcatcgagcgccatagcccctttcttttcgagggatacagtgtcacttgaaattcaaacaattgttgatggatttctggacttggatgataatcatgcaagtgcttctgttgttgataaaatcaacattttccgcccagatagagttttcatgtttttggtagaaattcattataaaattgcagcagcatctcattacagacataagtgccaccgattggctggaattgaggtgcttataagtattcttgggcagagagctgctgttttaagcacttccaatctatctacagatgtgaccagtatgcttggggaacagctccaggaattggagccactccctgaattaaaaatatttgatgagataaggaagttccatgaagaattatgccacacttactctatacgcgaccacttattgaagtttgtgaagaagtcttgctaccttccaccaaggttgcttttatcaagtctccaggcattgcaaaagaagttactgaatgtagaaacctttcaaagaggtgggaaagcagaagttttttctaaagacagatattggcatggtgatcatgaaattgtgcctgcagtctggaaacttgttcacatgtgtgggtcagatgatgcaagtgaagttcgagaattggtttcagatttcatttctagggttggtgctggagacccatattctgttgttttccatcttcctggcgagactagtcatcttcgtcttggtaaatctattgatatcagcagtgcaatggaaatcagttctgacttggatgcatgcatatctgaagaacttctggttgtccttttgaaatttctaatgaaatatctgatggatgattctgtgaaaattgttgatatggcatcacaaactcttcgtggaatactttcaactgaaagaggccaaagtgctttacagtcatttgattcatatcagaggtctctgattgagagagagagagagagagggagaacgagagaaagagtgagtttgagagggagaccacgtaggagagctcatgacagtgtgagagggagtgctcgtgacagggtacgtgggcgtgctcgagtgggagaaagtgaaaacggaggccagttacactatcgagcctctgctggccaacatggggggaggggttttgcagagagtagaagggcaacctatgaagtggataacagccctattggaactgatgaaaggtgggtggaagtatctcataggagaaagaagaaaacagatgtagacagaggaatctctgtgctcaataagcgacaaaggcaagataggagaggtacatggagagataaggaggatgtcacttccttttacttctcaagattccctgatggggtaaatgagaagtacttatggcagattttccaaaggtggggtaaggtgtgggaggttttcattcacaaagctaaaaacaaggcaggacataggttcgattttgtcaggtttaaggaggttcaagatgtgcaaaggttggaaagacagttggataatagcattgttcttggtgggatcaaaatgtttgtcaataaaccaaagtttgaaagggataacgtgaatagaggccatccgcatggtactcctacacatggaaagggaaaaccacaggaggtggacaacggtcgtcagagaacatatgacacgggaggaagacttcggtcctatgtcgaggtggctaggggggtaacaccactagggattaccttgtctaatgacaacaggctagttctgagccctgtcattttgaatccaactatcgaacacactgagtggctacataaagcttgggtgggcagattgaagaataaagggatgtttgaaaatgtgaaggaggaactgagatgggttctagaccccgatatcaaccctcgctattgggttgatgattgggttatcttacccaacctcgaagacgataaggcgcttcgcttaatgaatgaggaaaggacgaagggctccacacctattctggacctccagaaatggtccccacatattcctccaacacacaggttggcttgggtcttgctatggggcttaccgccaactgtgtgggaggtagtttatatggagaaggtggtggcggagcttggggagttggtggaggtcgatgagatggtcgaggaacgtgggaggatggacacggcgagaattttgattaggacgaacctcaggccgggtatcgagaaggcggtcccagctgtcatcgacggagtggacgtcattattcacattgtggaagacatgcaggggcttggaaggaagacgaagcccaaacaatcacccatgtggtacccgccatcacccctttcaacggagccaaactctctgacgacatacgctggtcgaaccccaggggatgataccgacggagcttcgttggatggtgggttaggcggctctgacggtggcctgtctgggcactggcatcgcacccgctcgttcctcgcgggtcgcgtccttcggacccaaccaacccacaacggccacatcgattggtctgacgcggtcaaacctgacgtggcccaatcgtgtggcgacaaccatcgcgtggaagaccaaagtcagcagggacccaataacggtcacctacgacaggaagggaaagtttttaaagcatcgtcccatagtgggtgctgtgttgacgcgcaaatggaaaaagctattttgacccaaacgggtgcagcgaaggagcagaaagaagacactgctgtagtggcagattttaaccagaatgaaaaaggtgttgtggccttgtctggttccaaagacggtatgttggagggagaaaagcagataatagacccatttgacgaaagaatagcctgtagtagaggtcaatacaattgcctgcaaacttcaacccctttaaccgtaggtccttctcattctcaaagggaagggggggagttgggccagcaaataataggcccatttaatcctggtacgaaagtctatgttagaataaaggaatttaaggatgctaaaacagaggcccaatctgttctgccttctcacaaagaaatagcttatcagccttatgaggctcatttgaaagctgatatgaaggacccgagagccaatatttgcaagcaggcttccctggaagatcaaatagctctagtcagcgacatgggccttacctatggtcaggaaacccagaagattaaggagttgatgatttacatggagcaacgcgataattctgtggcagtggagaagggtatcaagaaccatcaatcatga

SEQ ID NO: 72747 - DNA, 1098 bp, Glycine max
  Peptide Sequence Number=SeqID_164432
atggtgcattccaaaggtgtcaatattgaacttgtggaaaatctccttttggacctagaaaggaagtcaaaagctgaagcaatttcattggagaagtcccctgtgtgggtgacagatggtaaaacttttgatatgtggatttgtccattagtgtattcacttactgtctactgcaatgatgtgatactaagactgtgtcaagatattatatggtttaaaggtgaagttgctgagcttcttttgccaagtatttttgtcaatatcgctgcaaggaaggatctggaggttgatcttcacaaattaatctgtctgcagttggaggagcatgtatttacagagtcaaataagttgatgaaatccattcaagtggttttgaattgtcttaatgaacttcgtattcgtcatgttatggaaagattttcatttgtgccatcaaagagtgaagtttccaagaattcaaggccttcaagttatagttctaaaacccggtccactcctgcaaaggcaagggaatctgcagttgtttcatatgccttgtcaaagtcaccctcctcatgggagaaagtttattggctctccatcgactaccttcttgttgccaagctggcagctttagttgagcatacagctgggacaagccagagttgtggatcatattttacttcagtgatgtatgtagaacattggtgtgaagagcaatttaagactctaacaattgggggtccagatttctcccataacgaaatgttgccggatcatattgaaatacttgtttcggcagtcactagaatcaacgaaccagatagcttatatggaattcttcagtctcacaagttgacttctcaaataatcacatttgagcatgagggaaactgggggaaggccctggagtattatgacttgcaagtgcaatcagatgcctcagtacagaaggatggctgttcaaaaagtatgtcattgaaacaaacaggagcagcaaacccttcatcttttgcctcagaggtagatgagatgaggcagagtagaccttacaaagggttgattagatcattgcagcagattggctgcacacatgtgctggacatatttttaatttga

SEQ ID NO: 72748 - DNA, 288 bp, Glycine max
  Peptide Sequence Number=SeqID_164433
atggagttacaaaagtggcaccttcaaaaacaagtcagatcgggcccaaaatccaaggcactggttgatggtttttggcatgacaaagatcatgtgcgtggggcacgtaaaacaccagttgaggaagtagtggtcgaaaaaggacagattggattttggcaagttgaatggtggggtcaccttccggaaaggtcaccggagcatatgcaactggaaaagacccagatttttgttgttccatggatgcttgagttaggagacattgttcttcacgaagaagctcattga

SEQ ID NO: 72749 - DNA, 497 bp, Glycine max
  Peptide Sequence Number=SeqID_164434
gtgtcttccataccttcgatactcttgatgtagaccaagttgtgaacttgttagttgagttgcttgaagtcagtacaaaggaagctaaagataagactgagcaatgcaggggggcgtatgtttgtctagcatggctgcgagacatttatcgtgacaaatgtgaccatttccttacaattacttccattgttgctgatggggattaccataagaggaaaccacgtgcttgtcgatggaagtctgggaaggcattaccaatgttgatgtatcgtaagcacttcgatagattaacgccagatgttgtgtgttggattccttatgaataccttgcaccgtttggatatatttatattgctcctagacagtgtgcagcagactacatggagtggttctataggatatttcaccccttcatgagtctgacacagcttggggatccttctagacatccacatgtgatgcatgatgatacatttattgtaccagatcctatttaa

SEQ ID NO: 72750 - DNA, 534 bp, Glycine max
  Peptide Sequence Number=SeqID_164435
atgttttgttggtctaggtataagttagttgtcaagatgaaacagaatggggagaaggcgaacttccatttttgggatgcagtatgtatcaaaatatttggtaaaactgcagatgaatgttgtcaagagttgatagcgagtggtgatgagatcaaggtgttccctgcgtgtgttgatcaattgttgggtaaaacttgggttgtcagattcaaacaccgtatacagatgcaccaatcatctgtgttggattttagtgaacaggaacatcatatacaatcagtgatatccacactaggtctacaggatgaacaatgtataagcaacaagtcactggctgttggtgctgcatcttcatcacaacaagattaccatcctacaccttcattgtcacagtcatctgaatatgatcctggaaatgctgcctttgtaactcctgcaaaaagaacgtccgatcagcaagaaagtagtcagtttgatagtgacgacttcgcaacatatgaactatcgaccaacaagcatataaaagctgagtaa

SEQ ID NO: 72751 - DNA, 834 bp, Glycine max
  Peptide Sequence Number=SeqID_164436
atgtgtcacagatacagtattgaggcccttgacaaaagtttacaagacatcatgcacaacagcaatccttttggaggaaaggtcattgtttttggtggtgatttccgtcaaattctacctgttgtgccaagagcaacatatccagacttattacacaactacaacaatggcgatttcttgcaaaaaagagttgtccttgcctctacaaaagatgttgttgataaaataaatgactatgtcctgtctttgattcctggtgaggagaaagagtattgtagtgctgattctattgacaaatcagatgaactactcaatcctgcatttggagtactaacagttgaatttctaaactcattgaagacatcaggcataccaaatcacaagctcataatcaaggttggtatgcctaccatcctactacgaaatctggaccaagctgatgggttatgcaacagaactaggcttattgttacaagacttggttcaagtgttgttgaagtggagattattactggacccaacataggccatagaacatacattccaagaatgaatctttctccctctgattcaccatggccattcaagctaattagaagacaatttccattcatggtttcatttgcaatgacaattaacaaatctcagggacaatcgttggcacttgttggattgtatttgccaaccccagttttttctcatggccagttatatgttgcactttcacgagttcaaagcaaaaaagggctccatattcttattcatgataatcaaggcactcccaaaaatactaccattaatatagtatacaaagaagtttttgcaaacttataa

SEQ ID NO: 72752 - DNA, 900 bp, Glycine max
  Peptide Sequence Number=SeqID_164437
atggctgggctatatcagtctgacattgagcatcaaggtgacttgttgttcgagttcagttttttggaaatgtgggtagcgatttttggaaattgggtgatgatggaagttatctggggaggtgtaggtgtctcgtggaagtgtaacggggaggatgaagtactggggggaagtaggcaagtgaaggaattgagcaacgtggaactggataaaattatgagtactgcccttgtcgaccaagataacaaggcaatgctgggtcgaggtggtccgagtgtaaggaaagggtgtcagaacttgatgcaaagggttcgatgtcctcatcggcaattaaaatatgcaatcgaggtttacaatgatggccaggaatccatttgtcatcccaatgataacaaagtccctggtcacgccagagagccatttcctcggaaggggaaattgggtttggggatgcttggtaacaaggcggtggtgggggataagagctgcaatggtggccaagaagttttgtttcctggagcttggccagggacgcggcttgtgtcaatgatgaaggttggagggcctgcacctcccgacgccagtccggggatcctcgtaatatgctgggcaaaacgtgactcaagggcttcgagcatccctgtccaggattcaaagaactacaaagctttaaagatccactcgacaggatcgcgtccatcaaaatgtgggacgtccaatttcatatggggccaagaaggggatggtgaagttagtatcggaaaggaagaaggaaaggactggccctggttcaagcgagtgaccgcctcatccaagcggtcaatggtggcctgcctggtattatgctctggcggcagcataagggaaggtcggaccagttgttacgatcctatactatga

SEQ ID NO: 72753 - DNA, 129 bp, Glycine max
  Peptide Sequence Number=SeqID_164438
atggctttggtcattggtgtggcctttgcccctcctgctgggatgcaacgtagcccttcgctgttcttccattcgatcaacccgacgatgcacgtggatgactcttcttacggctcaaaattcctttga

SEQ ID NO: 72754 - DNA, 285 bp, Glycine max
  Peptide Sequence Number=SeqID_164439
atgattctcttgcctatggagcagactggcagaattaaggagaactcagcctatgctggccatggtggtggtggagggggtggcttcggtggtggtggtagatgtggtgatggtgtggcagcggacatcgtcgccgatgatggacagagcaagaggttgaaggtcgatgacgcaaaccacagcgagaacggcaggtgcaagaaggagcctaacaaggatagagcgagagaccgtgactgtgaacgttcttctagccgtcataggagcgagagggagagagactaa

SEQ ID NO: 72755 - DNA, 315 bp, Glycine max
  Peptide Sequence Number=SeqID_164440
atggcttccttgaatggaaattttccagcatctatgcccgttctcataggcaagaactatggtgattggtgtgctcagatgaagaaatcctatgtaggggatagaaaactcaagaaggtgaagctgcagaccttgagaaggcagtatgaacttctacaaatgagtgatcaagaaagcattgtggtggcaattgagcaaggccaggatcttgaagaaatgaagattgaagaactgcaaggaatacttaaagctcaagagatgaggctcaatgaaagaaactcacaaagatcagttgagcaagaattgcaagcctaa

SEQ ID NO: 72756 - DNA, 219 bp, Glycine max
  Peptide Sequence Number=SeqID_164441
atgtcgagaacaccatgtcccactttctttgcccttcaaaagaggtgggcaaatgcaaatccagggttggcaccgtttaattatttggaccctttagcaattgacatcactgccccacctctctttttctgttgcagtttagggtttcgatactccattgtgtatggacttcaaatgagagacttttcaagtcataaaggtggtagtttcaaggtctaa

SEQ ID NO: 72757 - DNA, 126 bp, Glycine max
  Peptide Sequence Number=SeqID_164442
atggctcaattacaactagctgtggagaactttacagggaccactatgagcaatgaaaggaaatatatatgccgacatccagcaggaaatacctggaaagtggtttctgttgttactgcaaggtag

SEQ ID NO: 72758 - DNA, 141 bp, Glycine max
  Peptide Sequence Number=SeqID_164443
atgaaattataccctgtgatactactacctaaaggcaaattagttgatacaaatggagcaggagatgcttttgtgggaggatttctttcacaattggttgatcagaaatccattgaagaatgcgtgagagctgggtgttaa

SEQ ID NO: 72759 - DNA, 132 bp, Glycine max
  Peptide Sequence Number=SeqID_164444
atggagagaggtaggaaagaaaggcctaaggaagtgaaatcttatttctctcctctttcaaggaaatcaaagtgcaccaaagagaagttcctatggagaaaggtacaagtattcccatggaaaaagcagtaa

SEQ ID NO: 72760 - DNA, 729 bp, Glycine max
  Peptide Sequence Number=SeqID_164445
atgtgggcatgggaacgatgtccaaccttggctccaaagaggactccttcccaagtagaaaatacaccactggggcacaggtggctgcgacatggaaaccaacatatcggcaatgatgatgtgagagtttttcgtcgcaagttagatattatgaaacgtcatgagtttgtgtgggagccgtacccatcaaccgtaatatcactgttgcctcccgtttgtttagtcagaagtcacgcgtggtacgaggttgtgccactaatttgtttccaagttattgagtggcaccaactggatagagtattgagacaatttgggatgcagcaaccaattccagagtctccttcacaacccttaaacattcatggcataacattaaaatggaaacatgacgaaaattgggggcaattgttcgccccaatgattgatcagtggaataatcgtcatgcatttagggtcgacgcttatccccgacaagaaggtctattgagctttaactcggactacatggtctggctgaagttgcggagacattacaatacatggtgtctcctcaagggaggaatacatggacagttgatgatctcgtgccttatgtggaaaaaattacaattttatccgaagagcaagagagattcactgagccagtgtcacatggtcctgcatctgagcgacaatttcccgcacaacagtttcatatgcttcagtcaagtgttgaaactcagggcatag

SEQ ID NO: 72761 - DNA, 1050 bp, Glycine max
  Peptide Sequence Number=SeqID_164446
atggcctctagaaaaaggaaagcaaccgcctctcgacttcgggaaccatatgacatgaccagatttatttatgaggtcgcttgggagtgttacgagcagaacgttcactcccgaaacatccttccggtgaggaacatcactttatatgtcacagagtacgaagagttccgccgggagttcgagaggaggcggtggcataaagccttgaccaggcagcctgatggtcgcattgatgtggccctggtcaaggagttttatgccaatctatatgatcttgacgataagtccccaaggcaagtcagagtttggggcaagctgataaagtttaatggagaatcgttgaatgctttcctggagacccccgtggttttggagccaggggaacattacaccacctactccaggttctgccacacgcacccagattctcaggagcttgcttccaagctctgtatcccagggtgtggttttgttttaaatactgagggagtgccctggaagctcctgaggaaggatttgactactctggctcagacctggagtgtcttttcctactctaacctcgcccccacctctcatacgtttgatcttaatatggatagtgcgaggttggtttatggacttgtgaagaagatggacatggatgtgggctcattcattttagacactcctgtttcttcttctgctccacctgctccagctccatcaccaccatcacctccagcacccttcggcacctccgctcagagctcagatgcaatcatgttgatgctggagagccttcaccatgccttatgcctggtgatgcagagtatacacgacctggctcaacatcggcccatcattagcatggaggatttcagggctcaggtggcctggccaggagtccagccttcttctttggggggaggtgaggctcctacagcccaagagccgctgctagagccggaggcgacactcgaggccacaccagaggagacaccggaggataatcctgctgccacacctactgaggacacagattatgcagctgatatggcggcggcatag

SEQ ID NO: 72762 - DNA, 411 bp, Glycine max
  Peptide Sequence Number=SeqID_164447
atgaaactacttgacatgctatcaagatatgctttaaaccaaattgttgttgagtttgagcgtgtacattatgctgacaaaaacccttcttattgtggatgtataatgagaactactcacagtcttccatgtacatgtgagctagttagatatgttgttgataccataccacttgacacaattcatatgttttggcggaggctaagttttacataccaaggtttatctgagcctaaagtcagcataatcgaagagatgaaaaccatatccaagcagtttaaagagtttgatgtatgtggcaaagttactataaagagtaaacttcgggaaattgcctacccttatgtaaattctatgtttgctctttcagaaaaggctgagaaaaggtggcacccgaacaagtgggcttaa

SEQ ID NO: 72763 - DNA, 225 bp, Glycine max
  Peptide Sequence Number=SeqID_164448
atgatgttacatcgggcactcacttatgttccctcctcaacctcccaccccaactctaacccacctacaacattgtcgacatcggagaaaatagaaatatgtgaaagtagattggggttgtttgggtcgtgtttggtggatcgggatgaacatggtggaggtggaggtacgcacaatgatgtggtggatggtggtaactgggttgctgctattgtgcacgcatag

SEQ ID NO: 72764 - DNA, 183 bp, Glycine max
  Peptide Sequence Number=SeqID_164449
atggatcaagtttttattgctagtgctgcaaatgtatttgctcaagtgaacaatatccctatgctgaatgagacaaattttaaggtctggaaggaagttgtagaaattgttcttggctgtatggatttggatttggcactgagaatggaacgacccacttccactccggaagcctccaatgag

SEQ ID NO: 72765 - DNA, 225 bp, Glycine max
  Peptide Sequence Number=SeqID_164450
atggaagaagaaaactcagcaaaagcaaagcaccaacagcacagcacacgcagaacactcaagaaatattcaacaatggagaaaagcaaagctactgaaaaagctgaagccctgaagccctgcaagcccctgaagcttcacgtgaagcctggcctgtctcgccagcactgtgggcgagtcccacgtggccctatctcaccatcactgtgggcgagtcccacgtag

SEQ ID NO: 72766 - DNA, 390 bp, Glycine max
  Peptide Sequence Number=SeqID_164451
atggcacaatgtgagggtggtaaagagggacatagtcgattggagcttttggtttcgttagacaatacctttgtggagggggtaaagaggtgtgtgaatgaagctgggatggggtttatgatgtctctaaagtatcacccaacaatgaagattgtcatacctataagaaagaagctaaagataaaaactatatttaatatattgggtccaatgttgaatctagcacatgtaccttttgctgttgttggagtatacacagaggacttggtcttcaaaatggctaaagcatttaatagatttggcatgaaaggagctttaattgtccattcaggtttggatgaaatgaatcctcttgtccctatacctagaaactacttgattattccgtag

SEQ ID NO: 72767 - DNA, 1755 bp, Glycine max
  Peptide Sequence Number=SeqID_164452
atgcagagaattttgagccatattcaggtgtttgcactatctagatggttaacagttaaattgccagtcgagttttacgaatttgccagacatttacaatggaccgtaccctattttcctgttccatgggaagctgaacctatgaacctgtttatggtaggctctaatccttttgggagctctaacttcatcaccaaagccccagcaacaatcccaaagaagttcttggacaagagtttgaatttggccgcttcagtgtatggatcaccacttacttcttccgagtacctgcaatactttgagagcgaaaatatgaaaccagaagctgaatatcttttggattcacaacattccgctggatggacagaattttatagaagcatgttttggttagctgtgatctgtggtggtttaatggttctgcatgcttttctcctcattgtcctgaaatttgggaagagaaattctgagaaggataaaatacatggagcactcacattccctagatttgaaatgtttcttatatttcttgcactacctaatgtttgcaagtcctctggtgtgcttcttcaaggggggtctccttctggattggcagttggaattctactgttggtttttgtgggcactgttcttctagctttgttcatgttcctctctattggaatcacatttggaaaactacttcaatataaggaagttcatcaagaaggtgagacatttcactggtaccaagagcttgtcagagtaactctggggccaggtaaaagaggccagtggacatggaaagaacaacctaaatctgttaatctaaccatctttggaccactgtttgaagacttaagaggccctcctaagtacatgctttcacagatagctggtggcagcggcaatcctccgagtcaaagagactgcatcattgcctctgatgatgaaacagaagatgcagaagcacctttcattcaaaagttgtttggcattcttaggatatactacgtgttccttgaatcaataagacgtgtctcattgggaattttggcaggtctctttgttctgactcagccatctaagagtccggtgattatcgtgctgtccatgacctcttttcagctattcttcatgctgctaaagaagccttttataaagaaaagggttcagttagtggagattatctcactcgcctgtgaagttactttatttgctacttgtttagtcctcttgaagaaggacatttctgtgagtgctgagactaagtatggaatttttatgcttgtgctgttcctaatagggtattgtgcacagatcactaatgaatggtatgctttatatatccaagcaaagatgctggaccctgaggaaaaatcactcttgacaggtttgaaaaatgcctccattgggtttcttttgtattttgtccctcaaaagtgcatcaaagatttggaaaagaggttaccacaaaatgacaatgtgaatgaagagcctagagacactgcttcgggcgctgacagatccaggcgctcgagtagcaggagctcaggtacacctgatggagcatggttgaaacaactaaggggatttgcaaagtctagcttcggtagggaaagaagtggaactagaaatgatccttctactagtggcactactggatggagtgggttatggggaaacaaaaggagtgggagctcatcttctgagttcaagtcaaaatcaagttcattgtacaaagatttggaagccatttttgcttccaagtga

SEQ ID NO: 72768 - DNA, 498 bp, Glycine max
  Peptide Sequence Number=SeqID_164453
atggctgcaaggaggcttcaaaagaaagatgaaaaggcacttgcaagggcatgtgcaatgtgctaccaaagtggggttcaaaggcataagaaaggagtatggacattggggagtgaggtctccattgaggaagaagaaaaaataaaacttgaaagtgggattgaaggagtgaatggggttaacgtggcaaatggtgattggaggattggggcttatccccgtgatgatgatgaggatggacaatgtgaccccgattatggcgggtgctcttatgcacacgataaggattcagagtcatgcgacgctattcgtgatactgttggaatgttttcaaaggacaaaagaggtaccgtgggtggttttctagacgactctgacaaccacgaaagtttgaaggccaacggcgacgctgaagacagggtcatagagcacattgtagagcggtcatctccggcgagaactgttgttctaatagtggttgtgacttcatcagagtga

SEQ ID NO: 72769 - DNA, 1014 bp, Glycine max
  Peptide Sequence Number=SeqID_164454
atgccaaacttaaaaggaaggctacagaaacagcattatgctctttttgttgtctctgaggatcagtcacaatactgtgagctcgaaacaactgctttagtgctagaaaacagcaatacagttgcagaagacatctctcctgcaagcaactcatattttcatttatcaggtagtgatggaaaaccaggtttactatcattttataaccgtccatacagaagagatagtaagatcctcttaccaaattcagagagaagtcaaaacagcatattgtggtttttgggccctgcagtcctcgttgcgtccttcatttttccttcactctatttacgcaaagtgctatccatcatttttgaggactctttgttaactgatttcctcatattattcttcacagaagcaattttctattgtggtgttggggtattcctttatctactagaccatgtaagaagacccttgctagtggatatcgctgcaaacaatagtgatactctacccccacaattgggacagagagtctcttctgttgctaccctggtgcttagtcttgtaattccaatggtgactatgggtttggtctggccgtggactggccctgcagcctccgcaactcttgctccataccttgttggtatagttgtccaatttgcatttgagcaatatgccagatatcgaaagtctccttcatggtctgctattccattaatctttcaacaaatgttagttgttaatatgttagtgagagggattcaaacccatgacctctccctctccctttcttccttcaaccaccaagtgtatagattgcaccaactaaatagagcagcacaactggtgacagctttatcatttactgttagaggagctgaaatgacctcacacaacatggctataaacagctctttgggtacccttctaaatgtcctacaattccttggtgtgatttgcatttggtccctatccagcttcctcatgagatttatcccttatgcttcaacaactaagcagtaa

SEQ ID NO: 72770 - DNA, 189 bp, Glycine max
  Peptide Sequence Number=SeqID_164455
atgtctgctttctctgctactggcaacatatttgatttggaaataacagtaaatgatgaaatcataaagtcaagcaggtcttatgcagatcctgtagtaggttttgaagagcaatccagcaatggatcaactccaccagcagattcccaagctaacatccccaatgggaaacatgtggtgaagaactga

SEQ ID NO: 72771 - DNA, 633 bp, Glycine max
  Peptide Sequence Number=SeqID_164456
atgaagatcttcattctctttagcataacttttgcttatggtttccttggaaatgttgtttcaaatgccaatccacttccatatgaagccattttcaacttcggtgactctataagcgacactggaaatgctgctacttaccacccacaaatgcctagcaatagtctttatgctgaggcatatgggatgccaatgttgtcagcctatctaaatcttaccaaagcacaaaacattaagaaaggagtaaattttgcattcgctggttcaactgcacttgataaggattttttgcaaggaaaaagaattcatgtacatgaagttgcttattcattgagtgctcaacttgatttgtttaaaaagcttaaacctcccctttgtaaaagcaaagaaggcttttcttctggtaaaattgagactttcagagcatgttgtggaaagggtgaaccttacaatctcagtttacaaatagcttgtggaagtccaaccgcaacggtttgccctgatccttcaaaacgtataaattgggatggaccccatttcactaaagcaacatataggctaatagcaaagggattacttgagggtccttttgctaatccttctctcagatcccctcctttcaagatagcttag

SEQ ID NO: 72772 - DNA, 378 bp, Glycine max
  Peptide Sequence Number=SeqID_164457
atggcaaggaatgcaagagtaactatcaatgcagtgcacccaggcattgtgaagacaggaattattagagctcataagggcttaataacgggtagattccctattttttattgcatcaaagttactcaaaacgacatcacagtatgcaatatttcgcattatgatggaggtaataatgtcaatgcgtgtgcgcagggtgcatcaactacgtgttatgtagcactgagccccaaaacagaagggataagtggaaaatactttgcagattgcaatgagtgtaaatgctcgagcctagcaaatgacgaatcggaagctcaaaagctatggaacaacacacatgccttgcttcacaaacgactgcgtcaagcaacgatttga

SEQ ID NO: 72773 - DNA, 1773 bp, Glycine max
  Peptide Sequence Number=SeqID_164458
atgactaagattttggcttttcggaataaccaaccaaaaggaagaaacctggaggtgcaggaagcaacagccgtgtttgctttgctcctccgttcactacaagaatttgtttcagaagattccaacgacaacaaaagagagattcagcaattgaatgaagttcagacagaagctatggacgcagattctgaatatcgtgaaaatagtgattcttcatttgtttgggatgagaattcacaactttacttccacgccagtagtggattctaccatgaccctaatgctggctggtactatagcaacaaagatggtgcttattacaaatttgaggatgggaattatgtgcttttaggtaccaaagaggatgataatgtagaaatgtatcagtgcaaggaaactacaaaagaaaatcctcaacaaatatatgatggtaacaacaatgaggatcacccttccttccttgaaagtaaatttgaaactaaccaacagataggaaccctggctgatgaagcgcctgctgataccccaaattccgtgagtagtccaacttgtgaagatcctcctccaccaccatcagaatggttagaggacacgcttatcgatctttacttatctggctacaagaacatagaagttagtgaagccgatgcagtgacagtgccatttgaaacagatgatagatataactcgttagcagctgatgcttacagcaaaacttacgaagtggaaggcgagtggatcctagaaccaggagatgaaaatggcttagctgataatagaagtactgtggatgaaggtataccttatagcaacacttatgaactggaagaaggtgaatggatcccagacatggaggacgaatatggcatagctgatagaagtaccatagatgaagccatctcattggatgaagagaaatggcgagctcaatatggtcaagttactgaatcagggaaagatctggtttcagaggttccaattgtggacttgtgggattgggaaatggttacgggatccaaaagagatggaaaagataagatggcaaggttggttggtagactggttaaaccatctgcaaagcaacatccatctatccctttcagtggagggaaattaagatctgctcccatctgtgaagcacatctcgatctgcagtattgggattttcagtaccgtgctagaggacaattgtacagattgcgaaatcctagcgcaaaatatgtggcttcattatcaacttatgattcttccaatccaacagaacattgggattttccccagttatcacctaatagaaaaatcaaacgtcactctaagtccagtgaaagctctgcttcagctttggatgaaacccctattgagaaggatttgtctgcattgccaagtcagctctctgcctctaagagttgcgggttagggaagttgagagaatataacgacatggagaacaattctaagcttaaaataaaacatcaatacagagatagggctgctgaaagaagaatattgcatggtggcttcggcatgggtccaggacagaagaatctgtcggacatttataatacaccatcttcacctgttgatgattgtccacaagaagctacggcagaggccttggagatgtcatttggagctggtagttatgctagaaaacttctaaaaagcatgggttggaaggagggggaagggcttggcagttctacgaagggcttggtagaacctattcaaccagttggaaacgttggtacttctggtttgggatggtctcgttga

SEQ ID NO: 72774 - DNA, 1680 bp, Glycine max
  Peptide Sequence Number=SeqID_164459
atggcgagaggggagagagcggagacagagagtggcgtttcgttgccctcggtgggcacggacgcgaagaagcggagagtaacgtacttctacgagccgtgcatcggcgactactactacgggcaagggcatccgatgaagcctcaccgcattcgcatggcccacaacctcatcgttcactacggcctccaccgccgcatgcaggtcaaccgccccttccccgcggcggaggccgacatcggccgcttccacgccgacgactacgtcgacttcctctccaccgtctcgccgcaaatcctctccgagaattcccactcccactaccgtcagctcaagcgcttcaacgtcggcgaggactgccccgtcttcgacggcctcttcgacttctgccgcgcctccgccggcggctccatcggcgccgccgtccgcctcaaccgcgaagacgccgacgtcgccatcaattgggccggcggcctgcaccacgccaagaaggccgaggcctccgggttttgctatgttaacgacattgttctcggcattctagaacttctcaaagttcataggcgtgtgctgtatattgatattgatgttcaccatggagatggcgttgaggaggcattttacactactgatagggtgatgacagtgtcatttcataagtttggggattttttcccaggaactgggcacattaaagacattggggtgggtgctggaaagaattattctctaaacgtcccactcaatgatggattggatgatgagactttccgtggtctgtttcgccccatcattcaaaaagtcatggatgtttatcaaccggatgcagttgttcttcaatgtggagctgactcgttgtctggtgatcggttgggttgcttcaacttgactgtgaagggccatgcagattgccttcgtttccttagatcattcaatgtccctctaatggtcttgggtgggggaggatatacggttcgcaatgttgctcgttgttggtgttatgaggtccctttctttacctacttggacgggaatactgcagtggcagtaggagtggagcctagtcctaagttgccttacaatgaatattatgaatattttggcccggactataatcttcatgttgagccatccacaatggaaaacctaaacacacccagggatctggaaaaaattcgatgtcaaatatctaaagccaccatagcacgttttctctcctatgtgcctgaggccaggggacagggactgaaccttagcaggattagagcttccgatttctcatgctgtcatgcatatagtgcccatataagtctctctgggtgtttgtgttggtggggggttggcttacactgggaagtggttacaacttacaattttgattatgatctatacccaaatgccttttcatgtctaccagcagacctgacatggagctttcctactccagattacaatatatatgcaaagaatacattactggaacaactttccaggcttccccatgcacccagtgcaccttttcaaacaacaccatcggtcatcgaagttccagaagaggaagaggaggacatggatgtaaggccaaaacgtcgtatatggagtggtgaagattttgattcggatcatgatgatgacatggctagttcaaagaactctgatttaactgcacaaacgaggtaa

SEQ ID NO: 72775 - DNA, 447 bp, Glycine max
  Peptide Sequence Number=SeqID_164460
atgttttgcagtggagacccgacagcgtatgagaggttttggcgacaaacgggtgacaagagcacgatcacaatccagggatggcagtctatgagttatttttctgatgtgaccaacatttgctggtttttggaggcagagtttgggagggaagtggtgaggttgcacaatgtggtgggaaatgcagtcacagaagggcgtcacattgttgttggaacaggttcttctcagctctttcttgctgctctttatgctctctccccaactgattcacctgaaccaatcagtgtcgtttgtgccacaccctactactcgctatgctcttgtactaattaccacaactcgtttagttgttataagcgatactttgaccactttaagttatatattgagggaattcttgcatggccaaggaactcattcttggatgtccatgatggactatag

SEQ ID NO: 72776 - DNA, 189 bp, Glycine max
  Peptide Sequence Number=SeqID_164461
atgttaattcaggacaaagacacacttaacgtgagtcatgcgctgagcacgaggatcaacgctatactcgctaagcgcggcaagcacgttcaacacgaaggttgcgtgaaaactaagctaacatgcatctataaaaggagtagcgtggagaaacattattttctaatagaactgagaaagaatatctaa

SEQ ID NO: 72777 - DNA, 552 bp, Glycine max
  Peptide Sequence Number=SeqID_164462
atggaattattgaaagttgctactgctgcaagatatttcaaggaagctgcacgaatatctattaaagcaaagttactgtatgttgaaaaaaagaccattcagatagacatgaatatgattacattaaatcttgagccacctagaaagaaacttggaggtcattcttctccaataaactatgttgtggaggtcaatatcaaagtcgaggaaccaggtgagaagaatgttcacaataatgcattctatgctgaagagaccttgctcagatctgaattggaagccatgcgtgattgcaattctttgactgctcgacattgggttgtaaggaacacgagaacatgcaatagaactggacagttgacaagctataagctggtacatggctcaaactgcttaccattggcaggttctgaagccaagtttttaagaagagctgctttcttgaagcataatttttgggtaacaacatattcacgtcgtgttggtgaaggactagctacatgggttaagcagaaccgttgtttggaagaaattaatgtagttctttggtaa

SEQ ID NO: 72778 - DNA, 306 bp, Glycine max
  Peptide Sequence Number=SeqID_164463
atggagataagatttttagtttcaggaaaatatgttgcgttgcaaatttctgatgacgaagatgttgaaactatgatagaaagtggttcgatgtttcatgctgcaaattctgttacgtcatgtggacgtaatgtatctcatcatgagtcggaactaccaagaaatataagcaatttacatgatgatgaagatgatgatgatgatgattaccttgcatctaactcatacattgaagagtctttcgatgaagatgatagtgatgatgaaatatctgatacagacgatgaagtcactgactcccaataa

SEQ ID NO: 72779 - DNA, 1155 bp, Glycine max
  Peptide Sequence Number=SeqID_164464
atggaacctcccttcgaccacctcctccgccgccttcaccctcccgtcaccgccctcgtcgccgacgtcgagcttcacttccctgtcgccgtcgcccgccgcagtaatattccggtcgcgctgctttggaccatgtcggcttccttttacctcacgttgcatcaactaggaagcttggttcgtaaccactctttgaaggttgatgttttaggtagggtttctaaggtcactgcaaaatatgattatgaagagcatataccaggaatttctgcagcacaattagctgatcttcgaacggtgcttcgtgaaaatgacttgaggtttttgcagcttgagttggaatgcatttcagtagtgccaaaagcagattgtcttatagttaatactgttcaagagttggaagctgaagtaattgattctttgagagccatgttccactttccaatttgtcgcattgcctttccttacttcaaacacgaaacatgtcattttgtgaccaacgacagtgattacaacgttgactacttaaattggctagatcatcagccatccatgtctgtattgtacatttctctcggtagtttcctttctgtgtcatgtgcccaaatgaatgaaattgtttcagctttgaacacgagtggtgtttgttacttgtgggtggttcgtggagaagtttcatggttaaaagagaaatgtggggataggggtttagtggtgccttggtgcgaccaattgaaggttttgtcacatccttctgtaggtgggttttggagccactgtgggtggaattcaactctagaagctgtttttggtggtattccaatgctgacattccctcttttcttagaccaagttccaaatagtaggcaaattttggaagagtggaagaatgggtgggagcttaaaagatcagatttgggaagtgcagaattgataacaaaagatgaaatagtgcaagtgattagagagtttatggatcttggaaagcgaaaagaaattcgagacagggcactagaatttaagggcatttgtgaccgagcagttgcagaaggtggatcctccaatgtgaaccttgatgcatttataaaagatgttttgtgtgttcaaaggtcattgagaggcaggggatatgtgatgtacaaaataggcaaataa

SEQ ID NO: 72780 - DNA, 1089 bp, Glycine max
  Peptide Sequence Number=SeqID_164465
atggcagaaccatcgaagaagagaaagggatcatcctccaccgccgctgctgctgcccatcgccgccacggaccatccgaagcacccacagcacctattcatccctctttatcatctccaagatcatccacattgttttcatccgatgatcaacgtctacggtacctttctcaattttcttctaggatcatcttagaccctaagtacctagacgtagatttctttaatgatgaaacgtttgattgctatcaagtgtttcaaaattctggcctggttgatttcatgtcattaaaattgtcacattatcctgaacttgtaaaggtcttctattgcaatttaaaaattcaggatgacattatttcctctgaggtgcatggtattcctatgatcattgatcagtcattgttcttttctttaactcatttacccagtcaaagtgcaccttttgagggcaccatttttgatgactggatatttgattattctagtcatgatgctcgccgtatggtctgcaatgaccaggctgaaatgaccggtagattactggccgggtcattaacatttgataatcgcatcatgcactatataattgttagaattttgcttcccctgtcttcaaatttagcacaagcctttgaggaagatttgattctaatgtggaatttcctaccggcattatgggccaatgcacctctcccttacccacaattgataactttgtttctgcgtcattttcaaattccgcttgatgatgaaccatttgttcaagtcaagcattcctttgcaattggtgctggtgcagtgacttcctttggataccgtaaggatcgaaatggtcaatggttgaaggaagacacactccctcctcaagatgagcgtactctttcatctcctcctcggcgagatgatttagcactcatgaatgaagtcctttccgaattacgaggtctttgttcttatgttgatgaacgtttcgactcattagatacacgttttgccggcatggatattcgtctcacacagcttgaagaggatgtgggttacattcgtcagagtttcgatcttccaccaccacctccaccttcttag

SEQ ID NO: 72781 - DNA, 225 bp, Glycine max
  Peptide Sequence Number=SeqID_164466
atggctgtcagatccatacatgatcaatacactggtccctgtaagatcggatcaatgacaaagcaactagacctcctccaaatggagaaagaaagagaaggagaaggggcgagaatgaggaagaagaaagaagcaagaacaagaagggaaagggaaaaagagggaggggttaggaattttgaagttgggggtagaaggataatttcaagggaggtagaggtgtga

SEQ ID NO: 72782 - DNA, 270 bp, Glycine max
  Peptide Sequence Number=SeqID_164467
atggttgtcgaatattcgttctccgttgtcgttcatggccacgctggaaacgtgttgattggcgccacactatgccttgtggcggtgttcaatggttgtgaacgacgcatgaaagtcgctggaatattcatggtggtggccggaggagatgcattgatacctaaaggggaaagaagggctacaggcggcgatggtgtcagagagaggaaaccgaaaagtaaggccacaacacgaaaggcatggttgatggtgaaggaggggaggttgtga

SEQ ID NO: 72783 - DNA, 576 bp, Glycine max
  Peptide Sequence Number=SeqID_164468
atgacaaggagaatagatttggttgtagactttggaaataggaaactcgagtggggcaagatcatccctagagatcgaagacaatacacacatgaatcgactattgagtacctgatggataatatccaagaaaaagtagatctggatggacaagacaaaggatatagagttgtgttagacgaaaaaagatttctaaggaaaaaagggattagtagagaaggaagtagatctaggctcgatgataacaccacatcgtaccttggtgggaactcaaaagtaggctatgaagaggatattgtttcaaaatttgtgtccatggaagaaagggataagaaggaaaatagagatgaaggggtatgtaaggaaggttcatgtggcattaccattgttaatgcctactcgctgtatgatttgcctaacaaaagatttgtgcaatttgtaaatgatgcttggaagaggttggatgtgcaagggtggggtgcatatgttctcaaagagaaatttaaagggataaagaaagaattaaaagtatggaagaaagatgtgtttggaaatttggagctaaggtacaagtag

SEQ ID NO: 72784 - DNA, 135 bp, Glycine max
  Peptide Sequence Number=SeqID_164469
atggaggaagagaaagagaaacacgaaggagatggatttgatggagaaggtagcacgacggtggctcggaggtggtggcataacagcagagtggaattgacaaagagagggagaaggaagcgaagaagcccataa

SEQ ID NO: 72785 - DNA, 1230 bp, Glycine max
  Peptide Sequence Number=SeqID_164470
atgggtggatcaatttcaaaacggaggcgttctaagcaacattcgtcaaatttttttcctcggtatcagcaacctcatttcccacaaagccaagataatgggtctgtggggcattatgggtattcacctcagagctatggtggtggtcgtgctccagaacaaggaaagagcttggataggaagtattcaaggataggtgatgattataagagcttggaccaggtaactgatgctctggcaaaagctggcttagagtcttcaaatctgattgttgggattgattttacgaagagcaatgagtggacaggtggaaggtcatttcaaaggagatgcctgcatcacattggtcatgaacaaaatccatatgaacaagctatatctatcattgggaaaacattgtcttcctttgatgaggataacttaattccctgttttggttttggagatgcatcaacacatgaccaggaagtttttagtttctatccggatgagagattttgtcgtggatttgaagaagtgttggaacggtacagggagttggtccctcaattaaagcttgcaggaccaacatcatttgccccagtcattgagatggcaatcaccatagttgagcaaagtggaggccaataccatgtgttagtgattatagctgatgggcaggtgacgagaagtgttgacactgagcatgggcagttgagtgcacaagaaaagaaaactgtagaagctattgtgaaagctaggcatgtatcttctgttaaaaaattgtcagttagttgtgctgagcatgaaataatgtcaaagaacatggatcggtccagaaaggaaacggagtttgcactcgctgccttgatggaaataccctcccagtacaaggcaacactagagcttaatatattgggtgcttgtagagggaaagatatagaccggattcctctcccaccgcctctatatggtgcagcatctttcaattcccccaaaacttcccgtcaatatagttctcgtcccagtgcaccatctagcagacatgatgttagcacaaaccctcctgcaacttctgcttctgataatcaggtttgtcccatttgcctcaccgatcctaaggatatggccttcggttgcgggcatcagataggtaggacttgcgggttaatttctcacaccattgacataacattgaaattttcatgtaattgtgttagtgttgggaacgtgaacgaaggtactggctga

SEQ ID NO: 72786 - DNA, 438 bp, Glycine max
  Peptide Sequence Number=SeqID_164471
atgacgtgcattcttatcctaataaataggatgatagctttagcttttgttttgtactctcttgcaagcaagtacaaccacgtatactcaaaccaaacattaatttccctcccattgagttttctgatgagcaacatgagcaaccctaagatgcagcaaaggagggagcgacgcatgttctccacctctgatgacagtgccatgaccaagcaagttgaggccactcatgcccctgatggtcgtgaaattgatgtcaaacccattctccaaattgtggatgaaatcttggttcggttcattgctcgcaccgttgagggtcatgaagtaaagcgagatcaagatgcattggagatgactgctgctctggctgaatttgacatgcttgactcgctggcttatatcataaacaaaatttcctgcgaggttgttttcatatga

SEQ ID NO: 72787 - DNA, 1098 bp, Glycine max
  Peptide Sequence Number=SeqID_164472
atggattcccctgcagtttcctctatccactttcacaacgcccatgtcttacccgaaccagacctttttatgcacactcccggtggcttcggcatccccagttttagaaaacgtcattgcgtccaaccgagtcgtcaaaatccacggcgttcccgacggcgccgtcacggccttcgtagcgttcctctactcctccaggaattaatagggtgcgcgcaggtgcacggaggaggacatggacaagtacggaatccaccttctagcattgtcgcacgtgtattcggtgccgcagctgaagcagaggtgcatcaagggactggcccagcgcttgagcacggagaacgtggtggacgtgttgcaactctctcggctctgcgacgcaccggatctctacctcaagtgcgtgaagctcctcaggaaccgtttcaaagccgtgaaggaaacagagggctggaaattcctcgagagccacgacccctggctcgaactcgacgttctccgcctcatgggcgaactcgaaaagaggaagaggagggtgaggaagtggagggaggaggagaggttgtacgtgcagctgagcgaggcgatggagtgtttggagcacatatgcacggaggggtgtacggaggtggggccatacgaggtggaggttggacgacaaaaaacgccgtgctcaaagttcgccacgtgtcagggtttgcaggaagctcaaaggagggtgtttgcggtgtaagcgtatgtggcagctcttcaggctccactcctccatttgcctatgccagaattcatgcaagaaatataggtcgtagcacatatagagttaaggatgcacaggacaggaccaacacggtatacagttattacttattagacccaacttcagtttcggtatcatgggtcgggaacaagccaaacatgcgtgcatcagtgacagttaaccttgctgttttggctgaatgtgacaggcaaattcgattaaaaatggagcaagagaacatgaaagatgacgcaaggtggaaactactggtgaggaaggtggcctcggccaaagccttgtcttccttggcgctgccaaagaggaaattagatcagagctag

SEQ ID NO: 72788 - DNA, 387 bp, Glycine max
  Peptide Sequence Number=SeqID_164473
atggggattggaatttgttgtggcaaagttagctccaagagtcaagctgatgttatggagggctaccttctagaagcaacatggggatgcgaggagtccaatggttccaacaatgtaggaactcaaggtcacaaacaaaaccatcgtggacctcgaggaggtggatcaaattcctactctactgtcaatgttgcaaactcttcccatggtgacaaccaacaagatattggtatatcatcatcatccaactcctcacatgggatttctaaagaacaacctcaacaaattgctcatgcactatccatgatgaatgcaactggtaatatgatgcttatgcaaatgttgcaggacttggctacggggagtatgattggctcgggtgaataa

SEQ ID NO: 72789 - DNA, 579 bp, Glycine max
  Peptide Sequence Number=SeqID_164474
atgctggcagttacttcagttgtgatgttgaagaattttcgagttccctatctaagccagggatggggttgtgcttaccgctctctccagactatcatttcatggttcagacttcaaaactatacatccatagaagttccttctcatagggaaatacagcagacacttgttgaaattggtgataaagacccttcttttgttggatcacgagattggatcggtgccattgaattgagctttgttttggacaaacttctgggtgttacgtgcaaagtcatcaatgttagatctggagctgagcttccagaaaaatgtcgagagctagcgatgcactttgaaaaccaaagtacacctgttatgattgagacaaatgacaaggtgctgcagcctgcaggcaggctcatccctgtacttattgttggtgaggtggagaatggccccagggaacttgatgaggacctcttcagtggtggcagagggactggtgttgtcaggcaagtggtctttgatgagctcagtagctcacaatatcaattgaggggcagagaaaggagcagggtggatcaagaggaatggtga

SEQ ID NO: 72790 - DNA, 1701 bp, Glycine max
  Peptide Sequence Number=SeqID_164475
atggcggagaagttgggagcagcagaagagagctctaattcaaaggcttttcaccatacggcgacgaagctcgtcgttttggcagacctcaacgtcgatcctcccgaagccgaagccgaagaagtggattcttctcttgtccctcctccaccaattaccattttgggaaatgatgaaaacagtcaagataaaagttcgttgtctaaagacactgatagcattgaaggtgaaagtaaaaagttgaacaaactgagcaaatcccgctccagaaagacagattcttctcttgattgtgtagctgatgtggatggcgatcaacatgttcaagggcctccttcatctcgggaggaaaaagttagcagtgtgaagactggcttggttcatgttgcaaggaagatgcccaaaaatgctcacgctcattttatactcggcttgatgtaccaaagattaagccaacctcaaaaggctgtgttagcttatgagaaggcagaagagatcttgctgaggcctgaggctgagattgacaggccagagttgctttctttagttcagattcaccatgcacagtgcctgatactagaaagttcatcagaaaatagttcagataaagaacttgaacctcatgaacttgaagagattctttttaagctgaaacagtcagtgaggtcagatatcagacagacagctgtatggaacacactgggttttatccttcttaaaactggtcgtatgcagagtgctatctcagttttgtcatcattgttgtccattgcacctgagaattatgattgcctaggaaatcttgggatagcttatcttcaaattgggaatttggaattatctgcaaaatgttttcaagaattgattttaaaagatcaaaaccatcctgcagctttggtcaattatgctgctcttcttttgtgtaaatatgcttcggttgtagcaggtcctggtgcaattgctgctgaaggtgccttgactgatcagatcatggctgctaatgttgctaaggaatgtttgttggctgcagttaaagcagatagcaaatcggcccatgtctgggcaaatcttgcctatgcattttctattagtggtgatcatcgaagttccagcaaatgcttggagaaggcagccaaactggaacccaattgcatgtctactcgatatgctgttgctatccatcgaataaaggaggcagaaagatctcaagatcctactgaactgctttcttgtgctggaaatgagatggcttctataataagagacagtgattcatccctggttgagattccaatagtatggtccgggcttgccatggttcacaaggctcagcatgagatagcggcagcatatgaaagtgaacagaatgggctaagagaagttgaagagcgtgctgtttgcagtttaaagcaggctatagctgaagatccaaatgatgctgtgcagtggcaccaacttggcgttcatagtctctgtgctaggcaattcaaaacatcacaaaagtaccttaaagctgctgttgcctgtgacaaggattgcagctatgcatggtctaacctaggtatgctctctctctctactgtaatatgcatgttatcatcttcaaattctatattgcctttggtattccctactgtggtctggcactttagctcactcactggatccctttcccctagaagaacttttttgataatatag

SEQ ID NO: 72791 - DNA, 1194 bp, Glycine max
  Peptide Sequence Number=SeqID_164476
atggcggatgatagcaaccgcagcgtgagactgctatgccgcccgaagcagctcaacacaaaaggatccgacccgggaatccatttctggcttatcggatccccattcttcccgccactcaccgtcgcctccttcctccgccgcatccacacgctcccctcctccgcttcccccgatttgcccaaagaatctgaggaccttcgaacactcatccccaaaggcttcgaagtcgttggagccctagcttctggggacgatacccacgctcgcacggccgttgacgccgcgcgtgcattgatgaaccttctctacggcgacggaacagatcgaccggttatcggagcggtttgcggctcggattccggcgagctgcggtttgttgtgtcagagagtgaaaatgccacgggactcgaatctgtttcgtcggtaatagaggaaagggattcggagaagtttgtgtgggagaatggttgcttgcttcactgcgagcttccaattaagttgccactctattatagtctcaagaatccaactgatgttgagaaatcatatgcacaggttactgaatctgttattgccaagttaagagaccctcaggctgtgtacatgttagaaatgtcaaacaaagcctcccgggatatatctcctcctgtcataattcgaggtgtacaattagactttagcacagacctctccaagatcaagcctttggctgaggatgatgatggcttcaatgcaagctcactatcatgttcatacttttccatcagcagtaaagcaggctcaccagttttttctgcagagaatgcagatactatccaagttagtgttctctttaatagcttagggtcatcatcagcttctactgtgcctgttgcagaatactttccagttgaagttaggagatccttgcactcaaggttgggattaccgtatgatcgtccccttctaagaatttctaatgccttggatttttcaaaattgaagaacaatgatatggtctctctacagaaaggttcaactttgctcagagatgtacacattgggattccaagtagcggggttactgggggaactgtttcccttgttcaaggttcatatgaatacttccattatcttcacaatggttataatgattcggctacggagatttggatgacgccacttccaatgaaggaagataagtcaggatag

SEQ ID NO: 72792 - DNA, 540 bp, Glycine max
  Peptide Sequence Number=SeqID_164477
atgaagctaaaagttatgattgcggtgctacttgccacagctggagcaatcatgtccataaaaaatttcaacaacctcttcaacaatagtcatcaaagattaggagttgcactatatggtgttatctggctgcaagttttactgggcatttttcgaccacaaaggggatccaaaagaagtgtgtggttctttgcacactggatactcggaactgcggtcacattcctgggtgtcttgaatgtatatcttggtttaggagcctaccaccaaaagacatcaaagggcataaaaatttggaacattcttttcactgttcagatatctttgattgtgtttttctacctttttcaagaaaaatgggtctacatacaaaaccaaggagtggttttgggcaatgaaataaaaactcctagttgtaatgaaggtgatccagatgaaaaggagaaggagataagaaataatttctattgtttttgtcagaaatggcaaagccattcaaagattacaaatgcagcagatgcaattgtggttgcattgtag

SEQ ID NO: 72793 - DNA, 1377 bp, Glycine max
  Peptide Sequence Number=SeqID_164478
atgaatcagatatcactctttgaggctaaggttgcatgtgaaaacggagaacaaacacttagccgtgatgtttatcgacttgggcaacgatttgacttctacagaatgatgtccttctacttcacaacagttggtttctacttcagtagcatggtaactgtgttgattgtgtatgcgttcttatatgggcgtttatatatggttttgagtggagttgagagagaaattcttcaaagtctaaacatacatcagagcaaagcccttgaagaggccatggcaactcagtctgttgttcagttgggcttactgcttttgctgccaatggttatggaaattggcttagagagaggatttcgcactgccgtggctgattttatcatcatgcagctgcagctagcctctgtgttctttactttccagcttggaacaaaagcacattattatggaagaacactcttacatgggggctctaaatatagaccaacaggtcgtggattgattgtcttccatgtgaagtttgctgataactacaggatgtactcacgaagtcattttgtgaagggcctagagatcctcttgctattgattgtttatgaactctatggagagtcatatcgcagctcgcatctttatttattcatcataatctcaatctggtttttggccacgtcctggctgtttgctcctttcttgtttaatccttctggctttgatttgctaaaaacagtggatgattggacagattggaagcggtggatgggatatcctgatggtattggtatttcatctgatagaagctgggaatcttggtgggatgaacaaaatgaacacctgaaatactcaaatctcaggggtaaaataattgagataattcttgcatttcgcttctttatgtaccaatatggaattgtctaccacatggatattactcatcataacaaagatttgctgattgtatccatagaaagacaaagatttgggactgactttcagctcacgattcgtattcttaaggcacttctctttcttgccttcttatcggtcatgactgtattatttgtggtatgtggacttaccatatcagatttgtttgctgccattatcgccttcatgccctctggatggggcattattcagattgcacaagtatgcaaggtgtgctttaaaggagctaaactatgggactcagtgaaagagctatccagaacttatgaatatgtaatgggatcaataatcttcttgccaatagttatcttgtcatggttcccatatgtgtcagagttccaaacccgcttgctattcaatcaaggattttgtagagggctccaaatttcaatgattcttgctggaaggaaggacacttataaatctgattga

SEQ ID NO: 72794 - DNA, 978 bp, Glycine max
  Peptide Sequence Number=SeqID_164479
atgttaatatctgagttttgcttcagtattctgacaccctatttcaaagaagatattcaatattctgatgaggaaatcaataaggaaaatgaagagggaatatcaattttattctacctaaccaagatatatcctgatgaatggtccaatttccatgaacgactaaaaagtgaagaagttcttgaagaaaataaggaggagttaattcgtcagtgggcatcttacagagggcagacactttatcgtacagtgagaggaatgatgtactaccgacaagcaatgatccttcagtgcttcatagaatctgcggcagacattgctctctctgaaggctattccgagacaaataagaagctactcgaagaagcacaaactatggccgatttgaagttcacctatgttgtttcttgtcaagcgtacggttatcagaggaagtccaaaaatgctagagacaaaaactgctatattaacattctcaaactgatgttaacgtggaatattccatgcaggcattcatcccttcgtgttgcttacatagatgaaatagaagagaagacagaggatgggaaatctcagatggtttatttctctgttcttatcaagggagggaagaaatatgatgaagagagctcaagttgcgatcaagggaattcaagattcttgtctgaatacaaagatcaagctgcgggagtcttgtttctggttctttcgctgcttcactgtatcaagaacactcaagaaatcatgtcaaacactattaggattgaaaaattcaagggaaagaacaacttcaatctatggcgcatcaagatgcatgctttgttaaaggaacaacgtgtctgggctcctgttgcttttgcatctgtgaagaaagaagtggcttctgaatcaaaagaaaaggtctctatttcaaagactgaagaacttgcagaacaagaaaaaaaaggctcactcactaatcttgctttccttgtttga

SEQ ID NO: 72795 - DNA, 288 bp, Glycine max
  Peptide Sequence Number=SeqID_164480
atgttaaaaccaattgagcctgaagttcccaagcatgataagcaagattctcaatccctgcattgttattggagagtgaacgaaattgcagaggaatttcaggacttacaacaaatcgatgaagtcgatgtgcttttagcactggagaagttgattggcgaagaagccgatgtagattgtatcaacacagaggtggcaaacagtggcaggcagagaaatgaagagaagctggcagagatggcagagaggctcctctgtcatgaccatgagacggaaaagtggagatag

SEQ ID NO: 72796 - DNA, 318 bp, Glycine max
  Peptide Sequence Number=SeqID_164481
atgactttaattgttaaaaagtggtccattctatcacgaagaccaagacggcttcaagtgttgcaagagactgcagagcctctaccaacctatgtccattcttccaccaccattgacaccacctatgaaaaggctttacattggatgtatgttcgtgatggtggtttcaccgtagaccgcagcagcggcagaggggaggggtcgatggtgcagtggaagcaaaaaggaaggagtgcaggaagtaaaagcccggccagttttacccaacaggctgtgggctggtgttggtctggcccagtagctaaatataaaaaataa

SEQ ID NO: 72797 - DNA, 425 bp, Glycine max
  Peptide Sequence Number=SeqID_164482
atggtggtggtcacggaggtgggatgtcgtgcgcaaagcacatatttggtgtgggaatgccaggcatggagtaggactaaggtgggtatgcatgtagatctcttcaaggtcggtggtgtgcgcagcggagagggcaaaggtaggtggcgacaaaaaattgaggctgaggttggtggtgtacatggcggagagggcggaggtaggaccatggccagcaccagtggcacaaagggtggtccttttgagatgggtaggcagccatcgaagaggatggtgagggctcctacaaggaatgtggagttgggaaatgatgagggtgtggtggacagtgagattgtgccttcttcacttgctgttcttgtgcctattctcagagcagcccttgagattgaggaggagaatcccagagttgcctatctttgtga

SEQ ID NO: 72798 - DNA, 2280 bp, Glycine max
  Peptide Sequence Number=SeqID_164483
atggggatgtctatagataactaccagtggcatgagttctttccagaaaatgagactcacaatatatgtattgtcattgcaatatgggctccgattatgctggtttattttatggatgctcaaatttggtatgctatttatgccactttatttggtggcattattggagccttcagccatttgggagagataaggacacttggaatgctccgctccagatttcaatctgtaccgatagctttcagtcagcgtttttggactggaagagacagaaagactaaacaggaggaatcggtatggaatgagtttataaattctatgagagaggaggatctcatcagtgacagggatagagatttgcttcttgtcccatacagttcaagttatgtttctgtcattcagtggcctccattcttgcttgctagtaagatccccatagctgttgacatggcaaaagattataagaaggagactgatgatgatttagttagaaagattaagagcgatgggtatatgtattcagcagttgttgaatgctatgagactctcagggacatcatactgaaccttctgcttgatgaagatgatagaagggttgtgatgcgtatatgcggtagagtagaagagtgcatacatgaagaaaaatttgtcaaggaattcaatatgagtggcttaccttcactcagtgagaagttagaaaaattccttactctactgagatctgaagatggcaaactagaatcccagatagtcaatgtcctgcaagatattgtagaaattatcatacaggatgttatgtttgatggccatttgttgctgcaaacacctcagcaaacacctcacgaatatcatgtagagagagggcagaagtttgtcaacattgacacttcttttacacataatacatcggtgatggaaaaggttattaggcttcatttgcttttaacagtcaaggaatcagccataaatgtgccccaaaacatagaagcccgccgccgtattacattctttgcaaactccttatttatgaatatgccaaaggctcccaaagttcgggacatgttgtccttcagtgttctgacaccctatttcaaagaagatgttctatattctgatgaggaactcaataaggaaaatgaagatggaatatcaattttattctacctgaaaaagatatatcctgatgaatgggccaatttcaatgaacgagtaaaaagtgattatcttgaagaagataaggagttaattcgtcagtgggcatcttacagaggacagacactctatcgaacagctctctctgaaggctaccggacaatggattcctatgaaaaaaataagaagcttctcgaagaggcacaagccatggccgatttaaagttcacctatgttgtttcttgtcaagtgtacggttctcagaagaagtccaaaaatactagagacagaagctgctatactaacattctcagtctgatgttaacgcattcagcccttcgtgttgcttacatagatgaaacagaagacacgaaggatggaaaatctcagaaagtttattactctgttcttgtcaagggaggggataagtatgatgaggaaatatatcgtatcaagctaccaggtcctccaacagaaattggagaagggaaacctgaaaaccaaaatcatgctattgtatttactcgtggagaagccttgcagaccatagacatgaatcaggataactattatgaagaagctttcaaaatgagaaatgtattggaagaattccggagaggacgtagtggacaacggacgcccagcatattgggtataagggagcatatatttactggaagtgtttcttcacttgcttggtttatgtcaaaccaggagaccagtttcgtgaccattggccaacgaattttggcaaatcctttaagggttcggtttcattatggccatcctgatatatttgacagactcttccacataacaagaggtggcataagcaaagcatcaaaagttataaacttaagtgaggatatatttgcaggtaaggggcgtgacgtgggcatgaatcagatatcactctttgaggctaaggttgcaaatggaaatggagaacaaacacttagccgtgatgtttatcgacttggacgacgatttgatttctacagaatgttgtcattctacttcacaacagttggattctactttagtagcatgtttaaggctattaagaatggcacattattggaatgcattttgtccaattggagtatatggtgttttcttccaatatag

SEQ ID NO: 72799 - DNA, 1056 bp, Glycine max
  Peptide Sequence Number=SeqID_164484
atgggaggaaaagggtatgctctatggctcttcattattgaaatcttggtgcatttttccacatcaagaagtgccaaagttccttcaataatagtgtttggagactcctctgtggactcaggtaacaacaacttcattccaaccattgcaaggagcaactttgagccttatggtcgtgactttttcaatggaaaccctactgggagattctccaatggacgcattgcccctgacttcatctctgaggcctttggcattaagcaatcagttcctgcatacttggatccagcttataacatatctgattttgcctctggggtgtgctttgcttctgctggaactggatttgacaatgctactgcaagggttgctgatgtgatacctctatggaaagaaattgagtactacaaggagtaccaaaagaaactgagggcacatcttggggatgagaaggccaatgaaataataagagaggctttatatttggtcagcatagggaccaatgacttccttgagaactactacacactccctgaaagaaggtgtgaattccctattgttcagcaatatgaggacttcctcctagggcttgctgagagcttcttcaaggaaatttatggccttggggcaaggaaaatttctctgactgggttgcctcctatggggtgtctgccactggagagagcaacaaacattttggagtaccataattgtgttgaggaatacaataatttggccttggagttcaatggaaagttggggtggttggtgacaaagctcaacaaggacctccctggacttcaattggttgatgcaaatgcttatgatatcatactgcaaatcgttaaacacccttctcgttttggttttgaggtagcagatacgggatgctgtggaacagggagatttgagatgggtttcctgtgcgatccaaaatttacatgtgaagatgcaaataacaaccatgctacctccattgaagacaaacctcgcaccacgataaggccagtccgcgtaacaaccaaacccagatatttgcaagattatgttagttag

SEQ ID NO: 72800 - DNA, 363 bp, Glycine max
  misc_feature (47)..(47): n is a, c, g, or t
  Peptide Sequence Number=SeqID_164485
atgccggggagcagacaagcccgtcagggcgcgtcagcgggtgttgncgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggattttcttatcaaaacgatttag

SEQ ID NO: 72801 - DNA, 171 bp, Glycine max
  Peptide Sequence Number=SeqID_164486
atgtcagtgaaaaatcttgtcggacaccttggaatacatgacaagacagaccatacactagtaaggagaccagccagagtcacgctgttttgtgagactgctccaatcatgtgggatcgacacatgattaaaggagcattcaaactgggtgtatttactcccaagggttag

SEQ ID NO: 72802 - DNA, 237 bp, Glycine max
  Peptide Sequence Number=SeqID_164487
atggctttaagaaggaaagttcacgtgtctccatgtggggatgatgccacccgtattcactccgggaaccaccgctgccgtgtgatggtggctaagcatatctaccacaccttctcgtggcccctgtcacaaattgaaactctaccgggtgaagaagaagtggtgaggaatggtaatagtgaagttcaaccgaaaggtggaatggcaagacttaagagagaaggaaggctaggatag

SEQ ID NO: 72803 - DNA, 834 bp, Glycine max
  Peptide Sequence Number=SeqID_164488
atggattggtatgttaagaatcctgattggtggggtgatgtttctggtgctttgcttcctcatccaagaatgctcactatgccaggagttgagaagtactgctatgatgacatcgataatgtgacccaaatcgcttccgatggcgatgtgaaccattctaatcagaacagaatggtggttgtttcagctacaaggaacaatgtgtcaccacataaggcttctttgaagttcttgatatatggtggtgcagggtggattggagggcttattggaaacatttatgtctgcagagatcatggtcttcctatgatgaattatgcattttgtggtaactttgaagacaaaacaaattccacagattccttctattttagaacacaagccaaggttgaagggttgctaaaggaatatgaaaatgtgtgcaccctaagaatccaattgccagtgtcatctgatctcagcaacccacataacttcatcattaagataacaaggtctgataaaatggccaacattccaaaccgcatcactgttttggatgaacttgtgccaatttcagttgagatggccaaaaggaattgcaggggcatttggaacttcacaaatcctggtattgtgacctgcaatgagattcttgagatgtacaaggattatgttaaccctacttttagatgggttaattttacacctgaacaacaggctcatttcacttccccaagcactaatgagatggattcgtcaaaactgaaaaaggaattttctgagctgttacctatcaaggactcattgatcaaatatgtgtttgagccaaaaaagaaaagctcggggttttga

SEQ ID NO: 72804 - DNA, 1674 bp, Glycine max
  Peptide Sequence Number=SeqID_164489
atggttttgagggtttctctgattctggttctccttgtgttacactgttcctgcactgtggaatccatttgggggcatcacaatgatctcaacaagaatggatcttctcttgctgcagtcaagtttcctgatcatgcacacttcaatgctgtttcttcttccacagaaactgggtgtagtttctccaagtcagagaaatttgagccttcagttgctaccatggcatcaaatgaagacactgatggtaaagagggagaggcttttgtggcagcaaaacagcacaagcaatctgtgaaactcaatttgagacaccactcagtgagcaaagattcggagcctaaaaaatctgtggttgattccacagggagagacttgaagagaattcagacccttcacagaagggtcatagagaagaagaaccaaaacacaatttcaaggttggagaaagcacaggagcactcaaagaagtcctataagccaccgacagtggctgcggcggccccgccggagtatttatccggtcagcttatggcaaccttggagtcaggggtcagtcttggctctggtgagtacttcatggatgtgtttgttggcacaccccctaagcatttttctctaattcttgatactggtagtgaccttaattggattcaatgtgttccttgttatgcttgttttgagcaaaatggaccatattatgatcccaaagattctagttcttttaagaatataacttgccgtgatccaaggtgccaattggtgtcatccccagaccctcctcagccttgcaaaggtgagactcaaagctgtccatatttctattggtatggagatagttccaacacaacgggtgattttgcacttgaaacattcactgtgaatctcaccacacctgagggaaagcctgaactcaagattgttgagaatgttatgtttggttgtggtcattggaatagaggactttttcatggtgctgctggattgctagggttggggagaggcccattgtcatttgctactcagcttcaatctctctatggtcactccttttcctattgccttgtggataggaacagcaattcaagtgttagtagcaagttgatatttggtgaggacaaggagcttctcagccaccccaatttgaatttcacttcttttgttggtggcaaagagaaccctgttgacacattttactatgtccagataaagtccatcatggttggtggtgaggtgctgaagattccagaggagacttggcatttgtcagcacaaggtggtggtgggggtacaatcattgattctggcaccactttgacctactttgctgaacctgcttatgagattatcaaggaggcattcatgaggaaaattaaaggttttccactagtggaaacctttccccctctaaagccatgctataatgtgtctggtgttgagaaaatggagcttcctgagtttgcaatcttgtttgctgatggagctgtgtggaattttcctgtggagaattacttcatccagattgaacctgaagatgttgtttgcttggctgttttggggactcctatgtctgcactttcaataattggaaactaccagcagcagaattttcacatcttgtatgatgtgaagaaatcaaggattggatatgcaccgatgaattgtgctgatgtttaa

SEQ ID NO: 72805 - DNA, 201 bp, Glycine max
  Peptide Sequence Number=SeqID_164490
atgagaggcgggtgcagtagcgataatgggaaagggaagagggagtttcaccagtaccaggttgtggggagagctcttcccactgaaactgatgtgcatcctaagatatacaggatgaagctgtgggccaccaatgaggtacttcttgagaaagctaaagaaggtaaagaaaagcaatgggcaaatgttagccatcaatga

SEQ ID NO: 72806 - DNA, 300 bp, Glycine max
  Peptide Sequence Number=SeqID_164491
atgtggaccaccacgggggagaagcttgccgcccagctcgcccaggcgagctcagttcgcccaggcgagcaaggttgcttcctccagaagcaacagccttctggaggaatcttttggagggcccagttttttgaaggagttacggaaacttacggattgcgcaaaaacacctcttttcgacttccaccacattacggaatttcacggatcgcgcaagcctgcttccttttgatttccgagacgtctcgggacttcatttatttgtgcaacaaaggacgccaagtacctcaaagcggctaa

SEQ ID NO: 72807 - DNA, 248 bp, Glycine max
  Peptide Sequence Number=SeqID_164492
atgagggttcatatcacaaagcccccgagcggagaaggagtttctctccgggttccttgttcaaccaattatcagacttatcaaggtaatccttgtggcgtctacccagacttatcttccttcaccggaagtggcgtctaccctgacttatcttccttcaccggaagtggcgtctaccctgacttatcttccttcatcggaagtggcgtcatccaaaccttcgtaacctgtatcaaacgttccgcccc

SEQ ID NO: 72808 - DNA, 310 bp, Glycine max
  Peptide Sequence Number=SeqID_164493
atggctcaacctccacctcgtgagaggactctaagggaaatggctgcacctgatttcacttatgaaagcttgtgcattcaataccctgatgaggatgtcccatatgttcttaaaactggactgatccacttgttacccaagtttcatggtcttgcaagtgaagaccctcataaacatatgaaagaattccatattgtctgctccatcatgaaacctccagatgtcctagaagatcacatttttctgaaaggcctttcctcattctttagagggagtggccaaggactggctatattacccttgctccaag

SEQ ID NO: 72809 - DNA, 351 bp, Glycine max
  Peptide Sequence Number=SeqID_164494
atgggacctctccaaatgcaagccttccgcaaggcgtacggaaagatcttagatttgaccatagcagagatatccatagaagccattgcatcactcacccaatactacgaccagcccttgagatgcttcacatttggagacttcgaattaggattcaacgagagaattggaccgcgtaaagcaaactcaaaatggcatagtgggcctaccacggaagtacttagaaggcaaggcgagggatatggcaaatcaagaggagtgagttccatttatggatgtattagcattgctaatctttggggttctcctctttccaaacgtggatgggttggtggacctagccgcaattga

SEQ ID NO: 72810 - DNA, 573 bp, Glycine max
  Peptide Sequence Number=SeqID_164495
cattcaggcatcactcccaacaaagttgccaatgctgccgaattaagcaatgatgttcctaagcaggaccccttgcgtgagttgattaagacccttgttgacatttatgacaagcctgttgagtttgtgtgggatcttactgaatttgggattccaaatgtaaattcatcgttgttcttaacgtatattgatgtcagcgaaataacatcaggcgacaaatggttgaacatagccatacttcaattgtggaccatgtatatgaatgagtggagtaatggcttgggttatcaatcggtgtatggattccttgagcctcaatctatacacaatgcaaaggacagacgtgggcaatgtgaagaatatatcgaaaaatggcttaaggaatcgcaacgacaactgtacattggagcttatttgaatgacgcccattggcaaatggttgtgttgtgccctaaagacaatgtcgtggtctggttttgttcagtgcgtagaaggcctgattgcatacaagaaattaacacgactgctgatggcaaagttcctaaaactggaccccagtggcttgaactgaag

SEQ ID NO: 72811 - DNA, 369 bp, Glycine max
  Peptide Sequence Number=SeqID_164496
atgacatcattcagccagatgcagtcccactttcggtcccagatgcaatctcagggacttgcactgcctctggatcctctggttggtccctcaggtcctcgagtaagcacaaaggagagttgtgttgttccctcaggaaacaatcctacgacgggtgactcagataggtgcggcttatacatcgaagcaaaggaaattgtgtctccggaaaaaccacctcaaaacccggatccgaaggtcgatgatctgctttatcatatgacattgaccatcccagagcttttcttgaggccttacctggggacactggcagatggtggtcatcctgcccaaggaatacctagttgtttggttttgttcattgcataa

SEQ ID NO: 72812 - DNA, 162 bp, Glycine max
  Peptide Sequence Number=SeqID_164497
atgagtcccattagtcacaacattttatacttcaatgaccaagacgatgaccaatcccacaaggtggtggacgccgattacgtcgcggatttcttctttccactgaagaactttgaccttgttctccaaacgaatatggtgcatcgaacagttgtaaagtag

SEQ ID NO: 72813 - DNA, 429 bp, Glycine max
  Peptide Sequence Number=SeqID_164498
atgtcatgctctcgtgcgttgtcatcacgttggaccagcgtgaatgaggaactcgaacagcttcttgcaaatgtgcccaagcatggggaatggaaggaattgacaaacacgatgcaggatgtcgtgactccatcagaggcttttttccataccattagcgccaaggaccaagtcattgaagttggtaaggtatatgttgtcaagtggaaggacgtactggacaggtggacagcactacgcgatttttacccgctaatcggagatcatctagtatccttgcatcattatggttctgtgaccttcaaggtttatctcattgagcagaaagtttcctgtagtagtctggatgtttcaagtagcatgtattattttttgaaagacaaaggctggactcatttgcacttggaggacgttgcagaatgtcggctc

SEQ ID NO: 72814 - DNA, 192 bp, Glycine max
  Peptide Sequence Number=SeqID_164499
atgcattccaagattattttgatgatgccaaagaatcaagactcaaacaagtttcaagaatcaagatcaagattcaagattcaacccccaagggcattggatagaagactccaagaagattgggccaaagatgcaagagaaggccctagggttctcatgagccttcgggcagatttcagggccatgggctaa

SEQ ID NO: 72815 - DNA, 240 bp, Glycine max
  Peptide Sequence Number=SeqID_164500
atgatgtttatggattgtcatcatcaaaaagggggagattgtggaagcaatgacttccaagattattttgatgatgccaaagaatcaagagttaagcaagttccaaagattcaagaatcaagtttcaagaatcaagaatcaagattcaagattcaagattcaagaatcaagtttcaagaatcaggattcaagactcccgattcaagaatcaagagaagactcaatcaagataagtactaa

SEQ ID NO: 72816 - DNA, 297 bp, Glycine max
  Peptide Sequence Number=SeqID_164501
atgtacaaagataattggacccaaccttggcccatgggctcagaaatctaccctaaggttcatgagaaccctagggcgttcttcagcagctctagcccaatcttcttggagcatcttgctcattgttcttgtgattggtcccttcctagggaggattgcatcatgcatggtgacatgcggtgttacctaatggttacccccacctttggtcaaccagtggcaaacaagcccgttgacgcacagagactaggatcgtctgctgcaccttttgtcgtcctgacccgtgaagtcaggtga

SEQ ID NO: 72817 - DNA, 351 bp, Glycine max
  Peptide Sequence Number=SeqID_164502
atggctgctgtcagaggagctgggttggatgatgaagggatgtcatcggttcttgccctttttcttgatgccatctgcaagaaagggatccaaacaactgcaaaacgaacagggtcgttcagctcaaaaaattccgcaatgaattgcacttggcctatggaagctcggcttagcgcgcggttatcaacacaaaatttgactaagttacctggtcttagcgaatcatcctcgcttagccacaggttctttatcaagaggatgaatattcatcctcaaaagataaactctcttagcgcgataagctcgctcaacgagttctttcgaaaaacgcaaatattcaatgaatattga

SEQ ID NO: 72818 - DNA, 639 bp, Glycine max
  Peptide Sequence Number=SeqID_164503
atgtgcccggtggtcggttttggcccgtggctaggtcttggcaagccgttggttgaaattttgccccccggtcaacttcgtggtttttgcccgttgttggcttggctagggtcggcggtgctgggttatggccccgtgctaagtttcggattggttggccccctcctcccccccgtgatcagttttgttgccaggattttgccaactttggcttgcgccccgttggctaagtctgtgcctcggtgggtttgttgtgatttggagggagggacgatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattgtgcgaatcaacggttcctctcgtactag

SEQ ID NO: 72819 - DNA, 1062 bp, Glycine max
  Peptide Sequence Number=SeqID_164504
gagtatgtggccggctttatcaatgctgactgggttgaatcactgaccgccacatccgaacgcagccgtcgtctgtcaccgccggcattccgctatcagctcaccgaactggcgcgtaaagccggcaagcgcatcgtcctgccggaaggggacgaaccgcgtaccgttaaagcggcggcgatttgtgccgagcgcggcatcgccacctgtgtgctgctgggcaatccggatgagattcagcgcgtggccgcagcgcagggcgttgagctcggtaaaggcattgaaattgtcgatccgcaggtggtgcgtgacaactacgtgccgcgcctggttgagctgcgtaagagcaaaggcatgaccgaagtggtcgcgcaggagcagctggaagataacgtggtgctgggcaccatgatgctggaaagcggcgaagttgacggtctggtctcgggcgcggttcacaccaccgccaacaccattcgtccgccattgcagctgatcaaaaccgcgccgaacagctcgctggtctcctcagtgttcttcatgctgctgccagaacaggttctggtgtacggtgactgcgccatcaacccggatcctaatccggaacagctggccgagatcgcgattcagtccgccgactccgccaaagccttcggcatcgatccacgcgtagcgatgatctcctactctaccggtaactccggtgccggtagcgacgtagagaaagtgcgtgaagcaacgcgcattgcgcaggaaaaacgtccggatctggtgatcgacggcccgctgcagtacgacgccgcgatcatggaagacgtcgccaagtctaaagcgccgaactcagcggtggccggacgtgcgacggtatttatcttcccggatctcaacaccggtaacaccacttacaaagcggtgcagcgttctgccgacctgatctccatcgggccgatgctgcagggcatgcgcaaaccggttaacgacctgtcacgcggtgcgctggtcgatgatatcgtctacaccattgcgctgacggcgattcagtcgcagcaggctgaaggctaa

SEQ ID NO: 72820 - DNA, 225 bp, Glycine max
  Peptide Sequence Number=SeqID_164505
atgtcatttaggactgtgggaaagcttgggctgtgcaaaggaggaaaatcagtgaccaaagtgaaggcaagagtcatttctaggaaaatgcttatgcatggctggttgtggaaagggttgtacatattcggttctggacgttttctagcagatcccaacggtcaaaatcttggagagattgatggggacccggtgttgagaggaatgaggataaaggctacgtag

SEQ ID NO: 72821 - DNA, 465 bp, Glycine max
  Peptide Sequence Number=SeqID_164506
atgaagatgaacatgaacttaggatcacttattcctggtcagatttcactcattgctcagtccaactcttcgtggcttggatttccagccttgattattgccttgtgcaaggcccgaggagtcacctcagattctctcacttatgagtcacttggcccagccattaatttggcttatattaagaagaattactggaacctggatgacctttcagtcacttttccaaggacccaaaaatccagggctagaagatctgaggccccatctcctttagctgcccctgctccccctacttctgctccctctacttctactctcccttcaccaccagcagctccagttcttccagagcctacaccagggccagctcctgattatgcagagcttgcaggatgtggtctagcagcgggtagttatgagcctggaggagtttgttcagaaggtggtgtggcgtccccaaaataa

SEQ ID NO: 72822 - DNA, 801 bp, Glycine max
  Peptide Sequence Number=SeqID_164507
atcccataaaaacttctttcgaggaatgggcaaaaccaggtcatttctcaagaacaatagctaagggacctgatactactacttggatctggaacctacatgctgacgctcatgattttgatagccatactaatgatttagaggagatttcccgaaaagtttttagtgcccatttcggccaactctctatcatctttctttggctgagtggcatgtattttcatggtgctcgtttttccaattatgaggcatggttaagtgatcctactcacattaggcctagtgctcagatttggagagcatctggaataactagtgaattacaactctattgtaccgcaattggtgcattggtctttgcagccttaatgctttttgctggttggtttcattatcacaaagctgctccaaaattggcttggttccaagatgtagaatctatgttgaatcaccatttgacagggctcctggggttgggatctctttcttgggcaggacatcaaatacatgtatctttaccaattaaccaatttctaaatgctgcagtagatcccaaagagattccacttcctcatgaatttatcttgaatcgggatcttttggctcaactttatccgagttttgccgagggagcaactccctttttcaccttgaattggtcaaaatacgcagaatttcttacttttcgtggaggattagatccagtaactggaggtctatggctgaccgatattatacaccatcatttagctattgcaattcttttcttgatagcgggtcacatgtataggactaactggg

SEQ ID NO: 72823 - DNA, 423 bp, Glycine max
  Peptide Sequence Number=SeqID_164508
atgggattgagtcaggtgcctcggcttaaaaagaggttctatcaagtcaagatcaagagcctaggagttgccagtctgaaagagttaggacaattgatgggtcaactccagcgacaaacctttcgcaaagcctatggtaagatctgggacctaactatagtggaggtctccacggaggccattgcctccctcgcccaatatcatgaccagcctttgagtcaaaatctcgacacaaaaattggaccggggaaagtaagtcaaaaatggggtggttggagtaccaaggaaatgtttggaagcaaaggcgagaaccttggcaagtcaagaagaatgggccccgttcatggacatcctggtgctcctgatcttcggagtggtcctctttccaaatgtagatgggttggtggacctggcagtgattga

SEQ ID NO: 72824 - DNA, 372 bp, Glycine max
  Peptide Sequence Number=SeqID_164509
atggaactattgagactaaatcaacatgaagaaaatgataagaaaaagaagggaattgctcttaaagcttcatcttcaatccaagaagaaagtgataaagaagacttaattgatttgaatgaagatgatgatcttagcctttttgtaaaaagggttgattgcccaatcttcaagaaaagaaaggagaaatctgaaaagaaaaattttagtgaaaagaagatgaagaaggcctacatcacatgggatgacaatgatatggaatcatctgaggattcagaaaatgaagagataaatctatgtctaatggctaaaagttatgaaagcgatgaagagagaatcaatcaaacttgcaaagttagtttcatcttctaa

SEQ ID NO: 72825 - DNA, 441 bp, Glycine max
  Peptide Sequence Number=SeqID_164510
atgatgatttggaaacaacatgcaaaattagtcatggccacagccaggtgggcactcaagcatcccatttatggcattgtgatactacggttgggagtttacacaaacagacccaaccatttcatttctaaacgaccatatagaggaaacactgggtccaacagagataggagaaaatcactcaaagtgtatcaatctcacacagtgcgtggcgagaaagtcgctagcgcacaggattttgtcggcaaccaaagggagaggaccactttaggtcgtgggcaaggatcgacattctcaccctgggtcaaggtttatgataagttgggattttggctcaaggcttgtggaacggctggtcatgatatatgtcagggtttggccagcggttcggggattaaggggatgtcctacattatttccatgatacacatgcaactatga

SEQ ID NO: 72826 - DNA, 141 bp, Glycine max
  Peptide Sequence Number=SeqID_164511
atggcaactatcagtaaccatgtcatcactgaaaatgtcagaaaattgataatgttcaaaaatcagtttgttcctagacagcaagatgcagtagactgtaattgctatagtcagacaacgaaattttccttgaacacctga

SEQ ID NO: 72827 - DNA, 503 bp, Glycine max
  Peptide Sequence Number=SeqID_164512
ggatcgcgcccacaagacacccagtagacccgaagaagtccagcagggccctggggtttccagctctggttacaggcctctttcagtcctaccgggtgcccatccccccagcgaggtcatgccatcgtgacataggaatcacacccacaaagacacttagtggacctggagaagtccaacagggccctgggggattgcgcctgcaagacacccagtggacccgaagaagtccaacagggtcttggagttgtcaagctctaattacgggtctctgtcagttctacggagtgcttgtcacctccggcaagggcatcaggccccctactaatcgagctttcatcaagaagtactgcgtccccaagcaggcgcagggcgaaacaccacatcagcctggggatggccgacagcgggcaacagacgcaccgccatcacctctagagttcacctcagctcatccacaaaaaaggttagagcgttgcttacgacccatggccgaccaatag

SEQ ID NO: 72828 - DNA, 591 bp, Glycine max
  Peptide Sequence Number=SeqID_164513
atgtggtatgatgaaagaatttcaaaagatagaaatacaacaagtccaaaattcagcttatgttgtggagatgagaaagttgagcttccgttattacaaagtccaccgaaatatcttgaacgacttctgtttgatggtaaagaaagtgatagtaaaaattatcagtgcaacatacggacatacaacatgatgtttgcctttacgtctgctggtattaagctagacaaatcaattaatgaaagtagaggacctcctacaattagaattcagggtcaaccatgccatcgaataggcagcttattaccaatgcctggaaagcaaccaaaattttcacaattgtatatctttgatacgcagaatgaagttgaaaatagaattaatacaatgagtcaacatgttagaattcaaccagagattgtttcaactttaagtcaaatgttggatgagtacaatgttcatgcaaaaagttttagaatggccagggacaaattggcaaatactcaagtcgataatactcaagaagggatattattgttgaaactcaaaatggagaattacaaagaatccatgaattacactctagctatctag

SEQ ID NO: 72829 - DNA, 84 bp, Glycine max
  Peptide Sequence Number=SeqID_164514
atgctggctgctgtaaagatttcacaaacatcatttttggattcggatactgaccatccttcgttgactccacagggagattaa

SEQ ID NO: 72830 - DNA, 3255 bp, Glycine max
  Peptide Sequence Number=SeqID_164515
atggcttccaacaacaacagcagcagcagcagcatcatcgtccaacattgcaactactcttcatatgacgtgtttgtgagcttcagaggtaaggacacacgcaacaattttactgatcatctttttggtgcattccataggaaaaaaattcgtacatttagggatgacacaaggctgaagaaaggggaacgtatactatccaacctcatgcaagcaattgaggggtctcagatttttgtcattgtcttctcaaagaactatgctttttcatcatggtgcttgaaagaacttgctaagatccttgattgtgttagagtctccggaaaacatgttctgcctattttttacgatgttgatccatctgaagtgcgaaatcagacgggggattatgagaaagccttcgccaaacacgaagatagagagaagatggaggaagtgaaaagatggagagaagctctcacacaagtagccaatctcgctggttgggatatgaggaataagtcacaatatgctgagattgaaaaaattgttcaagagataataagtaaattgggtcacaatttttcaagtcttccaaatgatctagttgggatggaatctcctgttgaagaattagaaaaacttttacttttggacctaactgatgatgttcgcattgtaggaatttgtgggatgggtggaataggaaagacaactcttgctactgttttatatgatagaatctctcatcaatttgatgctcactgtttcattgataatgtaagcaaaacttatagacattgtggccaaattggtgttctaaagcagctgcttcatcaaactctaaatgaagaccttcagatatgcaatctttaccacgcagctaatttgatgcaaagtaggctacgctatgtaaagagcattatagttcttgataatgttaatgaagttgaacaactagagaaattagttttgaatcgtgaatggttaggtgcagggagtagaatcatcataatttctagagacaagcatgtcttgaaaaagtgtggagtgactgtagtctacaaagttcaactcttgaatggtgctaattctcttaaattgttctgtaaaaaagctttcgattctgttgatatcacgggagattatgaagagttgaaatatgaagtcttaaaatatgccaatgacctaccactagcaattaaagtactaggttcggttttgtctggtcgaagtgtctcatattggagaagttacttggatagacttaaagagaatcctaacaaagatattctggatgtgcttcgaattagttatgatgaacttcaggatttggaaaaggaaatatttttagatattgcttgtttcttctgtggaaacgaagaattatatgtgaagaaagttttagattgttgtgggtttcattctgaaattggaataagagccctcgttgataaatcactcatagataattcaagtggattcattgaaatgcataatttgttgaaagttttaggcagaacaattgttaaaggcaatgcacccaaagagccaggaaagtggagcagggtttggctccacgaagatttctacaatatgtcgaaggcaacggaaacaacaaacaatgaagccattgttttagacagagagatggaaatattgatggctgatgctgaagcattgtccaaaatgagcaaccttaggttgctcatattccgtgatgtgaagtttatgggaatacttaattcagttaattgtctctccaataaactacaatttcttgagtggtataactatcctttctcctatttgccatcaagttttcagccgaacctgctggttgaattgatcttgcaacatagcaacatcaaacaattatggaaaggcataaagcatctgccaaatttaagagctttggatctcagttactccaagaatcttattgaggctccagactttggaggggtccttaatcttgagtggataattcttgaaggatgcacaaatcttgcacggatccatccatcagttggacttctaagaaaacttgctttcttgaatttgaaaaactgcattagtctagtaagtctacccagcaacatattgagtctaagttctcttggatatctaaatatctctggctgtccaaaagtatttagtaatcagctgttagagaaaccaatacatgaggagcattctaagatgcctgatatcaggcaaactgccatgcaatttcaatcaacatcctcctccatcttcaagagacttattaatttaactttccgttcctcctactattctagagggtatagaaattcagctggttgtttgttgccttccttgcctaccttcttttgtatgcgtgaccttgatctaagtttctgcaatctaagccaaatccctgatgctattggatccatgcattctttagaaaccttgaatttagggggaaacaactttgttagcctcccttatagcatcaaccagctttcaaaacttgtacatttaaacttggagcattgtaagcaattgagatattttcctgagatgccatcacctacttccttgcccgtaataagagaaacctacaactttgctcattaccctaggggattatttatttttaactgtcctaaaatagttgacattgcacgttgttggggcatgacttttgcatggatgatacaaattcttcaggttagccaagaatcagatacccgtattggttggattgacattgttgttccgggaaatcaaataccaaaatggttcaacaatcaaagtgttggtacttcaataagcctagacccatctcccattatgcatggcaatcattggattggcattgcttgctgcgtggtatttgtggcatttgatgatgcaactgatttgcatccgaatttgagatcctctataagaattggttttaaaacagagtcctactcttcctctcttgatattcctatacttattaataaggatctagtaacggtcggattgcatcacttgtggctactctatttgagtagggaggagtttttttcctattttaaaatagaaaaaatgcttgatcttcacggcatcaaaatgcaatccaccgtctggcactctcaaggtttaaatttggaggtgcacggttgcggatatcagtgggtatttaaggaggatttggacaccctaaacctaacaataatgcgaagaggatacaacgaaactcacgttgatgatgattttgtgaagggcgtttcaatcctttctttggaagatggaaactag

SEQ ID NO: 72831 - DNA, 195 bp, Glycine max
  Peptide Sequence Number=SeqID_164516
atgaccggagacgcgaccatgtccttcattgttgaccccagcaaaggtaaggccagacaaaggtgtggtgacacgaaggtgttgcggtggtggccggaggtgttgatgccgacaaaggtcacacgagacgaatgggccatggcgaagaggaagaagatatataggagcagagggggaagcttctggaggtggtga

SEQ ID NO: 72832 - DNA, 348 bp, Glycine max
  Peptide Sequence Number=SeqID_164517
atgttgaagctccaccagggccccttgccttcccaacctgctcatttaccacccacaaatactaacaatcaccttgatattgaacccctttctctgctagattggaaatgggacacttctgcttcacctcccaccaaacttgtgttggttcaatggtctggtctggccctagaggacatcacatgggaagcttgggatgcactgcctgactcttataaccttgaggacaaggttaatttcccagagggtggtgatgttagcgatatcagccctgcaactagttcagctaatgctagcagacccaagaggtgcagtagaagaccaacccacctcaatgactacatttag

SEQ ID NO: 72833 - DNA, 153 bp, Glycine max
  Peptide Sequence Number=SeqID_164518
atgccacgtcactccccattggtgcgttataagcacgctccacagaagccaggttttggatgtatggcttcggagcctatggttggaggagatgatgaagctagagagaaacagagattcggggagagaaaggtttacacgagaggaaagtaa

SEQ ID NO: 72834 - DNA, 366 bp, Glycine max
  Peptide Sequence Number=SeqID_164519
atgctactaggtttatatgcatctagagcagcttcaaattttgcctcatgttgggacaaggaagggacaaaggagaacacacatcttttagaagaaattgaaaagatcttatgctatgtatgtgatgaagtctgcatatgcttgctgcattcgtatggcttgctacattcgtatcaccatagagtggtggcagtgaagtgccttaagaatgttacaagtggagatgttgagttttgggcagaagtcacaatcattgccagaatgcaccacctccaatatggaactgaatttgagttagggattaggatattttttatgataatgagtgcaatatttatatacagtgagcaagaatctatcccttaa

SEQ ID NO: 72835 - DNA, 270 bp, Glycine max
  Peptide Sequence Number=SeqID_164520
atgaagccaaggggttacatagaattcaataatgtacaagatgatgtgccttaccaagtagaggaaatgtcacatgtcaacgaagtcattgaagttgaaagtatttctggattgcaagatttaagaggtggtgttgaagtagaccatgctaatatgttgacaaacgaagaagaatcaaataatttgaatgaagaatcaaatagtattgaacaagacaatgaagaggaattagaagatgactttaaagcatacaattttgaagaggattag

SEQ ID NO: 72836 - DNA, 192 bp, Glycine max
  Peptide Sequence Number=SeqID_164521
atggtggtagccagtgataaaccagtaattatagacaagaagttggctgaaacacttggagaaataaggtggaactacaaatctcttactatggaatttgaacatgctgggaaaacagtgaagctcgtgggagaacaacaatgtcgacagcaccaaggagcatctacaactatgaattgcattttaccataa

SEQ ID NO: 72837 - DNA, 246 bp, Glycine max
  Peptide Sequence Number=SeqID_164522
atgaaaatcaacccacaaacaagaatgaaaaacgttatggaaaaaggtcttgagcagggtgaatgcatgccgccagcaggaatgacgagtcctccacggatggtccacgtggcagtagactcgccagcaccagtggcgatttcgtgccagctggtctcgccaatcaaactggcgagttggtcccagtctcaccagacgcagtggcgacatagccatgcactggtgcagatgggcagagcgcaatga

SEQ ID NO: 72838 - DNA, 472 bp, Glycine max
  Peptide Sequence Number=SeqID_164523
tgatgtcagcaacaacggttatgataaaaataccaatggtgatcgtgatgacagtggtggtggaggtgacaatgacaatatagtggtggtagcggtgttggttgtggcagccaatcgtaacaatgttggttttggtggtggtgacagaggtgatattagtggtagtgtggtggtggtggtggttgtagcgattggtggtggtgataataacaatggcagtgatgctgatattatggtggtggtggtagtagcaatgttggtgatgatgatgatgtcagtgatggtggtggcaccaagtggtggttgtatagtggtggtggtggctaggatgacattggtagtggttgtggtgacaatgatgaaggtggtgatagtgataacggcggtggcaatggcaacgacactaatggtggtggcaatgatgaaagtggtattggtggtggtggcagtgacaatggtgataatggtgtaa

SEQ ID NO: 72839 - DNA, 690 bp, Glycine max
  Peptide Sequence Number=SeqID_164524
atggcgtcttccaacttttcagagttggacttcgaggccatgagagcgagacgagagcaccaaattgttaggaatgcgtttataaattctgggcttcgagggccagacctcccaaaacaaagaagaaagctaagtcctaacggaaatgagaaaatattcctaaagtggcagacaagatcaaggcaccgatccttagatgtccagctcatcaatttcggttatccagctcagcttctctgctcaaacgaagtctctgaggtatgttggtatcttcttcttccttttggggttcaaggaagtgacggcagcgttgttgttgaagtcgcagctatcgtcggtcatgccatgtttcagaaaatagtcgttgaaggcaaacgacgccgtattctggacgctggtggggtcgtagcagggcccaccgcgctggattgggcggcagtcggcgccgccggccccgcaggcccagtccagcgcggcctgcagcgccgcgtcctccgcgttgttcttcgccacgcaccacagctcctgcggcggagcgccaccgccgccgtcgccggaacagaggcccagaaggaggaggagcgaaagaacgaggctttttgggggaagaaagagaaatgggtggtgttgggttgggaattgggatttatgttattgtgtgtgaatgaagatgaagatgaagatgcttga

SEQ ID NO: 72840 - DNA, 2442 bp, Glycine max
  Peptide Sequence Number=SeqID_164525
atgggtcacattccaaagcaatctattttcatccacaacaacatcatatcctcttacattgcccttggcgaagtgcttaatgcacgcaagttgttcgacgctttgccccacagaacagttgtctcttacaacactcttatcaccgcttattgtcgacgcgggaatgtagatgatgcttggaacttgctctgccacatgagggggagtggttttgctcctacccagtataccctcactgggttgttgtcgtgtgagttgttgaatcattctcggggtgttcagttgcaggcattgagcattagaaatggactcctcgatgccgatgctttcgtgggtactgctttgttgggcttgtttgggaggcttggatgttgggatgaactgtttttggcgtttgaagatatgccccagaagagcttggtgacatggaactccatggtgtccttgctggcacgtaatgggtttgttgaagagtgtaagattttgtttcgtgatcttgtggggacagggatttctttgtccgaaggttctgttgttgctgttttgtctggacttgttgattctgaggaggatttggaatatggtgaacagatccatggcttaatggttaaatgtggatttggttgtgaaatcactgcagctaattctctcatcagtgtgtatgtcaggtgcaaagccatgtttgcggtggaaagattgtttgaacaggttcctgttgagaatgttgtgtcctggaatacagtcattgatgctttggtaaaaagtgagagacctatgatggcactggatctgtttctgaatatggcaaggagaggattgatgccaagtcaggccacgtttgttgctgttattcactcgtgtactagtttgagaaactcagtatgtggagaatctgtccatgctaagataatcaggagtggttttgaatctgatgttattgtgggtactgcattggtagacttctactccaaatgtgataaatttatttcagctcataaatgttttgatcagatagaagagaagaatgtggtttcttggaatgctttgataacgggttactcaaacatttgttcttccacatcaattctgttgttacaaaaaatgcttcaattgggttattcccctaatgagttttccttttctgctgttctcaagtcatcttcaatgtcaaaccttcatcagctccatggtttgattattagatcaggttatgagagtaatgaatacgtattaagctctcttgttatggcttacaccagaaatggtctcataaatgaagcactttcatttgtcgaagaattcaataacccacttcctgtagtcccatctaacatcattgctggaatctataacagaactagcctgtaccatgaaacaataaagctgctttctttgctagaaaaaccagatgctgtatcctggaacattgtcatttcagcttgcgctcggagcaatagttatgacgaggtttttgcgcttttcaagcacatgcattctgcatgcatccatccagatagttacacatttatgagtataatatctgtgtgcaccaaactttgccttctcaatttgggcagttctcttcatgggctgattataaagactaatcttagtaactatgacacatttttgggcaatgtactaattgacatgtatgggaagtgtggaagcattgatagttcagtgaaggtttttgaagaaattatgtacaaaaatattattacatggacagctttaattactgcccttgggctgaatggttttgctcatgaggcggtgatgagattccaaaacctggaattgatggggttgaaacctgatgcattagcactcagagcagtgctttcttcttgcagatacggtggattagtaaacgaaggcatggaaattttcaggcagatgggaaccaggtatggggttccaccagaacatgatcattaccattgcgtagtagacctcctggctaaaaatggacaaatcaaggaagctgagaaaatcattgcatgcatgccattcccaccaaatgccaacatatggcgtagcttccttgaagcacacgtcaaccaaatggctaagcgtaagaatcctatcaagctgacgatggtgggaaggattgaatgggacattcacttgccacctacaacttccatatctgcctttgcattcagtggtattgggagtggttcttcaaaatgcaaggtgaatggtgctcctaccaaggaggatggtgtttccagcatcatatgtttgttatgccggcttgtgattgtcaccttcggccttggtttgtccgagccagaaggtgaaccaatctggattggtcaatccggaagtcaaaaaaggatgcaggaagcaatttttgggtgcagaaagcaacagccagaggtgcatggtgtagcaagcttcaattgggcaagagcgtgtcatcttattgggccttaa

SEQ ID NO: 72841 - DNA, 1140 bp, Glycine max
  Peptide Sequence Number=SeqID_164526
atggcagagtttggtattcgaatcatgttattgctggcagcttgcttgcttccactatctggggaagctatggttcgctactacaagttcaatgtaggccaaagaggcacactttggtggcatgcacatatcctctggcttagggccactgtccatggtgccttggtcatcttgcccaagcttggagttccgtacccttttcccaaaccaaatagggaacaagttatcatattgagtgaatggtggaaatcagatactgaggctgtaataaatgaagctttgaaatccggtttggctccaaatgtctctgatgctcacacaatcaatggccatccaggacctatccaaggctgtgtgcttcacaaggcaaagtccaagaaccaaaatctaacttttgacgtaattagaccaagccaatgtgactcaaattctaacaagttctccacagtagctaaagccaaagaaaaaatggaaaaaaaaaaatcaggagggtttaagttggatgttcaaccaggaaacacctacttgctaagaatcatcaatgctgcactcaatgaagagctcttttttaaaattgctggccatgaactcacagttgttgaggttgatgcagtctacaccaagcctttcaaaactgataccattctcatagcacctggccaaaccacaaatgtgcttctaacaaccaaacatgaaactggcaaatacttggttgcagcctctcctttcataaatgcaacaccacttgccaccactttcaccgattctctccgaagcttaaactccgaaaagtatcctgctagagtccctttaaggattgatcataacttgctcttcacagttagcctcagtgtcaacccttgtgctacttgtgtgaataatagcagggtggtagcagatatcaacaatgtcacctttgtgatgcctaaaatttctcttcttcaagcacatttcctcaagatcaagggtgttttcaccgatgattttcctggaaatcctcctgtagtgacaagggaatttcaacccgcaaaagatgccaagaaattcaaccttggagatcctgtggagaaaaatacagttggagttccggctggggggtggactgctatcagattcagggctgataatccaggtatataa

SEQ ID NO: 72842 - DNA, 465 bp, Glycine max
  Peptide Sequence Number=SeqID_164527
atgggaatatgggatattttagactctcaccataggatagtatgttccctgatgaggtgtcgtcgaaggccaccttgtcatcggagtggtcgagctaaggtgcttgtggcattgggaggggctttcgatggtttgacgtcaatggctccaacagtggtggctaactgtgaagcacagggacacctactaggtggcgtcccccatttccagtactgcatagggacatggacggaacgggggacgacgttaatttcttgggtacggatgggcaagacggggacgacaatggctgggattttagggctgaatgcttcatattatctgaaaataggagtaaacatggcttccaatgattctaatgttggtagtagaagtgataattttggtagtgatgttgttgctagtaggagtggaagtgggtacttgtctttcttaataccaaatgaaaatgcagctcctttatga

SEQ ID NO: 72843 - DNA, 723 bp, Glycine max
  Peptide Sequence Number=SeqID_164528
atggcgcaaatggcattatacctgaatttgttcatattattaggccgtgggttaggagctagtagaggtagaggcattagtgaggatacgcatgaggctgatgttcctctgcgccgcagacctactacttcagcacgtaggcaacaggttcgtctgcgtgaggacgtggcagagagacctgaggatgtgcctcagttgcatgaggatgttcctcatgtgtctgatgtcaccccagagatgacaagtgccgccgatgctgttcagacagagagagtggctactgatgggagcttggggtcacctgctgcagatgagggtttccccggtggaccacacgacccatcgattttgactgattttgctgagcatgtcgcacacaacatctggagtggacaggaacgacccgatctgaagttggtctcccacgatagaaaagtagataaaattggaagaccagcgcctgagatcgaagggttgattgctggcaccggattgagtccactgatcaggtgttctgttatcaccactgatcctatactcatatccgccttcgtcgagaggtggcatcgcgagactagcacgttccacctgccagtaggcgagttgacgatcacgttggatgacgtggcgtcactcctacaccttcccatcactggcgcgctgcatacgttcgagccgcttgttacttcagacgccatttgtctactgacggagcttcttgag

SEQ ID NO: 72844 - DNA, 483 bp, Glycine max
  Peptide Sequence Number=SeqID_164529
atgcatgaatatcctaggggaacctgcgcattaacgtgtaagcattcctttcaaaattcatatggatgttcatgctttgttgggaaaagggaaatggctccgaagaaactctccacgaagaggtctagaagagacgtcacaacggaagggtccagtgccaccccggattttgatagtcatcgtttctggagcgccgagcaccagcaacgcttcgaggccatcaaaggatggtcgttccacagagagaggcgtgtccagctcagggaggatgagtatacagactttcaagaggagatagctcgcagacgttggacgtcgctggtgactcccatggctaagtttgaccctgagatagtcctagagttctatgctaatgcttggcccatagaggagggagtgcgagacatgcgttcatgggtgaggggtcaatggattccctttggcgtagatgccctcagctgttggaccttgtggcctcaataa

SEQ ID NO: 72845 - DNA, 474 bp, Glycine max
  Peptide Sequence Number=SeqID_164530
atggcttctccacctgcctcccctcctcctgctccttcggacgcattggcttcgccgtttgccgtgaagcggacacgcaaagcctcacgtctacgatcgttgtctactagaccacctggtgctgagagaccagtggtccatgttgatcctgctaccagcaaggccgacggtccccacaggaagaaattaagaacatatttggggattgtggtgcgtgataaggtggacgtcacctacgagaactggaaggaggtccctactgctcataaggacctaatttgggaggatattcaggcggaatttgaaatcctagaggcttctgacagtaggatgaaaaggaagttacttcagaccgtgggcgagagatggaggcagtttaaatcagacctcacgaggaaatgggtccttgcagttgataaggacagtgtggaggacactgtctatgagaaatacggcattagcaaggaaaaatag

SEQ ID NO: 72846 - DNA, 351 bp, Glycine max
  Peptide Sequence Number=SeqID_164531
atggtgaaagttggaacctcttacgtgccgatcaacgtctcattttcgccaaaagttggcccagggcttccccggtatcaacagggacaccaggatttatttattctgcgaagtgatcttccgtcacagtggcttctgtttctatcagctgtcccccctgttcagctactgacggggtggccgcgtaacggcaaaagcaccgccggacatcagcgctggcaagctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 72847 - DNA, 613 bp, Glycine max
  Peptide Sequence Number=SeqID_164532
atggcttcaccttggctaagcgagaccaagtgtcgccaagcgcaattcattgcggccagaattgagggccatggggctgagcgttttcctgaagaactcgctgagtgcgcctaccgtactaagcgagtttatttcttgaggatgaacactcatccacctggtacagatctcttgcgccaagcgaaattctttgcggcatctgctgagttgagcggcccttttagtgtcgctaagcgcaacttattcttggctaagcgcaaatctatgcggctaaccttaggcttagcgggctccttgcaagctaagccaactttgcagacactatacactgataatgtcctgggaagacatatactagctgagaggaaagtggaaatatatcatacagagctggatgaatttaaggctgaattggagaggtgtaacttccataagcgcctcaccaatttagctgacaatagcattgacctagcattggtgaaggagttctacaccaacctctacagtcctaaagggccttcaccaaaacaagtcagaatacggggccacttgataaggatagatgcagacagcctcaatgtctttttagaaacacctgtggtgcttgctgatg

SEQ ID NO: 72848 - DNA, 132 bp, Glycine max
  Peptide Sequence Number=SeqID_164533
atggtagatgagcacgaccagaggactacccttgaagactattctagtagctcggagaggccaagaggtggctccactcattcaaaggtatcagtcttaaaacctgggaagaagttgtggaaaagttcctaa

SEQ ID NO: 72849 - DNA, 855 bp, Glycine max
  Peptide Sequence Number=SeqID_164534
atgggcattttcctcggtcttatcctcggcgtcaccatcgcctgggtgcacaaccgcctgtgcaacgtcgaactcaacggcgtgttctcggtctacggcggcgccaaactggtgctgatcgccatgacgccgatcatcatgctgtacgccgtcgccttcagctacctgtggccggccatctcacagggcctgatcgcgctgaccggctttatgaaaagctccggctcgctcggggttttcgtctacggcttcttcgaaaaatgtcctcatccccaccgggctgcaccactttatctggtcgccgttccagctcaccagcatcggcggttcgatcgtgcaggacggccagaccgtctccggctcgcaggcgattttcctggcctatatgcgcgacccgagcatctcgccgctgatgaacgaagcgctgcgcttctcgcagcaagggatggtgaccatcttcggcctgtcgggcgcggcattggctttctatcacaccgccaaaccggaaaagaaaatgctggccaaggcgattctgatcccggccatcaccacctcgatcctggtcggcatcaccgagccgatagagttcaccttcctgtttatctctccgctgctgtgggtgatccacgccgtgttgaccgcgctgtcgcaggtggcctgcaacctgttccaggtgcgcccctggggcgccagcgggctggtcgagttcctggcctacaacctgccgctgccggtctccctcacccgctggccgctgtatgtggtcatcggcctggtgcagtttgcggtgtattacctggtgttcaaaacgctggtgctgaagctcaatctgaagacgccgggccgcgaagatga

SEQ ID NO: 72850 - DNA, 1016 bp, Glycine max
  Peptide Sequence Number=SeqID_164535
ctgagctcgattgaagggatgatccaaaggttggcggcggcatgggagaaaaaaactcctgagacgaatgtgcacgtagttgacaagagcggagaagatgaaggtatggtggcacatgacagcaatcggtggaggaatttggaattgcccatattcgacagacaagctggaggcggtaatggtcgcgatggatggggaagctctgggttggttccaatggtgggaatcttggaatccaaatcattcttgggatgggttcaagattgctgtcacccaaaggtttcaggcttcaagcttggaaaatccttttcaagtgctgctggcactgcaacaagaatagacaggttggaggagccatttctggtggaagtgttcctcacggggttaaaggaagagattagcattgaagtaaggcttcatgaaccaaaaaacatgatggaagccatggttaaggcccaaagagtggaggataagaacagaattttagggaagttacttgtgggtaatggtaaatggagtaatttgcagaaaaatgttcatttggggcagaagtgggtaagtgattggcagccagcaaacaataaggtgactgaccttcagaatgctgcaagaacaggcacaagtggttggataggtagaaggacgttccacaatttgtctcctgcggagaggaggaaggagatcctaagagccagcaataggaggataaggaagaagaggtgggggagtttcaccaattatccctgcatagtattgaaggctttaccacccgaaaatctcttaaattataagattggaggtaacccctacagacccatattctatagaagtaggagatggactcaaggaatggaatggctggctggattgggggcaattgaggccaatttggagaaattgacattaacagtgccagtgcagaacagaaaagtcatattgagagttgaaccagagttgataaaagctgccattagcatgaaaatgatcagggggaccatgctggagtctgaccaagg

SEQ ID NO: 72851 - DNA, 354 bp, Glycine max
  Peptide Sequence Number=SeqID_164536
atggtgtggcgtctcctctcaactcttcttctccattccacttccattaaaattcaagaagcaaaggactccattgatgaagaagatccaaggcctacaagttccaatggagctacatcaacacttccaatgaaaggcctttttgttacaaaacttgaaatcaatgaagtgcttcttagtccaatagctcttaaggtggttggccccttgcttcttgactcaaattcttcaagggatggcaccaatcctcctttccaattccctatatggcaactcacaaacaaggaaacaaagagacaagcaataaccaaagaccaaaaatatgaaataaaagctaaactgatagatttttaa

SEQ ID NO: 72852 - DNA, 663 bp, Glycine max
  Peptide Sequence Number=SeqID_164537
atgcgcgatgaaacgctgacgcatccgcgctgcgtatggaacctgctgaaacagcacgtgtcacgctacacgccagacgtggtggagaacatctgcggcacgccgaaagcggacttcctgaaagtgtgtgatgtgctggcctccaccagtgccgcagacagaaccacgacgttcctgtatgcgctgggctggacgcaacataccgttggcgcgcaaaacatccgcaccatggcgatgatccagctgctgctcggcaatatgggcatggcgggcggcggcgtgaatgccctgcgcggtcactccaatattcagggtctgactgaccttggcctgctctccaccagcctgccgggctacctgacgctgccgtctgaaaagcagttggatctgcaaacgtacctggcggcgaacacgccaaaagcgacgctgccggaccaggtgaactactggagcaactatccgaagttctacgtcagcctgatgaaatccttctacggcgatgcggcgcagaaagagaacgactggggctttgagtggttaccgaagtgggaccaggcttacgacgtcatcaagtatttcaacatgatggataaaggcgacgtcacggggtacatctgccagggctttaacccggtggcctcgttcccggacaaaaacaaagtg

SEQ ID NO: 72853 - DNA, 255 bp, Glycine max
  Peptide Sequence Number=SeqID_164538
atggaactatcactagtgacttctacaaggaggttgcacccatacttccaaagtcatttgatcaaagtcaagaccaaccatcctattagacaagtgcttcaaaagccagagcttgatggaagaatgcttccatctaaatcgagtagtagtgacagaggtgattggtggatgctctatgttgttggagctagtaaccccaatggtagtggaataggaatcacccttgaaggacctggagatatctcactcaagtaa

SEQ ID NO: 72854 - DNA, 240 bp, Glycine max
  Peptide Sequence Number=SeqID_164539
atggatagtggacaggcccgaaaatttgaggatttagagaattctcataagtcaagtaccgtgaccttggccagcataaaggagtccttaggcatggacgttgaccagaaaagtttagagcaacttatcaagaaaaatggctggtggaccaaaagcagctgggcatttctgaatgaaccgccagtgatagaacctgcttccaataagtatggatcacagtttcagaaaattcgaggctag

SEQ ID NO: 72855 - DNA, 324 bp, Glycine max
  Peptide Sequence Number=SeqID_164540
tgctttgagagtagcctggtggttggaactactagtggtgtttcgtcgcttatcgcactctgtactactagtgttcccggcaactgggctgctagcaaagtgggtcaatacgctgatgagagactagctattcccaatatgcgggtagctgtttcgtatggcttatctagtagatgtggctgggccctctatcgactcgcaactgagctccgacctccccgactgctagcagctatgcactgggtgtactcgatatacgctcactaccagctactactagcaactcgctatcgttgttgtgctgctagtgctgacagtagttga

SEQ ID NO: 72856 - DNA, 235 bp, Glycine max
  Peptide Sequence Number=SeqID_164541
atgactcaaaaacttggaatccctattcgatacaatgctcctaggaaatccatgaagatgcactacctctttgaagaaaagatccaccacatgacaaccatcttccaccttgtgacatggaatgaattgtgccatctaggaaaacctatcaacaaccacaaaaatcgaatctttgcccctcttggaccttggaagaccaagcacaaaatccatggaaatgtcggtccaaggggag

SEQ ID NO: 72857 - DNA, 192 bp, Glycine max
  Peptide Sequence Number=SeqID_164542
atggtgtttcgaagattgccacttaacaaattggagctaacagttaattggttcaaggacgtgagatttcctagacttgaaggaatggaatcggaagacatgttctcgggttgcgttgtgccacgaacaatgacgacgatggcaatcttcaatggttgcgatgtaacgagcgcagggaagacaaagtcgtga

SEQ ID NO: 72858 - DNA, 710 bp, Glycine max
  Peptide Sequence Number=SeqID_164543
ggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatccatggacaaggagcacatgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 72859 - DNA, 462 bp, Glycine max
  Peptide Sequence Number=SeqID_164544
atgggcaagaaatactttagatcggctccacggaccttctacacttcttcctccatggctcccgaagaactagagcagctgactcaacaaatcaaggaccagctggaggagttgatcatagaaaaagtgactcgacggatgatgtcatccttcagccagatgcagtcccagtttcaatcacagatgcaatcacagggacttgcactacctccggagcctgagggaacgatccagacacgggtgactcatacaaatacgggttatacatcgaagaaaattctccacgcttggtttcccctaggaagagtttatgagggatccacaaccgttcacaacatccctttgttgcatgatcaagtgaaggtcggtgttgaggaggttaaagatgcagatgctcccgtttctgtacccactaacgaggttaacttagtgggggagctgtgggaccagcaaaacctgtag

SEQ ID NO: 72860 - DNA, 429 bp, Glycine max
  Peptide Sequence Number=SeqID_164545
ccggtagaaaatgcagccccttcacgtccggtgataacaatacggcaacgaccaccaaaccaacggtcgccgcgccagcgggcccgcgcgccgtgagccgcagtcaaccacagtatccgcctcgcgctcagatgttgcgtattgaaggccgcgtgcgggtaaaatttgacgtcacggcggatgggcgcgttgataacgtggagatcctgtcagcgcagccttcgaatatgtttgagcgcgacgtgaaagcggcaatgcgcaaatggcgttatgagccaggcaaaccgggtagtgggcctgcggaagctggcgagacttcgatgttaatggaaatagaggtgattgccgcgttttacgcagcgcgtgtagcagcacaccacatcacccaccgccaccgggcgcaggaaggtcatgccgtctactctcacg

SEQ ID NO: 72861 - DNA, 207 bp, Glycine max
  Peptide Sequence Number=SeqID_164546
atggagtcagatgacatgcgggggtaccgtatggttatctgcacctttcatcaaccaggggcaaacgagcctgttgacgcgcagagacttacgtcgtcttctgcaccttttgtcatcccgacccatggagtcaggttttactctcctcgtccagagacatttaagcccgacgacgcacgaggttccgctggtcgggatattgactag

SEQ ID NO: 72862 - DNA, 417 bp, Glycine max
  Peptide Sequence Number=SeqID_164547
atggatcaattaagccctctcgggacttgcttaagaatgagaaagaggaatcttatcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 72863 - DNA, 264 bp, Glycine max
  Peptide Sequence Number=SeqID_164548
atgggggcgaacttatcaaacatggagaaatctttctcaagaagcctctgggcggcaaccggctccattttgttaaacaatggggtccagggcatctggggattccgtaatgcttccgtaaaacttccaaaaaccttggaaaattcaaaccgaggatcttctgtaacacttccgagacgttttcgtgagcaaatccgtgaagatttttcgtcgttcttcaccgttcttcgttcgttcttcggtcttcaactgataagtgtttga

SEQ ID NO: 72864 - DNA, 1191 bp, Glycine max
  Peptide Sequence Number=SeqID_164549
atggcaagagttgccaaggcattggcagatcaaagggaatgggcctcgtttattgacatctttgcactgttgatatttggtgttgtcctctttccaaatatggagagattagtgaacctagcagtaattgatgccttccttgcttatcaccatagcaaggaaagctcggtcattgctattttgaccgatgtttatgacacgcctacttgtccattgcaaggtcaccacttatgcgttgagaaaggaaaggaaaactgggagcaactcttggctaatgtggcatggggtgcagtgcaaaggaaagatacgaagcttagggggagcaccaatgggatcatcggcgactatcagaagtggctgcaagtccgaacgcaagaattagattggctcccaaagctaaaggctgcaagaaaagatgaggctgggactctggaggagagtgaggaagtgaaaaccctaaaggaagaacttgaaagagccaaagtagtcaaagagaagttcaagtcaatggccatcaaggttcggaaagacaatgagcttaagctccgaagagccgagagggaccaatcgcaggttgaaggcatgatcttggaagacgagttgaaggcttgccaaaggtcgaaaaggagcttgtccgagcagttgagcaagactgaagaaaacatatgggccatcatcaatcagtacaaggaaaagctaagcctagtagcgactcatgaacaaaggctagaggacgagtatgcaaaggtatcagtcctgcaagcggaaagggaagcaagggaaaggcttccacgactgctagccaaggccaaggccaaggcaatggcagatttatacttggcccccgaggaacatgcattcatgtttagttctttgtcgcattactcaccacattttgttcctttaggaagtaacaccataactgaacgcgctctaaggcacccttatcgaacccggtctaagactagagtcatgggtgatgtagacgaggtgcaagaacagatgaaggccgatatggtggccttgaaagaccaaatgacttccatgatggaagtcatgctaagcatgaaaagactgatagaaagtaatgtggccacgactatcgcagccagcgtcgctgccgaggcagaccctactcttccgtctgccatgaatcaagcacatcaacctgccccgaacatgaggggatga

SEQ ID NO: 72865 - DNA, 192 bp, Glycine max
  Peptide Sequence Number=SeqID_164550
atggtgaaagttggaacctcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcggtccccctgcgcgtaaccaccacacccgccgcgcttaa

SEQ ID NO: 72866 - DNA, 819 bp, Glycine max
  Peptide Sequence Number=SeqID_164551
atgaagaaattgaagaactactacatgcacctgcggcaccaccaccaccaccaccacgccgcggcggagcgcaagtgggtgttcccactcgccattggctccctcctctccctcttcctcctcttcctcgccaccctcacctccccggagggaacccccatcctccccttctaccgctccatcaccgccgcctcctactctgtcttcgtcgaatccaagctccgccccctccccgtcgtctcctccctcccccctccgccgcgcctcgcctacctcgtctccggctcaaagggcgacggcgccgccgtcacccgcgtcctcttggccctctaccaccccaacaaccgctacgtggtccacctggacctcgaatcctcgccggaggaacgctccgatctggtgaggttcgtggagggccacgcgctgttcaagcggttcgggaatgtgagggttataaagaaggcgaatctcgtcacgtacaggggacccaccatggtcgcaaacacgcttcacgccgccgcgattctgttgagggagcttggggattgggactggttcatcaatctcagcgcctccgattacccacttgtcacacaagatgatctgctgcatacgttttcgtacctgccgcgggatctgaatttcattgatcatacgagtgacattggatggaaagatcatcagcgtgcgaggccgatcatcgttgatccgggtttgtatatgaataagaagcaagatgtgttttggattacacagaggaggagtaggccaacggctttcaagcttttcacaggtgaagatccttttcttgtctgttaa

SEQ ID NO: 72867 - DNA, 501 bp, Glycine max
  Peptide Sequence Number=SeqID_164552
atgccaaacaagacaaataaagatcttgaggaggctattttggccttagtagttgaaatggaaaatttgcaagctcaccatgagaaccgccacgagcaactccaatccaccatggatgctaggaatgacgccctccatggagttttggcctccattatggacaaactagccatcatttcgtcagccccagcacaggtattctcccctgctatttttgccactacttctcccacattccacatggcttttgatggcactatccatatcaccacctcaccatttgggggtcatattctgtcctcttctaccttactacaccaacataatttctcccctcatcacaccccaaatttttctaccaatcccttcatccagcgtagagtggttgagcaccattggacctgtgacttctcagtttcatccatgtcctttacgcttgatgaggctctgattcttctccaaggggataacatgcacaccaaggaggtttcctatcaatag

SEQ ID NO: 72868 - DNA, 1884 bp, Glycine max
  Peptide Sequence Number=SeqID_164553
atgaagaggtattatgatgattctgcctgtgttctgcggaagatgttgttagatgcaaaagcacctcatctttcttcagcaattccgccaactttaccttggaaagtaaatgaactagtccaaccttctgaaccactaactcgtcagggtagtggtattaatggcacttttgaaggttctgaggaactgcgttgtgtaattgctgttattcgtcatggtgatagaactccaaaacagaaggtgaagctaaaggttactgaggaaaagctgctgaacttaatgttgaaatacaatggtggccggccgagatctgagacaaaacttaaaagtgctgttcagctgcaagatctgttagatgccacaaggatgctggtgcctcgcactagtagcactcatgaaatctgcaacttgaaacaagaagttagtggatacatgacaaaaggttgcaagttgaaaccgctgttgatgggacttgctcagcagtttaagcagcacattggtcatgttcttgatcatgatcgagaaagtgatagtgaggctgaagatgttgagcatgctgaaaagcttcatcaagttaaagcagttcttgaggagggaggacatttctctggcatctataggaaagttcaactaaagccactaaagtggatcaaaatgacaaatgacaatggtgaagttgaagaacaacctgttgaagctcttatggttcttaaatatggtggtgttcttacacatgctggcagaaagcaggctgaagaactgggaagatatttccggaataaaatgtatccaggagaaggtacagggcttcttcgcctccatagtacataccgtcatgatctcaagatttacagctctgatgagggtcgtgtgcagatgtctgcagctgcttttgccaaaggtcttcttgacctagaggggcagctaactccgatcctggtttcccttgttagcaaggactactccatgttggatgggcttgaaaatgcaagttctgaaatgaaagaagccaaggcttggttgaatgaaattattacatctaatgcaaatacagttgatagcaatggatcacctgaatttccttggatggttgatggagcaggactgccacccaatgcatcagaattacttgccaatttggtaaagttgactaagaaggttaccgaacaagtaagattacttgcacaagatgaaaatgagaaacttacagaaagaagcttatatgatgtaattcctccttatgaccaagcaacagtacttggtaagacaaatattgatgttgaccgaatagctgctggattaccttgtggtagtgaaggatttctattaatgtatgctcgatggaaaaagcttgaaacggacctgtataatgaacgcaaggaacgctttgatatcacccaaattcctgatgtttatgattcatgcaaatatgatctcttgcacaatgcacatcttaatctagaaggacttgatgagcttttcaaagttgctcagatgcttgctgatggtgtaattccaaatgaatatggaattaatccaaagcagaagctgaagattggctcaaagattgctcgtcggttattgggaaaacttttaattgatctgagaaacactcgagaggaagccattactgttgctgagctgaagaataaccatgaccattcattatccataaatatcgagaaggaagatgcagaggccaagtcaaaactattccataagaatgatgaaatggatcaagatgatgatgatgataaagagaccaaatatcgtttagatccaaagtatgcaaatgtgaagacacctgagcgccatgtgcgaacacgcctctacttcacatcagtgagtgttgtatccgcaaacatctatacctcgtgtcaatga

SEQ ID NO: 72869 - DNA, 501 bp, Glycine max
  Peptide Sequence Number=SeqID_164554
atggcactgtcaaaatctttcattgattactgcatatggggatgggacaacctacctcgaaccgtactcatgtactattcaaatttcatatcttcccctgaaggatacttccacacagttatttgcaatgcacaagagttcaggaacacaactgtgaacagtgatttacatttcatttcttgggacaatcctcccaagcagcatcctcactaccttacagttgatgacatgaaagggatggttggcagcaatgctccgtttgcaaggaaattccacagagaagatccagttttggataaaattgatgctgaactattatccagaggtcctggaatgactgttcccggaggttggtgcatagggaaaagggagaatggcaccgatccctgctctgaagtcggtgatactaacgttctgaggcctggcccagttgactctgttgtccctggtcacctcttcctccctttgaccaatctcagcaaaatcagtgaccagcattga

SEQ ID NO: 72870 - DNA, 306 bp, Glycine max
  Peptide Sequence Number=SeqID_164555
atgaataaccaaaacaaccaaaacaatgtcgaaaacattatcaaaaacactgtcaaatccaaccaaaacactgtcgaaaataatcaaaacaagcagatttatgatctcattgtcgaaaaaagcttcgagagaaaaacataccatgagagcaaaacatgcatgcataaaccatgcaaaccgccattggcaatggcgagtttactgcggaatggatgcgtggcacgtaaaccgcctgcatggctggcgactttgcctaacgaggatctcgccacctctactacgagacagcacaaaccgctggtttga

SEQ ID NO: 72871 - DNA, 2871 bp, Glycine max
  Peptide Sequence Number=SeqID_164556
atggctgagaaggaagaagccatgcgcgttgttttgaaggaagctgtggatttggaaaacgtgccacttgaggaggtgtttcagactctgaggtgtgattcaaatggactcacaacagaatctgctgaggagaggttggccatctttggccacaacaaacttgaagagaagaaggagagcaaggttttgaagtttttaggatttatgtggaatcctctttcatgggtcatggaagctgcagcaatcatggccattgctttggccaatggaggaggcaaacctcctgattggcaagactttgttgggattatcacactccttattatcaattcaacaataagtttcattgaggagaacaatgctggtaatgctgccgcagctctgatggctcgtctagcacctaaagctaagttccttcgagatgggaaatgggttgaggaggatgctagcattcttgttccgggtgatataattagtgttaagctaggggatattatccctgcggatgctcgtctacttgaaggcgatccactgaagattgatcagtctgcacttacaggcgagtctcttcctgtcacgaaaggccacggtgatagtgtttattcgggctccacatgcaagcagggagagatcaatgcagttgttatcgccacaggagttcataccttctttggcaaggctgcccatcttgtggactccacaaatcaagttggccattttcagaaggtcctgactgctattggaaacttctgcatatgttccattgctgtgggaatgatagtagagatcattgtcatgtacccaattcaacaccgggaatatcgtcctgggattgacaatctgctcgtgcttcttatcggaggaattcctattgccatgcctactgttttgtcagtgacaatggcaattggatcccatcgcttagctcagcagggtgctattactaaaagaatgacagcaatagaagagatggcaggaatggatgtattatgtagcgacaaaactggaactttgactttgaataaactgacagttgacaagaatcttattgagatttttgctaaaggagttgacgtagatactgttgttctgatggccgctcgggctgcgcgattggaaaaccaagatgctatagatgcctctattgtaggcatgttgggtgatccaaaagaggcaagggctggtattcaagaggttcacttcctacccttcaatccaactgacaagcggactgcgatcacttatatagacagtgaaagtaaaatgcatcgtgtcagcaaaggagcaccggagcagattttaaatcttgcacgcaataaatcagagatagaacgtagagttcattctgtcattgataagtttgcagacaggggcttacggtctcttgcagtagcctaccaggaagttcctgatggaaagaaagaaagccaaggagggccttggcaatttattggactgttgcctttatttgacccacctagacatgatagtgctcagacaatacgaagggcattaaatcttggagtaaatgttaaaatgataacaggtgatcaactagcaataggaaaagaaacaggacgccgtctggggatgggaaccaacatgtacccttcatcagctttattgggccaaaacaaggatgaatcaattgctaccttgccagttgatgagttgattgaaaaagcagatggatttgctggtgtttttcctgaacacaaatatgagatcgtgaaacgtttacaagctaggaaacacatatgtggaatgactggtgatggggttaatgatgctcctgctcttaaaaaggcggatattggaatagctgttgctgatgctactgacgcagctcgtagtgcttctgacattgttctgactgaacctggtctcagtgttatcatcagtgctgtattgaccagtcgagcaatattccaaaggatgaagaattacacaatctatgcagtttccatcacaatccgtattgtgcttggtttcatgttactggccctcatatggcaatttgattttccaccattcatggtgctgattattgctattcttaatgatggtaccattatgacaatatcaaaggacagggtaaaaccatctccatatccagatagctggaagttggcagagatctttaccactggaataattcttggtggttatttggctatgatgacagttattttcttttgggcagcatacaaaacagattttttccctcaaacatttggagtctcaagtcttcagaaaaaagatagggatgactttagaaagcttgcctcagcaatatacctacaagttagcacagttagtcaggccctcatatttgttacacgggcacggagttggtcatttgttgagcgtccaggcttgttacttgtagcagcttttgttattgcccagttgatagctaccttaattgcagtttacgcaaattggagttttgctgcgattgaagggattggatggggctgggctggtgttgtttggctttacaacctcgtcttttatatcccacttgattttatcaagttcataattcgatatgccttgagtggaagggcttgggatcttgttattgaacaaaggattgcttttacaaggaaaaaagattttggaaaggaagaacgtgaacttaaatgggcacatgcacataggacgcttcacggccttcacccaccagagactaagatgttcaatgaacgtacaagttacacagaacttaatcagatggccgaagaggctagaagacgtgcaaacattgcaaggctgagagaactgcatacactgacgggccatgttgagtctgtgtttagactgaagggccttgacattgacacaatacagcaagcatacactatctag

SEQ ID NO: 72872 - DNA, 750 bp, Glycine max
  Peptide Sequence Number=SeqID_164557
atggacacccgtctccgtgtgattggtgatcccatgaatgaagttcaacggggtcacaactcactctttgaggattcacctagtgagtgtggtggtggggccgccactgtgagatatgggctaatctctaaaggacactcacgaaacaagatacaagcgcaaggccgtgaatgggaagtgcaggaagcttgtagggccgtttcaagttatcttggagaattgggagtgtcgttggaggattcggtgtggatggcgtcaaagtcaccggagtacgtgaagatgttggtggaaggtgtgagggatttggagcagtggcatgagtgggatgcaggcctaagcttcagggacaagattcttcatatcgcccctcaaaaaggggacaagggcaaagttgcctacttagagactctgggcttctctctctcttcctctatgaacatcgccagatatttctccgctgacactctcacccttccatctctcatgcacaagatggacctggctgataaagattatgctaagctgttgctaaaatatccctggcttctatctacaagtattcaagacaacagtgctaaattcaatatcagctatgctccacagtccaaatgcattaagaaaacgagaatgcagaagagagttgacgcttgtggaggctacgacgtttggagggatcagcattatcgtcgtcgtggttatcctcttcttcctcgatgcctctccagcggtccagtagctcccgcttactag

SEQ ID NO: 72873 - DNA, 180 bp, Glycine max
  Peptide Sequence Number=SeqID_164558
atggaggcttgcgatgccatcgccgagaggttggagcgtcacctcagcctcagggtagtcacaccaggcacattgacacatgaggtcatcaaaaaatgcctcaagattgtcaggagtgtcacccaggaccgcattgtgtacgtgaggtctctacgtaggcgctgcatggatcagccgtag

SEQ ID NO: 72874 - DNA, 672 bp, Glycine max
  Peptide Sequence Number=SeqID_164559
atgacattcttggtagagacaagcagtcaaacagttgtgaactccacattaggttttatttttccaaatggatccattgtttacaacgacagtagtgtttcctttcaagcttccactccagttctcattcgagtacctaacaggtgtgattttcaaacgttaaaaaccagaatacacaatacccttaagctaaccgacaagcaatttttggatgaaatttactaccgacagcctttcacgtatacagctactatgacccctactcatgatgccctgctatattacaatgagaggtggaacatgtcacggcaaaatgagtttgttggttactcgttcacaggaaaaaatcccaaaaactttgacattcccaccggatgtaccatggatgaactgaaggatttgatcaagcaagttgcgtctcgtgggattcccccttatggtattgatgaaacacaaatggtaaaacgattgttttttcggaaaccaagtcaccacgagtattcagaaaaagttataaaattcgaaataattgaactcaaaaccaacgacgacgtgatgaaggtgctcattgagtctaactactggaaaaagattgggccaatagaaattttagttgttttcagtaaacctgtattgcaaatggaagacgagttgtccttgccgcaaaattag

SEQ ID NO: 72875 - DNA, 294 bp, Glycine max
  Peptide Sequence Number=SeqID_164560
atggggtttgggagtaatgcagttcaagcagggagtttggatgtggacaagtcaaatgaaaggaagaagaaggtagaaggtgctggaaaggagagaaaatggtggtttagatttagcttctttgggagctgcataccttcaggatcaaaagttgatagcaccataagtggcactaaggcccataatgcttttcaaaatcaaagccacgttcttttctccgttacctttggaccacggcatgttcttttgtatgcactagatgctcggcaaagagccgagaaaaatattctgtaa

SEQ ID NO: 72876 - DNA, 75 bp, Glycine max
  Peptide Sequence Number=SeqID_164561
ggttcgtttctctttggtggtttctttaggcttgttgtttattttttcggggtgtcaaatgtgttgtttgcttag

SEQ ID NO: 72877 - DNA, 507 bp, Glycine max
  Peptide Sequence Number=SeqID_164562
tatccaggaaaaagcaaaatctttgatggaagaacagggaattcttttaaacagcctgctataatgggaaaaccttatattttgaaattaattcatcaagttgatgataaaatacatggacgttccagtggacattatgcacttgttacacaacaaccacttagaggaagggccaagcagggaggacaacgggtaggcgaaatggaggtttgggccttggaaggatttggtgttgctcatattttacaagagatgcttacttataaatctgatcatattaaaactcgccaagaagtactcgggactacgatcattggaggaacaatacctaaacctacagatgctccagaatcttttagattgctagttcgagaattacgatctttagctatggaactgaatcatttcctttataaacatcaacaactccgaattggatcagtttctcctcaacaaataagtgcttgggcaaaaaaaatcctacctaatggagagatagtgggggag

SEQ ID NO: 72878 - DNA, 147 bp, Glycine max
  Peptide Sequence Number=SeqID_164563
atggtcaaatactacgccaaatccaagacagagatgaaccgaggtgctcagggatgggtacgagtagacgctaggcccgtgatcagtagatcatcgtcccgcgtccggcttcgtacgatcaagaagcactactgggaggcagcctag

SEQ ID NO: 72879 - DNA, 399 bp, Glycine max
  Peptide Sequence Number=SeqID_164564
aacaagagagggtacatctcttgtggatcagttctagtggagggtacatccactaggttgttcaaagagaacaagggagggtacatcccttgtggatctttgcttgtaaaggaatttacaaggttaaaaagaaatctcaaggactgcaggttgcttgagggctggatgccacttgatccaacactgctgggattgcatctgttggttaccgcaaagagcatgatggctcttgggttcgatggtcttcaaacctatgttggtgaaaggtttgatgctttggaattacaagtggatatgcgattcgatgtgatggactcaaggatctccaaggttgaaggagatgtcacttacatccgcacatgctttgatctaccaccaccaccaccatcatcatcttag

SEQ ID NO: 72880 - DNA, 657 bp, Glycine max
  Peptide Sequence Number=SeqID_164565
atggatttgaaggaaggttgtacttatgtgatgcacaattttagagtcaacatcattggtgtcgttgatgaggttgtctttcgtcatatttcacctagaagtaagagagttgtttttaagcttatgaatttgaggctttcagaattggacattgagatccgctcagttttgacacgtcgttcccagtggagttcgcagccttcaggttctgctcagttatcatcaagggagacattcatttccaagtcagaggcaaagagcatttctgagatgaataacctttgtgaagagtttgtttgtgttactgttggtacaatcacgaggattgttatggacaatcattcatggtgttatgcatcttgcattcagtgccataagaaaatagatgtctatacagaaccatttgtgtgcccatgtggcaaacataatgatcgagttgtgcttagatatagagttgaagtgatggtcaattacaaagatgaaagcacaaaatttctccagtggtatcgtgaatgcaccgaattgattgaacaattagctgatgaagtcaatacccttaaaatagaagatggtgatctggatttaaatgcctccccaaaagcacttgataaactactaggtcatctgctcgccttcaaagtcaaaatccagccgtag

SEQ ID NO: 72881 - DNA, 1470 bp, Glycine max
  Peptide Sequence Number=SeqID_164566
atgacagaaagcattacatcaaacgggacgctggctaacagtgatacccgaagaagggtatgggccatcgtcagcgcctcttcagggaacctggttgaatggttcgacttttacgtctactcattctgttcactctatttcgctcatatattcttcccatccggcaacaccactacacaactcctacaaacagcgggtgtatttgctgcaggattcttaatgcgacccattggtggctggttgttcggccgcattgcggatcgtcaggggcgtaaggcctccatgctgatttcggtctgtatgatgtgttttggctctctggtgatcgcctgcttaccgggctatgaatcgattggtacctgggcaccggcgctacttttactggcccgcttattccagggattatcagtggggggcgaatacggtaccagtgcgacctacatgagtgagattgcactggaaggacggaaaggcttttacgcctcattccagtatgtcacgctgattggcggtcaactgctggccattcttgtggtggtgatcctgcagcagatcctgacggatgaacagcttcacacctggggctggcggatcccgttcgcaatgggagccgcgctggcgatcgttgcactttggctacgccgtcagttagatgaaacttctcagaaagaggtcaggacgttgaaggaagcgggaacgtttaaaggattatggcgtaaccgcaaagcttttcttatggtgctgggctttactgcagggggctctctcagtttttatacgtttaccacctatatgcaaaagtacctggtgaacaccaccgggatgcacgccaacgttgccagcgttgtcatgactgtagcgctgtttgtctttatgctcatacaaccaatcatcggggcgctctcggataaaattggccgccgaacgtcgatgcttatttttggtggattatcggcgctctgtaccgttcctgttttgactgcccttcagcatgtatcctcaccgtatgctgcatttgcgctggttatgctggcgctggtgattgtcagtttctacacctcgatcagcgggatactgaaagccgaaatgttcccggcgcaggtacgtgctttaggggtagggctctcttatgcggtcgccaacgcgttgtttggcggatcggcggagtatgttgcgttgtcttttaaatcatggggaagcgaaacgacattcttctgccactcagtaagatcacgctcagcaacagaggaatacgcatcaacgggctccataaaaaagccctgcgatggcagggcctggatattacagaatacggctgataagtcggtcgatacggattcgacgcaagcggcgaataagcttgcgaactttcaccggataatcggcaatactctgcagttcgcggtagtgattcaccacggttgtatgcgtgcgaatcagttccagctcacgttcacgctttgcggctaa

SEQ ID NO: 72882 - DNA, 1641 bp, Glycine max
  Peptide Sequence Number=SeqID_164567
atggcactgccgaaaaaactgaaatacctgaacctgttcaacgacggctacagctacatgggcgtggtgtcctcgctgacgctgccgaagctcacccgcaagctggagaaataccggggcggcggcatgaacggcgcggcctccatcgatatggggctggacgatgacgcgctggccgttgagtggtcgatgggcggcattgatgagctggtgttgaagcagtggggcgccgtcgatgctgtgccgctgcgctttgccggttccttccagcgtgacgacaccggcgaggtgtccgctgtggaagtggtgatgcgtggccgccacaaagaaatcgattttggcgagtacaagcagggcgaggataccgaaaccaaggtttccaccgagtgtacttacttcaagctgaccgtggacggcaaagagctgatcgaggtcgataccgtgaacatggtcgaaaagaacaccatgaaagacgcaaaagaaaataccgttaccctcgacaccccgatccagcgcggtgaaaccaccatcaccgaggtgcaggtgattaaacctaacgcgggcgcgctgcgtggcgtcgggctggcggcgatcgccaatgccgatgttgacgcgctgctggttgtgctgccgcctgccggatttggtggcgctggccgggaaagtggtcggttttttgtcgccgaactcggcggcgtaatccccgacgcccggctgggcgttgatgacctgatggcggacatcgcggtgatcttccactggccgccgtctgaaatggccggaatgacgctcacggagctgttgaactggcgccatttggcactgcaacgcagcggagccgtagaccaagccacccgcccgctaaagagtatccaacaggcaagcaaacagcttgccggtgacatcaaaaccacgcagcaaaccctcaaggctctggacgcgcaaagcgcccggattgaggggtttcgcaaggcgcaggggcagcttgccgttaccggcaaggcactaaagaaagccaaggaagaggcggccgcgctggccgttcagttcaaggcgacggaaaagcccacggcgcagcaagcgcgcttgctggaggcatcaaggcgcgccgccgccgagctgcagacgaaatacaacggtctgcgccagtcggtgcagcgccagcgtgacgcgctcaacgctgacggcatcgctacccggaacctgagcgccgaacagcgccggttgaaggccagcgccagcgaagccacgacagcgttgggccgccagcgcggcgagctggatcgcctgagcaagaaacaagatcaggttaaccgcgtcggcgcgcgttaccgtgccgggcaatcggcaaccgcggctgtccgtaataccagcgcggccgggctgggtatcgctaccgccgggctggtcgctgaaggggcgtttattgcgccgggggtgcagttcgacaggcagatgtcagacacgcaagccacgttagggctggcgaaaaatgaccagcaattggccgccattcgccagcaggcgcgggatattggcgccacgaccgcgttttcgccgacggacgtcgcccgcacgcaatcggtgctcgccaagtccggatttaacggcgatgccattctgaaatcgaccgagtcaacg

SEQ ID NO: 72883 - DNA, 714 bp, Glycine max
  Peptide Sequence Number=SeqID_164568
cgccttatcgatagtcagcccgttgagtgccgcgcggtatttctcgttgacgagttttgtttgcgccggattgggcgtcggcagcgtgccgttcccgtcgccgacggccatagagacgattttcaactgcgtgccgcccgcgctggcggcggcaatcttggccgccccggcggtggtaataatcgctttgtatttgttcatgattttctcttatccggggtaaacggtaataacatcgccatcaatggcggccgcgccggtgtaaatccggccggggatgtcctgcaaaatgttgaggccgatcaggtggcggctcaggggcttggcgtcggcgataaggcgctccatttcctgatacatttcctcggtgatgccggtttccagcacgccaatatccagccggaaggtgccgggcggatcggcgccgtcggtatggaaccactcgataacgttaatcaggtagccgagcggctccaccacacggcgcactgcgccgatggtgcccttatgccggtgaatgtagaacgcagcggacaccacaccccgcttgacgtcctccggccacgcctcatcccagcgatcgacagagaacgcccacgccagatagggcagcagatgcaccgggcaggttttcgggttccacaaatcacgcaggggaaccggcacgcgctccagctcagcacacgcggcggcggcagcaacttccagcggtga

SEQ ID NO: 72884 - DNA, 324 bp, Glycine max
  Peptide Sequence Number=SeqID_164569
atgaggcgggttgttacatgtttcaccaaggatgaagacatctactcagtcatcaagcgcttgctaggtcttcctaccattcaacatttcaatgatgtttgtagatgtctcacgaagataaacgaacaagaactcgtagctcatgaacaagctgctacaatcgaagctgaagctttgctaaagctgtggacaacaacattatgtgggaggtcattattgtgtgtggatgatgaagttcgactacactccaaggcgggttctaaagtgcgaaggcgaactgtgtttcgtagtgcgaaagtgaactacatcgttggatctttttaa

SEQ ID NO: 72885 - DNA, 144 bp, Glycine max
  Peptide Sequence Number=SeqID_164570
atgatgcttacctctgtgtcagttgagctttgctggagaagacaatcagggctcactggaagtagaggaaatattcaaatcaatgaattacaacttgctatggtcatcttcaatttcaagatgattatatcagcacgctcatag

SEQ ID NO: 72886 - DNA, 342 bp, Glycine max
  Peptide Sequence Number=SeqID_164571
atgttcaattccggaagaagttcttccggaagcacttcttccggaattgaacatggtaacttccaggaagaacttattccggaaattcaacattctcattccggaactacttccttcagtagtaaaaaaaaacgcgaaaaaaaaagcgataaatgcggccgtccgacgaaatacgaacagcaacgaccaaaacaacttcaaacacggaacaactgcttcacgggaccaccaaatcgcttgttacagaacttctacttcacgggaccaccacaaaggctttttacggaaaaggataacaatagcaagaagacggagatgaaggtgagagcacaacatatttaa

SEQ ID NO: 72887 - DNA, 941 bp, Glycine max
  Peptide Sequence Number=SeqID_164572
gttcagactctaattttttaactgcctatgaggattgccaatctccaactaatcagcctgtaatcaacactgaaggatattctgatcttggtgatcaactcatgcaatgtagatattgtaatgcacaaatgtggtatgataaaagaatatcaaaagataaaaattgtgggagtccaaggttcagcttatgttgtggagatggcaaagttgaattgtcattattacaaaatccaccccaatatctccaacaacttttgtttgatgataatacaattgatagtaaaaattatcaacataacttacgagcatacaacatgatgtttgcctttacttgtgctggtattaagctagaaaaaacaattaatgattcgagaggacctactacaattagaatacaaggccaaccatgccacagaataggcagtctattaccaatgcttggaaaaaatccaaatttgcacaactatatatctttgacacagaaaatgaagtgcaaaggccatattgtctcaagtttaagtcacatgctagatgagcactattctcatgctaaaagttttagaatgaccagggatagattggcagatgatgaagttgataatatcaaattgcaactgatagctgctcgggggaaagatggtcgtgtatataatatgccaaatgttcctgaaattgctgcacttattgttggagattttcatccaggctcaaaaagagatattattgttgaaactcaaaatggagaattacaaagaatccatgaactgcaccctagttatctaccactacagtaccctatactttttccttatggagaagatggatatagagcttacatacttcaccgttctacttcatccagcaaaaaaagaaagcaaaaccgtctgacaatgagagagtggtttgcttatagacttcagtccaagtcaaataaagcatag

SEQ ID NO: 72888 - DNA, 216 bp, Glycine max
  Peptide Sequence Number=SeqID_164573
atggagcgttatctacaacacttggggcagggcttcactccttttgcatgccctactccagagcagtttggggctgaggttgcatggcccggagactggcccgaggcccaggcaggggaggagcctgtaggatccatcgatgaggcagaggaggcccggatggatgaagaaatgacagacttgctcggtttcttgggaggaagcggagccacgtga

SEQ ID NO: 72889 - DNA, 441 bp, Glycine max
  Peptide Sequence Number=SeqID_164574
atggcttacgaacggggcggagatttcctggaagatgccaggaagatacttaacagggaagcgtttccccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccgtcatgcgccggttaaggctaaactgaaaggacaagttttggtgactgcgctctcaagccagttacctcggttcaaagagtgtagctcagagacttcgaaaaccgcctgcaagcggtttttcgtttcagagcagagatacgcgcagaccaaacgatctcagaagatcatctataatcagataaaatatttctag

SEQ ID NO: 72890 - DNA, 159 bp, Glycine max
  Peptide Sequence Number=SeqID_164575
aatttctgccttaaccaaattaggattttccacccagaaaccatcaatttctgcctttctggaaattggtttttcaggggaatcccatcctcagcccaagcatcttcccagaacaggatttggtcacccctgttagacaagtggcctcagatatcttaa

SEQ ID NO: 72891 - DNA, 519 bp, Glycine max
  Peptide Sequence Number=SeqID_164576
atgactggtcaaaacatacatactacaatcgtatcatcgacttacggtctgctgacggaaaccaactcagcccttctgcgattgtgtgaccaagctagctcgctagtgataatcgtcaactcaactgaacaagccatagagtcttctcagcattcagaagagataacgttgctcgagctatctgaagagctatgcgaacacttgctaccgctatcacgtggtgatcgatcccgtaaggcacctgatatcctcgctaaaatgctaaattgcatagcgtctgaagtagtatggattgacaggattcaaattctatttgagccatctctagaactcgatcctttgcgccagctacaagagctagcgcgtatcaagcctatcgtcgctatttggcctgggcagcttacagaacaatttttaaccttttcagttccgggaagggccgattatcaatcttacacagcgaatgagctggcaaatctgccgatcattcattttattgagcagagggaatataaatga

SEQ ID NO: 72892 - DNA, 498 bp, Glycine max
  Peptide Sequence Number=SeqID_164577
atgacattgctacttagcaacattctgcccagcgaccgcaatgccaatctccccctgcaaaagtatcagttggtctgtgtcgtcccgacatggggatcgcacccacaaagacacccagtggacctgaagaagtccaacagggccctggggtttccagctctggttacgggcctctgtcggccctacagggcgcctgttccccccagcaagttcatgtcgtcgtggcatagggattgtgcccgcaagacacctagtggacccaaagaaggccaacagggtcttggagttgccagctctaaatacgggtctctgtcagttctagggagtgtctgtcgcccccagcaaggtcatcaggccccctaccaatcgagctttcatcaagaagtactacgcccccaggcaggcgcagggcgaacccacatcaacattgggatggccgatagcaggccaatagacacactgccaccacctctagagttcacctcagctcatccataa

SEQ ID NO: 72893 - DNA, 318 bp, Glycine max
  Peptide Sequence Number=SeqID_164578
atggtgggagcaggtttgaaaaaggatcttagagtgtctagggttgtgccaggagggtctcttaatgccttcctttttcttctcatcggagttatttcacaaagacttgccatgttggtagagctccgctcttgcaattgggtcgttgcgattacgggttggatgtctaattgtccaggcggtaatgatagtatctttgaaccggtggctcactttttcgccctaagtaatgggaaagaggaccgaaacattagcatgaagactctacttgagacaaagacggggtttgaaaccaagaacttatcctcgaggaggtag

SEQ ID NO: 72894 - DNA, 657 bp, Glycine max
  Peptide Sequence Number=SeqID_164579
atgaccgaccctctcaatgagtcaatctcatgttttctcataagggtggacccttgggtactagaacttgtcgcctttggaggactagacttcctcgccttcagaggactagacttcctaaccttcagaggactacacgtcctcgccttcagaggactacacgtccttgccttcgtagggcaacacgccctcaccttccgaggactacatgtcctcaccttcagaggactacacatcctccatttcagagaactacacgtcctagccttcagagggcttcacgtccttgccttcagagggctgcactccctcgccttcagaggactacacgtcctcgtcttcagaggactacacgtcctcatctttagaggactacacgtcctcgcctttagagggctacatgtcctcaccttcagagggctgcacgtcctcgcctttagagggctacgcactctggccttcagtgggatccatatccgctccttaagagaatttaaggcgatcaactgtgcgagcacaaccagagagggaggctatcacgcagctactatgcatatcgggcaagatttcacccgtgccgctgcaaagagacaagtggtggatcatgcgcgccaacatgaccactcttacacagatatggatgacgttgctacttag

SEQ ID NO: 72895 - DNA, 147 bp, Glycine max
  Peptide Sequence Number=SeqID_164580
atgcttcaagatgagcaagtatactactcatgcacaagactaacaaaaagcgttgaaggatctactgcctgctatggagaagtggtatcagccattggtgctggagtgtcctcaggagacttttcaggagtggctgcgacttcctga

SEQ ID NO: 72896 - DNA, 391 bp, Glycine max
  Peptide Sequence Number=SeqID_164581
gaaaataggggaggagcttgccacccagctcgcccaggcgagccaggttgcttcctccagaagcaaccgccttctggaggaagaatctggaaggcccaagttatggaaccttacgggtcatgtaattactccttttttagctttcggaaagttacggaaactcacggattacgaacaatacttccttttgatttccaacatgttacggaatttcacagattgcgtaacaatgcttccttttgattttcggcatgttacggaatttcacggattgcgcaacaaaggatgccaagtatctcgaagcggtcaaccaaaggttgcatgccatcaaacaaaggctacggagatttggatgacgccacttccagtgaaggaagataagtcaggatag

SEQ ID NO: 72897 - DNA, 453 bp, Glycine max
  Peptide Sequence Number=SeqID_164582
atgttaatgtgtaatgatcaattttcgtgtgttggtccgattgagttattatgcatcgttggaagaacaccagatgaagaaataaacttacttgaacgcactacgacccctactcatggcgcgctcttgtattacaatgggagatggaacatgccaccccagaacaaatttgtaggatgtgcgttcacaggaaaaaatccaaagaaatttgaaattccttcaggatgtaccctcgatgaactgaaggatttgataaagcaagttgcacctaaagggattccccctcatggaattcacgaatcacaagcgctgaaaaccaacgatgaagtgctgaaggtgttagtacagtctaactactggaaaaaatatgggccaatagaaattttagctgtttttactaaatatggtttggaattcgaagacgatgtggatgccacgtcgctaaacaactga

SEQ ID NO: 72898 - DNA, 600 bp, Glycine max
  Peptide Sequence Number=SeqID_164583
atggagaagagggtcatctcaattaattgcttttcccttgagggtcaacttgcaaaattagaattaattggattagggacatttcaacttcttcaaaaagtattgcatgctgttggaagagaactattggcaattgaagaaacatgtgccagaaattcatccatactgagaaatgaggattatttttcttcatgtgctatgctatctcttaatgtcaaggatcctcgagaattgccatggaagaagactgttgttccagtggagtccatttcaactaagactccgactgatgcacaagaaaagaaatacaaagagcttgctgaattgggaggaatattggaagagaatagagatttatcttcattatcaagagggttgaggcctccagtggaagacagttttctttctaaggagaaacaccatgaacgtatggttaatttctgccttgatgatatacattctggagaggccaactcttcaactaagcctcctggattcctctcatctgtaatgggggttgggggtggggggtttaggattgcgggatgcggggttttttggggttcaggattgggggtggcggggttttttggagttggg

SEQ ID NO: 72899 - DNA, 93 bp, Glycine max
  Peptide Sequence Number=SeqID_164584
atgaaggtggggatggagtgggaggcatcacgagagatgaggggggttgtttttcatacagtgcgtttcaaaaagggtgtagatttgaagtaa

SEQ ID NO: 72900 - DNA, 507 bp, Glycine max
  Peptide Sequence Number=SeqID_164585
atggatgaagacagacccgagacccacgatggaaggcccaagagaaaacggaggttcccttgccctcgaaatgaaggaccattgtcctctgcttgtatcaggaagccatcagagctgaagcccaatgtttcgctgtctagcgttaaggtcgtgactgatttggtagtggtctttgatgatgtggagccatgtctgattggctctgtcctatttcttggaacaaaattcgttgatagtgatagtgatgtcctagttattgataagtcatttggttttgacactgctgttgaagaggcacaaggagccataaactttgctcatgtggaagcagaaagcactgagaatggtatcgatattgtcaagcttatgggtcgttacagtgttcaatacaagttcattctgtttggagatggagacaagaacccaagctactgtgatcttgtcaacatgattacttctgatgtttttgatgctgccgtaggtgacattgcgattgtctctgtctga

SEQ ID NO: 72901 - DNA, 648 bp, Glycine max
  Peptide Sequence Number=SeqID_164586
atgatcaggtctgcaacagttgattcaagtttattttcaagatacttcaacaattgccctgtcgttactgcagaaggcaggactcatccagtgacaacatactttcttgaggatatatatgatcagattgagtatcgacttgcctcagattctccagcttctttgacagatgggacatttcccaaaggacagagagatgttgtgacaaatagcaggggtaagaagaatctagtcttatctgcatggggtgacgagtctctgctttctgaagaacattttaatccatattttgttccaagttattatcaattatgtagtgaacaaactcaacaaaatatgaaaagattgaatgaagatgtcattgattatgatcttcttgaagatctaatatgtttcattgatgaaacttgcgatgagggtgccatccttgtatttctacctggaatgtctgaaataaactatttacatgataagttggtggcatcttcccaatttggtgggccatcttctgaatgggttattcctttgcattcagcagtagcatcaagtgaacagaaaagggtatttttacgtcctccaggaaatatacgtaagctatacaaggaaactttggtggatatccctgacatggtgtatttggcaccatag

SEQ ID NO: 72902 - DNA, 645 bp, Glycine max
  Peptide Sequence Number=SeqID_164587
atggggctcatagcagaacctattacaaatatttgccctgcactcctaatgtcaactacatctaaaaccatgatgctgtatggtgcaatgtttggttgtttgtctccaattctttcagttgctgcatttctgagttacaagtctccatttgtatatcctaaggatgagaggcaaaatgttgaaagagcaaagttgacattgctgaatgataagctagatgggcctggcaacacaaatgatattgatcggcaatctgatcacttactgatgatgacagcttataaaagatgggagaggattttgactgagttggtgggtgtcctgatcagccatccctctgcataccttgggcaaagccttcttcatgcacccctgcgctcggctttttgtggtagttttaaccaaaacatgagactcaaactgccttttcggagtccattgatcatactgcttgttcagatctgttcacaggctcttttaggttccttttttcgtaatttggtttttgggctttgcccgaaaatgagttatgagcctaactcaaccttacaaaatcggcttgtaagggagatgagggtacagtttggaactttgctagcagacattggtctcatcactcttccgaaagattatcaggacaagtaa

SEQ ID NO: 72903 - DNA, 879 bp, Glycine max
  Peptide Sequence Number=SeqID_164588
atgatagttagaactccaccgccacccaagaggccacgcgccgatggcgatgacggacagctagtcatctacgaggatccgccggagtcatcccctccttcggagcaaatgctctgcacctatcaatgtcgccaaatggtcaaatccgattttattgatgccttaagcaaagctgaaaatcaagctcgtcattatcaatccaagtttgagacattggagcctcatttccgcaaagttgaatctgagaggaagaaatttcaggaccaattcttatacgcccaacaggaacttgcagctgcaaaaggccgcgagcaggcactccaagaccaactcttgaaggaggccactcagtctcaagaacgattaagaaaacaaattcaattaaacactcaactccaggttaagctccaaaatgagacagaccttcgccaaaaagctgactctcatgctgcttcaacagaggagaaagcagcatctttagaaggaaaactaggccatctctccgaaagtatagagagggaaaaaaagcgacttcatgatgagcattcacaactgaaaagcgactcaaacttgtctatttctagaatatccgcaaatcttgaacaaatggaatgcagagctaataatgctgagaaagaagcagagctgctaaaagaacaactgaaacatcttaaggatcaacttgatgagtgtttgcatcagaagattgaagttgaaaaaaaactatctactttaatgtctcaagaagttgcttctacagagagtaatgttttagttaaacatttgcaacaggagcttcggaactattgcaaggacacatacattgattacttgatgtatgactctggactaattttggtagttatgcatctggcataa

SEQ ID NO: 72904 - DNA, 1185 bp, Glycine max
  Peptide Sequence Number=SeqID_164589
atggaaaggcaacgccgagaagaggagcttaagaaccggtcatccaaaaagacacttgatgcagaacagtcaattctaaatagggcaactagtcctcaaacaagtcaacaaagtgggggaaacttaaaatcgatgaaagataaatccagtcagcaagacagggatacacaagagggatctggcttgaagactgctgggcctgaaggggagataaccgcaggatatttgttgaaaaaaagtggaaaaggtagtggttggagcagacgatggtttgttttaaatgagaagactggcaaggaatgcaatattgacgagattcctgatgatgatgaagcctccacaaagaattccaaggataaaaagtccaacggacctgattctggaaaagcatcaaaccttattttcaagataacaagcaaggtcccatacaagactgttatgaaatctgaaagtgcagttttgttaaaggctgagagtatggcagataaggttgagtggatcaacaagttaagaagtgttgcacaggctaaaggaggtcaagccattggtgaacctagttttcctatgcggcaaagcctttctgatgggtctcttgatacgatggccaggaaacctgcagatccagaggaggagctcagatggatgtctcaagaagtccgtggttatgttgaagctgttcttaacagccttgcagctaatgttccaaaagcagttgttctttgccaagtagagaaagccaaagaagacatgctgaaccagctatacagttccgtcagcgctcaaagctctgcaaaaattgaggagctgctccaggaagaccacaatgtcaagaacaaaagggagcgagttcagaaacagtctgcccttctttcaaaactcactaggcagcttggtgtccatgacaatagagcggctgcagcatccagttggtctgatagagggagtgcagcagaaagcagcccaagaagctctggaccctcatcaggtgatgattggaggtctgcatttgattctgctgccaatggtccaagcaacctgacgtctaggtatggttctggtggtcatagtagacgctacagtgacccatcccaaaatggtgatgtgagctcaggctcaaattccaacagtcgtcggacgccaactcggttgcccccggctcccccacaatctggttcaagatattag

SEQ ID NO: 72905 - DNA, 684 bp, Glycine max
  Peptide Sequence Number=SeqID_164590
atgtcatctgcaaaaagcatgcatctcggcgctatctcttggatttgttccgtcaggacatccaaaattaaggggggacgagaacacaccaggcttgtcgaacaggggcgcagagaaacttaccaggcacagaaacacacagcgacgccgggcctggtacgcgggtcttttgcagatgtggtagctaggagagaaccacgtatacagcagaggaggacatcggcagttcagaatgctaaaaccaacacttcgagatcagaagtacatctcgacagacctatgacagcaccgaaatggctacaggatgcatgggtgggaaggctaaaaaatcttgcactccttgacagagtagaggagaatatgctatgggactggggattagacgtagtgccgaaatacatcggcgacgacatggtacttctccccggacttaccgaagacaaggcaaaacaaatgatggaggaagggaatgcaggaagggaggtgatgttctactcggtagaaaggtggaacaagaagatgcgtgctgggtctagacttacatgggtgcaatgttggggagtgccgctggtagcatgggacccaacacacttaagggagatcgtgacggccataggcgaggtagtggaagtagacgaggagatggaggatttgaggaagatggacaggcaaggctccttgtaa

SEQ ID NO: 72906 - DNA, 186 bp, Glycine max
  Peptide Sequence Number=SeqID_164591
atggtggtgacgacaatgacaatcatgatggtggttgtaatagtgattatggtggtagtagtaatgacgatgaaggttatgagaacagaggtggtaattgatgatgatagtgatgacaacaacaattatggtggtgactataacggtgatagtgataaccatgatattaatctttcagagatttga

SEQ ID NO: 72907 - DNA, 882 bp, Glycine max
  Peptide Sequence Number=SeqID_164592
atgacaggatactcctcttacttattgcttgctgttgttaccgaggaaaggaataaattaagaaattttgccaatttgaagaatgatgaaactctagatgcttcaaaaaatgcaaactctgttcaggaacctgaatcatctcttatgaagaaagatgattgtgttaaagatttagaaagtaccttgcatgagcagagattggttaataattgtcaattagaggaaatcaagttacttaatgaaaagttgcacagtgaagcaagaagagtgaagtcattggagagggagagtgaccggctccggtcagagatttcattattagaggcaaagttgggtcatggtgatttttctgctgctaatacaaaagttctgcggatggtgaatacacttaccgttgataatgaggccaaacaaacaatagaggcactgcaaactgagctgcaaaaaacaaaagagaaattaaaagctttggaagaattgaagagtcaatcaggagaagctggaaagctggtagatagctacatatcagataagatgttacaattaaaagagcaaatcgctacacttgagaagcgagaagaaagatacaagactgtgtttgcagacagaatttcagttttccggagggcatgctgtgagctttttggttacaagattgtgatggatgaacaccagcgttctaatggaatcccggtgacacggtttaccttgcaatccatttatgcacaaagtgatgacgaaaagcttgaatttgaatatgaatcagggaatactaacattttggcaaatcattatacatctcagcctgaagtttctcgtcaggatctgatcttgtatttctttgaccacgatcatcaatatgattgtgagggttttgtttaa

SEQ ID NO: 72908 - DNA, 873 bp, Glycine max
  Peptide Sequence Number=SeqID_164593
atgcttctctccggttctgttctgcaatcgttagccattctaggacgccctaatgttggtaaatcaaccttattgaatgcattgttgcaagaagaccatgttcttgtgggtcctgaagctggtttgacaagagattcaatcagaacccagtttgaatttcagggaagaacaatttatctggtactcaataggcatgctgattatacttttgcttcaagggttgatactgctggttggttacagatgcagtctactccgggcattatgcaatcaaggaagagtctactccaggctcatataattgctttggtactagatgcagaagaggcctgccaggccctacctaatggattagccactcatggccatcattctataggcaagattataaatgcaagacgaagtatgaaacatgctgaagtaattatagccagatgggcagtggaagaaggacgtgggctggttgtgattgtgaacaagatgaaccttccaagaggcaaacaccaatcgtcatcctatgagaaggttatggaaattgttccacaagaaattcagacaattatacctcaggtaaaaggaatcccagttgtattcatttcagcattggagggaaggggcaggaccactgtcttgaatcaggttatgagcaggcattcttggaaaggccaagcagcacagcctaaggttaagtatttcactcagtccttgaaggagaactttgatttgggtggaattcctatacggctcatgcaacgttttgtcactaagaaagatgccagtggaagtgaaactagaactagcaagaatagccattcagtaggcagagtgattgaaaggactgtctctgacaagagaagtgtcttagttgaataa

SEQ ID NO: 72909 - DNA, 480 bp, Glycine max
  Peptide Sequence Number=SeqID_164594
atgtcgtggataaatcttaaaggtgctttgccattgagtataaagcacctattcatgcaatactcctttttgcaggatgcaagtagtaggaatagaaggtggcaatattggtggttggctatcacttggtccacttggcaacttcgaaataaaattctgttctcaggagcgacctttgatggaatcaaattggttgaagacgcgactttcttaatgtggacttggctccataatttggagaaggactttacattacattttaatcaatggtctagtgattttaacagcataagaaggccatctgaaagagtaggttctaatgaaagacaacaagatgaaaggagtattaaggaattcaatgagtggatagctgagcttgaagtggaagatgtaccttgtgtggggagaaaatacacttggtacaggcctaatgggacagtcaagagcagcctagacaggatcctagtatctgcaaaatga

SEQ ID NO: 72910 - DNA, 531 bp, Glycine max
  Peptide Sequence Number=SeqID_164595
atggtgcttaaccactcaagacagaagcaaaacacaatttttgaatgcttaaccactataaaggcagaagcaacacaacaatgtttaaccatgcatgaggttcttgaccagattgaacaccaggaacaacaattgcttcaaggacagagacaaggaagaagttgctggacaacaggatcaacaaatgacctaaaattgaaccctggggacagagatattaaactgcagaccacacaacagatgaatagaaggacaggagacaatggagctgcacaacaaagggcagctggaaggggagccttgacaacatacaaaaacataccaaacttagcaactgcttttgaggaaggacttcaaaccaaagcaatgggtaccctctggcttggtaacaatattactgtttgtaacacgagagagagctgcccagcagagaaggagaacgcaggactggcagaggccatttttgatcaaaaagacgaagccctaatggagaacaagaagggaatgcaacagttggacagcaaaggctga

SEQ ID NO: 72911 - DNA, 768 bp, Glycine max
  Peptide Sequence Number=SeqID_164596
atggattggattggattcgtaaagaatattaaaaagcggaagaaagcagagcagagagggaggtggaaaaagaaaaaggaagaaggaatgagtgcaacagtgactctaactctaaacctatgccgttcttccatcgtcgcttcttgtccacattatagccacaaaccaaaccctaatttcaatgccttttttagcttctctttgtctctgtctctgtctcaccacagacgcatcgttatctacaagaaaccattcccctctagacggacgtggctttatggatatatgaatagagatcgagattatgaattggagaatgggttagccttattcggttctgatgaagaactagcaacacaaattccaactcaggcccagtcacttgttgaaggatcaggctccattcgcatagcggagttcaagcctgttcctgatgttgattatcttcaggagttattggccattcaacagcaaggacctagagctattggcttttttggaactcggaacatgggattcatgcaccaagaactaattgagattcttagctatgctatggtcataactaaaaatcatatatatacatctggagcatctgggactaatgctgctgttattcgaggtgctttaagggcagagaaaccagagttgcttacagttatattacctcaaagtttaagcaaacagcctcctgagagtcaggaactattgtccaaagtttttgttataaacaattatatatgcatattccctgaaaagcagttctaa

SEQ ID NO: 72912 - DNA, 1077 bp, Glycine max
  Peptide Sequence Number=SeqID_164597
atggcgccgaaaaagaacaagcagaaggccaaggcgcaatctggtccgaagcttcagatttcggccgaaaatgagaaccgcctccgccggctcttgctcaactcggcccggccaaccactgcgactgcggcagatgataccctaacgaaggctcagaaggcaaagaagctcaaagccgtttacgagaagctctcttgcgaaggtttcggcaatcatcaaatcgagctctctctctctgctctcagggaagctgctacatttgaatcagctcttgattggttatgcttgaatttgcccgggaatgaacttccgctcaagttttctactggaatatctcattatgaccaagggggttctgttggtgttatatcaaatcaaccggctgtggatgctgcatctattacaatcgaggaggaagctccagaatctccagttttaatcaggagacagtggaagaatgatgatactttagattctcgtctaacatctcaagcagattggatcaggcaatatgtggagcaacaggaagaggatgaatctgagtcttgggaagatgatattttttttgatggaagaagtgccaaacacaagccctgtgaacctaggtcttatgatgttattgctaaggagtatcttgctgcaaggttggaagccacaaaagccaaggaaaaaagggacaagaaccgtcaggagcaggccggccatattatccggaaactgaagcaagagttgtctgctctaggattatcagatgacagtttggccttagaacatgagcatgaaatcagttatacctttaaatctgagagagcatccacgggtcctgaggctgttgattgctttaaagaaaaaactccatgtgatactgaaggattggcttctggcaaaacagaagttgccgaaagtgatgtggagagccatagcatggtggaacatcttgttaagtctggttcactggttgtacatgtggaaaaagattcagctcaaggagaggttggagacattgagcttggtggtttgttcttggaggatgcttcacctagtgagatattacctcctgatattttgaaagtacag

SEQ ID NO: 72913 - DNA, 312 bp, Glycine max
  Peptide Sequence Number=SeqID_164598
atggaggaagcacaaatttgggctcagaaggtggagctgccaacgttcatggggacatacccaattggttggattgctagggctgaaaaattctttgaggtactagaaattccttcgttccataagctgcaatatgcattcatgagtatggagggtgcagcgacacattggttctacatttggagccaaaacaacccagattcagattgggagtcattttccacagttttgatcaaaagattcagagatcgccatggcactgtaattacagaacctggaagaaaccacaaaaagagaaaagtacaggagtga

SEQ ID NO: 72914 - DNA, 426 bp, Glycine max
  Peptide Sequence Number=SeqID_164599
atgaattacaggaatcatgttatttctactgtatatctcatcaatcgccttccatcatcatctatccatcaaaagggctacaagtgcatgactgcagatggacgaatttacatctccaaggatatgatctttgatgagttgagctttccttttcctaggttttttggtgatacagcctcagcaactacctctgctactacagccagtgatacttctgcatcacaagcagctgctcttgttcagcagtcaccagtgagttccacctcagtggatgttgatcctgtctctgatttcccagactctcagcaacatcaagagccattacccacagatgttgcctactctcaagcaacagctcttgtcagacctgaaaatatccatcctatgtgtactggggccaaggctggtgttgataagcctaggtag

SEQ ID NO: 72915 - DNA, 390 bp, Glycine max
  Peptide Sequence Number=SeqID_164600
atgatcacgggtctctgccagtcgttcggggttcccgtcacacctagcaaggtgattcgaccgccgatcaccgggccttcattgagaagtattgcacgcctagacaggcgcaggcacttggttcgccagcaggcggccaaccacagggggcaggtgcagacccacgagtgtctctaccagctcagcctcagtctgcagagtcagggtttcgctccttttgcgtgccctactccaaatcagtttagggcagaggctgcatggcccggagattggcctgaggcccaggcaggggaggcgcctgcaaaggctcccggcgatccagaggacacctgcatggatgaggagatgacagatttactcgacttcttgggaggaagcggagccacatga

SEQ ID NO: 72916 - DNA, 310 bp, Glycine max
  Peptide Sequence Number=SeqID_164601
taagccagtatacactccgctagcgcccaatacgcaaccgcctctcccgcgcgttggccgattcattaatgcagctggcacgacaggtttcccgactggaaagcgggcagtgagcgcaacgcaattaatgtttcgagacaaagagtttcggtccgggcttttttcttgcccctccgaagaggcagttatagaaagccacatcaagccagctacgtacaggaaattcacttcgagggagtatagacaacagactgagaaagatgtcaagcaaaccggggataaagtggggctctctagatttcttctctag

SEQ ID NO: 72917 - DNA, 516 bp, Glycine max
  Peptide Sequence Number=SeqID_164602
atgttttttaaaaagcttgagtttgacctttatagtaaacaagtcaagccgagtcgagccttaaataagccgagccataggcccttgacaagcggctcggctcattttcatccctacctaccatatggcttgcctcccaactatacaccacccagcgttgcacacgctcccgatgagaatgttgataactctggtcccataccctttgagagccaacaaccccaatcaggtcatgccaatgtctctcaacccatgggggagacacctgaagtaccccaaaaccacactctagccaacttcaagcctcacctcggatacgtcactgaggggcaagcatttggtagcacacccctgctaaacactttggggggccctcaatatcgcccacaaccacaacccttgcattttgcggtgggaagagtccctcctactatggtggaaagggagaaatttgatcatatagaggaaaggctgaaggctattgaagaaggagaggattatgcctttgctgacatg

SEQ ID NO: 72918 - DNA, 453 bp, Glycine max
  Peptide Sequence Number=SeqID_164603
atggggtacattcagaccgttcctccaccaccggttcgtgattcgttgacagatcatgtggtgtctacaggggagctctgtgtagttcctgggcaggtggccccagactacatgcagtggttttttcagatttcgcacccttttgtgacgccgacggaggacactggtgagccgagacctgcgcctccccctcccactcatgatgatgacttcgtcgagccacctgtcgccgaggttccagtcgcgtcagatccccctacgcattatgtggttgattgcacagcatgtatcaggattggaaggattgctgagcatttggagcgtgtcatcaacctcaggatggtgactgcaaggactgacttatatgatatcatgaatctttgtctgaggatagttagagatgtcgacccaaatgacagtcctagaccgcgacagagacctcgcatagattag

SEQ ID NO: 72919 - DNA, 474 bp, Glycine max
  Peptide Sequence Number=SeqID_164604
atgcagctactatgcatatcggggcaagatttcacccgtgccgctgcaaagagacgagtgcggatcatgcgcaccaacatgaccactcttacacagatatggatgacgtttctgcttagcaacattccacccggcgaccgcaatgctgatctccccctgcggaagtatcagttggtctgtgccgtctcgacatgggtaagggttgtgcccacaagacacccagtggacccgaaggagcccaacatggccctggggtttccagttctggttacgggcctctgtcagtcctacagggcgcccgtccccccagcaaattcatgccatcgtgacataggtaaggatcgtgcccgcaagacgcccagtggacctggagaaggccaacagggtcttggagttgccagctctaattataggcctctgctagttctacgaagtgcctgtcgcccccagcaaggtcatcaggccccttactaa

SEQ ID NO: 72920 - DNA, 1644 bp, Glycine max
  Peptide Sequence Number=SeqID_164605
atgtcgaacaaacccttctactaccagaatccctttcctctcgccaaagacgataccgagtactatctgctgagccgcgaccatgtttcggtggccaactttgacggcgaagaagtcctgaaagtcgacccgaaagcgctgacgctgctggcgcagcaggcgttccacgatgcctcttttatgctgcgcgcgtcacatcagcagcaggtggcgtcgattctggcggacgatgaagccagccagaacgacaaatacgtggcgctgcagttcctgcgcaactcggaaatcgccgctaagggcgtgctgccgacctgccaggacaccggtaccgccatcatcatgggtaaaaaaggccagcgcgtctggaccggtggcggcgatgaagccgcgctgtctcagggcgtttacaacacctttatcgaagataacctgcgctactcgcagaatgcgccgctcgatatgtacaaagaggtcaataccggcaccaacctgccggcgcagatcgatctctacagcgttgacggcgacgaatacaaattcctgtgcatcgccaaaggtggcggttctgctaacaaaacctatctgtatcaggaaaccaaagcgctgatcacaccagcgaagctgaaaaactacctgattgataaaatgatgtcgctcggcacggcggcctgtccgccgtaccacattgcatttgtcatcggcggcacttccgctgaaagcacgctgaaaaccgtgaagctggcgtcaacccactattacgattcgctgccgaccgaaggtaacgaacatggtcaggcgtttcgtgacgtgcagctggaacaggaactgctggaagcctcgcagaaactcggcctcggcgcgcagtttggcggtaagtattttgctcacgatatccgcgtggtgcgtctgccgcgtcacggcgcatcctgcccggtgggcatgggcgtttcctgctcggctgaccgcaacatcaaagccaaaattaaccgcgaaggcatctggatcgagaagctggaagacaacccgggtcgctatatcccggaagcgctgcgtcagcagggcgaaggcgaagtggtcagcgtcgatctcaatcgcccgatgagcgagatcctcgcccagctctccgcttacccggtggcaacgcgtctgtcgctgaacggcaccatcatcgtggcgcgtgatattgcgcacgccaaactgaaagagcgcatcgacaacggcgaaggtctgccgcagtacatcaaagatcacccggtgtactatgcgggcccggcgaaaacgccggaaggttacgcgtccggttcactcggtccgaccaccgccggccgcatggactcctacgtcgatctgctgcaggctaacggcggcagcatggtgatgctggccaaaggtaaccgcagccagcaggtcacggatgcctgccataaacacggcggcttctatctgggcagtattggcggcccggcggcggtgctggcgcagcagagcattaagagtctggagtgcgtggagtatgccgaactgggcatggaagcgatctggaaaattgaagtggagaacttcccggcgttcatcctggtggatgacaaaggcaacgacttcttccagcagatccacaaccagtgtgctgcctgcgtgaaataa

SEQ ID NO: 72921 - DNA, 1212 bp, Glycine max
  Peptide Sequence Number=SeqID_164606
atgaaaagcggaacatgtgcgatttgtgcggtcaatatgaagcagacccgtgaacaggagaacaagatgctggcttcagccctgatggtaatgcgcgccaaagcgaacttcgttcagcaatttatccgcaatccgcgcaaaatgggcagcatcacgccctcttcagctgccctgtgtcgcgccatgtgtgaaacggtcaactgggagcacagcctgcgcattgccgagctgggcgccggcgacggcgtgctgacccgtcatctgctggcacatatggcaccgcaggcgcagctggatgtgtttgaaatcagtcccgagctggtaaaagggttacgccgctggaacgatgcgcgcatgcaggtgcgcgcctgctccgcagagtatctgtccggggagactggggccgcgcggcgtgtttgtccagtttcagtacacctcgctgacccagcccagcctgtcacgctacttcacctggcagcgccagcgggtgctgaaaaatatgccacccgcgtgggtttatcgctgcacgcggcattacgcgccctgagcctgcgcctgcgggcgcgtttgctgccagaaacgctgcagcagctcgcgcgcccagtcttcgccagacagctgcgcgccatcatcgctgacgccggaaggcagacaggcgcgcctgcggcgaatagcgcaggatctggcaaccatccagcgctgaacgcgccagcacctgtgcctgcggcggcggtaccagcaccgactggcggtgcgacaaccacgccgggaaggcctccggcaactgtgccagccacggatcgcgccgttcgggttatcgcccactttaccgcccagcgcataggccatcagctgatggccatagcaaacgccgagcagcggcagttgcgcgtcgatggccgcacgaatccaggcggcggtgcgctcgctccagtcggcgtgatcggtcaccatcgcccacgaaccgctgaaaatcgcgccgctgatgccagagaaagccggcagctcttccccgagatgcggccgcacaatgacataatcatccggctagcaagggtggggattgctggagcttccgccactgtttctgacctggatgcgctttgtggtggtggctatcgtgctggtgccgttttgccgcatcacgcgcgcccagctaccgtggctgctgacgctggcgtttacctttggcttcatgcacttttcactgct

SEQ ID NO: 72922 - DNA, 405 bp, Glycine max
  Peptide Sequence Number=SeqID_164607
atgtctatgccagttaggcctcccgatgttgcagctacaccatctccacctccgactgaagctagaccattttcatctcatgttgatgcacctggaccatccacggtaccagcattcacaccatctccatcctcggttgatgcacgtggaccatccccagtacctacatccacaccttccccatccacagttgtagccaatatgcctatcgatgaagatgctacaaatttggtgatggaagacccctccattaatgactgtcttatggttacgctaatcaatttagcgtttcatccatctaaggttgcaacaaaggctatcactttgtccattaggcaacaatttggtcagccttggcctacacagggagcgattccaaaagatcatcgggaactttttttctag

SEQ ID NO: 72923 - DNA, 168 bp, Glycine max
  Peptide Sequence Number=SeqID_164608
atgcatctacgtgatcaagatcttcacacaacaaaatctctcaaactctctgaaatttggacctctctctctaggactaaagacatgcaagagctcctcaagaaaaatggccaaactccccttctaaatctgatttcaggcaactctgatccgctcagcgcacattag

SEQ ID NO: 72924 - DNA, 318 bp, Glycine max
  Peptide Sequence Number=SeqID_164609
atgcttgcaatagaatctggaatgagccctcttgtccttgttgcttatcgacaactctttgctactgtgtccattgctccctttgcttataggctcgagtggcaaaatacttcaacgacggtccttatgaaaacccgtctttatagccttatttaccaacaacgacgggtgctccagccaccgtcgttgaaacctcaaacaacaatgacggtgtacacaccaccgacgttgacatactaccaaacaacgtcggtggtgagcccgccaccgatgttgacaggaaacaaaacaacgacgggtcttgtgaacccgacgtga

SEQ ID NO: 72925 - DNA, 405 bp, Glycine max
  Peptide Sequence Number=SeqID_164610
atggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccggtgtcattccgctgttatggccgcgtttgtctcattccacgcctgacactcagttccggtccgaccgctgcgccttatccggtaactatcgtcttgagtccaacccggaaagacatgcaaaagcaccactggcagcagccactggtaattgatttagaggagttagtctga

SEQ ID NO: 72926 - DNA, 936 bp, Glycine max
  Peptide Sequence Number=SeqID_164611
gattgcatcaaagctcagtcccaaaattctgacaaattgccttcacaaactgtgcagaatccgaaaaatgtgagtgccatcaccttgaggtctagcaaccaaattcaagtgcctccaccagtagcagcacctgcacctgaacttgtcaagcttcattctacacctgaaaaagaggatgagactgttgcacaaaaaagaaagcttcctaacaaaatttttcatgcaggtggaccttcttctagtaattttgacttgcagcagcctcctatcccacttccattcccacctagagcaattccaaacaaaaagatggaagaagagttgtgcacccacaaaaggatgctcaaaggcaatgaaaggattagcatgggtagaaatgtgtcagcattgataggtaaatctgttcctcacattcctgagaaatgtaaggacctagctcgaaccaagatagatgtttatgctggcacattgtctatggaatttggtgatattgttgttcattttaacattctggatgccatgaaacatccatctaaggatcattctatttttcgtgctgagataattgatcagattgttgatgattatatgtttgattttgattatgttcttcatggtaggaaacatccatttttatctgatctgcatacttctcattccttatgcattgaatttgaatctgagtttgaatttgatcctgtatctgatttttatgctaagcatgaatttgaatttgagtctggtgttgtacctcttgatgttgattttttagagtcagaatgcactaaccatgttgcaggaagtacatatacttctgacttgctttatgaggtatatgctgaggaaccttcttcttctcctaccctggatgaggaaaaatttctagtgatcatctctgcctcccttgttgttgagcaagaggagaagttgttgcta

SEQ ID NO: 72927 - DNA, 936 bp, Glycine max
  Peptide Sequence Number=SeqID_164612
atgacaagctatggttctgaaagaatcactaataaaattccacatctagaagcccatttactcagaaatttagacaaaaatggaattgtgatcctcgggtcgtgggtagaaacgggtgatattttagtgggtaaattaacacctcaaatggcaaaagaatcctcgtattcccccgaagatagattattacgagctatacttgtgcctgcaggtcgtctgaggtatccccgttgtccaattgacacgtcggaaggaatcaatgttggacttattggatctctagcaattcatgcgaggattggtagttgggggtccatagaaagtccattttatgaaatatctgagagatcaaaaagaatacgcatgctttatttatcaccaagtagagatgaatactatatggtagcaacaggaaattctttggcacttaatcgagatattcaggaggaacagactgttccagcccgataccgtcaagaatttcttacgattgcatgggaacaggttcatcttcgaagtatttttcccttccaatatttttctattggagcttctctgattccttttattgaacataatgatgccaatcgagctttaatgagttctaatatgcaacgtcaagcagttccgctttctcagtccgaaaaatgcattgttggaactggattggaacgccaagtagctttagattcaggggtttccgctatagccgaacacgagggaaacatcatttataccaatactgacaggatatttttatttggtaatggagatactctaagcattccattaactatatatcaacgttccaacaaaaatacttgtatgcatcaaaaaccccaggttcgccgaggtaaatgtataaaaaagggacaaattttagcggatggtgctgctacagttgacggcgaactcgctttgggaaaaacgtcttag

SEQ ID NO: 72928 - DNA, 176 bp, Glycine max
  Peptide Sequence Number=SeqID_164613
caccaaaccacaaggcaatgagcagatacatggagaagaagatgaagaacaaggaattaaacttgttggccttggctcttcttcatcaatggagtcctttgcttcttgaagatcaatgtcagcagaatggaaaaggaggaaaggtgattggagacaccacttcaaggagaagatga

SEQ ID NO: 72929 - DNA, 621 bp, Glycine max
  Peptide Sequence Number=SeqID_164614
atggtcaaaagaaaagtgattcacacaaggagacctaatcaattagcattgttatgcttacttggcagtttctattacctaaccaatacagaacatgcctacactaatccgttaaagaatttgagaatagctagacatgggaaatttggagaaaattctgctaggtcatcagtacttgcatgggtatacagaccaactaaaccaaggccaaatgattttggtaggaaacccatagaattggtacaacctagccggccaaattcaattcaggcaagattgattccactagtgcagccgaattcagtcagttcaaccgaattcgggtcagttatttcagctgaaggcagttcagctaatacagccgaattcagtgcatgcaggaccttcttggatggttcagccaatatgattcaagtaagaccaacaccaattcagttgtgttatgctcaggcaagccaggctttgcaagtccaaccaaatttcactcaacatgtaccgtatagccattcttggcccaatcaggttcatccgccacttccaatcaattgcttgcttgaatcgctgtttggaggtttgagagcgagaacactgttcacggtaacaggctgtttgggtttttaa

SEQ ID NO: 72930 - DNA, 552 bp, Glycine max
  Peptide Sequence Number=SeqID_164615
atggcttccatgatggaggccatgttaggaatggaacaactcatggagaataacgtggccactgctgccgctgttagttcggctgttgaagcagacccaactctcccagctaccgcacaccatcctctcccaaacgcggtaggacgagaaagaagcacattggggcactccagcaacccccatttgggatacaactgggtggcttacccttatggattaccacgtaattacacgccaccagtcatgcgtgatgacacaggtcatgtcccttcccccggggactcttccaattcagcacccgtacagcctagagcgcccgcgcccatccagagggagaccccaagctccggctccaaccccgactcgcccggccggcaacgcccactttggcgctggttccaacgcgatgaggaactttcccccaaggccaactccagaattcaccccgatctcaatgacgtacgaagacctcttgccgtccctcatcgccaaccaaatggttttgatatctcctgggaagatctaccaacctcctttctcaaagtggtataa

SEQ ID NO: 72931 - DNA, 99 bp, Glycine max
  Peptide Sequence Number=SeqID_164616
atggcaaatatatacgcaaggcgacaaggtgctgatgccgctgcgattcagatgatcttcttgagatcgttttggtctgcgcgtaatctcttgctctga

SEQ ID NO: 72932 - DNA, 709 bp, Glycine max
  Peptide Sequence Number=SeqID_164617
tggaacctcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttaattgcattcctcatgaaactgagtatgaggcgcaactcccagctatacgactccagtctatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggagatacttaa

SEQ ID NO: 72933 - DNA, 168 bp, Glycine max
  Peptide Sequence Number=SeqID_164618
atgccagaggacccgactacatcagtcctggctatggacacttctcctctagctactccagtattgcatctgacagatgaggaggatgttcagacacaggacacccaggaccaatttgtaagctttggggctgaaaaactatataacagcaccaaggttctagtttag

SEQ ID NO: 72934 - DNA, 512 bp, Glycine max
  Peptide Sequence Number=SeqID_164619
ggactcgcacagcctcctgagcctgagattggtccttcagttactcgtgtcaacacaaaggagagttttgttgatccctcagggaatgatccaaacacgggtgacttagacaaatacgagttgtacatcaaagaaaatcctccccgcctggttgccctgggaagagtttataagggatccacaactgctcacaacattcctttgttgcatgatcaaatcaaggttggtgttgaggaggttagagatgcagatgctcccattcttgtacccactgaatacgttatgttagtgggggaggcacttaacaccttccttgcttggccgacacatcttgtcaagcatttatcagaacagggagatgtgggaccggcaaaacctgcagataggccggatcatgatgtcaatgatcccttatatatgatgacattgaaaatcccacaagtttttctgaagccattgcaagttatgtgggatgctactgtgttcgggatgtttaatgaagacttcccttt

SEQ ID NO: 72935 - DNA, 171 bp, Glycine max
  Peptide Sequence Number=SeqID_164620
atgactgagaacaagagagggtacatctcttgtggatcagttctagtggagggtacatccactagggtttcaaagagaacaagggaggaggcttgcgtggaatcgacgagcacgaacaaaaaggaatcttcaagtgacgcgacgacgaatccgcggggtagctcacgatag

SEQ ID NO: 72936 - DNA, 482 bp, Glycine max
  Peptide Sequence Number=SeqID_164621
atggcaccttctgggtcaaaagaacttatgaggttgaggaatggagcaaagtttccaatggcagctattagtgaggatttgataaagaccacaatgacagtgcatgcagagaaaccagtacaattcaaggtcaaagtggtggtgataatgagaaataaaatcaaagaggatttcaaagagactatcttgaagcatttggatgtcatcaatgataggataggaacaagaaatattgtgctggagcttttcagcaccaagattgattcaaacgatttgtttcataattgttgcacgatagccctcaggccattgaggataagacttggaggttctttgcaagaccaggttctgtatgatgtgggaagtttgaagtctccttgccatccccttcaaaaggttaaaggtggattgtttggattttcaaagggatgtttacacatgaaaaggtgggatgagctgaatcagtttttctacgagacagg

SEQ ID NO: 72937 - DNA, 507 bp, Glycine max
  Peptide Sequence Number=SeqID_164622
atggtgtgcagtgctgcagttaaccaaagaacgcgttcaggaagactccacttttggaggatatccgatgaaagtgaggagaaggcagcctttcttcaggctgtatcatctttcggcaaggatttaaggataattctacagcatgtaggaacaaagtccaaagatcggtgcaagaaatttttcatcaagggtcagaaatcccataggttggatctcatgcgccatagacttgaaaatattggatctctactgaatgaaatagatattggcatgagtacttacactaacgatgcacacattgtggagggagattcagccgctgacaatgataagttagatacaaaaacaaatgatgaccagccttcatctgccgcgaactcgagccatgataaatccaaacctatggaagctaggaatctttcaactaactttaaggaatcagtcatggcaatgataagtcaggcaccaaaacaaacgatgagcagtcttcatctggcacgaacttga

SEQ ID NO: 72938 - DNA, 201 bp, Glycine max
  Peptide Sequence Number=SeqID_164623
atgaatcaagcaactctgttgcaaacaagcggcaagagtgagacattggtggaattgcagggtttaccacagactagtaagggaattagtgcacagccagcacccacatgggcaatagggatgcccatcatgcggcatgtagcaaccgactttgagaacactatcatgggaagcaagattgccactattttcaatgtgtaa

SEQ ID NO: 72939 - DNA, 699 bp, Glycine max
  Peptide Sequence Number=SeqID_164624
atgttagaaggtcccattccagatggatttgggaaagtaatgaactctcttgaagttcttgacctctccggtaacaaactgcaaggcgagattccatctttctttggtaacatagaactcgttgtctctgaaattggtcccaagcgacccatcaagcccaacagaagcgaacccgacgccgttttccaataccccgtcgcagccgcttctgtcaacaatatacctgagcttcacaagtttcaatcccttcaatctccctctcatgctataatttcatcggcggggtttgtggatgcacaggatgagtttgtggagacgcagtactataaagaattggcatccattgacaaacaacatcacacgacagtgagtgggttcataaaggcagcgagagaaggaggggaaggtgaatatgagattcagttgcccaataatcatgttaatgctgctgaaacccaacccaggtcctataaaagcaaccctgccactaacgattgggttcctaactctgatgaacatcaggcacaagagctgaaaggcactgtcccgacaggggtaggagcaaaaggccactcgacaagaggtctcagagcggcccctatgagaagcactaaactcacacaaagaacaaacaaagaaaaagtgcttgctgcgggtgaggatgaagacattgttggaaataaggctttttatgtttag

SEQ ID NO: 72940 - DNA, 114 bp, Glycine max
  Peptide Sequence Number=SeqID_164625
atggataagagcttgaaggtaggaaaagatgagtggagggagagggagataagggctatggttcagcccactaatccaagatcaagtccaagattctccgctaagtgtacttag

SEQ ID NO: 72941 - DNA, 630 bp, Glycine max
  Peptide Sequence Number=SeqID_164626
atggtgtgcggtgctgcagttaacaaagaacgcgttcaagaagactccatctttggaggaaatacgatgaaatggacagatgaggagaaggcagcctttcttcaggctgtatcatctttcggcaaggatttaaggatgattctacggcatgtaggaacaaagtccaaagattggtgcaagaaatttttcatcaagggtcagaaatcccataggttggatctcatgcgccatagacttgaaaatattggatctctactgaatgaaatagatattggcatgagtacttacactaacgatgcacacattgtggagggagattcagccgctgacaatgataagttagatacaaaaacaaatgatgaccagccttcatctgccgcgaactcgagccgtgataaatccaaacctatggaagctaggaatctttcaactaactttaaggaatcagtcattggcaatgataagtcaggcaccaaaacaaatgatgagcagtcttcatctggcacgaacttgagccatgataaatccaaacctgtggaagccaggaatcgatcagctgacttaaatgaatcgagggaaattaatagagaatttgatcatcaagataaaaccatcatttctaatacataa

SEQ ID NO: 72942 - DNA, 219 bp, Glycine max
  Peptide Sequence Number=SeqID_164627
atggtggcgtctctggtgctctctagagctcctcctctgattgctctgttagggttcttgtgcggattggtgaccctgggagagagaagactggctctcggtgaggcagtggatggcctcctcgagtttgtcagtggtggtctgacgggtgtggtggtcaggcatggcggagagggcaggccggaccagtttgatacgaatcaagaatggaaaagataa

SEQ ID NO: 72943 - DNA, 359 bp, Glycine max
  Peptide Sequence Number=SeqID_164628
gctaggaaaggctttcgtctgtccttcattgaaacacaagcaagagacatattggcctatattccaaccgatgtgatctccattactgctggacaaatatgtttgaaaacagagctcttttatcgcggaattagacttgctattaatgttggcttatctgtcagtcgcgttgggtctgctactctgttgaaagctacggaacaagtctgcggttcgataatagatggacatgtagatatctatatagaagaggcctcgtcgaatgaatccacccaggcacaggcgaggagtcgtttgggattggatggaaatccttttgcctatgcggagggtgttcttaatgatgatagcctcaacat

SEQ ID NO: 72944 - DNA, 402 bp, Glycine max
  Peptide Sequence Number=SeqID_164629
atgttttcaatgttcaattctagtaatgagctggttgaagatccattggcagttgagagagaaggagctatgatcaaccgttggacattagaggagagaaatattttctccgagaaattggcagcctttgaaaaagattttaaaaaaattgcttccttccttgaccacaagacaactgctgactgtgttgaactctactacaaagatcataagaccaattgtttagagaaagataagaagaaaaagaagaagaagatgggttgtaaaagtcagaagtcaaaaacatccacaactaccgtgaagggattggttaaccaaagaacgcgttcaggaagactccacctttggaggaaatccgatgaaagtgagagggttgcagttgatgcattgattgagatgtga

SEQ ID NO: 72945 - DNA, 125 bp, Glycine max
  Peptide Sequence Number=SeqID_164630
tcgtcgcctttgctcaatttgactcagaccttgatgctgcgactcaggcattactcaatagtggtgcaaggcttacagaagtactaaaacaacctcaatatgcatcacttccaattgaaaaatga

SEQ ID NO: 72946 - DNA, 344 bp, Glycine max
  Peptide Sequence Number=SeqID_164631
atggtgtgcggtgctgcagttaaccaaagaacgcgttcaggaagactccacctttggaggaaatccgatgaaagtgagagggtagcagtagatgcatttattgatatgtgtgattctctttcacctaaggctacaaaacgttgccttgccaacaacatcagtactaacactaactatgcccatgtatgggaggcagatttagtcattgacaatgatgagtcaggcacaaaaacaaatgatgaccagccttcatcggtcgtgaactcgagccgtgataaatccaaacctatggaagccatgaatctttcagcttactttaaggaatcagttattggcaatgataa

SEQ ID NO: 72947 - DNA, 351 bp, Glycine max
  Peptide Sequence Number=SeqID_164632
atgactttatgtctaattgattgtagtactaggtggcataacctcgtggatgctgacttacttctcatagtattaatcaaatacggggctgctcatcacgacccgttccattgcaaagaggctaagaaagaaacagaacatggcccttgcaaaagaacttatgggtttttcctcatttgttctgcttcctacaatgtgtttctgcacaacaagcatggcaccttctgggtcaatactatcttgcttccttcggataacacaagagttgtgaggatgaggaagggagcaaagtttccgatgacagaacaagaaacattgtgctgcaacttatcagcaccgagattgatccaa

SEQ ID NO: 72948 - DNA, 1197 bp, Glycine max
  Peptide Sequence Number=SeqID_164633
atgattctgaagtcatacctctttccaattgaatctctcacaccgcaggacaatttcaaatctcgacctacttttttcctcttcgcgaaatctcggcctacttttttcctcaacgcaattgaagcgggtttcaacctcaaactacaccaatcccctcgacgacgacaattggggcgacttcatgaaccattccaactagatcaacgaaaaacccttcgactcgttcggggttcccacagatcccatgaacaaacacgtgaacaacgacaaaggcgttgccgttcaggctggggcagtgaaaaatcccaagggagctattccgctttcgatcttcggcgaggaagagggaaaataagaggagaaacctgcttttgtcaatgttttctccaacgacaatgtttgtataatcagcagcgccctcaggtggattctcataacaacgaattggtttcggtatccaatgttgctgctcccaatctgacgtactcgaacgaaagcaaattgaattcagatgaggatgaagatggatgggaattcaagtctacggagtgggaaactggaaccaagagccaggatgttaaggctaaaacaccaaagcatgataatggtgctcttgatgttgacaaagctggcagatggcacgtggagtttgaattcagtccacattctgcatcgcaaggtcatattaacccacaaccaagtccggaaagtgaatcaaatgacattggaacagggtttgccatgttcagtcaatattttggggagtttagttcagggtcagggccaaatcaaaatttgattattaaggaatgtccattaacacaatctgattgtggatttgtggattttgtctcaccatattttcaccaattccatattcattcactgcaccttggggctaaaatccatagccacaacttcccttatgctaatctgtttcaatgtgtttctgaaaaatttgaagaaaggaaagaatctcaactaatttatattttgattaataaactagaaatagatgacggtggctactactcaacaacaacctctttgagcggttcaatcgggcaagtgatgaggcccaaatcaccattgtctggccttgttgattttcatgggaagcagaagcaaatggttaagattcaggttttggagagagagattggtttgcttcagcatatcaaagcttcaaaaagttga

SEQ ID NO: 72949 - DNA, 504 bp, Glycine max
  Peptide Sequence Number=SeqID_164634
atggctactccacctgtgtcgcctcctcctcctcctccttcacacgcatcagtgtctccgtctaccgtaaagtggacatgcaaagcgacacgtctacgattgtgggccactagaccacctggtgcagagagactagtggtcaatgttgatcctgataccggcaaggccaatggtccccacaagaagaaattaagaacatatttggggattgtcgcgcgtgataaggtcaacgtcacatacgagacctggaaggaagtccctgctgctcagaaggatttgatatgggaggatattcaggcggaatttgaaatccctgaagcttctgacgctgatcatgacagtgtggctgacattgtctgtgaaaaatatggcattagcaaggataaatggacccagttttgtgagacatgcagagacccttcttgggaggatgtgcgaaaaaagccatccggaaacaaaacactgcccccgacatgttgtctcgtgggggttaagaatatttag

SEQ ID NO: 72950 - DNA, 273 bp, Glycine max
  Peptide Sequence Number=SeqID_164635
atggtatttgttggcagtggatccggagttggaagatccatacagccactttcggctgttcctttaaatgatgacatgcaaagcttcctcaccaccaaggttgtaatagaactggaaattccaagggaagtagaaaacatggaaacagcaaataaggacatcacgcaaagagaagactgtctcaatcaagcatcttttctagaaacacaaatggaactgccccaattggcaaagaaagtggataagaggaacaagggtatatgtgagatatga

SEQ ID NO: 72951 - DNA, 175 bp, Glycine max
  Peptide Sequence Number=SeqID_164636
atgggggtgcaaatagcaaccagacccacttgggccctccagaagattcctccagaaggctgttgcttctggaggaagcaaccttgctcgcctgggcgagctgggaatttcgcgaaggtttcgaccgttcttcgacattcttcatccgttcttcatcattcttcgatcttcacgg

SEQ ID NO: 72952 - DNA, 945 bp, Glycine max
  Peptide Sequence Number=SeqID_164637
atgtcatacacaccgaattgtgaagcagaattgaaagagaaagagatgagaaagaacacacagaattacgtggttcaccttgagaaaggctacatccacgggagggaaaacaaaaagcttttctattattgttgcagtcatagcccaacacatagggacctcaagcctgagaactttctctttgatactgttgaggagggtgctaagatgccgagggagagggcttggtcgtgggttttggtggaggtggggattctgatgatgtctttgagttttccttggcggaggagctcgccgatgcagtcgcttggcagtggagccaatgccgaggaccatgccggacttgacatactcgatgaccttgtaggtggcaaggaggagggtgtgggcgatacgttttgcgtaaaagatgaaactacggacagtgatgtttgtgatttgggaggttcacctggtcccgtgcctccaaaaaatcatcaattgaagtttcctttgagttcacagaggaaagatgtcatctctttgaacaggttgaggtcttcaattgttgagttgctacattttgacaagcctggctctgtagattctaattcagaaggattcactgcaatgactaagttgcagatatggaaaaatgtcatttcacaagcactggagcagacagaaactgaaatttgttcacttgagaatgaactggagccactacaatttgaatctggggatggaatgccatgttacaatacaaaatcttgtgataaagaaattggagactatcataaagttactcatcatccagaactgtcacaaattggcccttccaatgacgacaacaacacagagaaaatgatgcctctttcagctaacttgcatggtatgcatgatactaccaaggaaaatgatatcgacaatcctgggacaacaacaccgaaatttgtagaagcgtaa

SEQ ID NO: 72953 - DNA, 759 bp, Glycine max
  Peptide Sequence Number=SeqID_164638
atgtctttagttccttctgtttttgcagcaggagatcagttaagcttagttccaacatctgagatgataaattatacaagccaactgctttcaaaaccccaatatgaagttaacagaaaaatcttgaagatgccagcattaattttggatcaaaaggataaaatgttttcaatgttcaattctagtaatgagctggtagaagatccattggctgtggagagagaaagggctatgatcaactgttggacatcagaggagagaaagactttcacggagaaatttgcagcctttggaaaatattttcgaagaattgcttctttcattgaccacaagacaactgttgactgtgttgaattctactacaaagatcataagcccaattgtttagagaaagataagaataaaaagaacaagaagaagggttgtaaaagtcagaagtcgaaaacatcgaaaactatcgtgaaaggattgggtaaaaaaggaaattgtaaagcaaatgttgattcacagaagaaattgattgaagctccggcaatggcgaaattcgatgaaagtgagagggttgaagttgatgcattgatttctatgtgtgattctctttcaactgagactacaaggctgccatgccaacaacctgtgacacctgacattactcgtcgggatattgatgatggaacttgtgagtggacagatgaggaaaatgcatcctttcttcaggctgtttcgtctttcgacgaggattttaggatgattgcatga

SEQ ID NO: 72954 - DNA, 459 bp, Glycine max
  Peptide Sequence Number=SeqID_164639
atgactccacacatttccgcggtagtctcctctacaaccacctcacctccgtgtgacgtcatgtgggacaaggttgtcagcgtccacgaccaccatgtccccccttacgtcatcgggattggtgcttccctctattgccctttatgcttacactattttttgccgattggaatggagactcttgcccaaaacctgttcaatggaatgctcgtgaatggaaggtctattgttgtggaagccattgcacttctcaagggaaggtggaagattcttcaagatttgaacaccaaaattcagttcagtcttctctgcttgaaggaagcgaaccatatatattcaaggcatcgagtttttatagctgggaaaagggagttttattgggtggaagcatgtgcttggcatggtgttctaccttatcataatcctaataatgaatgccccaagttattcatattctag

SEQ ID NO: 72955 - DNA, 696 bp, Glycine max
  Peptide Sequence Number=SeqID_164640
atggctttggctcaatgggatttggcagcctcggattcctggatagaagggggacaaatatttggctttggagacaatgaaagagcacaacttggtcatgacacttcaccaaacatagaatgggactcagtcatgtatagatcatttctgagatgtgatgatccaaaaggagtagtagaatgtgggataatcaggaaatacaagactcgttctcacaaagtaaaggacaagacaaaaatcctgaagacgggtgaaaacttggagacatccttgtccttgatgaacaaaagatacaaagaagagaataaggtcccaaaaggatgtgatggaaatctcatcgatccatcatcttatagagatattatgtttgatgaaaagtctgaagatattgcagaagatagaattgacgcaaagatgattggtagaatgcaggctaatccatttggggaacaaagtaaaccaaaggggtttcaaagaccacaaccttcagttggtggttgtctaagtaattgccaagaggaactaaagaaggtgattaaggagagtttggttatgcagaatatgtttccaaagacctctaaaagattaaacactgcaatagctccaaagatggaaagaccacctagcctaattttcaagctgatgggtttagaagaagccccctcaaaatcatttccagctgttaagcagaaatag

SEQ ID NO: 72956 - DNA, 318 bp, Glycine max
  Peptide Sequence Number=SeqID_164641
atggttggagcattctcgcaaaacatcgtgaccctgactggtctccctatgatcttacttagtgagagtgacctgacaaacccattgtgtggtgtgtcttgttatgtactcctaagcgccccaggatggtttttcactgacatgcatacttcatttagccctgatgggaaactagttgttactggtggattctcaaacaggaaagtttggcatgttctatttgtctatatcataggttcttggctgtatatttctctaagtactctcttgaatgggatgggagtgggggctggatgtgccaagtgtgagaagttgtga

SEQ ID NO: 72957 - DNA, 183 bp, Glycine max
  Peptide Sequence Number=SeqID_164642
atgtcagctgcccttatggcagatagatctggtgttactttccatgaggatattagtaatgcagctattccattaggagtgattttagccattcttgatcctatgctcattgctgtttcgaaaaatggtcatgcggtcattgctggaaagtcaattgtgctgaattttccaactcagttgtag

SEQ ID NO: 72958 - DNA, 339 bp, Glycine max
  Peptide Sequence Number=SeqID_164643
atggttcacaacatccctttgttgcatgaccaagtgaaggttggtgttgaggaggttatagatgcagaggctctcattcctgtacccactgacaaggcagctgtgtctccagcaaaacctccaaaaagcctggatcatgaggtcgatgatcccctgtatctgatgacattgaccatcccacaactatttttgaagcctctccaagttatgtgggatgcttccctatttgggctatttaattcagacttccccttgtacataaaacatgaagatttgtctgaaataccacacggtggtcaatgtctcagcatctctgtcatacagttgtggattctataa

SEQ ID NO: 72959 - DNA, 186 bp, Glycine max
  Peptide Sequence Number=SeqID_164644
atgagtgaaagcttgaagaaagggcccttagtcaggaaagtgaatcaaaccggatggtcctaccttagaagcaaggagaaggaccagagagaagcagttctcagttgtagaactatagactatgggagcagcaagcatttctttctatgtgagacgatgccgcaagcagagctggaaatgaggtaa

SEQ ID NO: 72960 - DNA, 63 bp, Glycine max
  Peptide Sequence Number=SeqID_164645
atgggggaggtggtggccgcccagctcgcccagatgggcccaaatgctaggtacaccccatag

SEQ ID NO: 72961 - DNA, 927 bp, Glycine max
  Peptide Sequence Number=SeqID_164646
atggcgcaggcgatattggtcagcggcccgattgccaccagggtaatcgcgtgcggctgcgcgcgtacgctgtcgatgatgaactgcaccgcgctgtcggcgacatcgctatacggggtggccggtgcggaaggggccagcgccagcggacgcgaacagccacgatacaccggcgcgctgatgttcatctttgcacagaacagccgggcgttttttaccgcctggccaaccgcgacattaccaaacaccgtggtgatgcccagcagccgctgcgtgcgcgccgcatacgccagcgcaaaggcgtcatccacgccgatatcagtatcaaaaatcagggtacgcatcggaatctccttgctgatgatgtctgccacggtgaatattgtcacctccgccgcgccagcgtattatcgtgcctctgaggtgatggcgtgccaccttacccaaccgccctctggttacagacggctgatgacgcctgacaacttgcttatccctgcgcgggagacggcggagctccagactatgctgaagtcgctgttcgcggtcatgatcggtggtgccatcggttgcacgctgcgctggcttatctctttgcgtttcaatacgttattccccaacctgccgccagggacgctgatcgttaatctggtcggtggctttattattggcgcggcgatggcgtggtttgtgcgcaatccgcacatcgatcccgtatggaaactgctgatcgtcaccggcctgtgcggcgggctgacgacgttttcgaccttctcggccgagatcgtggtgttgctacaatcaggaaaatacctgtgggcaatgtcgagcgtgatggtgcatgtcatcggttcattgctgatgacctttgccggtttcgccgtggtgaacctgctgggctatactacacgcttgaatcacccttga

SEQ ID NO: 72962 - DNA, 327 bp, Glycine max
  Peptide Sequence Number=SeqID_164647
atggggagcaagcaaagtgattatattcccattgatttggagattaacaccatttgtagaaggcgtaatcaagagagaattagaaaatttttgcaggacttagaggcagcagcaattccaaaggaagaacctcaatcttctgaggcatcttctagttttcctattgcagaacattctcatttagatcctagtgaagactacatcatggttgaagagccaagaagagttactctggaagattattcaagttctaatgtgccacaatttttcatcagcattgcacaaccagaagttaagcacaaaccattacttatccaccatcattga

SEQ ID NO: 72963 - DNA, 654 bp, Glycine max
  Peptide Sequence Number=SeqID_164648
atgtcgatgaggcagcgcggtttttcactgactgaagtgctgattgccacggcggtaagcagccttttactgataagcgcctcgcgtttcttacccggcctgcagcgggcggtactactgcaatccgggcagcgagagcgggaggaagaggtctggcagcacctgtttgcgatcggcaaacagcttcagcgtgcgggatactgcgcgggaaactgtcagggacaagggctgttaatcggcaggcaagggagctgtgtcattgtgcggtgggatgccaacagtaacggcaaatgggatagcacagcatcagaaaacgacagcaccggttttcgtctggaatcgggggcgctggaaaccctgcgtggggcaacgtcgtgcgaaggaaagggatgggaaaagctcactgacccggaaagtctggcgatcacgcactttaaggtgagtaaagccgatcgcgccgggggaaccctggcaggcgctgtacacggttacggggtacaacctgtgaggcgtcaacgcggaatctcttcgctagctctggtactgctgttgctggtgctcggtactctgatccttaccggccttaaccagcagctcgtgacctttagtgcgctcgtcgcgggtgagagccggtcgctccagcaacaggcgtct

SEQ ID NO: 72964 - DNA, 417 bp, Glycine max
  Peptide Sequence Number=SeqID_164649
atgggatggatggtagagggctgcctgcgcccaaaagcgatgattccccttgtccatagggacctcgtggcatacaaccgaaacgactcccgctatatagccgcccctatctatctttttacagcctcgggggtaagcacttcactcgctaggggatgggattcattcacttgcattcctgctagcactacaaaaagctccggtcttaacgcccctactactgctgtgcagcctttcctcgggttcgtagagtcgggtttcccgtttacccacaacggaggaccccacctgaccaggcaggcggccacgggtcataacgcactcttcgcacaacaaatccactttgaagttgacttatccgctcggccaatcgtcggaatgtgtacgatataccataagggcccaatatctcaatag

SEQ ID NO: 72965 - DNA, 465 bp, Glycine max
  Peptide Sequence Number=SeqID_164650
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtggctgcgacgtggaaaccaacatatcggcaatgatgatgtgaaagtttttcgtcgcaagtttgatattatgaaacgtcatgag

SEQ ID NO: 72966 - DNA, 68 bp, Glycine max
  Peptide Sequence Number=SeqID_164651
atgtccccaatggagtcgccaattgtcgcaacctacccttcggcgggagggcgacgcgagactgacag

SEQ ID NO: 72967 - DNA, 423 bp, Glycine max
  Peptide Sequence Number=SeqID_164652
atgaaagattgcagaaatacaagtagtggggatgtctcctccacctctaggacctcacaatcactcacaaacgcatctcaatctctcaggatggctctggtctctgcagatcttcacacaacaaaatctcccaaactctctggaacttggacctttctctctctagaactctctaaacatgcagaagcttcaagaaaaggccaaactcccctcaaaaatctgatttcaggcataaataggtggtcttcgcggcttttctcgctcagcggatggaccgaagtggtgcgcttagcaggatggcccttcgctcagcgaacaagtatagctcatccttcttccagattcttcctcgcgcttagccgaggaatcttgcactcagcagatggctcgctcagccaatctgctggcttagcgagaaggtga

SEQ ID NO: 72968 - DNA, 552 bp, Glycine max
  Peptide Sequence Number=SeqID_164653
atgtcttgcctagtgatcataactccgaccttcctctgccgaagtgtcagctggtgtatggaacccaccaggcactctctagtcccggataagtctaacagggccctggggtttctggcattgatcacgggcctctgcaagtcgttcggggttcccgtcactctttgtaaggtgatccgaccgccgatcacccaagccttcattgagaagtattgcacgcctaggcaggcgcagggtgatgcaccgcaggccgcagacgcaccgccaccacctcatcaggctgatcccgctgggtcattaggcatggaacggtatctacaacacttggttcaccagcaggtgcccaaccaccgggggcagggccagggtttcgctccttttacgtgccctactccagatcagtttagggctgaggtcgcatggcccggagattggctcgaggcccaggtaggggaggcgcctgcagtagctcccggcgatgcagaggaggcccgcatggatgaggagatgacagacttgctcggtttcttgggaggaagcggagccacgtga

SEQ ID NO: 72969 - DNA, 770 bp, Glycine max
  Peptide Sequence Number=SeqID_164654
ggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtagctcgctgttcacttccggcaagtgcaccgtgatgcaatcctaccccgcaagggcattggatagaaaacatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 72970 - DNA, 321 bp, Glycine max
  Peptide Sequence Number=SeqID_164655
atgaagcttgcttctacagtatttcccaaagagataccccctgggttacctcctcttaggggaatagaacaccaaacagacttaggagaagggcagggtccaagagagcttaagtccttgtgctatgcttgtgttgttggtgcccaagatgtgagctatccgctaagcgcaaacatcgtcttctgcaccctttgtcaatcgcggccaacgagcccgctgacacgcagagatttacatcgtcttccgtgcagtcaatctctgtcagtactaacccgtgaagttagggggcaggcggaaatacccaagtggttatctgtataa

SEQ ID NO: 72971 - DNA, 387 bp, Glycine max
  Peptide Sequence Number=SeqID_164656
atggtgaaagttggaacctcttacgtgccgatcaacgtctcattttcgccaaaagttggcccagggcttcccggtatcaacagggacaccaggatttatttattctgcgaagtgatcttccgtcacaggtgctcctggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 72972 - DNA, 414 bp, Glycine max
  Peptide Sequence Number=SeqID_164657
atgcacacacaaggtttcacaattccacaattccttagaataggcataactcacaaaaaggtccccagtggagtcgccaactgtcgcaacatgcccttttgcgggcgagcgaaggcgaggctctcgggtgcactttccaaaggaggaaagatgcgaggagtcgccaccaacgtttatttgtgggaaacgtcggaaaaaccgaaggaaactggtcaagatgaaattctaagttcaggagttgtatttacacttaaggaaggtgatcattttaaggcgttggaccttaaaaatgatccattttacttgcaaaataggggaggagcttgccacccagctcgcccaggcgagcaaggttgcttcctccagaagcaacagccttctggaggaaggatctggaaggtccaagtgggctag

SEQ ID NO: 72973 - DNA, 441 bp, Glycine max
  Peptide Sequence Number=SeqID_164658
atgtactcaccaattcaaatatttcatcgaatcattgataaatggattccatttgtcctgtccctatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 72974 - DNA, 453 bp, Glycine max
  Peptide Sequence Number=SeqID_164659
atggggacaaatcaaaatggaaaaagattctaccaattcaagattaagggcctagatgtcaccagccttaaggaattgggacggttgatgggacccctccaaaggcaagccttccgcaaagtgtacgaaaagattctagatttgaccgcagcggaggtatttacagaagccgttgtatccctcgcccaatactatgaccagctgttgagatgctccacgtttggggacttccaaatagtaccgactgttgaagaatttgaggagatattaggatgccctcttgggggaagaaaaccatatattttctccggctgtggtcggagattcggcgagagagttggatcgaatgaagcaaactcgaaacggtgtagtgggcctaccgcagaaatacttggaaggcaaggtaagggatatgcgagtcagaagagtgggttcccgtttgcggtatactag

SEQ ID NO: 72975 - DNA, 482 bp, Glycine max
  Peptide Sequence Number=SeqID_164660
atggatgttattggaggacgagagtatcgtttagcaaaatacgcaagagcaaatcttgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 72976 - DNA, 228 bp, Glycine max
  Peptide Sequence Number=SeqID_164661
atgatgcactacttgacgatccactatatgcagctactaggccatggcatgcttgctgctctactagccaatatgcaattggagttgcaactactatcaatgaactacttgtccacctccagccctgtactgagcatggggaacggcacgtgggtacgctcggatctcgttgctactccactagagctactgatgttgatgttcgatgccactactcccaatagctaa

SEQ ID NO: 72977 - DNA, 213 bp, Glycine max
  Peptide Sequence Number=SeqID_164662
atggcctcctatggtgtggcgtctcctctctctcttcctttcttcattccgctgccattcatcttccaagaagcaaaggaatccattgatgaagaagatcctaggcctacaagctccaatggagcttgcatcaggatggaggcagaggacacgcaggaagctgcggccacacctgagagatctcttgaggcaacttctgagctcccagcataa

SEQ ID NO: 72978 - DNA, 672 bp, Glycine max
  Peptide Sequence Number=SeqID_164663
atggacctcatcaaggctgctggactgctgaaaactgtcaccaagttgggagattgttatgaaagtctagtcagggaattcattgtcaacattccctctgacataacaaacagaaagagtgatgagtatcagaaagtgtttgtcagaggaaaatgtattagattctcccctgctgtaatcaacaagtacctgggcagaccaactgaaggagtggtggatattgctgtttctgagcatcaaattgccaaggaaatcactgccaagcaagtccagcattggccaaagaaagggaagctttctgcagggaagctaagtgtgaagtatgcaatcctgcataggattggcactgccaactgggtacccaccaatcatacttccactgttgccacagaatcttttgctgtcaaattacccattgccttcccaactgtattgtgtggcattatgttgagtcaacatcccaatattttaaacaacattgactctgtgaagaagagagaatctcctctatccctgcattacaaactgtttgaggggacacatgtcccagacattgtctcgacatcagggaaagctgctgcttcaggtgctggaggcaaccatcaaagccaacacagagaagaaaatggagctggaacgcctgatcaaaagactctcagaaaatggcgttga

SEQ ID NO: 72979 - DNA, 1056 bp, Glycine max
  Peptide Sequence Number=SeqID_164664
atgccctcagcttcagaggactacatgtcctcgccttcagagagctacacgtcctcaccttcagatgactacacgctcacaccttcagaggactacacaggactacacgtcctcgccttcagagaactaaacgtcctccctttcagaggattacatgtcctcgtcgtcacagggctacaagtcctcgcctttagagggctacacgtcctcgccttcagaggactagacgtccttgcctgcagagggctacacgtcctcgccattagagggctacacgtcctactcttcagaggactacacgtcctcgccttgagagggctacacgtcctcgcctttagagggatacacatcctactcttcagaggactacacgtcctcgccttcagaggactacacgtccacgccttcagaggactacacatcctcccctatagaggattacatgtcctcgccgtcagagggctacacgtcctcgcctttagagggctacatgtcctcaacttcagaggacaacacgtcctcgccttcagaggactacacgtccaccccatcagtggactacatatcctctccttcagaggattacacatcctcggcatcagagggctacacatcctcgctttcagagggctacacgtcatcgccttcagaggactacacgtcctccctgatagagggctacatgccctcgccttcatagggctacacacccccactctgagggctacacgccctcgactacagctacaaacccttagaggactacacgtcctcctcttgagagggctacaccccttcgccttcagaggactacacgtcctcaccttaagaggactacacgtcctcgccatcaaagggctacaggtcctcaacttcggaggactacacgccctcacctttagaggactacacgtcctcgcctttagaggactacacgtcctcgccttcagagggctacaagtcctcgccttcagaggactacacgccctcaccttaagaggactacaggccctcgccgtcagaggactacagctacaaacccttagaggaccacac

SEQ ID NO: 72980 - DNA, 261 bp, Glycine max
  Peptide Sequence Number=SeqID_164665
atgaggggcaccgtgcatgagcctcaagcaaacctaggggcagataacaagggggacaaaccctgggatttcaatggattgattaaatgtcaaatggctccattgccgtcactccaaaatggtcaagtgagtaaatcaaacagaacatacactctaagggagttcccgaagagatttgcaaaagataggataaggttgcatgaattatcacctctttcaaaaatcaaatcaaaatcacaaaatagggaaagaatgtcatga

SEQ ID NO: 72981 - DNA, 969 bp, Glycine max
  Peptide Sequence Number=SeqID_164666
atgaaggccgtcatgttggctctaaaagatcaaatggcttccatgatggaagcaatgctaggtatgaaaagattaatagagagtaatgcagccacagctactgccgccagcaccgccgctgaagcagacctggtcctttcgtctatagcaaatctagcgcatcaaccttccttggatatggtgggacgaggaaaggacacattggggaataccaacagcccgcatttggggtacaaccgaagtgcttacccctacactctaccccccaactttatgccacctaccatgcatgagaacttggatcgcaccacagggggcgctcgcgaagaccgtcgggagcatgcccaaggggacgtcaactcctacccccttttcaccactgagggaccagcgcccaatgtcttgcctcagcccaatattgtaggagtctctcaaccctgcccgatgcaaccactgctcttctctgtaggggggtcgcctctagcagtggaaggaagtgaaaagctcgatctcatcgaagagagattgagatcggttaaagggttcggtgattatccctttgtcagtgattatccctttgcctcatgcccatgtcgtcacctcgacacctacttggtcgaagcctcagcaagcctcacatggtactcatccatacactcaacaccacccgagttttccagcctgtgccggaaactcttccagctcagctcctgtccaaccaaggatgtatgcaccatcgtaaagggcccctactcatactttggctctagcgcaacctcatcccgccaacaatgccaattctggcatgatttccaatgggggaagaaaccctccggtaaagaaacttccggagtttgccccaatcccaatgtcatatggggacctattgtcgtcactaaacaaggtcgagcaatcggtcgagcatgggggaactccggggcattcgatcgagcaatgcatggctcttaa

SEQ ID NO: 72982 - DNA, 480 bp, Glycine max
  Peptide Sequence Number=SeqID_164667
atgagtggtaagcgtcaaatcgctgtacggcgattacgacacgccgcaggatttcctcgaagccttcgatgcgctggtgcagcacgccccgaacgcccagcccgcgctgcaggcggtgatcaatcgcccgcgcgacctcaccccgcgtggaaagcgacgcgcaatcaggatatcgccgccaggctaattggccatatccgtcgtgcggcggtgggcgatgcgctcaaaccgttcgacgagcgtgtcgatcacgcgctggcacgtatcaagggcgagaacgactggagcgatgagcagctaagctggcttgaccgtttagcgcaggcgctgaaagagaaagtggtgctcgacgacgacgtgttcaaaaccggtaatttccaccgccgcggcggtaagccaatgttacagcgcacctttgacgataacctcgacagcgtgctggataagttcagcgattacatctgggacgagctggcttaa

SEQ ID NO: 72983 - DNA, 255 bp, Glycine max
  Peptide Sequence Number=SeqID_164668
atgtacatcaagtatggcccaaaatacatcatgaagcatagccaacgaaatatgttatccaacaaaccccctacacttattcccaaaacaattccaaagctccaaaattccttaaggcttgtaatgagcttcaaaacaaagaaagggaaacataggctcaaagggctatcaaagggattaattcaaggaagcatcaacaagaatcaagccaaggctattatgcaagcaatcaatggggcaaaacacaccaaatga

SEQ ID NO: 72984 - DNA, 1241 bp, Glycine max
  Peptide Sequence Number=SeqID_164669
cccgccagcgcgcggccggctaccagttcgagcatgccttcaacgacaggctggccgtgcgtcagaatttgcgctacacgcagagcgctgtcgactatcgcagcatctacaccgccggcttcactggcgccagccatggttgggttccgggcagcgacaccctgctgcgccgcaagctctaccaggaacagaaggcgttgcggcaaggggtggtggacacccaggcgcagttgagcctgcgcgccggccccgtgcgccacacggtgctggcgggcatcgactatcaacgcgccatcctcgattcccggctcggcctgggaggcaccgcggcgccgatcgatgtgcatcatccggtctatggcaactatgtggcgccgacctcgtacgcctggtcgacctatcgcgcccatcagaccggcctgtacctgcaggatcagcttgaatgggagcgctggctgctgatgctggggctgcggcacgatcattcccgcaccagtgtcgacaatgatccgaaaggcggcgcggacgacagcgcgctgaccaggcgtttcggcttgatgtaccgttccgtcgctggcttgaacccttacatcagctatgccgagtcattcgaggggcagacggggctgaacaaggccaatgaaccgttcaagccgctgcgtggcaagcaatgggaggcgggggccaaataccagcctgccggccgtaacctcacgctaaccgccgccatcttcgcgatgatcgagaacaaccgcaaagtgccgggcgtggtcaatgggcgcgcggatacggtgcaggtgggccaggcgcgcacccgaggccttgaactggaggcgctggcctcgcagggcaatctcgacctggtggccagctacacctacctggatgcccgcgtcgccaggggcaagcctgccgaagagggcaggcaactgtccggcatcgcccggcacatggcatcgttctgggccaactaccgcttccgcgcattcggcgtgtcaggcctggtcgcgggggccggcgcgcgctacaacggcacccacgatgacggcaccggccacaatggcatggccgccgtgaccctgtacgatgccgtgctggcctacgatgcgggaccgatgcggatggcgctcaatgtcaccaatctgttcgacaagcgctacgtcgacgtttgcctggcgcgcggcgattgcttcttcggcacccggcgcagcgtggttggcagcgtgacgtaccgcttctga

SEQ ID NO: 72985 - DNA, 498 bp, Glycine max
  Peptide Sequence Number=SeqID_164670
atggaagtcaatcttagtgatctgatggtgccaagtagaaggattgtccctcaatgggctatagggataatagactcatcttcccccaagagttcagatcgacaagaagtcgagattagacatgacattggggcggggcggggatgggtattgtctccccaatccctgactccgactgttgaacatgtcctcataccgatacctgatactcgacgggttcgagttcgaggtcagggcggatgtagtaatcctatacccgtagccgtacccgatttttggttatcggggaaaacccgaacctgttcccgtactcggtcaacttgggtattacccatcaaagtcgggacagattcggatgggtatccacggccaacattagtcgagactgtagaagcaagattcatgatgatgaaccaagcaattttgatgatgccaaaagcccaagtaattgattcaagacttcaagatcaagcatcaagaatccaatccaagatttaa

SEQ ID NO: 72986 - DNA, 225 bp, Glycine max
  Peptide Sequence Number=SeqID_164671
atggcatgtgatcctgtggttagatttagaaagtggatagaaaaaaatggctggtggaatgatatggctgagtcagagcttataaacaatttgagacagcaggtgagatatacatctctaaatcccttgattgatactggattccatactaacatatcatgtagcgtaacaaattcctattccaaagttaagcaactttctattctgactgctagtgctagttag

SEQ ID NO: 72987 - DNA, 117 bp, Glycine max
  Peptide Sequence Number=SeqID_164672
atgagggaacatgcagagcttttgagttctatcaaggatgatattactgactttaagacttaccttcttctggcagacatcaggaagtatgtaaccaaggatgcagttactacctga

SEQ ID NO: 72988 - DNA, 429 bp, Glycine max
  Peptide Sequence Number=SeqID_164673
atggtctacaatgaccatgctgatatgaccggcagattgcttgctaggtcattcacctttgagtgtcgtatcatgcattatatcctttgtcgagtcttgcttcctaggtccaccaatcttgctcaggcctctgaggaggatttaatcttgttatgggctcttcaaaccggtcaccaaattgactgggcccatcttcatttcaatgttcctttagatgatgaaccttttgttaaggttaaaagatctttttctattggtgctggtgctgttacttcttttggatactggaaggatatggatggccaatgggtgcgtaagcaagacctgccacctcctattcccgatgaatgcacatcctctccaccaccacagcgagatacctcttcctccttattaaatgacgtcttcactaagctacgtgatctttga

SEQ ID NO: 72989 - DNA, 288 bp, Glycine max
  Peptide Sequence Number=SeqID_164674
atgtcccctatccttaccactataaatatctcatgtaataagtgttgggcattaggaaaaatatcagagaaagtttctttccttagttctctcttctctctccctctctctctctctctctctctctcggaggtgctggacctcgaatccagtaggcttacgagcctaacatttcatatgccatggaagctttgtatggtgagtggcatgggttgtggtagtggagggtggtatggcagccatggaaggcagccatggactctcaatgagagcaccaatgttaggctc

SEQ ID NO: 72990 - DNA, 846 bp, Glycine max
  Peptide Sequence Number=SeqID_164675
atgacggaagtaaagcaaaccatgataaaatttgcaactggtcaaggagctgacatgagccaacccgttagaccaccaaacattggggacaaccaaatcaatttcccattgtgggtccacaatagcctcaaccactaccaattcgtgggagcaagcactgaggaagtcaaagacaaattcctcaatcacttcttcctcgagtttggagttgaagctatcatggagcacatcgtcaacttcaaacaaactccaactgaaatgttatttgatgcatggaagagatacaaatcccttttaaggagttgtccttttgatggaaacaaccaattcatgcaaatttcaatgttgatgaaaggaattaccaacgattatagaaggatgatcaatgcatcattcgaaggaaactacctcaataaaaccaccactcaagtgaagaccataattaaagatctgccagctagtgagaaaaccataaaaacaaacgggtcaaatccccaaaaaggtgaagaagaagaggtagaagaaagaaccatgctagaagaagagatgaaagcacaagttaaccctttaacccaaggtatgaaatcctcacttaatcctccattgtttgattttagcaagcaaagcatccataagcaaggagacgatgagatgatggccaaattcgagaaatacatggagatgctacaagggaagaaggaggaaccacctattgaaaaactcacatgggacgtgttaaatgaaaagattggtcgccttaacctaaaggctaccaacatgactatacaacttatcgatggttctaaaaagaaagcactatggaaagcggtaaacgtgacaataaag

SEQ ID NO: 72991 - DNA, 328 bp, Glycine max
  Peptide Sequence Number=SeqID_164676
atgggtgatgttttgagtgaaaagattgtgtattcgttgggttcttaccttgctcgaggagggtttgagaggggtcgaatgatgttcttcaaaggtgagaaaaggacatgcagattacatggaatagagaatttgagcaacacatggaattgttgggaaggagttcatgacagggaagaagaagttcatggtgaggatgcagggggcgatggaagggaggaaggggaacttggccataacggtggaggtattcgagattgtctgtttgacggtggtggcatggcgtggtcaacggttgtggtggtttttgttggagaaggggaaaaag

SEQ ID NO: 72992 - DNA, 498 bp, Glycine max
  Peptide Sequence Number=SeqID_164677
atgtaccctcccttattctctttgaacctagtggatgtaccctccactagaactgatccacaagagatgtaccctctcttgttctcagtcaaacccaaggaatgggaagaatcaaaagaattctcagactgtgtcgttttgaattctttgacaagggagaagggagacacagaagaattcaggcggttagtcctttgttcttttggaaaagggagaagagagacacaaaaagaattcagacggttagtccttggcgaattctttttggcaaagggagaagagaatgaaaagatgaatagcacaagttttcaaggtttggaaaaaccagaaaacttcagaaagcttttggtacaaagacgaagaaaaagttcaaagagattcaaggcttgtaaaggattgtatgaaaataagtgttcaagatacttgacatgcaaaacaaagccttgcttttatagactcttcatgtctggtcaagagaaccattcagaagagttataa

SEQ ID NO: 72993 - DNA, 78 bp, Glycine max
  Peptide Sequence Number=SeqID_164678
atggctggagcattttctaccataaaaatcgaatgtctgcatattagaatggagttatttaaaactattgatggttag

SEQ ID NO: 72994 - DNA, 538 bp, Glycine max
  Peptide Sequence Number=SeqID_164679
atgcagatggcaaacagaggtagaggtggttgtcgtagaacatttaatcgtggtacaagacgtggtacccacagtttgagagctccaattaccaccaacccttccccctcatctattcacatatcaacctcaaagtcgatgattcatgttgttgcacagactccaaacacacttcctacaactgaagaccaaccaaatcctacctttgtaagggagtcaattctcactaccccagttagagatgcttcaccttcagcaccagatgattctgttacacctgagtacccaacagatccaaattgtgaacatattgttgatgaaaggcctttcattcgtgcatataaaggagagtttcaaccaacatatgggtgttctaatatcatatcaaatatcattagggaaaaatttgatgaaccagctccaagttggttgaaggtgtcagttgaccttcgcgataggtggtttggagagtttaagaaagagtataggtggcacccacaagaagagcaagccattagagctgtttttgagacaaaag

SEQ ID NO: 72995 - DNA, 381 bp, Glycine max
  Peptide Sequence Number=SeqID_164680
atgcataacggaaacacaaacccgtgcctacctccagtccccaagcgacctgcggtctttacaagcaaagatccacaagggatgtaccctcccttgttctctttgaacctagtggatgtaccctccactagaactgatccacaagagatgtaccctctcttgttctcagtcaaacccaaggaatggaaagaatcaaaagaactctcagactatgtcgttttgaattctttgacaagggagaagggagacacaaaagaattcaggcggttagtccttccttcttttggaaaagggagaacagagacacaaaaagaattcaggcggttagtccttggcgaattctttttggcaaagggagaagagaatgaaaaggatgaatag

SEQ ID NO: 72996 - DNA, 234 bp, Glycine max
  Peptide Sequence Number=SeqID_164681
atggctggccgaagtgttgagttaactctatggggatggttgcaaactatttgtcatgctggggaatttccagttttggctacaaaagttgtcagatcaaatgatttcaatgggaagtctgtcgggactatagccactagtaaggtctataagggtaccatgacaaagaatctgaatgttgcaatgaagcacataatcaatgatgatgggtctcggacacttttgtcagactaa

SEQ ID NO: 72997 - DNA, 816 bp, Glycine max
  Peptide Sequence Number=SeqID_164682
atgctagtggaatcaccgtcaaagggatcacaagagcagcaatcacaggatggttcctcacagtcacattcatggtatctgccgtcggtggtcagttcaccaacttcatccaggcctgttacaccgactgcatcttcttcttcattgtcgcagaggccctcatctcatgttccaccttccaaagctgttgcagttattgccattttgaaggacaagagtgttgatgagttgcagaagtttttatctgacaaagatgcgtatcaacaatttttgcattcgcttgatcaggtcaacattcaaactaatgttactattcacttcctaattccaaagccacaaggttttgttgtaccaaaagaatctcagaataaggttgcaaaatttccaattttatggacaccagcacatcttaggcatagtgatgttgttatagctgctatcaccagttgtataaatacttcaaatcctagcgtaatgcttggagctgcattggttgcaaagaaagcatgtgaattgggattgcaggccatccaatttggtgctgttaaggatgagctcaatcgccctgcaatcaaagtgaagaactctctgatattcaatgcatttgttctttgtcaactaacgaccttcttagaaagataccttctaagacggtcattagctaaccaccgtcttataagacaacatacctttctaagacagttttttatgaaattgtcatcgaaagtcttaactttcaacgacattagcttcaaagacggttcaaaaccgtctttgtatattgttttccactgtcgtcgtttgtcctttttgtag

SEQ ID NO: 72998 - DNA, 420 bp, Glycine max
  Peptide Sequence Number=SeqID_164683
atggcccagacaaagaaaactggtcaaatgacgtctgaggcagcaaaggaaattacagacaagattgcaaattctttggaggagcaggcctcacagggaagctttgtcacccatggacgtcaggatggacttgcactacctcctgagcctgagattggtccttctgctgctcatgccagcacaaaggagagttgtattgatccctcgggacacgacctagacatgggtgtgccagagaaatatggattgtacgtcgataaaaatcctccctgcctggttgcccttggctttagaagactttatgagggtcgaccaccgttcacaacatccctttgggaaatgatcaagttaaggtcggtgtttaggaagtttgagacgttgatgctcatattcctatacccactcaagaggttcaattag

SEQ ID NO: 72999 - DNA, 924 bp, Glycine max
  Peptide Sequence Number=SeqID_164684
atgatagttcatatcattagtgtgaggctcctccttcaagggataagcagcaatcactgcacaacttccctttatgctcacgagcactgggtccttatcaactcaagtaactattttgggttgatcaaagtagaagtatcagatgttgagtacaagtgtgaggtaaagtcccacatcgggcctccttatgtggtggctcgtggtccacaggtgtacccctcgaatctccccaacaattggtatcagagccgatggttcaagttgatgaccggctcagacgagtatgcaaggcaagtaccgcaggtggccatggctatactcgtggatgataaaagcttccgcttgaggggaaggctacgatgtggaagagactcacacttgagggggagatgtgttgagtacaagtgtgagagtgtggtgtcaggcctccttatgtggtggctcgtggtccagaggtgtacccctcgaatctccccaacatcagagccatatgaatcatgtccaaagtattgggcgatggtgacacctattcttgtagcacaaacacaacaaggatactatggtcacctaatgtttccactgttgaatgaccctaacaaagcatgcatctacgtgatcaagggaagatccaacagaggatttagctttccataccaggaagccttctttacaaaaaaagagaagaacaagatgaaagattgcaaaaatacaagtggtgaggatgtctccttcacctctaggatctcacaatcactcacaaactcatctcaagcattcaaaccgattcctgcttcaagctctggtggccttgttcgtgctcgtgcgcttagcgcacttatggactgcttagcgcacattagtgaatttcggcttagcgcgtgcctttcttgcttagcggatgaactgaagcggtgcgctttgtga

SEQ ID NO: 73000 - DNA, 312 bp, Glycine max
  Peptide Sequence Number=SeqID_164685
atggttcatgtgaaccctttcattgggaaagctttagacccacttaaagagaagttcgacacctatttggggatagtagccgagataagaggaaatttgatattccagaagtgtccaatgccaagaagaaggtcatttcaatggtgggtacaagatggagacaatttaagtcctatctcagcattaaatctgtatacgcagaaaaggaagcgagtgtccgcgaagcgcaacactcatgggctaagcacgaggaagactctgcaagaagatgagttgtacaggttcgctaagcgcaccgcttcatctcactaa

SEQ ID NO: 73001 - DNA, 600 bp, Glycine max
  Peptide Sequence Number=SeqID_164686
atggataagagcttggaggtaggagaagaagaatggagggagaaggagagagggagcatgaaatttgtgcctcaaaagggggtactgttgaccctcttccatagttccttttttccaaaatttgtaatcactctttttatgcggaagtggtttaccggaaagtgcactgggtcgtcaaattatctaaaggcattgggtcttcctactgaacaagttgatgcaattaaagatgtttctctaattaaggatgttcctgtgttctatgtcgaaggctcaagtactaaacctcgatgtctcaaatccccaactgagggttttagccttccatggcaaggaagttccttttacaataaagaaagggaatcaagagaaatggcttggttacacatgagggggatgtctcctccacctcttagcacctcacaatcactcaaaagctcccttatctctctaaaagttgagaacttagctccttgctctgcttcttcattctctgcagtccatactcaaaggatctatgtggtctcactccaaaagctccttcaattttgtgcaaatcagggcttaaaaaggactcaaaaacctagacatcacgtttag

SEQ ID NO: 73002 - DNA, 357 bp, Glycine max
  Peptide Sequence Number=SeqID_164687
atggcagaaccatcaaagaagcgcaagggttcttcaagtagaagccaacgacactccgaggctaaggatattccaattccttcctcaatttcctcctcctcattgttctcatcggaagaacaatgtatacggtacaaaaacctcttctcctcttgttctatcattgaccctaagttcatagatatggatttcttttctgatgagagttttgaatgcattcaagcatttcaaaactcaaatcccattccctttatgtctttaaaactgcctgtgtattctgaattggtaaaagctttttattctaaccttgaaattcaagaaagtaccttgatttctgaggactatgggatcaagatg

SEQ ID NO: 73003 - DNA, 450 bp, Glycine max
  Peptide Sequence Number=SeqID_164688
atgcatgcttttttaggatcattcaatagtggaaattggtctgattctgatgaccttgataggacagggctaagttgtcgtactatcacgagatctcccgtaggcaatttagttcctctgaacttagaaattgaagctacattgaaaaggaacagggccgagaggagaaggaaacttctgcaagacagaacagttgcatccattcttgaggaagaaactcatttttcttattcattatcacctgattcaccatcatcaagggaatccgctactcaattgcgtgaaacagctagcatggaagatgagcagcaccagaagatcacccttgaggattattcaagcagctcagtaccccaattctttactagcattgcacatcctgaagtgcaagctcacaacatcaaatacccgcattctttaattcatttaatacaggggaatttattctaa

SEQ ID NO: 73004 - DNA, 237 bp, Glycine max
  Peptide Sequence Number=SeqID_164689
atggacatagaagaggactttgagattcccttcatcttagggtggcccttgatgttgactgcaagttgtgtagtagacatgggaaagaaaaagctggagttaggcattgataatcagaaaatcagcttcgacttgtttgatgaagaaaaacatttgtcagaccaaaatgtctgcttacaggtgaaagagtttgatgagaaggttctgaaggagagaactaagattgatccaggataa

SEQ ID NO: 73005 - DNA, 330 bp, Glycine max
  Peptide Sequence Number=SeqID_164690
atggcatttttaggagaaactaacactcagacgattgtcaactcagggttgggtttcatttttccaaatggattgattattcacaatgatagtagggtttacttccaaactcccactctgttattatgcaccgttggaagaacaccacatggaataataaacttacttgaacgcactatgacccctactcatgatgtgcttctgtattacaacgggagattgaacatgtcacgccaaaacaacattgtcattatgagtattcagacaaagatcaaatttgaaattattgagcagaaaactaatgatgatgtgttgaaggtcttagtatag

SEQ ID NO: 73006 - DNA, 186 bp, Glycine max
  Peptide Sequence Number=SeqID_164691
atgccagcaaacacaccaacggagctccagaaatgcacgaaaatggtaacaggaagaaaagcaggcgcggaggaaattttcaggaagaagatagatctcatccagcacaagaagttgcagcccagatacgctcactgctatataaacacgaaggctgcacgagttctgtaccaagtccggggttga

SEQ ID NO: 73007 - DNA, 588 bp, Glycine max
  Peptide Sequence Number=SeqID_164692
atgaagaattggatgcagaattcaaaatgggatgtgtacctaggagcctacctgaatggtgcacattggcaagtggccatcattttgcctaaggaaactcttgtcgtctggttttgttcgttgcataataggccagacaactacctgaaaggaataattaacagtgctttgaaaggacttgacgatactccacaatctaaatccagggctggtgctaggtggattgttgttaaaaccactggaaccagagacattgaaggcactttgcatccagtgggcaaagacattgatgacaagatggaagatgaagatctgacaatgattctattagcctctcttcctccctcctatgagaattttgtgagttctcttagtgtaggcaaagattccattacacttgaagaagtcaagtctagtctctattctagagagcttcaactaaaggagtctgggaatggtgatgaagcctctatgcccaaattatcagtcaatgatttttcctcatggaagaagaacaacaaaggcaaaggtcgaaagaagagcaaagctaatcctaagggaatcttcataattactacaaagaactga

SEQ ID NO: 73008 - DNA, 417 bp, Glycine max
  Peptide Sequence Number=SeqID_164693
gtggtggtgcctctaggatctattcctttagtggagcagttctctgagttggtagcctggcccgggacccagccttttcttcacagggaagatgaaggtcccacagcccaagtacctcaggatgtgggggatgagtcatctgaggccaccatcccagagccatttgttataggagaagaggcagaggagacacaggtgagacaggtagctgctgccatgcctgagagatctcttgaggctacttcagagccttctgcacaaggggaggacataccctcacctcagcctacagcagacccctccactcctcttctagagatgccagaggactcgactagaccagccctggctttggacacttctcctccagctactccagtattgcacctgacagatgaggaggatgttcaaacatag

SEQ ID NO: 73009 - DNA, 216 bp, Glycine max
  Peptide Sequence Number=SeqID_164694
atgaagcttgcttctacagtaagtgttgatagtcaattagcacttagtcttaggaaaaagagggttgtcatcatcaaaaagggggagattgtagaagcaagcttcatgatgatgaatcaagttgattcaagtagttttgatgatgacaaagatgatgacaaaaagctcaagagaatgatttcaagattgagtcaacaagttcaagatcaagattaa

SEQ ID NO: 73010 - DNA, 258 bp, Glycine max
  Peptide Sequence Number=SeqID_164695
atgtggaccaccacgggggaggagcttgccacccagctcgcccaggcgagcaaggttgctttctccagaagcaacaaccttctggaggaaggatctggaaggcccaagtgggccagattgctatttgtacccccttttttactaaatgcacccccttctatttttttgctttcgaagaagttacggaaactcacggattacgcaaaaacacctcttttcgatttccgccacatcacggaatttcacggattgcgctag

SEQ ID NO: 73011 - DNA, 252 bp, Glycine max
  Peptide Sequence Number=SeqID_164696
atgtcgcagaactttacggattatctaatgatgggtgttaagtacctcgaggcggtcaggatgccaccaaataatggtccttggacgaaattagggtatgacagtttggcacttgttttcatagagttcaatattcacttaggatcaacatttcagccagcaattcaatcaccaaaactcaaattcacaatagacacaatcataaggaaacctaaaagttcaagaaaaggttcacaatcaaagattctctaa

SEQ ID NO: 73012 - DNA, 342 bp, Glycine max
  Peptide Sequence Number=SeqID_164697
atgttggaccttgtgtttaaaggccatgcactgttcggtggagtggcctggggttttcccatggtatgcgtaggtggcgtcaaggttatgccactttgggaaaggaggctggtagatttttccgggagatatcacaaccatcttgttggtgatgagggatggcaagaggtcttcctacatcattgggatcggggtgaatgttgtcctcgggggaaagttccttatcgcgttagaaccgacgccaaagtgggcattgccagtcgggcgagtcggggttggagccgtagcttgaggggtctccctctggatgggtgcaggcaccctagcttgtacgggtgctga

SEQ ID NO: 73013 - DNA, 285 bp, Glycine max
  Peptide Sequence Number=SeqID_164698
atgtgtttacacctgaagggtgaatgctgtgaaagtttttccatcgaattcctgcagcccgggggatccactagttctagagcggccgccaccgcggggggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 73014 - DNA, 963 bp, Glycine max
  Peptide Sequence Number=SeqID_164699
atggcgaatcaagaggaatgggtcccgttcatggacgtattagcattgctaatctttggggttgtcctctttccaaacgtggacgatttggtggacctagccgcaattgatgctttccttgcatatcaccatagcaaagaaagcccggtggtagctgtcttggcgaacttatttgatacatttgaccgaaggtgcgagaagagtagcgcacgaatcatctgctgcttgcctgttctttatgtatggttggtttcgcacctattccaacaaaacataaggcatccatgtccgctccggagccatcgctcgtgtgtcaaaaagagaagagtagattgggaccaacacttggctgggataggaggtagaacaatcaattggtttcctcgatggaaggaaggaaaggagggagtcctcttctcatgtggggactacccaaacatcccattgatggggacgaggggttgtattaactacaatctcgcacttgctgtaagacagttagggtaccccatgaggggagcaccggcggaagggagcctctctcctttccttgtgagagattttggcgcgcaaagtttcaagattatacaaagagtccataaggcgtgggaaagcccgttaaggaaagataaagaacttaggggcattcgtaatggcatcatcggtggttatcatgaatggctgaaagttcgtacacaagggttagattggctctccaagttgaaaattatcaacgaggagaacttcgaagctccggaagaggatgaagaagtccgggctctaaaaagcgaactaggaaaagcaatacttgccaaagaaaaattcaagttagtcgctacagacgtccggaaagagtgtgtcgagttacgagaagaaaatgcagctaccgcaagagcccttgaacaagaaaccaagagggcttgcaaggaagagcatggccgagacaaattccgtggagcttag

SEQ ID NO: 73015 - DNA, 534 bp, Glycine max
  Peptide Sequence Number=SeqID_164700
atggagtttgggaacaacgctgacgaacgggcacgggaggctcaaacccaagttcttgatttggaacgagatttgctctttatggggaatgaattgaacaaatataagaatcaacatcaattgtggaatagagaatacgaaaagatgcaaaatcaaccggttcctctatggactggcatagtcccaattctcaatggatttttgctatttctcgtagagccatggaagcaactaatgttcatcctccccgcatttctgaatttggaacgctggatcaatctcttggatttcgcattgaagataccaattcctgaaaggtgtgaatccagtggatcaaaagataaatcaaatcaaaaggttacattaagacggcttgctcaaaattgtgaggctgccaggaaaagtcgactgaggaaaaaggcatatcagcaacaattagaaagcagtaggtttaaactgacccaacttgagcaggagctccagcgagcacgccaacaggggtcattgttggacaccatgacatttggctcttag

SEQ ID NO: 73016 - DNA, 162 bp, Glycine max
  Peptide Sequence Number=SeqID_164701
atgggtgccaagtacctcgaagtggtcaagcaaaggttacatgccatcaaacaatggtccccggacgaaattaggtacgtcatttcagtgtgcttttgcctgatcacgcagatgcatgcctttgtaggatcattcaacagtggaaactggtctgattcttag

SEQ ID NO: 73017 - DNA, 408 bp, Glycine max
  Peptide Sequence Number=SeqID_164702
atggtggtgagcttcttcttgactcatcttctccttgaagtggcgtctctattcatcttgctccttctccattccgctgcaatcaaacctcaagaagcaaaggactccattgataaagaagatccaaggcctacaagctccaatggagctacatcaacttccctcggaaccgacacaacaatagttagaagcacattggccactgaccctgatgctaaaaccatgggcagctgtgcatcattgttgcaatcttgggcatggtatcgcatgcccttcattgcagcaagagttaattggaaaccatcgtatctgttggttacgagtggtggtggattaagctttactagtaaaccacatggagatgtcattggttatagaatgagattagaccacatgacagctgaacag

SEQ ID NO: 73018 - DNA, 84 bp, Glycine max
  Peptide Sequence Number=SeqID_164703
atggaggaggagaagaagaaggagaaaatggtggaggatgacaaacaactgaggaagaaaaagaagaggaggatgaatagatga

SEQ ID NO: 73019 - DNA, 363 bp, Glycine max
  Peptide Sequence Number=SeqID_164704
atggttccgaagaaactttccacgaagaggtctagaagagacgccgcagcggaagggtccagtgccacccgcgagtttgatagtcatcgtttccggagcgccgagcaccagcagcgcttcgaggccatcaaaggatggtcgttccacagagagaggcgtgtccagctcagggaggatgagtatacggactttcaagaggagatagcttgtagacgttggacgtcactggtgactcccatggctaagtttgaccctaagatagtcctagagttctatgctaatgcttggcccacagaggagggaattaatgaagcattgggcttgaatccaacattgggcttggacttgaagagggcagactaa

SEQ ID NO: 73020 - DNA, 198 bp, Glycine max
  Peptide Sequence Number=SeqID_164705
atggcactcatatgggacaccttaggggttcccatgaaccctaagagaataaaggtcattcccgagtggcccactccaccaagtgttgaggaaaaaagcccagagtttcaagaacctcaggatttgaggtcaaatccttttcaagggcctagaatgatgcaatcctaccccgcaagggcattggatagaatactctaa

SEQ ID NO: 73021 - DNA, 723 bp, Glycine max
  Peptide Sequence Number=SeqID_164706
atggcttcccgtaagagaaaagcaccagcttcagtatcccaggctaggagagaaactgagaggaggaattggcataaggagctcactaagttctttgaagggagcattgacgtggcattagtgaaggaattctatgccaacctttatgaccttgaagataaatcaccaaagcaggctaagttaatctacgagcttgtaatgcagatgaatatgaacttgggatccctcatctcaggtcagatttctctcatcgcacaacatgactcctcgaggctaggttttccagcccttattattgctttatgcaaggcccgaggagtcacatctgattctctgacctttgaatccctgagcccagccattaatttggcttatattaaaaagaattgttggaacctggatgacccttcggtcactttttgggaaacccgcaaatctagggccagaggatctgaggcaccatttacctcagctccttctacctctcctctccctcctgctctagcaactccagtggcctggccaggagtccagccttctcctttaggaagggaggctgcagagcctacacttcttgagccattcactttagagtttgatccagctgatccagctatatctcctcagcctaagccatctgcaccagtgccagacctgcctctttctcaagatccatcatctgcaccatcactggatctgaatgagcatgcacaagatcattga

SEQ ID NO: 73022 - DNA, 255 bp, Glycine max
  Peptide Sequence Number=SeqID_164707
atgggtccttttccttcatctacaggtaatgagtacattttggtggttgttgactacgtgcctaaatgggtgaaagctgtggccaccccaagaaatgatgctaaggctatggcatccagggagcacaggaagattcaactgttggagttggaagaaatgcgactgacaacttacgaatcttcaaaactctataaaggaagagttaaggctaccacgataaatgttgttgaagaaagacttcaaccgggacaacag

SEQ ID NO: 73023 - DNA, 657 bp, Glycine max
  Peptide Sequence Number=SeqID_164708
atggctgggcatagtaaatgggccaatattcaacaccgtaaaggccgtcaagacgccaaacgcggcaaaattttcaccaagctgatcaaggaaattacggtttctgcgcgcatgggcggcggcgataccgccatgaatccgcgcctgcgtgcggccgtggctgcggctaaggaagaaaatatgccttcagacaatatcacgcgtgcgattaaaaaaggcacgggtgagctggaaggcgtgaattatgaagaaattcgttatgaaggctatggtatcaatggtgcggccattattattgattgcctgactgataatcgtcagcgcgcagtaatggacgtgcgtcatgccctgaccaaacacggcggcaacctgggtaccgatggcagcgtggccttcatgttcaagcactgtgggcaattggtattcgagccaggtgtgtcagaagatgcagtgatggaggtagcgctggaagcgggcgcggaagatgtcattaccgacgaagatggcagtattgaagtgattactgccccgggcgacttcgtgaccgtcaaagaagcgctggaagccgctggcctgaaagccgtgatggcccaagtgacgatgaaatcactgaatgaagtggttttcaccggatgtgtacacttcagccgtgattga

SEQ ID NO: 73024 - DNA, 297 bp, Glycine max
  Peptide Sequence Number=SeqID_164709
atgacatgcgaagacaaattatcgtcatccgcacaccttttcgccatccaaagacgatcaagtccgatggcacgcaaagacaaattatggtcattctacgcattttttaatctagaggcggcaagcccgatgacaggtggagacaaattatggtcatccgcacacctttttgtcaaccagaggcaagggcagcgagtcgggtggtgggtggagataccttatggtcatccgcgcctttcgtcgaccgagaggaacgaattcggcaatatgaagatgatgttggtcgttcggtgctga

SEQ ID NO: 73025 - DNA, 477 bp, Glycine max
  Peptide Sequence Number=SeqID_164710
atgtatgttcgaaatgccccaaggaagcttgcctcaaagagatccaggaaagacaaggcggttgaaggaaccagttccgctcccgaatatgacagccatcgttttaggagcgctgagcaccagcagtgcttcgaggccatcaaaggatggtcattccttcgggaaagacgtgtccagctcagggacgacgagtatactgacttccaggaagagatagttcgccggcggtgggcatcgctggttacccccatggccaagttcgacccagacgtagtcctcgagttttatgccaatgcttggcctacagaggagggtgtgcgagatatgcgatctggggtgaggggtcagtggatccctttcgatgcagatgccctcagccagttcctgggataccctttagtgctggaggaaggccaggagtgcgagtatggccagagaggaaccaaggccgatgggtttgatgaggaggcatcgcca

SEQ ID NO: 73026 - DNA, 369 bp, Glycine max
  Peptide Sequence Number=SeqID_164711
aaaactgacttgactccttcatgcatgctccactcggctcggggggatatagctcagttggtagagctccgctcttgcaattgggtcgttgcgattacggaggaccgaaacatgccactgaaagactctactgagacaaagacgggctgtcaagaacgtagaggagggttcctcatttgggatcctggggaagaggatcaagctggcccttgcgaacagcttgatgcactatctcccttcaaccctttgagcgaaatgtggcaaaaggaaaaagaatccatggaccgaccccatcgtctccaccccgtaggaactacgagatcaccccaaggacgccttcggcatccaggggtcgcggaccgaccatag

SEQ ID NO: 73027 - DNA, 366 bp, Glycine max
  Peptide Sequence Number=SeqID_164712
atgctcaatggaatgccccggggctcctccatgataagcacacattgcgttcgattcgtatcctcggaaaaatggaggttgaggaaacctagcaggggttatggctaccattgcagtatcaagtggtgtttagcattggttgtgtggaaggtgggttttgtggttgatttagggatggcctttgtggataattgggtggaaacttggctgtataggaatggcagtcacagcatgggtttctccctcatcctcaccctcttcatttgccccagttttctcattcatcaaagcagaatgattaaatttgcctcttttcagacccacttcgatccttttgcttgcgaagaccaaatctgtaaaacttga

SEQ ID NO: 73028 - DNA, 264 bp, Glycine max
  Peptide Sequence Number=SeqID_164713
atgtcatggatgaatataaaaggtgttttccctttcagcccgaaacagcacttcctccagcacatttctatcaagatcgaaggaataagggctaagcgatggagaaacagaattctggttgcaaatgcaaaatttgacgctaatcggctttttgaagatgctatttttgtagtctggacttggcttagacactttgagaaggatttcacaatccactttaatcagtggtcaagcaatattagacaaggttttttgcttatgtag

SEQ ID NO: 73029 - DNA, 699 bp, Glycine max
  Peptide Sequence Number=SeqID_164714
aaaaaggcggagcaacaggcgaagagcttcagcagaagcaggcggagcaacagcagcgcctgaaagagctggagaaagagcgtttggcggcgcaggagaaagccgcgcaggacgccaaagcgcaggctgagcaacagcagaaggcggcggagcagcagaaacaggcagccgagcagcaaaaagcggcggaagccgccgcagccaaggccaaagagcaacagaaggtcgccgaggccgccgccgcgaaggcgaaggctgaagcggacaagatagccaaagcgcaggcggacgcgcagaagaaagccgaagcggaagccaagaaagaagcggccgccgctgccgccgccaagaaacaggcggaagaggcgaagaaagccgcggccgccgccgcagagcaaaaagccgcagaagctgcggagaagaaagcggccgctgaagccgagaaaaaagccgcagcggaagccgagaagaaagctgcagccgagaaagccgctgccgccaagaaagccgccgcggacgccaagaagaaggccgccgctgaggctgcgaagcaatcggaggaggtcaacgatctgtttggtggcctggcggacggcaagaacgcgccgaaaggcggcggtgccaaatcgaagggcgacggtaaaccggccgggcagggcaatgccaaaacggctggggccagcggggcggatatcagcg

SEQ ID NO: 73030 - DNA, 339 bp, Glycine max
  Peptide Sequence Number=SeqID_164715
atggctccaaagaaactctccacgaagaggtctagaagagacgccacaggagaaggatccagtgctgccttagagtttgctagtcatcgtttccggagtgccgagcaccagcagcgctgcgaggccatcaggggatggtcattccacaaggagaggcgtgtccagctcagggaagatgagtacacagacttccaggaggagatagctcgtaggcgttggacacctctagtgactcccatggccaagttcgaccctgagatagtcctagagttctacgctaatgcctggcccacaaaagagggagttcgggacatgtgctcatgggtgaggggtcagtga

SEQ ID NO: 73031 - DNA, 188 bp, Glycine max
  Peptide Sequence Number=SeqID_164716
attggtctcctgctgtagccacttggtatggaccagcccaaggggacggtagtgaaggtggtgcttgtggttatggaagtgctgttggggaacctcctttctcatcattgatgtcggcgggaagccctcttttgtttgaatcaggcgaaggctgtggttcttgttacgaggtgctaatgattttttga

SEQ ID NO: 73032 - DNA, 1377 bp, Glycine max
  Peptide Sequence Number=SeqID_164717
atgaagaacctctctttcttcctcatcaccaccctattcgccgccttctccgccgtcagatctgatccctcagatcaccgctacaaagaaggcgactccgtccctctctacgccaacaaagttggccccttccacaaccctagcgaaacctaccgttacttcgaccttcccttctgtgaaccaggtgatttgaaagagaagaaggaggcgctcggggaggtgctgaatggggaccgtttggttagcgcgccatacaagctggagttccagcgcgacaaggagtcgatttccgtgtgcaataggaagctctccaaacaggacgtagcgcggttcagatccgcggtgaggaaggactactacttccagatgtactacgacgaccttccgatttggggtttcatagggaaggtggacaaggaagggaaggaccccagtgattataggtacttcctgtataagcacattcacttcgacgtgttctacaacaaggacagggtcatcgagatcaacgtgcgcaccgatcccaatgcgctcgtggatctcaccaaggattctgaggttgatgccgagtttttgtacacggtgaagtggaaggagacgaacacgccgttcgagaagaggatggacaggtactctcagtcctcgtcgctgccgcatcatttggaaatccactggttctcgattatcaactcgtgtgtgactgtgctgctcttgaccgggttcctcgccaccattttgatgcgggtgctcaagaacgattttgtcaaacaaggacagctacagttgctgtttgtcacaatccttgatattagggaaattgtgaacaaatgcggtcacaattgcagtcacagttttattgctacacttgatattgcaggaaattgcagatatatgtatgcacatgatgaggagtctgcggaggatcaggaagagactgggtggaaatatatccatggggatgtgtttaggttccccaagtttaagtctctgtttgcggctgcgcttggatctggcactcagttgtttacccttacggtgttcatattcatattggctcttgttggtgtgttttatccatacaatcgaggggcactgtttactgcactggttgtcatatatgcacttacttcggggattgctggatacaccgcaacttcattctattgtcagttggaaggaacaaactgggaatctgctgttgactggatgccttttctgtggacctctgtttctgactttctgctttctaaacactgttgcaattgcttacaaagctactgctgccctcccatttgggacgattgtggttatagttctcatatggacacttgttacgtctcctttgcttgtattgggagggattgctgggaagaatag

SEQ ID NO: 73033 - DNA, 660 bp, Glycine max
  Peptide Sequence Number=SeqID_164718
atggagcaaaacccgccgtctccggcggaagactcggcggcggcggcgccatcctccggcgaagcaaaaccttccctcttccctctatttcctctcacagcctcctcctctctccaaaccaccaccacatcctccactccccaatggctcagcaacaccagcttcaccaccgacatctccgttataaacgacgccgtggcctcgcaactcaaccgcgaaatcacgcagtcgccgccacaagacgacgaggacgaaaatcgcgcccaggcgaatcccctcccttcttctaggtacgagattctggaatcttccgaatcggacggaggcggaagagatagagagaggaagaagagaaagaagaggaaaaagcggaagtgcgattcgtctgtggagagaggcggattccatggtttcggttcgagaaagtcgcgcgttcgagcttgggcggattcggaggccaaagttgccaaggattattacattgattctcacggagatcgcgacaatctcgcgttcggatgtatttacagaatggtggtgcttacttcggtcctgttagcgctgttgatgaatttattgggagttagaatccaaatgaagtgtttctccgcctcgagcggaagccattatcatccacaagtatttcatgatgatcattag

SEQ ID NO: 73034 - DNA, 252 bp, Glycine max
  Peptide Sequence Number=SeqID_164719
atgcctttgagggaggagctgtcattgagggagaggtgttttcacgatggttgtgccattgaaggaggaggtgtcgtcaagggaaggaagggtgccattgagggaggaggtgtcatcatggtgagtgtgccatcaaagaaggaggtgtcgtcaagggaaggaagggtgtcatcatgggagatgttgttgcaaggggtgttagggttgagagaaggaagaagggaggtgtttggattgggagatgagaagtga

SEQ ID NO: 73035 - DNA, 78 bp, Glycine max
  Peptide Sequence Number=SeqID_164720
atgtttaagggagttaatggtggtggacaaggaaatattcgtatctggcaagtacatttaggttgccatgcaccatga

SEQ ID NO: 73036 - DNA, 1314 bp, Glycine max
  Peptide Sequence Number=SeqID_164721
atggttctcatctatgatctgcgctcgtctaatcctgtacgaatacaggatcatatgtatggcagttcaatattggatattaagtggcatcatactcttaactatgaacaaccaatgttgattaccagtgataatcatgttgttaggatatgggatcctgaaacgggagaaggcttgaccagcattgaaccgacaacgggaacaataaatgacgtgtgtacatttcctggcagtggtttgatcttgctggccttagattgtagtcaaataccatcttacttcataccatcgcttggacctgctcccaagtggtgttcttcgctagagaatttcactgaggagttagacatgggtggacaaacaactatttatgatcattacaaatttttgacaaaggaagagcttgagaggttaaatttgaccaacctgattggcaccaatctacttagagcctacatgcatggcttctttattaatcatgcattatacaaaaaggcaaaagcactggtggatccttttgaatatgaagcttatattgaacagcagaaacgagaaaagatggaagctgagcgcgcctcacgaatcacggtcaggaaaaagttacccaaagttaatcgggcccttgcagctcgcctcctagaaactgaagaagctgaaaatgagaagagggatgaagatgctgatgatggtgaaactaaaaaggcatccaagaaaaagaaagggctcagcatgcaagatcttcaggacgatcgatttaaagcaatatttacaaatgaggaatttgagattaaggattcctcacaagaatatctggctttacatcccatgggttctaagaagcaaacatccttgttaaaggaacattttgaacctgtcatgtcagatgatggtcaaagtctaagtgattctgatgcatcaacatcatcacaagatgaacctgcgaatggaatgaaagacaaatctcgggttccaagaatgtatgaaatcaagaatgagcagcatgcggaggcattctggagccaaaaatcacttgcaggggaggactcacttcctatgggagacagagtagcagctctaagagatgaccaacaatcttctcgtgttccaaaaggtattaagcagggtccaggaggatcacgagaaatcactttcgccacaagaagctcagctaagtacaaggaagacgaggaggataaagaagtgccaaacaggaaaaagaggggagttcaatccttggggcttaagcccaatagaccagtgtttcgtggtcaagggagagggaaacgagggaatggcagaagaggacgtcgataa

SEQ ID NO: 73037 - DNA, 1065 bp, Glycine max
  Peptide Sequence Number=SeqID_164722
atggggatacttggcgaagcttcctcaattgatttttgtttaggaactaccttagttttaatggtttctcctaaagcttttggtctaggtatgctagaagtagtgtctaatccttggaggtttacagtaggaaactggttatgtgactcagatctggttagtcctactggaattgaacgggttctaaccgaaaaagaccttctggctgactcatattcagacctagaggcttctatccttgatgaaaacgaatttctcctattgaagattatctctatctttccggagttatcttgcttaatatgctctatggttggagcgggtcggggaacagacgtcatccatgttttgattgatatcttcgaatcggacttcctcatcgaagagattgtgtttgggggcgacctcttgggtctggatctacgacggttcatgaagacccgatttagaagttctcttccactcgctgtcccgcgattcacgccgtcgggattcgatttcgctatcgaagagcaagagttcggcgacctccacggaatgcttttcatcaatgttgaggttcatcgcgatcccagggagcatgttgaggttaaaggccgggggatgggtaggattcagcctttgcaatcgtcggggaggggggagtttgatggagaagtggagaagatacagggatttgattttgctaattggttgaagaagacagtttcaaagaacgattttgttgtgatgaagatggatgtggaaggtactgagttcgatctgattccgagaggagtgcaaagtatgagaaaacatatgatccatgcttgcagctcttcaaatcccttagacaaagtggagttcttgttcatcagtggttctaattgtgcccagcatgataggaattttaaaggcaacaagaagcagcattcaatgcccaatgctcatgtgcgttcagaactcagatatggatcaaattcgaaaggagaggcagacaaggccaacagggtttcttatataaagagcaagtcaacaacgggtaaaaggtttggtaaaaatggtaaaaaaagaaaaggcaaatag

SEQ ID NO: 73038 - DNA, 78 bp, Glycine max
  Peptide Sequence Number=SeqID_164723
atgtcaaatatagatataaaaactggaggtgtaacaagcaaaaaggctagaaaaattgaagaaaagaagaaaatctga

SEQ ID NO: 73039 - DNA, 294 bp, Glycine max
  Peptide Sequence Number=SeqID_164724
gagaaatatcaacatcgtcgagatgaaatcttacaacattcgacagaggaaggcacatctacacaggattcccctaacactgctacttctgttaatgataatgaaatatatttgaatgttgttggaggtccaaattacaaggggaacgtgtacgacctaggtactttgagcaaaaggtttagttgctcaaaatcagtttcatctacttctattgctcctgtggaagaccaaatagaggaccatgttaatgatgctcaggttgatcgtcctcatgacatgggaaattatcattga

SEQ ID NO: 73040 - DNA, 342 bp, Glycine max
  Peptide Sequence Number=SeqID_164725
atgacaagtcttacttctgttccttttcagttgtatgcagatacttttatgacatctatgttagataacataaatcatcagtgtagctgccagttattagtcttctttcttgttgctaatcaatctttctcgatgctgagattgatgcaacatatacaaagccttccaaccagagcaatctttttagcacttagcagaccccccattaaaaaggtgcgtgctaggaggaataagagcaggcacaaagggaattgtattgggttggtttctgttatgctcgaattgaggtctgttgaacttgttaatagctgtactgtattaacaagagatttcaaccaataa

SEQ ID NO: 73041 - DNA, 828 bp, Glycine max
  Peptide Sequence Number=SeqID_164726
atgaagtcattgatctctggaaaagtattcttgcaatggggaaagtgctgggaggttcacataggaccaaggagagggtctgcaaagaatacaaaatttgaaaagtatggtagaggggatattggaagaaaaacaacaggacatcaagggagagaagaaacacaatcaaaggggcaggatgtcgggaaaggtaaggaggtggtttatcagaatgctggccagaaaacagggagacacaacaatgcaagatcatatgctcggttagtttctacaagggtaataccagttggccagacatggaggccaaaaaatggaaacaaaggcaggggagaaacagtgttgggaagggaaaccgtgacacctatgcaatatggaatggctaaacaagaggataacatagtactcttaacggctttggagggaggtgatttaaatggcatgttgcaagagtctgaagcatggatgggggaaagtttcgaatctattgagccttggaactcgtttttcatttcgggaaacaaaacttgttgcataaggatagtcggggtgctgttgaacgcatggagcaacgtagatgaaaacacagagaagatggctagtttggagtatgcaagggttatgataagcacttcatcatatgacaatatttgcagtactgagtgggtaaaaatacatggaaatccttactcttttcgtgttgtggaagaactgaaagagagtggaaacctgaagatgatatggtggtcaagatactgccaccacagggagaagttcaggagagttttctgtaaaagggaaaagggactgggaggagagaaccggttgtaa

SEQ ID NO: 73042 - DNA, 276 bp, Glycine max
  Peptide Sequence Number=SeqID_164727
atgacaacaacacttgttttatttagaagcattaatgatttgatatatttctttaacattcttgtacagtttaggttggcttatgtttctcctgagtcaagggtagtaggtgctggagatttagttgatcatcccaagaaaattgctcttaattatctgaagggtttttttttcattgacctatttgttgtattgcctctacctcagttgaattttcagtggctttgtatctttgatttactagaaaataaggaggtctttgatgttgccatatga

SEQ ID NO: 73043 - DNA, 621 bp, Glycine max
  Peptide Sequence Number=SeqID_164728
atgcctaactccttgtcatggtataattctgtgaaatatttgcagatattcatattgtttgtccaaccgaaacacttggggtcatcaggagcaaactatgcaggattaatatttgagtcaccatgggcaagtttctttataaatctttttacctttatgctatctggccatgttgttggatcatggtggtacctcttcggtttgcagagggttaatcagtgtctacgagatgtctgccagaaagtaatcaaagaacataatgaatgcgcaaaattcattgattgtgggcatggtcaagctgaagaaaatcaaaataacccaaccttgcataattggaggagcaattctgaagcaagttcttgttttactgaagatggttttccatatgggatctataataaagctgttaaccttactgcagatcaaaatgtgatcactagatatgtatattcatcattttggggattccagcaaattagtactctggctggcaatttaacccccagctattatgtttgggaagtcatctttaccatggcaatcataggatcaggactgttgttgtttgcccttctcattggaaacatacaaaactttcttcaggctcttgggcgcaggtag

SEQ ID NO: 73044 - DNA, 1992 bp, Glycine max
  Peptide Sequence Number=SeqID_164729
atggttttccttcgtccccttttcttcgtcgaaacgaagcagcagcatccaccacagtacataataaattctctgaaaaacccttccttttcatcactcacccaccatcattgtcaggtcttcagaaataaagttctgcaacaaattgaaaccacacttcaacatacaaggttttcaccctttcatcaccttgctcattgccaaaggccttcgttatctgataacaaatcttcctgtgtgcacttgattcaatattcgttgcccttgaactattattatattgcttgtcatgtttctaaccgccattattgttcagaaactgtttccatgaacaaagatcttagttgtagtgagagtggtgttgtggagggtaatggttttgaaagtgacgttgataaggtgtatagcattgtgatggataatttagctggatttaacaatatggagaatgctcttggccaattggggatccctttgtccacccctttggttacaggggggttgcataggcttagatatgatgaaaaaattgcacttaggtttttcacttgggctggtcatcaagaggattattcacatgaaccttgtgcttataatgatatgatggacatcttatctagtactaggtacaaggtgaaacagtttcggattgtttgtgatgtgttggaatatatgaagaggaataacaggactatggttccggctgaagttctcttggtgattttgagaaagtatactgagaagtatcttactcatatgcagaagtttgcaaagaagaagaggataagggtgaagacgcaactagaaataaatgcatttaacttgctgctggatgctctgtgcaagtgttgcttggttgaggatgctgaaagtctatataagaaaatgaggaaaacggtcaagcctaatgcggagacgtataatatattggtttttgggtggtgtagggttagaaacccgactagagggatgaaattactggaagaaatgattgaactgggtcataggcctgacaatttcacgtacaacactgccatcgatacctactgcaaaacaggtatgataacagaggctgtagatctttttgagttcatgaggacaaaaggttcaactatatcttcccccactgccaagacttatgcaattataattgtggctcttgcccaacatgatagaatggaagattgttttaagcttatagggcatatgattagcagtggctgtcttcctgatgttacaacatacaaggaaataattgagggaatgtgtatgtgtggaaagatagatgaagcttacaagttcttggaagagatgggaaacaaaagttaccgaccagatattgttacttataattgttttctcaaggtcctttgtgacaataagaagtctgaggatgcccttaaactctatggaagaatgattgaattgaattgcattcctagtgtccagacatacaatatgctgatttcaatgttttttgagatggatgatcctgatggggcatttgaaacttggcaggaaattgacaacaggggttgcagaccggacactgacacatattgtgtgatgatcgaggggctatttaactgcaataaaatggaagatgcttgttttcttttggaagaagtgataaatgagggagtaaaactgccatataaaaagttcgactcctttttgatgcaactgtcagtgattggcgatctccaggccattcataggctctcagaacatatgaagaaattctataatcatggtatggcaaggcgttttgcactaagccagaagcaaaaatttgaaggggcagaattagggggttcttatcatgataggtcagacaaatattttctggaagcatggcagcctaaaggcgggaagatccatgtatatattttatggttgcatctgaggacagaggttgcgcagatttgcttgatgttaggaggcttgtttgttttgttggagatccagttgtggaaggatggggtttcttaa

SEQ ID NO: 73045 - DNA, 279 bp, Glycine max
  Peptide Sequence Number=SeqID_164730
ggaggtaggtatgagaattgtggcgttagaacaaccagatctagtgagcacaatgtcattttgtcgtcatcacgtgcacttcgaagccttcgctcccaatcaaagcacttgtgtgagaatgatatggtaaagtacaaatgtgaagaggatgccaacgatgaagctataagagttggtgaggtgaaggatgccaacgatgaagctataggagttggtgagaacccgtcatctaacaaagcagttgagttgttgagaaataatccgcaaaagaagagttga

SEQ ID NO: 73046 - DNA, 324 bp, Glycine max
  Peptide Sequence Number=SeqID_164731
atgcatacacaaagtttcacaattgcacaatttcctaaaataggcctaactcacaaaaacagtccccaatggagtcgccaactgtcgcaacctacccttttgcgggcgagcgaggcgaggctcatgggtgcgtcttccaaaggaggaaaatgcacggagtcgccaccaacgtttattagtggaaaatgtcggaaaaacccaaggaaactggtcatgaagaatattccagattcgggagttgtatttacgtttgaggaaggtcgacaaaagcagggctcttgctcctacgtaccctccatcgaagaggaaatcagacctacgtag

SEQ ID NO: 73047 - DNA, 368 bp, Glycine max
  Peptide Sequence Number=SeqID_164732
atgaagatcaagaaaagaacaaaagaaaggaaagaaggattctcgatcaaagatcgaaaggaagtgaaaaggggaaaagaagcaactctcgatcaacgaaaggaagagaatagaaagtctccaaagccagattgccactcagaatcattcttgactggcaatattccaccccacatgaacaaagaggaaaaaaccgaaacacccagcttcctctccaaaaacgctgacctcgagaaaatcctattggataagacacttgccttggctgttcatgtgttctccacttttgagtctggagctgtgttccatgattgtctaagagaggaccctcaaggcaatcctccattctcatccttttccggagtcgc

SEQ ID NO: 73048 - DNA, 72 bp, Glycine max
  Peptide Sequence Number=SeqID_164733
atgactgtgaaaaagaggctaagtcatgaagtgccaaaagtgacagttgagcttagctcattagtgggctaa

SEQ ID NO: 73049 - DNA, 309 bp, Glycine max
  Peptide Sequence Number=SeqID_164734
atgcagtcagatgtttggggtagtataagtgatcaagggatagtaaatcatatcacaggaggaaattttgcgcagagttccattaccattaatgggtggctccgtgatttcttatgggcacaggcatcccagtttaatgtttctattcagcgggcgggttatgcaagaacttatgaatccattgtttgggctcataataaattaaaagttgctcctgctactcagcctagagccttgagcattgtacaaggacgtgctgtaggagtaacaccatattaccttctatgccacacctatccattcttctag

SEQ ID NO: 73050 - DNA, 132 bp, Glycine max
  Peptide Sequence Number=SeqID_164735
atggggtccagttgtcatacatcgaccagagaggattgtgcgacagtttggatgcatttctctgattacctcgcactggtggatgagatttgtgttgtgcctggacaatgtacatcagactacatcaactga

SEQ ID NO: 73051 - DNA, 291 bp, Glycine max
  Peptide Sequence Number=SeqID_164736
atgacgaaaggcgaaaaacggttgaaaatcttcgcgaaatcacccacgaaaatgttacggaaatgttacggaagcgcctcggcttggattttcttcacggaaacaattttcctcactgattttaagaaaataggggaggagcttgccacccagctcgcccaggcgagccaggttgcttcttccagaagcaaccgtcttctggaggaatattctggaaggcccaagtgggcctgctttcggaatgttacggaaactcacggattgcgcaacacttccttacaggtcatgtaa

SEQ ID NO: 73052 - DNA, 375 bp, Glycine max
  Peptide Sequence Number=SeqID_164737
atgtgcgctgagaaagggaaggcaaattgggagcagctcttggctagtatggtaggggcatctgttaattggttcctccgatggaaggaaggaagagccggggttttgtcttcatgtgaggggttctcaaacatccccttgatgggaacgaggggttgtatcaattataatccagtccttgccataagacaacttggctaccccatgagaggagcgccatcggaagaaagtatcacacccttcgtcacaaggggtttcagtgaccccaatgcaaggatatttcaaggggtccgaaaggcatggagcgtggtgcaaagaaaggataaggagcttaggggaagcagtaatgcgatcatcggtggctatcacaagtag

SEQ ID NO: 73053 - DNA, 1014 bp, Glycine max
  Peptide Sequence Number=SeqID_164738
ccgccgcacgcgcagtggccgggtgaggcgcgggtggcggtgcagttcgtgctcaattatgaagagggcgctgaaaacaatgtgctgcacggtgacgcgggctctgagcagtttctctccgacatcatcggagccgccagctatgccgatcgccacatgtcgatggattccctgtatgagtacggctcgcgtgccggtttctggcgcatccatcaggagtttcagcagcgcggcctgccgctgaccatctttggcgtcgcgatggcgctggcgcggcatccgcagattgtcgaggccatcaaagccgccgattacgatgtggtcagccacggctggcgctggattcactatcaggggatggatgccaaaaccgagcgtcagcacatgcagcaggcagtggacgtgctcaccgagttattcggtaaagcgcccaccggctggtataccgggcgcgacagccccaatacgcggcggctggtggtcgagcagggcggcttcagctacgacagcgattactacggtgacgatctgcccttctggacgcaggtcacctgtcaggacggcacggtgaagccgcatctgatcattccctatacgctggagtgcaacgacatgcgcttcgccacgccgcagggattcaacaccgccgagcagttctatacctatctgcgcgatacctttgatgtactgtatgaagagggcgcgacggcgccgaagatgatgtcgattggcatgcactgccgtctgctggggcgtccggggaaattccgcgcgctgcagcgtttcctcgaccatattcagcagcacgacaagggcacactcgcgcctgcgtcagctcatcaaactcacctgcgctgccacgatgcgccagccgcacggcagccgtacccaggtctgctgctgacggccgatcttctctacgccctcgcgggtgaactcggtgctgcacaccgcatagtcatcgccaaaggtggtgatcaccgtattgcgcagcgtgcgatcgagcccctttga

SEQ ID NO: 73054 - DNA, 333 bp, Glycine max
  Peptide Sequence Number=SeqID_164739
atgacagatcttgtgagcgcggaagatgatgtaaatctccgcgtgtcaacaggcttgtcggccgcgattgacgaagggcgcagaatgaccataatttgtctctgcgtgccatcggacacaactgtgtctgaatggcaaaaaaaggtgtgcagaatgaccataatttgtctccgcatgtcatcgggcccgccacctttggatgacaaaagggtgcagaatgaccataatttgtctctgcgtgccatcggacacgactgtgtccgaatggcaaaaggtgtgtggaatgaccataatttgtctctgcatgtcatcgggcccgccgcctctggatga

SEQ ID NO: 73055 - DNA, 983 bp, Glycine max
  Peptide Sequence Number=SeqID_164740
atacgccgcagttcaaaatcgacatcgaccaggagaaagctcaggcgctgggcgtgtccatcagtgacatcaataccacgctgggtgcagcctggggcggtagctacgttaacgacttcatcgaccgcggtcgtgtgaagaaagtgtacgtgatgtcagaagcgcaataccgtatgttgccgaacgatatcaataactggttcgtgcgtggcagcaacggtcagatggtgccgttctcggcgttctctacgtcgcgctgggagtatggttcaccgcgtctggaacgctataacggtctgccatctatggagatcctgggtcaggccgcgccgggccgaagcaccggtgaagccatgaacctgatggaagaactggcaagcaaactgccttcgggtatcggctatgactggaccggtatgtcctatcaggaacgtctgtccggtaaccaggcccctgctctgtacgccatttcactgattgtggtcttcctgtgtctggcggcactgtatgagagctggtcgattccgttctcggttatgctggtggtgccactcggggttatcggtgcgctgcttgcggcgacgttccgtggactgaccaacgacgtgtacttccaggtaggcctgctgacaaccattggcttgtcggcgaagaacgcgatacttatcgtcgaattcgccaaagatctgatggagaaagaaggcaaaggtctgattgaggcgacgctggaggcggttcgtatgcgtctgcgccctatcctgatgacgtccctggcgtttatcctcggcgtactgccgctggttatcagctccggtgcgggctccggcgcgcagaacgcggttggtacaggggttatgggcggtatgatcaccgcgaccgtactggctatcttcttcgtaccggtgttctttgtggtggttcgccgccgcttcagccgtaagaatgaagatattgagcacagtcattcggtagaacctcactga

SEQ ID NO: 73056 - DNA, 285 bp, Glycine max
  Peptide Sequence Number=SeqID_164741
atgaatgcatcaaagatgcactgctatgctagtaccagtacatctaataattctaatgtttgtttaaatagccccggactgtggaacaaaggagtatcccgaacctacaccgagatttcggaatcaataaaatctccccaagtaggattcgaacctacgaccagtcagttaacagccgaccgctctaccactgagctactgaggaacaacgggaaattcgagctcatagagttcaattcccgttctcaacccatgaccaatatgagctcgaagtttccttcgtaa

SEQ ID NO: 73057 - DNA, 293 bp, Glycine max
  Peptide Sequence Number=SeqID_164742
atggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccgggtgtcattccgctgtatggccgcgtttgtctcattccacgcctgacactcagttccgg

SEQ ID NO: 73058 - DNA, 852 bp, Glycine max
  Peptide Sequence Number=SeqID_164743
atgagttttactaccatctctgtcattggtcttggctacattggcctgcccaccgcggcggcgtttgcctctcgtcagaaacaggttgtcggtgtggatatcaatgcccgggcggtggaaaccattaaccgcggcgaaattcatattgttgagcccgatctggaccgcgtggtgaaagaggccgttgacggcggcttcctgcgtgccagcacgacgccagtggaagcggatgcgtacctgatcgccgtcccgacgccttttaaaggcgagcacgagcccgatatggtctacgtcgaggcggcagcgaaatccattgcccctgtgctgaagaaaggggcgctggtgatcctggaatcgacctcgccagtgggcgccaccgagcagatggcgcagtggctggccgacgcgcgtcccgatttaagcttcccgcaacaggcgggagagcaggcggatatcaacatcgcctactgtccggagcgagtgctgccgggccaggtcatggttgagctgattaaaaacgatcgcgttattggcggtatgacccccgtctgctcggaacgtgccagcaccctgtacaaaattttcctcgaaggcgaatgcgtagtcaccaactcccgcaccgctgaaatgtgcaagctgacggaaaacagcttccgtgacgtgaatatcgcctttgcgaatgagctgtcgctgatctgcgccgatcaggggattaacgtctgggaattgattcgcctggcgaatcgccatccgcgcgtgaacattcttcagccgggcccgggtgtgggtggacactgtatcgccgtcgatccgtggtttatcgtggcgcagaatccggcgcagcgcgtctga

SEQ ID NO: 73059 - DNA, 422 bp, Glycine max
  Peptide Sequence Number=SeqID_164744
atggtggggtacacaccttcaagctttgcggatttggtcttcgtcggggaaagggtcgaagcggatctgaaaagaggcaaatttaatcatcctgcttggatgaatgagaaaactggggcaaatgaagagggtgagagtgaaggggaaacccatcctgcgactgtcatttctatacaaccaagtttcccaccaacccaacaatgtcattactcagccaataacaacccttctccttacccaccacccagctatccacaaagcaaaaagcctatagaattcaccccaattctggtgtcctatgctaacttgctccattatctacttgatactgcaatggtagccataacccctgctagggccctgaagcataaggtgcaaggtccaattgatgcgggctggctgaaatttgaggagaatcgctt

SEQ ID NO: 73060 - DNA, 186 bp, Glycine max
  Peptide Sequence Number=SeqID_164745
atggcagtagaatcgagaaggaggaagggtgattggagacgccacttcatgaagaagatgagtcaagaacaagtatcaatggcagtagaatggagaaggaggaaagatgattggagatgccactttaaggagaagatgagtcaagaacaagctcaccaccataggaagccatggatgagagcttaa

SEQ ID NO: 73061 - DNA, 269 bp, Glycine max
  Peptide Sequence Number=SeqID_164746
atggcgcataacattccattcccaccccgtcagccctccgcttccacccatctgcccctcacgctgatctcgctggaagattgggcgctggtgacgctgaacgggccggacacggtgaaatatctccagggccaggtgacggcggacatcgacgcgctggcggccgatcaacacgtgctgtgcgcccactgcgacgccaagggcaaaatgtggagcaacctgcgtctgttccaccgtagcgaagcttcgcctatctggaacgccgcagc

SEQ ID NO: 73062 - DNA, 213 bp, Glycine max
  Peptide Sequence Number=SeqID_164747
atggataagagcttgaaggatgaaaagatgagtgaagggagagaaggagcaaaacattttgtgcctcaaaagaggtatgaacttaagtggtacgtagcccatgagcccgaaatctaccataatgctcatgagaaccctagggccttctcttgtatctctggccaaatcttcttggagtcttcaatccaattcttcaatccaattcccttgggg

SEQ ID NO: 73063 - DNA, 1396 bp, Glycine max
  Peptide Sequence Number=SeqID_164748
atgaacttcttcggtctggagatcgccatgattggctatcagggcaccgtgttcccggtgctgctgacggtgtggttcatgagcgtgctggaaaagcggctgcgcaaggtgatccccaacgcgctcgatctgatcctgacgccgttcctgacggtggtcatctcaggctttgtcgccctgctgtttatcggccccgccggccgcgcgttgggcgacggcatctccttcgtgctcagcacgctgattgcccatgcgggctggttcgccgggctgctgttcggcggcctctattccgctatcgtcatcaccggcattcaccacagtttccatgcggtagaggccgggctgctcggcaaccccaatatcggcgtcaacttcctgctgccgatctggtcgatggccaacatcgcgcagggcggcgcttgcctagcggtgtatttcaaaacccgcgacgccaaaatcaaagccatcgcggtgccttcggccttttccgccatgctcggcatcaccgaggcggcgctgttcggcatcaacctgcgcttcgtgaagcctttcctggcggcgctggcgggcggcgcgctcggcggcgcctgggtggtggccaaccacgtcggcatgaacgcggtcggcctaacggcgatccccggcatggcgatcgtgcaggccagttcgctgcttaatcaaacaggcgctgcgggcggtaatgaacggccagccacgcgcgctgcgcgatccgcaccgcccggcctggcatctggcgcccagcgttggcctgctgaacgatcccaacggctttatccagcacaatggcgtttatcacctgttctatcagtggaacccgctgggctgcgatcatcgcaacaagtgctggggacactggcaatcgaccgatttattgcgttgggaacatcagccgatcgccctggcgccgggcgcctgttacgacagccacggctgttactccggctcggcggtggtggcggaagacaaaatcacgctgatctacaccggcaacgtgaaattccccgacggctcgcgcaccgcttaccaatgcctggctcaggaaagcgatcggggcgaataccgcaaactcgggccggtgctgccgctgccggagggctacagcggccacgtacgcgatccgaaagtgtggcgtcatcaggatgcctggatcgcggcaaggtgctgctgctgcgttcctgcgatctgcgcgactggcaagcgctgggggagatcgccggttccggcctgaacgacctgggtgaattcggctacatgtgggagtgcccggacctgttctcgctggacggcgacgacgtgttgatctgctgcccgcaggggctggtgccgcagccggaacgctatctcaaccgttatcaggccggctatctgctcg

SEQ ID NO: 73064 - DNA, 273 bp, Glycine max
  Peptide Sequence Number=SeqID_164749
atggcaagttcaacatgctttcaacaaatcccttcacaaataactatcatgaagctgaaacctagcaaaactacccatcatacctcccaaaacccgatacccacgaaaatcaaagatgcgcttcacgactccgaaaatgccttcctttcgcgatttggagcagaaatgggcaccaaaggttggagctttaatggagtttcaatggaggatgaagaagaaagaaaaagcaacgtgagggagagggagaaagcttctgaaatgtgggctgagtga

SEQ ID NO: 73065 - DNA, 989 bp, Glycine max
  Peptide Sequence Number=SeqID_164750
atgtggcttgtcaagcctccgagcctggacatgtgttgtccaggctacttctgtcaagttgtccgtgatggacgtgtctttggcgtgtcaggaaaggcgattcctcatctaaggatacttattgaggtgactctgatagagagtcctcctccttggagaggggcacaaccttctgcggctactggggagccagtcctggttactgtgatccccccttttgcttttgggggaacgaggagagctaacaacagcgaaaatgtgaggtcgtctccctgcatacgaccttgcgtgagtgctgggtcgccgtcatccacccaggccgttgctggctatgagtgggtgaagctggcgaaccctgaggactcctataagctgacctttcaggcttacgggagtgatgacttcctatgtttgtttgaggtcttgagtgttattttacctttgaatgcttttcaatgtgctctgctggagcacttgaatgtggccccttctgagctctacccaaaaaattgggcaatggccacttgtttaacccttccaaataaaactgtctggcagattggatggctctccttgaacagtgtgttcaagaagctgtttgagtttgattcaaacgtctttcaccgtttcaaggaccatttctttaaggtcttgactactgatgttgtggctaatggaatggcactaatgttcaatagggatgaggagccccgcttcctattctactggcagtctgatccctccaagatcaagtcgtatgacaaggatctgttgacccttgtagcaagcgatcctcttgttgtcttggatggtatgataggtgactttgctcggaggccactcgtgaagcaagtcggacttgtaggtggaactgtgccactatttgttgctgctccgttcattggagaagggggccaacctattggtgaggtttgtcctgttgttgttgctattgaggtcgcacccagcgcagggtgttgtggagcaag

SEQ ID NO: 73066 - DNA, 177 bp, Glycine max
  Peptide Sequence Number=SeqID_164751
atggatgttaaaaatgcttttttaaatggctttatagaagaggaagtttatgtaaaacaacctcaagaaatacattataaagagcttatgaagaagttcaagatggaagactatgcaggagacaaattgaatgaaaaggcacaagtggtggatgccattatattgaaccctgtttga

SEQ ID NO: 73067 - DNA, 1167 bp, Glycine max
  Peptide Sequence Number=SeqID_164752
atgacagagatcacaaacctaagcacagacctcatagagctgatcctgtccctcctcccaatccccatcctaatcagagcctccacagtgtgcaagctatggcactccataatctcctcatcttccttctccaccctctccaaccacctcaaccaaccatggttcttcctccatggcatccacaacatctcctcaaagaacaaccaatcctttgcctttgaccctgcctccaacacctggttcctcctcccaaccccccaacaccagcaccagcaccagcaccaataccaatccaacacctccttcattggcaccaactccttcttcttcatcactgcccccaacttcctctacaccccaattcttcacccctcatggcaccccacccctcccctccacttcccaagaatcaaccctcttctgggtgtcttccatgatgctaaagatcacacctttagccaccccaagttcattgttgttggtggggtcaagttcattgggaaccttgttgacatagaggaccgtttggatgttgaaatctatgaccctcttctggggtcttgggaccttggccctcctctccctcctgatttcagatcaggaaactcttcctcttccctctcctctgctctcttccgagagaaattctatgtctttgggatatactcttgctttgtttcgtcctttgacttgcataaaagggtttggagtgaggtccacacccttaggcctcatcatgggattgtgttctccttcttggtggcttgtaaggagatgcttgtgcttgctggggtgtgcaatttccctcatggatcttcttcctttgtgctgtggaaggttgatgagaggaccatggggtttagccagattgctgtgatgccacatgatttgctctgtagcctttttgatggggatgaggatgataaatttgctagcttgaagtgtgttgggttgggggatttgatatatgttttcaatgaggattaccacaggatgtaccctgcttgtgtgtgtgagattgatggggagagtgggaggtgtgtgtggaggagagtgccccagttgccatcactgatgaacaggtttcacaaagttgttagcttctgttcaactgtttcactgcatagtattctcggtgaacgtcaaccttgtggtcttcagtactag

SEQ ID NO: 73068 - DNA, 213 bp, Glycine max
  Peptide Sequence Number=SeqID_164753
atgaagatcaccattgagaaggttccttgctcggattccaaccctcttgtaatgtcaggagaagaacgtgtaaggaatgctctagtgcaaactctcatggattatctcactcctcaattggataaaaacaacaatattcaactgctaactctacctaaggaggtgatatttgacttcaaacatgggttcctccaaatgattgaaagcaactag

SEQ ID NO: 73069 - DNA, 264 bp, Glycine max
  Peptide Sequence Number=SeqID_164754
atgcctttcaatatatgtatatgtgttgaatatataacatggaaatgcctttcgaaaaaatgtgtgtatatggaagtagggaaatggctccaaagaagcttccagccaagaggtccaggaaagatgccgctggagaaggttccagtgcggccccataggtggacatggagtttgatgggcacaggttccggagtgaggaacaccagcgatgatttgaggccattaaaggctggtcgttcctcaaggagaggcgagtccagctaa

SEQ ID NO: 73070 - DNA, 691 bp, Glycine max
  Peptide Sequence Number=SeqID_164755
atggtagcaagtctgcgtacgacatcgagatgggagcgaattccgcaagagacgagttttgaatgggggccctttgtggttgagcgggtgccctttgctggatgggcactggactggaggggtttccgccacgagccgaaaagcttggttgatgttgggcatattggtaagtgttgtgcggggtttgttggggcttcggccaagcctacttcaatcctctcgcccataaatactaaatctgcgaagctagaggtccctccatcgttgggcatactccttaaaggactcatgctcccgcttgctcatattttgcagttgggttctgttgggagccatgtcagtattgtattggtactgcctaatgaaggcagtaatcaagtccttccatgtgcggatacaagaagcctccaaattggtataccagatgattgtcgccccgaccaaactttcttggaagaaatgcatcaacagtttctcatccctagaggcggggttgaggagctcccgcggtattgggtcaaggcatatagcattaaatgctggtccctcagtggtgaaagtgaggtatgggtagaagtcaccttgagcatgctcctgaggttcttcacgggcgcccctaataggctggggttgctgaccctcaaaggtaacgggaacggcgtgattagcgttctcattgggcatgtgcatg

SEQ ID NO: 73071 - DNA, 624 bp, Glycine max
  Peptide Sequence Number=SeqID_164756
atgggcataaatgccacaattttaatgtgtcttagagatattaggcacaacaaattcaaagattccttaataggaatggtagaaacaaacttaggacaaggtccagtctatttcaattgttacccaaacaaaataatgagtctaatggatagaaacattcttgactctctgttcctaaacatccactttcatggacttgacatgaaagaaagaaaaatcccaacagcattgatatataggattcagtacaaggtcataaacacttgtgcatcaagagtccttctaaaaccacaaagaggagagacaactttgttcatcacttatatgacaaaggtcaatgtttctctcccaagaaccataaaatgggatgaggtaactcttcctgaaaaatgggtcatggacaaggccacaccgttagttcctcgacccgctccaaccatagaacaaattaagcaagataactccggtaagagaatgaacctcaaaggagatggttttttcaacattttaagggttcaaatagaaaacaaatccaagacaaattttaagaatttgtcgaaagagtcaagatcaacgtccttttctttgattggtttcatgcctataccatcagagaaaacctag

SEQ ID NO: 73072 - DNA, 1209 bp, Glycine max
  Peptide Sequence Number=SeqID_164757
atggtgggtgagaaggtgaatctgcctaaagtcattttctactactggatgcaaggcttcaaagacaaattcaaccccaaaatgaagaagaaccttgtcccttatgagtatgctcaaaagcatataaagagaaaggtcaagaaggaccccaggctaagaagaagtctatggtcgaagcccacaaaaaggccaaagttggatgagactctggaaaggaagcaggctttggagttggaagaaggtgtccttacttctgtgaaagctctattagctaaagagcataagaggaagttgactaaagatgcaaagattgctaacttggaacaatttgaacaagagatgaagaaaacaaagatgaatgaactagaaagagtccaacctttagtagaacatgcaactgaaatcatgtctcctgatgttgctcaaagacaggcagagaaaaaaaccatcattgttcctaaagacatggatcttgtagagaaggaagctcttgaagaggccattcttaagtatattattgaagcatctcttagagaatcaaaagatgacattgttgaaacaaaccctagaattgcaccagttcgaccaaggccaatgtctgatgttgatgaacaacttattgatgctaatcagtctaatataatagatgtcgacaaacttagacgcttagaggagatatgcaaagttccaaaatctgtctccatagagacttacaacagagtctggaaggagaaaggtgaagttggttctcatattcttcatccagaaatgcaagatgtagagcttgacaagcttagaaaggtatatcctcctagcgctactgtctacaaatgtaggaagcttaaccctttgagttgcccttctatacttccttggatcttcaagaattcatgggtcttatttgtgccctcaatgttgttcttccttgggatcacactacgcaaaaagctactgattgaagaagatgaagatgatccaccaaccagatatgtcaaggcttgtcctagaagacttttcaaacatgagcttgaagctctgaagcaaaagaccaagcttgagagtctagattggtctgccataaaaaggatctatagactcaaggcttattgctctgaaactcccttcaacgtggtctaccctaggacaagggagttctttgttgtgtctgaatcacacattctcttttgtggtgttcttgccatgaagtga

SEQ ID NO: 73073 - DNA, 159 bp, Glycine max
  Peptide Sequence Number=SeqID_164758
atgaagagatacggtgaatttcaaagaggggcgtgggagaggtggaatggatcaagagaaggctctgaatttgatgaagtggaagatgttgtcatgattaacatggctaaaggaggaggtgccaaagtaatggtctcaaatggaggggtgcatatgtaa

SEQ ID NO: 73074 - DNA, 48 bp, Glycine max
  Peptide Sequence Number=SeqID_164759
atgaggtggtcatggcggcaacgggagaagtcaacagagaagatgtga

SEQ ID NO: 73075 - DNA, 192 bp, Glycine max
  Peptide Sequence Number=SeqID_164760
atgaggattctgctccgattaaaatgttcctctcattgtggtggttcagcaacaagcaacaccagctcgtggtggccaccaatgatcatgggtgatggacgaggaggtgttagggcttggatctcgcttagtgagctcgtctcgctaagtgggagttcacttttggcgctaagcgtgacttttcacgcttag

SEQ ID NO: 73076 - DNA, 723 bp, Glycine max
  Peptide Sequence Number=SeqID_164761
atggattgtggcagtgcatctaagagaataatgggagctgtaggtgtgcctgttgtgcttggatatcatgggaggattgatgtgatggagttcatgcttgaaatcgtatgtgacatcaagaataacaaaagaaagccaaatgaggactctcacatgacactcggattaagaagtggttacaaaagcttacttggtcatctaagaaatgatgttcctgtggccgagcatccttcctgcaaatgctacttgtctttgaccgttgaaattcttggcttgttgaaagacagtgttgagttccattcttacgatgcaattgatgacattttgattagagggtttaaatggagcaagttacttgatcctgacaagaagggccaatggtggttgtctggggatgtggcttcttcaacaggtaatgttgaagaagttgccaacagaatagacaaggatgttcatgaaacccaaagaatgcttcagctcgccgctgctcaaaagatgaacacaaatgcccgaagggaaatcttttgtataataatgagtggggaggactatcttgatgcatttgagaagcttctaagattggagttaccaggcaagcaggacagagatatcatgtgggttcttgtggagtgttgcttgcaagagaaagtttttaacaagtattatacagtgttggcttccaagttatgcgagcatgacaaaaatcacaagcttactctatag

SEQ ID NO: 73077 - DNA, 210 bp, Glycine max
  Peptide Sequence Number=SeqID_164762
atggctgataatgatggagttagactgtggggtctaaaaatcacggctcaatttcgcacttacggtggcggcaatggaggttcacggtggctgaaggaggagggtagccatgtcagtaatgtatcaggaataactagaggagatcaagaagccaatcccattaattgtcgtgcaattattgctgagcatgccgtttttcaaaatccataa

SEQ ID NO: 73078 - DNA, 336 bp, Glycine max
  Peptide Sequence Number=SeqID_164763
atggcctatcttgaacgcatcatggaggatttttccaagagatatggtggaggaaaagctacaacagccactgctaaaagcttaaacaaagaatttggatccaagttgaaggaacatatgcagtattgtgtggaacacccagaagaggttagcaaacttgcaaaagtgaaagctcaggtttcagaagtccaacaagttatgagggcaaacattgatcaggttcttgatcgtcaagtgaagattgacgttttagtgggtcaaactgaggaccttcgcaatcaggtaaatattcgttcgttatgtgaagggttttgtttgcctaatactaccgattga

SEQ ID NO: 73079 - DNA, 297 bp, Glycine max
  Peptide Sequence Number=SeqID_164764
atgggtgatcaagccacaagcatgcatacaataagcatagatagaagcagtgaacacgaagcttcttttacattgaagatgaggaatcaagagaaattgcttgcttacaaaggagtagggatgtctcctccacctctaggaatctcacaatctctcaaaaactcactaatctccctaaaagatgaaaacttggccccttgctctgctctacgctctctgaaattcacactcttcaagcctctatgtggtgaacagttctctcttggctcccttcaattctgtgcaaatcaggcttaa

SEQ ID NO: 73080 - DNA, 717 bp, Glycine max
  Peptide Sequence Number=SeqID_164765
atgaaattatctcacgaggagtatggaagtgctgatttttgtgagtgcatcttcaataatgggttgaggttggcaggtgaactcaacaaacaaaggttcaacaacattgacctgggggccaagatgagcataaagtttagcaaccattccttgtcctggagcccaagggttctaatcaggaaagaatggacgctctttgagagcatgaaacctttcccaagtagttactattgctcttctcatagaagctttgcggtacttgtgcaagttaaagacaaaccgagagtgaaaagaaggaatatcatggatgaggcattgatagaactcgttatcccccttttgcctcaagaagcacatatgcctatcattgaatctataaatcttggtggatacaaaacgagagttttcatacatgtctttaaaataaaagagaatgatgtcgttttgattgaactcaacgtttggcttaagagaaaccgtcttcttagtagcatccctggtgaagttcatgttccaactatatggaaatgggcgcaaggcaacatagtcctttgggcttggatgaggcatgggtttgctatgaggaggaaccttacctttcttctttctgaggtccaatggaggcaacctcagagcaattcaatctggcatgaacttgatggttgtggttggtctgatgtgaatgtcaggaggatatcttggccactgatcagttaa

SEQ ID NO: 73081 - DNA, 186 bp, Glycine max
  Peptide Sequence Number=SeqID_164766
atgggttatctcttggagaatcttgaacacaagggtgaggatcctaagcttgtaggcctaggatcttcttcatcaatgaattcctttgcttcttggaagatgaatggtagcggaatggagaaggaagagagagaggagatgccacttcaaggagaagatgagtctagaagaagctcaccaccatag

SEQ ID NO: 73082 - DNA, 214 bp, Glycine max
  Peptide Sequence Number=SeqID_164767
atgggaagagtctttacccttagtagtgctgaagcttcaaaatccaaaggtctaatccaagaagatgctcaagtatacatgaccttgtctaacctggaagtagagacaaaggtttccatgggtgacctccctgttgttagaaagtttcctgaagtgttccttgaggatatatccaatttaccacttgagagagatagagttttccatagacctg

SEQ ID NO: 73083 - DNA, 243 bp, Glycine max
  Peptide Sequence Number=SeqID_164768
atgggagggactaaagagatatcatcctctttgatatcaaacattgtggcggtagggactaccagcgacaaagtatcatcaaagagaaaaattctagatgaggcttcattgtcatcaagcgagttgaagacccagcatgaccacaaatcaacctccacttcctatgtttccatggaccagggtatagggcccaatagctccccgtgtgtgcaaaggtgtaagtgccatgtgtgcatagaataa

SEQ ID NO: 73084 - DNA, 399 bp, Glycine max
  Peptide Sequence Number=SeqID_164769
atggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccggtgtcattccgctgttatggccgcgtttgtctcattccacgcctgacactcagttccggtccgaccgctgcgccttatccggtaactatcgtcttgagtccaacccggaaagacatgcaaaagcaccactggcagcagccactggtaattgatttagagagttag

SEQ ID NO: 73085 - DNA, 448 bp, Glycine max
  Peptide Sequence Number=SeqID_164770
atgaaaaaattctctgttagaaatcacaaagttaaacgattcagcaagccgaataccgccaaacccgccgcgccgaaagggccgcgccgaattgtgttattcaacaagcccttcgacgtgctgccgcagttcaccgacgaagccggccgcgccacgctgaaagagtacatccccttccccgacgtttacgccgccgggcgtctggatcgcgacagcgaagggctgctggtgctgaccaacgacggccagctgcaggcgcagctcacccagccgggcaagcgcaccggcaaaatctattatgtgcaggtcgagggcgcgccgcaggagagcgatctggcgccattgcgcagcggcgtcacgctgaaagacggccccacgctgcccgccggggtggagttggtggccgagccgcagtggctgtggccacgcaacccgccgatccgcgaac

SEQ ID NO: 73086 - DNA, 1182 bp, Glycine max
  Peptide Sequence Number=SeqID_164771
atgacaacgaatgccgcggatcatgccacaaaatcgaggctaaacccagcgtctaatacgcccgagacgaggcggaggcgccgtacggcgcagaactgcgcagacaggcggcgaaaatcgccggcgcggcggcgcgaacttattgttgcggcggcaaataaagtgcggcggctgcatctatactgccaacgtgagccctcaaataaagatcttcatatgcacgtaaaaaacaagcagccgctgccggcggtaacgctggcggccatcggcgtggtgtacggcgatatcggcaccagcccgctgtataccctgcgcgaatgcctgacggcggaggagggcatcaccatgacgccggcctcaatctacggctttttgtcgctgattttctggctgctgacgctggtggtgtccattaaatacatttgtttcgtgatgcgcgccgacaacgacggcgagggcgggatcctgacgctgatgtcgctggcgatccgcaggctggatgcgcgctgggtgccggcggcggtgctgatcgggctggtgggcggcagcttcttttacggcgacggggtgatcaccccggccatttcggtgctttcggccatcgaggggctgcagattatcgcccccgaactggacagctttatcgtgccgctgtcgctgctggtgctgaccgcgttgttcgcgatacaaaagcgcggcaccggcagcgtcggcaaactgttcgccccggcgatggttatctggttcctgacgctcgcgctgctgggcatcggcggcattctgcagcaccctggcgtgctgcgggcgctgaacccttactggacggtgaatttcttcctcgaatacaagacggtgtcgttttttgcgctgggcatggtggtgctgtcggtcaccggcgccgaagcgctgtacgccgatatgggccacttcgggggcgctgctgctgaccaatccggcggcgatcaacaacccgttcttcctgctggcgccgacctgggcgctgatcccgctgctggtgatcgccacgctggcgacagtgatcgcctcgcaggcggtaatctccggcgtattctcgctgacgcggcaggcggtgcggctgggctacctgccgccgatgcgcatcatctatacctccgatcaggagtccgggcagatctacattccggtggtgaactggctgct

SEQ ID NO: 73087 - DNA, 475 bp, Glycine max
  Peptide Sequence Number=SeqID_164772
cgctgacggcaacgttagggagtccgaagacgtcgcggggcccggaaagagttatcttttctgtttaacagcctgcccacctggaaacggctcagccggagcctctggtcgatggaacaatgtaggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactgtgctctgaatgtcaaagtgaagaaattcaaccaagcgcgggtaaacggcgggagtaactatgactctcttaagcgaaaccacagccaagggaacgggcttggcggaatcagcggggaaagaagaccctgttga

SEQ ID NO: 73088 - DNA, 504 bp, Glycine max
  Peptide Sequence Number=SeqID_164773
atggttacgagcccagaatgggttaaggcaaggacaacggcaaccagcctgataagtgccaaaggaaaccatgggaagtttgggttaggctataaacccacacaagcgtacataaggaaaagcgttgcgggaaggaagagcggaagtccaggctcgcgattaagacaagaagaagaagggggcccgccctgccacataagtaggagctttataagcgcggatctaggacacgaaggccaagtcgttgcaatatgcgaagatgattctccgagtggatcggatttggtaagaccatgccctcctggtttccgactaggaaattggcaagtggaggagcgcccgaatatttacgcgacaagcataatatccgatgacaagtccctcgaaggtactaatacctgggacccgaccatcgatttcgagcaagaaacaaatcagacggaggatgaagaggacgaggatgtggggacttcccccagaattggagaagatagtcgcccatga

SEQ ID NO: 73089 - DNA, 255 bp, Glycine max
  Peptide Sequence Number=SeqID_164774
atgaggattcataagctgttaatcgcatttcttctagctccaacatttggatccttctgtgctccttggatgccttctcatcaaagttcaaaaatttcagagcccaatatgccttgtgttccatttcaaccggggatgctactctatgattcacatggtattgacctaataccttttgaagctgagtattacagaagtgtgaccaccatcactgatcatattcgagtacccaatcgagaaaaattgttcttctga

SEQ ID NO: 73090 - DNA, 264 bp, Glycine max
  Peptide Sequence Number=SeqID_164775
atggagaagaggttcagggaggcagtggaaagcaaggggttagaagctgaagtaaaggacatggattgggagagcacattcttcttgcgccatctcccagactccaatatctctaaaatccctgatctcagccaagagtaccaggatgcaatggaggaatttacacagaaattggagaagcttgttgaggaggtgttaaacttgatatgtgaaaatcttgcattagagaaatggtacctgaagaatgcattttatggatcatag

SEQ ID NO: 73091 - DNA, 447 bp, Glycine max
  Peptide Sequence Number=SeqID_164776
atggacatgaatgttagagccctcatctttggacagatcactcttatggctcagtccaactcctcgaggctcggatttctagccctcatcatttccttttgcatggcccaaggagtcacctcagattccttgacttttgagtccctcagcccagccattaacttggcttacataaagaagaactgctggaaattggacgaccccacggtcagctttcaccagggtcaatacctgagtttacatagtttggctcagcatcagccaattatgagcatggaggagttttctttgcaggtggcctggctaggagtccaaccttcttctcatggaagaggtgaggcctccgtagctcaggagcctcaactagatccaaagactacacctgctgctcaggaggatgatttagaggccactccccagagtcatttgtaccagaaactgatctag

SEQ ID NO: 73092 - DNA, 562 bp, Glycine max
  Peptide Sequence Number=SeqID_164777
atggcgcgcagagacaaaaattggtcattctgcaccctttgtcatccagaggcgaggggcccgatgacatgcggagacaaaatttggtcattccgcacccctttgccattcagacacagtcgtgtccgatggccgcagagacaaaatttggtcattctgcaccctttgtcatccagaggcggcgggcccgatgacagggagacaaaagtcttcaccctttcctgtgcggagacaaaatttggtcattccgcacccctttgtcattcagacacagtcgtgtccgatggcgcgcagagacaaaaattggtcattctgcaccctttgtcatccagaggcggcgggcccgatgacatgcggagacaaaatttggtcattccgcacccctttgccattcagacacagtcgtgtccgatggcgcgcagagacaaaatttggtcattctgcaccctttgtcatccagaggcggcgggcctgatgacatgcggagacaaaatttggtcattctgcacccctttgccattgagacacagtcgtgtccgatggcgcgcagagacaaaatttg

SEQ ID NO: 73093 - DNA, 514 bp, Glycine max
  Peptide Sequence Number=SeqID_164778
gattctatcttcatgcgaaggatgtccaaatgttctcttgatgggaacaaggggttgtattaattataatcccgtcctcgccataagacaacttggctaccccatgagagaagtgccatcagacgaaagcatcacgcctttcatcgcacggggtttcagtgaccacaacgtgagggtactccaaggagttcgcaaggcatgggatgcggcgtgtagaaaggacaaagagcttaggggaagcagtaataggagcatcggcgactatcataagtggctgagagtccggacacaaggattggattggctcccaaatctaaagactatgagagatgatggggttaaagcttcagaagaaagtgatgaggtacaagccctaaaggcagagcttgaaagagcccgggtagtcaaagagaagttcaaggcagcaatagtgagctcaagctccgaagaggtgaaaggaatcatcacgggtcaaaggcatgatcttgaaggacgagctaaaggcttgccttag

SEQ ID NO: 73094 - DNA, 294 bp, Glycine max
  Peptide Sequence Number=SeqID_164779
atgatggcacatcaccttgcaagcggaaaaatcagtaaggaagcaaaaacaaagtggaaaaatcagtacacaacgacatggccaaagaaggttggacagcaagacacgtgggagaaccaacagaggaaaaaatggaggggcaaaaagaccaaaaaatcgggaaaagtgccaggtgtcaacatttcaagtatgggagggcatcgcaagacgctacattggccagccaactgtaggtcacagatcgaggcgaaggcgacggacagacgatcattgaagcttgtttattttggataa

SEQ ID NO: 73095 - DNA, 264 bp, Glycine max
  Peptide Sequence Number=SeqID_164780
atgaagacaataaccagttctttccaaggcatgtctaatcaagctgcaccttggtgggttgaaccaaagagtcatgtccaaactggagcgtacgagtgcggatattatgtcatgcattggatgtggtgcataatgactggtggattgaaggatgactggaacaagtggttttctgatggatcaccgttagacgtggaggccatcaccacacttcgccaaaaatgggcaacattctttttaagtattaggaaaagcggatgctaa

SEQ ID NO: 73096 - DNA, 636 bp, Glycine max
  Peptide Sequence Number=SeqID_164781
atgatgattctgcgcgttctgtttggcatggcggaaggtccgatttgcgcctcggctaacaaagccatcaacggctggttcccgaaaaagcaggccgccaccgccatgggcctgctgagtgccggttccccgctcggcggcgcggtcgccgggccgattgtcggctacctggcgctctccttcggctggcgtccggcgtttgtggtgatctgcctgattggtctggtgtggatggcgctgtggttcttcttcgccgccgacaatccggcgcgcagtaagcgcgtctcagcgcaggagcgcgcgctggtagagaaactgaaagcggaagagccggcggatatcatcgacgcggacggcaaagcgcacggcatgggctactatctgcgtcagccgattatcctcgtcaccgccttcgccttcttctgctacaactacattctgttcttcttcctgagctggttcccggcctatctggggcaggcgcacgggctggatatcaaagccatgagcatcactaccatgatccccgtggattgtcggcttcgttggcctggcgctgggcggctgggatttccgataaaattctttaatattaccgggaagcctgcggctaatcacgcaagattggtgctggga

SEQ ID NO: 73097 - DNA, 201 bp, Glycine max
  Peptide Sequence Number=SeqID_164782
atggagaaagctccaaggattgacccgctctacaaccctaattcatcgtcattggggctattctctcgaaagaagagtgtgatagaagcatatccgtttcagcctagggatcagcctatcaaacaaacaaaaagctggttttcgagcggaatggttttgaccttgaaagtctttaggcttcgacctgccaaatcagcctag

SEQ ID NO: 73098 - DNA, 228 bp, Glycine max
  Peptide Sequence Number=SeqID_164783
atgaagcttgagatgtccctaaagataaaagaagaggtgaagaaacagtttgatgcaagttttttggctgttgctcggtacctagagtgggttgccaacttcgtgccgatccccaaaaacctgtttttccctattttctttcatggatgggttttcagggtgatgtcgtttgggctaaaaaaatgctggggcaacataccagcgggccatggtggcattgttccatga

SEQ ID NO: 73099 - DNA, 270 bp, Glycine max
  Peptide Sequence Number=SeqID_164784
atggagaaaaatgaagaaacaacaatggaggagaaggtaaagctggaaattagtggaggtccttcaatggtgattttccaccatggagatgcagcggaagataaaggagaagaggtgagaggaggcgccatctactatgatgcaagctccattggagcttgtaggcctaggatcttcttcatcaatggattcctttgcttcttggaagataaatggcagcggaatggagaaggaagagagagaggagacgccacttcaaggagaagatga

SEQ ID NO: 73100 - DNA, 801 bp, Glycine max
  Peptide Sequence Number=SeqID_164785
atgggcgccatcaagtacatgaccacggatgaattaaagctcctaagcatcccgtcagaaatggttaaattctttaaccactctattttcccacataagggacatccgacaaggaaaatcagcatgcaacagggacagacatatattctcatagctaggttccctgaccctaactacggtgtcaaaacggtaaattttataataaactcccctcacctatcgattttccaaaggaagcgtaaaaacatacaatggtggttccaaagtaagaaaagatgcaaagacgagttgaatctaacaaggaacaagcgtagaatcacggttacctcgaagaaaaccatgaaggtcagattgggcttcattctctaccgaaaccacgagacaagtttagaagatttcgctccgattgaagggttcctctcggtgtggggtttcaacggagatctacggcggtttttggatgtcattcggctaagttttttctctcaacccgatggcccattgatgggatatggttcctttaagtcctcaccactagttcaaggtataaaagatggaatatatcttggtccaccaccaaaagaaaagcttcccaagaattctccacaaggatctcttttgctaggggaaatttcatatgggaagctatcctttgctaatcaaggagagaataaaactgcagaaatcctgatgcaaccttcgtttgactgcttcgaggtacttaacacccctcgtcaggcaatccgtgaagttccacgacattccggaagtcaaaaagaagcattgctgcgcaatccgtaa

SEQ ID NO: 73101 - DNA, 709 bp, Glycine max
  Peptide Sequence Number=SeqID_164786
atctcgtcttttccggtttttccgacgttttcctcaaataaacgttggtggcgactccgcgcgtattcctttcgtggaacacgcatcccgcgagtctcgcgtcgccctcccgccgaaggctaagcgagcttctctcgctaagctccgaatacttagtggaatttttgaagagttggtgtcgctaagcgcagcctttaaggagcttagtgcatatccttgcggcagaggccagctaaacggaccatgtcacgctaagcggccaatggcttctaggaaacataaaagtattggttcaagacccacaacgcagtatgacacaaggagattctcttccttagatgcttggaccagatacaccgataatgttctagggagaaacattttaccagagaggaaagtaaagatatatcattatgagctagatgaatttaaggctgaattggagaggcataatttccataaatgcctcaccaatttagccgatgggagcatagacctagctttggtgaaagaattcaatgcaaatttatatagttctgaggatcatccaccaaagcaatctagagtcagaggtcatttggtgaagattgatgctaacagtctcaacacattcttggagacacctgcggtattagctgaaggggagaccttatccgcttactccagatattgcaggttgcctacagactacagagagatagaggctgcc

SEQ ID NO: 73102 - DNA, 273 bp, Glycine max
  Peptide Sequence Number=SeqID_164787
atgccatggatgctcgtttcgatgggatgtgtcgcaacctacccttcggcgagagggcgacgcgagactcacgggatgcgtgttccacgaaaggaatacgcgcggagtcgccaccaacgtttatttgaggaaaacgtcggaaaaactggaaaagacacgatctacgaacttttaagtgaaaggttcgggagttgtatttacgcacggggaagggtgtttccctttgctcctacgtattcctcaatttgcgatgaggaaatcagacctacgtag

SEQ ID NO: 73103 - DNA, 783 bp, Glycine max
  Peptide Sequence Number=SeqID_164788
atgcagtttggtacagatgatgagggtggtgtttctcaatcacagtctacccagaattgccaacataagtttttgcataatgctcaaatagtgagctttggtgaaataaagactctgcgacaggattgttactgtttgactgtgggcactgtcgatgaagtgatgattgatacaccatggagttatgacagttgtccatactgtacaatcacttttgatccattaaaaataggtgtcgcctgccgttcgtgccagaatcatgttactcacactattccaaggtataagttagttgtcaagatggaacagaatggggagaaggcgaacttccatttttgggatgcagtatgtatcaaaatatttggtaaaaatgcagatgaatgtcgtcaagagttgattgcgagtggtgatgagatcaaggtgttccctgcgtgtgttgatcaattgttgggtaaaacttgggttgtgagattcaaacaccgtatacagatgcaccaatcatccgtgttggattttagtgaacaggaacatcatatacagtcagtgatattcacgctaggtctacaggatgaacaatgtttaagcaacaagtcagctgctgttggtgctgcatcttcatcacaacaagattaccatcctacatcatctgaatatgatcctggaaatgctgcctttgtaactcctgcaaaaagaacatccgatcagcaaggaagtagtcagtttgatagtgacaacttcacagcatatgagctatcgaccaacaagcatataaaagctgagtaa

SEQ ID NO: 73104 - DNA, 3234 bp, Glycine max
  Peptide Sequence Number=SeqID_164789
atggatcctgaggtgcagcaatcgcaggtcgccgccattcttggcgccgatccctcccccttccagacactgatctcgcacctcatgtcctcctccaacgagcaacgctcccacgcagagactcttttcaacctctgcaagcaaaccgatcccgataacctctccttaaagcttgcacatctccttcactcctcgccgcaccaggaggcacgggccatgtccgccatcctcctccggaaacagctcacccgcgacgactcttacctctggccgcgcctctcccctcagacgcagtcttccctcaaatcgctcctcctctcctcgattcaatcggaaaacatcaaatccatctccaagaagctctgcgacaccatctctgaactcgcctctggtattttacccgacaacgcctggccggagcttcttcctttcatgttccagtgtgtttcctccgattcccctaagcttcaggaatccgcgtttttaatcttcgcgcagttgtcgcagtacatcggcgattccctcactcctcacatcaagcacctccacgatatctttttacagtgcctcacgaacgctaccgttaaccctgacgtccgaattgcggcgcttaacgccgttatcaatttcatccagtgcttatccggttccgccgatcgcgaccgcttccaggacctgctgcccgcgatgatgcggacgttgaccgaggcgcttaattccggccaggaggccaccgctcaggaggcgctcgagcttctcatcgagctcgccgggaccgagccgaggtttctgcggaggcagcttgtggatgtcgttggtgctatgttgcagattgctgaggccgagtcgcttgaggaagggactcggcatttggcgattgagtttgtgattaccctcgcggaggcgagggagcgcgcccccgggatgatgaggaagttgccgcagtttattagtaggttgttcaccatactcatgaaaatgcttcttgatatcgaggatgatcctgcgtggcacagtgctgagactgaggatgaggatgctggtgaaaccagtaattatagtgtgggacaagagtgcttggataggctctctatatctttgggtggaaacaccattgttcctgttgcgtctgaacagttgcctgcttacttggctgctcccgaatggcagaaacgccatgctgcacttattgcacttgctcagatagctgagggctgctcaaaggtcatgataaagaatttggagcaagtggtggctatggtcctgacttccttccctgaccaacacccccgtgtaaggtgggcagctattaatgcaattgggcagctgtctactgatttgggtcctgatttgcaagttaaatatcatcaaggagtgttgccagcactagctggtgccatggatgattttcagaaccctcgtgtgcaggcacatgctgcttcagcagttctcaacttcagcgagaactgcacacctgatatcttaacgccatacttggatggaatagttagcaaactacttgtacttcttcagaatggtaagcagatggtgcaagaaggtgccttaactgctttggcatcagttgctgattcttctcaggaacacttccaaaaatattatgatgctgtaatgccatatctgaaagctatattggttaatgcaaccgacaagtctaaccgtatgcttcgtgctaagtccatggagtgtataagtttagttggaatggctgttgggaaggagaagtttagggctgatgctaagcaggttatggaagttcttatgtcccttcaagtatctcaaatggagacagatgatccaacaacaagttacatgctacaggcatgggctagactctgcaaatgtctgggacaagattttcttccttacatggagtttgtcatgcctccactacttcaatctgctgcacttaagcccgatgtaaccattacatcagcagattcagacaatgatattgaggattctgatgatgaaagtatggagactattactcttggggacaagcgaattggaatcaagactagtgttctagaggaaaaagctacagcatgtaacatgctttgttgctatgctgatgagctgaaggaaggattctttccatggattgatcaggttgctggaactttagttccactccttaaattttatttccacgaggaggttagaaaagcagctgtttcagcaatgccggagctattacgatctgcaaaattagctattgagaagggacaatctcaaggtcgggacgtaacctatttgaaatttttgactgacagtatcatcccagctttggtggaagcattgcacaaggaacctgacacagagatttgtgcaagcatgttggattcattaaatgaatgcttacagatatctggaatgcttttggacgaaagccaggtcagatccatcgtggatgagataaaacaggtgatcacagctagttcaagtagaaaacgagagagagcagagaggacccaagctgaagattttgatgctgaagagggggacctgattaaagaggaaaatgaacaagaggaagaagtttttgatcaaggaagggacaagactcctgaagagagaagaattgcaatttgtatttttgatgatgttgcagagcagtgtcgtgaagctgctattaagtattatgatacctatctcccattcctgttggaggcttgtaatgatgagactcctgatgtcagacaggcagctgtgtatggtctcggtgtttgtgcagagtttggtggatctgtgttcaaacctctggttggagaggctcttttgaggttaaatgctgtgatccagcatcctaatgctcttcattcagataatgtaatggcatatgacaatgccgtttccgctctgggaaaaatttgccaatttcatcgtgacagtattgattctgcccaggtagttcctgcatggctaaactgtttgccaatcaaaggtgatttgattgaggccaaagttgtgcatgatcaactttgttcaatggctgagagatctgacagtgagctgttgggtccaaacaatcaataccttccaaaaatagtttcagtgtttgctgaggaccttgcaacagaacagacagctggtcgtatggttaatttactcagacagctccagcaaactttaccaccctctacacttgcttctacttggtcatctttgcagccccagcaacagcttgcattgcaatctatcctttcttcatag

SEQ ID NO: 73105 - DNA, 1595 bp, Glycine max
  Peptide Sequence Number=SeqID_164790
atgatggatgaaaggaagttgaacattgatgctcctcttatgtcggtgaggcgctcttttggtatatcaccatctttaactgaagcaaataaaaagatattagagaagccacaaacacttccacactacaaatcagacaccgctttggatcaggtaacagaacctgttgcagtgcctttcaattgggagcatatccctggaagaccaaaggattatgatggatcagaacctcaacctcctacacaggcttcaattaccccaaccgccccaactctcccccctggaaaatccacaaatgttgccaaacagtcattggaaaaggaacctaatgttgcaaataactttaggccctcaagcatatcaaattctttaagggaaaaaatagattgtgacaaagaacacaaagatgagaaaataaataaggtggaagagaatgatgactatgatgatgatagtgatatttattctgatgcccttgaaacactgtcacctacagagcccatgtctatgaactgtagtttgagtggtgtgagtggcttagataatgtggatgaaaataggtgcggaacctcttctactgataaacaagctcatgatttcatgatgagcaggtttttaaatgcagcaaaggctatgactatacaacctcctcaatatgcttcttttagaaagcaacaacctgttctggcagaacaacctagggaatttatcaaattggttcctgagcaaaagaagtcctttgttaatagacatatcactgacattgtaccatatactggtcaatgccaagaggaggaggaggaagaagaagaaagtgacgatgaaactaatgattatgcaaataattcagctaaaggttgcggattgtttccacgcttatgtgttagaaactcattgtgcttactaaatccagtgcctgggacgaaaatggggaatcagtttcccttgtattctgcctatgaggttgtaaaacctgataaaagttctcatattcgttctcatagaccagctccagctataaagaaggcttgggatgctattaataagagcaagttaagctctagctctcgagctgcatcaccagacaagaaagatgtgaggaaaaaatggactagtgaatcaagcaggtataactactcaggtgaattgaagcagctaggtaggctctctccctttcgtcgttcaagagctgcttctgctggagtatctccttttcgaagtaaacctcaacctccctttcctggagcaaagttgcttggtgattccgaacaagctgataataatcattctggcaaattgaaattcccgaatagaggacatgcaagtattcaagaggtgctatcacaaggagccaaaaaaagctatagctttgggagcctttctgttgaaaagacattgtacatagatactgcaagcacagtaaaatcatcatgctctagttcacgttctttaggtagcacaatagtggtaggaaaagacagaaattcccttgtagattcttttcgagatatgaagcacctagaagctttggaggagaatttggattctcaagtgttgaattctgtggatgccaattctccaactttgtctagcat

SEQ ID NO: 73106 - DNA, 546 bp, Glycine max
  Peptide Sequence Number=SeqID_164791
atggcaagaatccaagacacatcactccattcaccacctataaataccctgcctgagttaagtactcacaaatcacaatatatatcattcacattcactaaagaggaagatgaagccaagagaacctcccttgccaagagtaccgttctacgcttatacaagctaaagctcgcactggaaactgtcaaaagacagtatgaaaacctattagccaccagaagagagtgcgttaggctattgaaccatgtcaaagagagcaaggatgtgaaaatagagaaggtaggggcaggaacttttatggtgagggtcacatgtgagaaaggaggtgacaatctggtggctatattaaaggcatttgatgagatgtgcctggatgttcagcaagcgagagtttcatgtgaaaatggtttttttctggaagccattgctgtggctgaggaccaaacgctggatgtaagagatatcactgaagtgcttctaaaagcaattggaaagcagagtggtgaaaaggactcgcagatgtttgacaaatgctgtgattcgtga

SEQ ID NO: 73107 - DNA, 1059 bp, Glycine max
  Peptide Sequence Number=SeqID_164792
atggcctccaccaaggaacgcgaaaactttgtctacaccgccaagctcgccgaacaagccgaacgctatgaagaaatggtggaagcaatgaagaatgtggcgaagctgaacgtggaattgacggtcgaggagcggaaccttctgtcggtagggtacaagaacgtggtgggtgctcgtagggcttcgtggaggattctatcgtcgattgaacagaaagaagaagctaaagggaacgatgtgagtgtgaagaggataaaggagtataggcagaaggtggagtctgagttgtccaatatctgcagtgatatcatgactgttattgatgaacaccttattccctctagctctgctggtgaacctagtgtctttttctacaaaatgaagggggactattaccggtacctcgcggagttcaagtccggtgatgagagaaaagaggctgctgatcattccatgaaggcgtatcagtcggcttccactactgcagaggctgagttaccacccacacatcccatccgtttgggcctggctttgaacttctctgtcttttattatgaaattttgaactctcctgaaagggcctgtcaccttgctaagcaggcatttgatgaagccatctctgagttggatactctgagcgaggagtcttacaaagacagcaccctaattatgcagcttctgagggacaatctcaccctgtggacttctgacatccctgaagaaggagaaaaaactaaaagggtttccaaaataaaaattgcaaaagcatgcataccatgcagcacacattccagtattggacattgttacagactacagtggcctgaaggccataccactgctttagtatttttagggtcagctgaggaacaaaaggtggattctgccagagctgctggaggtgcaactgtacgcgtggagtgcaaggaagctgtgacgagagagtgtaagctggggaagagcagcaaggctgattgcggagatgttgacagtgagcagctggtatcggcatcgtgtccccactcttgccttcttcatgaaggagttaacttaaaataa

SEQ ID NO: 73108 - DNA, 585 bp, Glycine max
  Peptide Sequence Number=SeqID_164793
atgtggctttcttcaaaagcttactacagtccaattgttgaattgtgtggaggcactgagctcgcatctagctacattgcaggaagtcccttgcagcctcaagcttttggagcatttagcacagcatcaatgacaactggttttgtcatttttgacgaaaatggagttccttatccagatgatgttgcttgtgttggggaagtgggcttatttcctctctctctgggagcatctgacagattgcttaatgctgaccatgagaagacaagttctgtagaaattgagagtgtctgtgatggagcggatgaatgcattttggtgacagctgcagttggtgttgcaactgcaaatggaggcccagaacaactggttatatttgtagttttaaaggaaggatacaattccagtgcagaaactctaaagatgaaattcactaaagctattcaaagcaaccttaaccctttgcttaaggtaagccttgctaaaattgtgccagagtttcctgggacatcttccaacaaaataccgaggagagtaatgagggatcaaatgaagcgtgagctatcagtccagagcagactttag

SEQ ID NO: 73109 - DNA, 156 bp, Glycine max
  Peptide Sequence Number=SeqID_164794
atgggagaaaagggtgcaggaaaagaagtccctttgtgcgttgaaactgaaggatcaacaatgtttgatgatatgatgcaatgcaatgcaatgcaatgcacgttggtggtgacagataatagattcttctatggagcaaatcagtacccattctaa

SEQ ID NO: 73110 - DNA, 396 bp, Glycine max
  Peptide Sequence Number=SeqID_164795
atggaaaacgaaactagtaagggtgcggcgtggttcgacctgagtgcggggggtggtggtgttggcttgagcggcggaggcagtggtgtagtcagcaacagaggcgacggtggagtcagcggtggtggcgtcggaaatggcggaggtggcgacggagtccgcgacagaggtgtggatggtccattgaagctttgtttggcgtcgagtagtgtgggtggtggtagtggaaggtggaagctctgtatggcgagtggtagccatggaaggcagccatggaagctccatacggtgagtggtagccatggaagttggtatggcatccatggaaggaagccatgggctctcaatgaaagcaccaaatgttacgaaccaagcacaggaacgggaacaacctag

SEQ ID NO: 73111 - DNA, 862 bp, Glycine max
  Peptide Sequence Number=SeqID_164796
tgggattatcggtctgggcatcatgggcgcgccgatggcggaaaagctgctggcgggtgggcacacgctttacgcccacacccggcatcaggtgccggcggcgctgttgcagcaaggggccatcgcctgcggcgatccgcagcaggtggcggatgaggcggacgtgatctttatcatggtgccggatacgcctcaggtggaggaggtactgttcggtgaacgcggctgcgccgccggcaagctgaacggcaaagtggtggtggacatgagctccatttcaccgctggagaccaagcggttcgcgcagcgcatcaaccagctgggcgcccagtacctggacgcgccggtttccggcggcgaagtgggcgccaaacagggcacgctgaccatcatggtgggcggcgaggaagcgaccttcgaacgggtgcagccgctgctggcgctgatgggcaagaacatcacgctgatcggcggcaacggcgacgggcaaacctgcaaggtcgccaaccagatcatcgtggcgctgaccatcgaagcggtctccgaggcgctggtgttcgcctcgcgcgccggcgccgatccggcccgggtgcgcgaagccctgatgggcggtttcgcctcgtcgcgcattctggaggtgcacggcgagcggatgatcaagcgggcgttcgcgccagggttccgcatctcgctgcaccagaaggatcttaatctggcgctgcagggcgcgaaggcgctggcgctcagcctgccgaataccgccacttgccaggagttgttcaacgtctgcgccgccaatggcgacggcgaactggatcactccgcgctggtgcgggcgctggagatcatgggcaaccaccgg

SEQ ID NO: 73112 - DNA, 810 bp, Glycine max
  Peptide Sequence Number=SeqID_164797
atgggaacaggtcatcttcgaagtattttcccttccaatatttttctatggagcttctctgattccttttatgaacataatgatgccaatcgagctttaatgagttctaatatgcaacgtcaagcagttccgctttctcagtccgaaaaatgcattgttggaactggattggaacgccaagtagctttagattcaggggtttccgctatagccgaacacgagggaaacatcatttattaccaatactgcggatatttttatttggttcgccgaggtaaatgtataaaaaagggacaaattttagcggatggtgctgctacagttgacggcgaactcgctttgggaaaaaacgtcttagtagcttatatgccatgggaaggttacaattctgaagatgctgtactcattaatgagcgtctggtctatgaagatatttatacttcttttcacatacggaaatatgaaattcagactcatatgacaagctatggttctgaaagaatcactaataaaattccacatctagaagcccatttactcagaaatttagacaaaaatggaattgtgatcctcgggtcgtgggtagaaacgggtgatattttagtgggtaaattaacacctcaaatggcaaaagaatcctcgtattcccccgaagatagattattacgagctatacttggcattcaggagatattcagaggaacagactgttccagcccgataccgtcaagaatttcttacgattgcatgggaacaggttcatcttcgaagtatttttcccttccaatattttctattgagcttctctga

SEQ ID NO: 73113 - DNA, 645 bp, Glycine max
  Peptide Sequence Number=SeqID_164798
gggagccgacgaccgaagccccggtgaacggcggccgtaactataacggtcctaaggtagcgaaattccttgtcggactcggtgaaatagacatgtctgtgaagatgcggactacctgcacctggacagaaagaccctatgaagcttcactgtttcctgggattggctttgggcttttcctgcgcagcttaggtggagggcaaagaaggcctccttctgggggggccagagccatcagcctcccaaaaggtaacggaggcgtgcaaaggtttcctcgggccagacggagattggccctcgagtgcaaaggcagaagggagcttgactgcaagacccacccgtcgagcagggacgaaactcacatcgacgggaaggtttggcacctcgatgtcggctcttcgccacctggggctgtagtatgttccaagggttgggctgttcgcccattaaagcggtacgtgagctgggttcagaacgtcgtgagacagttcggtccatatccggaccgggaaggacgcacctctggtgtgccagttatcgtgcccacggtaaacgctggagcctccggtagcacagccgagacagcgatgggttctctgccccagcggggatggagcgaaagaagttttgagaattcaagagaag

SEQ ID NO: 73114 - DNA, 180 bp, Glycine max
  Peptide Sequence Number=SeqID_164799
atggagaaagaaggggatggcttagaatctttaactatccatgtttctcatgagaaaaagtacttgtacttgggggcatgtcactcggtttggaacttccttgagactcaggttgatcaccatgggggggggggggagtttcctgtgcacgacagggtgaccttgacacttgctgcctag

SEQ ID NO: 73115 - DNA, 219 bp, Glycine max
  Peptide Sequence Number=SeqID_164800
acttatcaaggtaatccttggggcgtctaccctgacttatcttctttcaccggaagtggcgtctacctgacttatcttccttcaccgaaagtggcgtcgaccctgatttatctttcttcaccggaagtggcgtcatcaaaaacctctactgcctgtatcaaacgatccgctcctactcaagttcacatcactatgcgcctgaattggacatccgagtga

SEQ ID NO: 73116 - DNA, 432 bp, Glycine max
  Peptide Sequence Number=SeqID_164801
atggcttccatgctagaggccatgttaggaatgagacaactcatgaagaaaaacgtggccacaattgccgttattagttcagctgcagaagcagacccaactctcctagctaccgtgcaccatcctcccccaaacgcggtaggacgagaaaggaacagactggggcacaacagcaacccccatttgggatacaactgggtggcttacccttatggattaccgcctaattacacgccaccagtcatgcatgatgatgcggaaagaccacccccgacggccgaagaaagaaggaaactcgatctcctcgaggagagattgaaagttgttgaaggctttggtaactattcgttcacggacatgacagatctttgcttggtaccggctgtcgtcatccccccaaaattcaaagtgcctgatttcgacaagtattaa

SEQ ID NO: 73117 - DNA, 444 bp, Glycine max
  Peptide Sequence Number=SeqID_164802
atggtacatgatgacaatgaaatagttctgcatgcaaacactccaaatgatgaaatcaaggaatatttggattgcagatacatttctccatgtgaatctgcttggaggatctttggttttccaatacatggtagaaaaccttctgtagagaggctacagttccatcttctaggccaacatagcgttctctaccaagaccatgatgatattgatgatatgctctctaacccaagcatttctgaatcaaaatttatagcttggatgaatacaaaccaagtttttgttgaagaggaccaatctcatttgaagatatcagaacagtggatggtgttgaatattctacatatagagaagcatgttttgctatgggttttttacaggatgatagagaattcattgctgcaatctaggaagcaaaagactggggctcaggaccttatctaa

SEQ ID NO: 73118 - DNA, 471 bp, Glycine max
  Peptide Sequence Number=SeqID_164803
atgaccatgattacgccaagctcgaaattaaccctcactaaagggaacaaaagctggtaccgggccccccctcgaggtcgacgatcagatgacagatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 73119 - DNA, 270 bp, Glycine max
  Peptide Sequence Number=SeqID_164804
atggtcggtccgcgaccctggatgcgaaggcgtccttggggtgatctcgtagtctacggggtggagacgatgggggagatagtgcatcaagctgttcgcaaggtttcagttcaccaggttgtctcttgcctgcccgtggattcagcagcagttcgaaaggttgacctatatcgggaatccccggatctacgcttattttgcaactccccgaagcatttcgtcgcttactacgcccttcctcgtctctgggtgcctaggtatccaccataa

SEQ ID NO: 73120 - DNA, 1337 bp, Glycine max
  Peptide Sequence Number=SeqID_164805
tcgtcagtgagagatttgaagcacgagagacgaagaagtccaagctctcaaaagcgagttaggaaaggcaaactcgccaaggagaagttcaagttggctgctacacacgttcggaaggagtgcgccgggttacaggaagagaacgcaattaccgcaagagcccttgaacaagagaccaagagggctcgcaaggaagagtatggccggaacaaatttcgcggagctctatggggtagcaataatgaactcaagttgcgaagggaagaaagggaccagtcacgagcacatagcatggttctgaaagaggagttgattgcttgttcaaggtccaaaagaagcttgtctcagcgtctatgcgagacggagaccaacatgctagctatcatcgccaagtaccaagaagagttaggtctagccgcggcccacgagcataggattgcggacgaatatgcccaagtatacgcggaaaaagaggctagaggaagggtgatcgactctttacaccaagaggcaaccatgtggatggatcggtttgctcttaccttgaacgggagtcaagaacttccccgattgttagccaaggccaaggcgatggcagacacctactccgcccccgaagagattcatgggcttctcggctattggaaaaacaccataactaaacgcgccgcaagggatccctatcgcaccagatccaaatctagaacgatgggtgatcaagaggagacgcaggaacagatgaaagccgacatgtcggctctgaaagaacaaatggcctccatgatggaggccatgttaggtatgaaacagctcatggagaagaacgcggccactgccgccgctgtcagttcggctgccgaagcagacccgactctcttggcaactacgcaccatcctccctcaaacatagtaggacggggaagggacacactggggcacgatggcagccctcacctgggatacaaccgagcggcttacccttatggattgccgcccaactattcaccacccatcttgcaagaagatgcgggccacattgcttctcccgtccatgaaaaagagcctcctcagcagcccgacgaagtccataaagaccctcaagattatgctcggagggatgtcgagttttatcccccgatccccgaagggccggcaccaggcacgttgccccaacccaacatcgcagcatcgccaatagttttgtctatggaagggccgcccccggcaactgaagaaaggaggaagctcgatctccttgaggaaagattgagggctgtggaaggatttggggactatccgtttgcagacatgacggatctttgcttagtacccgatgt

SEQ ID NO: 73121 - DNA, 780 bp, Glycine max
  Peptide Sequence Number=SeqID_164806
atggtaatccgcacacgttttcggcatccagagacgatcgagtccgatggcacacagagacaaattatggtcattctgcaccttttgtcatccagaggcggcgagcccgatgacatgcggagacaacttatggtaatccgcacaccttttcggcatccagagacgatcgagtccgatggcacgcagagacaaattatggtcattctgcaccatttgtcatcaagaggcggcgagcccgaagacatgtggagacaaattatggcaatccgcacaccttttcggcatccagagacgatcgagtccgatggaacgcagagacaaattatggtaatccgcacacgttttcggcatccagagacaatcgagtccggtggcacgcagagacaaattatggtaatccgcccacattttcgccatccagatacgatcgagtccaatggcacgcagacacaaattatggttattctgcaccttttgtcatccagaggcggcgagcccgatgacatgcggagacaacttatggtaatccgcacaccgttttgccatccagagacgatcgagtcaggtggcacgcagagagaaattatggtcattctgcaccttttgtcatcaagaggcggcgaggctgatgacttgcggagacaaattatcgtcatccgcacacctttatgctatccagagacgatcgagtccggtggcacgcagagacaaataatggtcattctgcaacttttgtcatcaagaggcggcgagcccgatgacatgtggagacaaattatg

SEQ ID NO: 73122 - DNA, 452 bp, Glycine max
  Peptide Sequence Number=SeqID_164807
atggatcgggaaatggaaggttcaacggatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 73123 - DNA, 460 bp, Glycine max
  Peptide Sequence Number=SeqID_164808
accatccgttgttgggatgcgaccctcgtttgaccacttcgaggtatttggaacccattgttaggcaatttgtgaagttccgtgacatgtcggaagtcaaagaaggcattgcagcacaatctgtgaagttctgtgacatgccagaaattaaaaggaagctcacttgggcctttcaggatgttcctccaaaagtggttgcttctggaggaagcaacctagctcgcctgggcgagctgggtggcaagctcctcccctattttcctataaatagggggaggagtgaaggggaaaaatgttcagccccttctggtatttcgagatcacttgaaattagtgaaaaaaattgtttccgtaaagaaaatccaagccgaggcgcttccgtaacgtttccgtgggtgatttcgcgaaagattttcaaaccgttcttcgatgttcttcatcgttcttcggtcttcaaccg

SEQ ID NO: 73124 - DNA, 282 bp, Glycine max
  Peptide Sequence Number=SeqID_164809
atgacaactgaggaatcaatacatgttacttttgatgaaactaatattacctccccgagaaaggagtttcttgatgatattgcagatactttggaagatgcacaaaatgaagaaagaaatctgaaaagaaaaagagatgatgaagacaaggatgataaagatgacatagcacaagaaaatgataatcttcccaaagaagggaaaacttcaagaaatcatcctcttgacaacatcatcggtgatatcttaaaagggaaaaaccttcagattatccaatcatag

SEQ ID NO: 73125 - DNA, 245 bp, Glycine max
  Peptide Sequence Number=SeqID_164810
ggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgataaaacttaaggaaaatagcttaacacatagattcaggacagggcacgaagcacaaaaatttcaagacaacatgttcaaggaagtttaa

SEQ ID NO: 73126 - DNA, 333 bp, Glycine max
  Peptide Sequence Number=SeqID_164811
atgtcgattgggaaatgttcgatcggcatcatccggcgaagcttcttcattagacctcagggatcggtcatcttgactagaatcatgaaactggccaaatacaagctaaaggcccaagtggagaaggacgaaggcccaagtggagaaggacaaagcccccgagtggagaaggatgaaggcccaagtaatccttgtggcgtctacccagacttatcttccttcaccggaagtggcgtctaccctgacttatcttccttcactgaaagtggcgtcatccaaaacctccgtagcctgtatcaaacgatccgctcctactcacgttcacatcatctg

SEQ ID NO: 73127 - DNA, 405 bp, Glycine max
  Peptide Sequence Number=SeqID_164812
atggccgttattaatacgaataccctgtctctggttacccagaacaacctgaacaaatctcagtcttccctgggcacggcgattgagcgcctgtcttccggcctgcgcatcaacagcgctaaagatgatgctgcaggtcaggcgattgctaaccgcttcacctctaacatcaacggcctgaccgttgctgcccgtaacgccaacgacggtatctctctggcgcagaccgctgaaggcgcgctgtccgagatcaacaacaacctgcagcgtgtgcgtgacctgaccgtacaggcgcagaacagctccaactcggcttcagacatcgactccatccaggctgaagttaaccagcgtatggaagagatcaaccgtgttactgcacaaactgatttcaacggtatcaaa

SEQ ID NO: 73128 - DNA, 245 bp, Glycine max
  Peptide Sequence Number=SeqID_164813
atggcttccatgatggatgccatgctaggaatgaggcaactaatggagaatagcgcggccaccgctgccgctgttagttcagctacagaagcagacccaactctcccagctaccgcgcaccatcctatcccaagcgtggtcatgtcccttcccccatccttgaaggggagcctcctcgacagtcggacgagattcatgaggatcgtcgagaacatgcccaaggagacatcgattcctactcctcg

SEQ ID NO: 73129 - DNA, 270 bp, Glycine max
  Peptide Sequence Number=SeqID_164814
gcgagggtcacgggttcgtcttccataagaggaaaatgcgcggagttgccaccaacgtttatttgtggaaaatgtcggaaaaaccgaaggaaaccggtcatgaagaatattccagatttgggagttgtatttacgtttgaggaaagtattagcacctctcaagtcgacaaaagcggggctcttgctcctacgtaccctccttcgaagaggaaatcagacctacgtagttctttcaaaaaggcgaatcaagcgattctttttacttggaag

SEQ ID NO: 73130 - DNA, 135 bp, Glycine max
  Peptide Sequence Number=SeqID_164815
gaaaatgagggaggagctttccacgcagctcgcccaggcgagctaggttgcttcctccagaaggcaccgccttctagaggaacatcctggaaggcccaagtgggcctggttgctatttgcacccctatttactaa

SEQ ID NO: 73131 - DNA, 815 bp, Glycine max
  misc_feature (44)..(44): n is a, c, g, or t
  Peptide Sequence Number=SeqID_164816
atggtgaaagttggaacctcttacgtgccgatcaacgtctcatnttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggaattcgatcgacgatatacgacatcaaacacgccaaaacgtcattttcggactttggtcgacccattccatggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 73132 - DNA, 210 bp, Glycine max
  Peptide Sequence Number=SeqID_164817
atggccccgacggatgcagagaaacgtgaggaactggaaccaaaaaacggcatgcaaaccgagaaaaaatttcagacagctttctctccctctccctcacgttgcttttctccttcttcttcatccaccattgttgcccaacaaagcttcaacctttggtgcccatttccgctccaaatcgggaaaggagggcattttccggagtcgtga

SEQ ID NO: 73133 - DNA, 690 bp, Glycine max
  Peptide Sequence Number=SeqID_164818
atgggtgaagtagaggagatacaagagaagatgaaggccgacatggaggccattaaagagaaaatagccacaatgatggaggccatgatgagcgtgaagaagataatggaagccaatgcggttgcaattgccgctaccagcgttgttgctaaggtgaacctgatgtccccatccgacatcaaccaaatgaatcatccaaccttagacatggtaggcaaagatttgggaagtacgggcagcccccataatgtacaaattcaaaacgagcacgccttcccgccatatggcttgcctctcaactatacgccacccaaagtggcgtacactcccaataagaatgtcaataactccactcctatacccattgaaagccagcaaccccaaactgatcatgcacatggcaagcagttggtggtatacccctacaaaaccctttggagggccctcggtatcacccacaactgcacctcttgcattccacagtggttaaaaaccctcatgactatggcaggaatgggaaagttggatcatctagaggaaaggctcagggccattgaaggaggtgaagattatgcctttgctaacctagaagagttgttcctaatacccaaacatggtcattcccaggttcaaggtgccggactttggcaagtacaaggggactactcgctccaagaaccatctaaagat

SEQ ID NO: 73134 - DNA, 480 bp, Glycine max
  Peptide Sequence Number=SeqID_164819
atggtgatcaccgttcatttagagaatttgagatggggtcccttaacagtcattcaccgacctaagaaggttgtacgacaatttgggtacatccagactattccaccacatcttgttgtgccttcagcttctgttgaagaaatggatgctaaatggatgcaccaatgttcgtcagattacatggagtggttctacctgatttcacatccatttatgactccggcacaaccaggggatcctcctacagttccgccgcaaccagtggcggcaggagcacctaatgaagtagacgttaatgtgcatcgtcctggacatgtagtggatggttatgtagcaattgttgataagttggagaggctactgaatctaaggatcccgactgaaggaataaaaccctgtattgttgttgaaaaatgtctgagcatcgcaagaagctacattggccaaccaactataggtcaaagatcgaggcataggtag

SEQ ID NO: 73135 - DNA, 165 bp, Glycine max
  Peptide Sequence Number=SeqID_164820
atgtcagtgaaaaacctcgttgaacgcctaggagtacatgacaagacaaaccacacactaggagatcaatcagggtcacgttattttgcaagaatgctccaaccatgtgggatcgacacatgcttaaaggagcactcaaaccaggtgtatttagggatcctctag

SEQ ID NO: 73136 - DNA, 240 bp, Glycine max
  Peptide Sequence Number=SeqID_164821
atggaatggagaaggaagaaagatgattggagacacaacttcatggagaaaatgagtcaagaagaagctcaccataataagaaaccatggataagagcttcaaggcatgagaagatgagtggagggagagagagagaaggagcacgaaattttgtgcctcaaataagccaactaatccaagatcatgtccaagattctccactaagtgtgcttaggtgtcatgagacatgtaaagaatga

SEQ ID NO: 73137 - DNA, 417 bp, Glycine max
  Peptide Sequence Number=SeqID_164822
atggcaaagtcgatccagctggcggaccaagtggccaaggcagcgacggaagaggcgagttccttcttcaagcaagagtgtttagagctgaaatccaagacggagaagctggctgggctgctctggcaggtggctcgcgtgagctctgacctctacgagtggcccacacggcgcatcatcgttgacaccgagctggtcctcgacaaggccctctctctaatcctaaagtgtcgcgccaacgacctcatgaaacgtgtcttcaacatgatccccgccaccgccttccgcaagatgtcctcccagctggagaactccatcgtcgatgtctcttggctcctccgtgtctccgcccccgccgatgaccgtgctgacattgagtatgtgacaacaaccgctacggcgtcagacccttactaa

SEQ ID NO: 73138 - DNA, 378 bp, Glycine max
  Peptide Sequence Number=SeqID_164823
atggagtgccttactttaaatatgtcattttatctagtatgtggtctaaaggtctttgcttatttctttcctaaaaaggtcttcaaaatccctaaagaactcaatagatttggcatgaaaagagctttagttgtccattctggaggtttggatgaaatgagcccttttggaccttgtttaatgttggaagttacaactaacaaggttgataagatctcatttgatcccttggagtttggcattcctcgatgcaatattgaaagcttaaaatgtggtggtccagaatacaatgcagaggttccaaagtgtgttcttggtgtaaagaaagggcccattgcatatgctttggggctgagaggatatgatatcttagtgtaa

SEQ ID NO: 73139 - DNA, 264 bp, Glycine max
  Peptide Sequence Number=SeqID_164824
atgtgctcgcccagcgcccagccagcccgcccagcgggttcgttgtctcttctcacacttagcgtgaccagtctcgctaagccaaaattcacttactctcgcttagcgagccttcggaagctgaaaggtccaagagcctttaaaacattgaagttggcgaaaataaagcatagagttagagatagcgcaccagaggaagctaagaagacagaaaggaagcagctaagagagcatatgttagaaggagtgaagtctagggtttag

SEQ ID NO: 73140 - DNA, 570 bp, Glycine max
  Peptide Sequence Number=SeqID_164825
atggaagatgaaacatctagctgttgcaagttattcaaaaagccatgttctaataacattgaagcagttggtcgctctgttggatttcttataaagcaaagtcttaggaaatctttaccctctgctgacaatgtttctggtataggaggggttctcaatcctccacttcaacagccacgcgaccaagaccagcaggcatggctccccgcggtttcaccgccgccactgccggcatgcgccgtcgccactaccggcatgcaccgtcgccgtctcgacaacagaaacagctctaccagtaccgtcattagaggcggcggacagcaacatgctgaggttctacacggacgatgccccggggctgaagatttcgccgacgatggtgctcgtgatgagcttctgcttcatcggcttcaccacgctccacgtcccgacctaaaaagcatacgtttcaacgtcgttgctgacatcaacaacgtcttcgaagaggtctacaacgacgtcgcatttaaagacaggcctgcaccgtcgttgaatgccgacaaggaccgatgtaaaacggcttttttctag

SEQ ID NO: 73141 - DNA, 153 bp, Glycine max
  Peptide Sequence Number=SeqID_164826
atgaggaccactaagggaaaaggaaggagatgcttgccacccagctcgcccaggcgagctaggttgcttcctctagaagcaaccgccttctggaggaacatcttggaaggcccaagtgggcctggttgctatttgaactccaatttttactaa

SEQ ID NO: 73142 - DNA, 110 bp, Glycine max
  Peptide Sequence Number=SeqID_164827
ttctagcttctcatctcaaggaggtgagcttagccattagagaggaagttttctcaaagaagcttctcaaggaagttttctcaagaaagcttctcaaggaagctacctag

SEQ ID NO: 73143 - DNA, 506 bp, Glycine max
  Peptide Sequence Number=SeqID_164828
gtcagatttcttccattgctcagagtaactcctctaggctcggatttccagccttgatcattgccctatgtagagctagaggagttacctctgacaatggcatccaggaagaggaagggctcgaccagctgatgttccctcttcttctacaccgccatcttcttctacttcttctagctctacaccagctcagtatgataccaggtgcattccaggactctttggaagcttggaatagatacagtggcaaccattctcagccgaaatatcttcacggagagaatatgtttattattgagttcgacgagttgcaaggtggagttggagaggcgggagggtctcagcaagctcagagtaagagcccgatcaaaatagatgcagaccccgcaatgccagcacctggattagccactactcctcctactactcccgttctacgtttttcagatgaggaggagggacaggactactactcctccagggactccagtgttacatttggatga

SEQ ID NO: 73144 - DNA, 405 bp, Glycine max
  Peptide Sequence Number=SeqID_164829
atgggtttggacagatacccactggtaaaagtttcattgtcattgggtttcattgtcatgcctaaaaaatacttgttaaccagaccattggaagaaggggttgagaaagaattaaaagggatgaacctggttggtcgacgaatcagtgaagagggaggaagcctcgttcaagaaggtataatacatttgagaaaaatgattgtctttaaggtactggtggaccatgagggccacaagagcagggctgattttgtccattcagaacgactatgccgtgttgggtttggttgtcttcgacgttttggaatctccagcaacgaaaaagagaagaaggagtgtgatgatagatcaatgagtgtagctcgctttagaagaggtaaggggtatagaggccggtacttctga

SEQ ID NO: 73145 - DNA, 141 bp, Glycine max
  Peptide Sequence Number=SeqID_164830
atgacgagtgcagcatgtatgcatggggacctgccgtacttgcttatttatatagagagatgcgcagcgccaccgattataaaattatcaatcggaggtggctgcgacgtggaaatcaacatatgggcaatgatgatttga

SEQ ID NO: 73146 - DNA, 363 bp, Glycine max
  Peptide Sequence Number=SeqID_164831
atggcttataaagagagcagtcattgcaattctcctatcgaagcagatacaggaaaagcaagtaagaaggatgatgtaaggggcaaactgaacttcgatgcctctaatatgcctgagagcttggacaaatcattggctaatgaggtttctacatctgagttggacaagggagttgtcatatctgacattgatttttcaaacttggactggtcactccaaggaaccagtttcgaagatttttttgaccctataggtctaactgattccaaagataatgcttcaagttcaaggtcttcaaatgaactgcaagtaagcaccaataaaaatttgaatgtacaaggccttgatagtcaacatgtctga

SEQ ID NO: 73147 - DNA, 308 bp, Glycine max
  Peptide Sequence Number=SeqID_164832
atgcaatggaactatctacctttttgtgataccatcaagcttaatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 73148 - DNA, 1473 bp, Glycine max
  Peptide Sequence Number=SeqID_164833
atgaacgggaagagctttaagagcatcgagaatggacaattgatattgcagcggttcaaggaggattgggtttcggcccagagggttgtctccgagtccaggaccagaaccgaaacctccatgcccaaacgcgtccttgagaggctcacgactccagaaatatggatgaagccaaacagtgacaaatattacaaatgcgtttctccacccaggaatgtaataaggccaaaacagacaaatggctatcttcttgttcatgcgaatggtggattgaatcaaatgagaactgggatatgcgatatggttgcagtggcaaaaataatgaatgccacccttgtccttccttctctagaccatgattcattttggactgatccaagtgactttaaagatatctttgactggagacacttcgtgaaagttttgaaagacgacattgagatagttgagtacttaccggtccagtatgcgtcgctgaaacctcttgtgaaggcccctgtttcctggtcaaaggctagttactacagaggtgagattcttccattgttgaagcaacatactgttgtacagtttactcacacagattcccggctcgccaacaatggccttgcttcctcattgcagaagctgaggtgccgtgccaattaccatgctctcaagtacacggcagaaattgaagagcttggaagggtcttggtgaataggctaagaaacaataaagaaccatacatagcccttcatttaagatatgagaaagacatgctatcctttactggctgcagtcacaatctcactgctgaggaggcggaggaacttagggttatgaggtatgaagtgaagcattggaaggaaaaagagattgatagtgtggatagaagattacaaggggggtgcccaatgtcacctagagaggcagctatttttctcaaggccatgggatacccttccactacaacaatctacattgttgcaggacctatttacggtggcaatagtttggaagcctttcaatctgtgttccctaaagtattttctcattctacccttgcaactgaggaggagctagaacccttcaagccatatcaaaaccgtctcgctgctttggattatatagttgcccttgaaagtgatgtctttgtgtatacctatgatggaaacatggccaaggcagtgcagggtcataggaggtttgaagggtttcagaaaaccatcaatcctgacagattgaattttgttaagctgattgatcaactggacgagggtgccatatcttgggaagcattcgcttctgaggttaagaatttgcattccaataggctaggcgcgccttatcttagacaagtaggagagtcaccaagaatggaggagaatttttatgccaatccctttcctggttgtgtatgcaacaagtctcaggagcaaatcacaagccagaaactagaccatcagtttggtattggagcacaaagatag

SEQ ID NO: 73149 - DNA, 684 bp, Glycine max
  Peptide Sequence Number=SeqID_164834
atgcatctgactttcatgttaggctctcaatttttgtgtcttgcacactctggaactaagtttcaattagcagtggacaagccaattctaattcctaagttgaactacataagaatagaggacctcataagcagggataaacaagctttgcgagggtattacagattgggagctcattacttttgtctggaacctgaggaaaagccaccattagataaagttcatcataagataggttgttgctatcaaactatcaatcacaatccctttgtggttgattcaccatctaatcgcatttgtcaatggaaaagagacttcgttgttgtgtctgagcgtaatttctcattcactattgagcttccaaactccaccttcaccttcattcatcaagtacaatccatcattgacgaggtgaattctaatgaagaggcctctattgttgctgatttggcaacggaagtctacaatggccctccatcccaagaagaggtgcttgttgaagctcttcaggatagggctcatgctgaaagagaagccaaaagatggaagatccttggagagtcactttttaagaaatgtgttgaaattcccttggatagttcatgtgatgacgacttcaaggatgattttcttcgcaagattaaagaggaagatgaagcttccaaacaaagggggaagaaataa

SEQ ID NO: 73150 - DNA, 690 bp, Glycine max
  Peptide Sequence Number=SeqID_164835
atggagcataagcttcaaggctttgttaaaattgacagggatgattccagcctacctctggttacatctcctatcagacatgccacccagagttttgccaagtttagtgagaaacagatgtcaaacttccacaacagaaatttgagcacctttgcagttcagccttcatttctggcaagtcattttggatctagatgggataggaatgctctatcagatctaaatggcggtcaaagtggagggagtgatttcatttcatcaccgttgaagagtttcatcaagttcagtgagaaacaaacgtccaacttccataagagaaacttgagcatctttgtagtccaagcttcttctctagcaagtgattttggatgtagacacgagctagggaggtttgaaggactcatcagaactgatgggatttctggaaacttaagaaatgtatggcaagtaacattttcctctgcttcgagtccaaatgaatcttctggggcaggcactgaagtatcaaaacctgagcagttttggaatacaccattggtagaatgcccgaggatgcacttgtccttgctttctaccaaggatatgaaagattttgatacaatccaagtcatgaatgtttggttcgaatcgttcgttctggatgtaaattcaagagcaccattgatgacctttcaagaactcaagaattga

SEQ ID NO: 73151 - DNA, 501 bp, Glycine max
  Peptide Sequence Number=SeqID_164836
atggtccaatgcaattccactgtaaatgtttatcaacatcttcctgctcttctctcgaccaaccaacaacatatttggacacctcctcccacaggttttgggaaatgtaacctagacgcaaaaattttcaacaactcactcccttttgggattgatatttgtattcgaggtgagcatggtcatttcatccaagtgaagatgtcctctttcaatggcattccaactctggctcaggcagaagcgtgggctctttaccatgctcttcaatggacttcacatctaggctaccaaaatccgctgacggtgctggcgataaagcttgacccgccattggcattggcgttacaggacgtgacatggacggtaccgccatttccactggcgagacgtggtgacgtggacggtaccgccattgccactggcgatacaggccacggtcacagatttgcagtgtttagggccacagctttgcaatgtttagggcagcaacatgcagactag

SEQ ID NO: 73152 - DNA, 759 bp, Glycine max
  Peptide Sequence Number=SeqID_164837
gtcatcaatggtgctcttgaatttacatccagaacgaacgattcgaaccaaacattcatgacttggattgtatcaaaatctttcatatccttggtagaaagcaaggacaagtgcatcctcgggcattctaccaatggtgtattccaaaactgctcaggttttgatacttcagtgcctgccccagaagattcatttggactcgaagcagaggaaaatgttacttgccatacatttcttaagtttccagaaatcccatcagttctgatgagtccttcaaacctccctagctcgtgtctacatccaaaatcacttgctagagaagaagcttggactacaaagatgctcaagtttctcttatggaagttggacgtttgtttctcactgaacttgatgaaactcttcaacgattgtcctctgatttggttagaagagaatctgaagaagagtcaacatgaggatgtggatagttggtcaagacattttacggttatgcttgataagttagggagcgatggagccttgatggttattcttcgtctcatggaagagatcacgtcttatccaaatggaattaggtggagtccgcctcctgaaggtttgtttaagttgaactatgatggggctgtgaattgcaactccttaaaggttagtgctgggggagtggttcgtgattcccatggaaactttgtgattggttttactactactccggattcgtgcacaatcaatatcgcagaactttgggcctccacagattaa

SEQ ID NO: 73153 - DNA, 540 bp, Glycine max
  Peptide Sequence Number=SeqID_164838
atgcttgcttttcctttcgaaatgttgcgaaactttacggattatgcaacaatgcttattttgagggtctcgaagggaacaaacaagggaagtaaagataagacactaattttgttcaagctgaacctcactcgaccgatcaattgcccaaccagtggaactagtcaatcaaatagaatagaaaatgcatcaggagcaccaagaagagtcttgcacgtcgtcggacttgaatgtctctggatgacaaaggcgaccatatattgtcttcgtgcgtcatcggacttgtcgtctctggatgacgagggtgcaggtaaccatgaggtatctccacatgctatcggaccctcgagtcacgatagtagaattgagactttttcgcggtctcggccgaaagatgctgacatctccgggaagggtacggataaccataaggtgcgttcgcatgctaccggacccttgggtcacgatagcgaaattgagattttttcgcagtcccagccgaaagacgctgacatctccgggaaaggtgcagatgacgac

SEQ ID NO: 73154 - DNA, 351 bp, Glycine max
  Peptide Sequence Number=SeqID_164839
atggagtcgccaactgtcgcaacctacccttcggcgggagggcgacgcggggctcatgggtgcgtcttccaagaaaggaaaatgcgtggagtcgccaccaaagtttatttgaggaaaacgtcagaaaaatcagaaaggtgtggtctacgaacattaagtgtgaaaggttcaggagttatttttacgcatgggaaaggtcatttaaggcgttggaccattaaacgatcttttgattttgaaaagagaacgttaaggcgttggaccattaacgatctcttggggtggtcgacaaaagcagggtttgtgctcctacgtatcctcaattgcgatgaggaactcaaacctacgtag

SEQ ID NO: 73155 - DNA, 153 bp, Glycine max
  Peptide Sequence Number=SeqID_164840
atggtaacatcccacgacacttgcaaaggcttgagaaaaagccatgggatggtctttgctatcaggaatgcaaacattagctgtagaagcaaagtttccaagattattttgatgatgccaaagattattaaagatccattcaaacaagattaa

SEQ ID NO: 73156 - DNA, 282 bp, Glycine max
  Peptide Sequence Number=SeqID_164841
atggacattttgcttcccattgtcctaaaaagttctacaattactggaaaaaagaagaatttgcctgctcctgtgccaactttaacccctgaaatggttcaagaaatgattgtttcagcattttctgctttgggtcttttaggtaaagcttctttacccagctctccttggtattttgactctagtgcatccaatcatatgaccaacaatgttgctgcacttaccaatgtcacaaattactctggatcaacactcaaggaagataatcgcgaatgggcctaa

SEQ ID NO: 73157 - DNA, 273 bp, Glycine max
  Peptide Sequence Number=SeqID_164842
atgttgatgaagaaggacatggtggagaagattaatctcttcttcaaaagattttggataggttcgatggtcttcaaacctttgttggtgaaagtatgtccctcagaattttctcctgcaccatccaactctttaatacaagtctgcacttcatgttcctcctctttattggctgtggacatgaaaggacgtcccaagattataggaatgtcaggatcctcctctatatccataaccacaaaatctgcagggaatacaagctgcttgacgtaa

SEQ ID NO: 73158 - DNA, 195 bp, Glycine max
  Peptide Sequence Number=SeqID_164843
atgggtttacatcattttggtatcagagctccggttcaagggtttttcaagagtgcttgggttgaaatttcttgctttcaaaaattcttgaaggtggtggtgaacatcaattggatggggcacaaagattcttattggatgctctcaatgctcaaatgcaaaactattgagaaacaacaacgaggagttgtatga

SEQ ID NO: 73159 - DNA, 243 bp, Glycine max
  Peptide Sequence Number=SeqID_164844
atgggggtgcaaatagcaaccaggcccacttgggccctccagaaggctgttgcttctggaggaagcaaccctgctcgcctgggcgagctgggtggcaagctgctcccccaattttctataaatagggggagaagtgaaaaaatccaagccgaggcgcttcggaaacgtttccgtgaggaattttgcgaagctttcgaccgtttttcgacgttcttcattcattcttctatcttcaacgggtaa

SEQ ID NO: 73160 - DNA, 609 bp, Glycine max
  Peptide Sequence Number=SeqID_164845
atggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggcggggcgtaatttttttaaggcagttattggtgcttag

SEQ ID NO: 73161 - DNA, 528 bp, Glycine max
  Peptide Sequence Number=SeqID_164846
atggagcctactaggcaccctctggacccagagaagtccaacagggccctcagagttcctgtcacccccagcaaggtaatccgaccgccgatcacccgagccttcatcaagaagttctgcacgcctaggcaggcgcagggtgacgcacatcaggacgcgggcgcaccaccgccacctcgacaggctgattcggctaggccactgggcgtggagcggtatctacagcatttggttcgccagcaggcggccaaccaccgtggacaggtgcatatacatgaatgtctctaccggttcagcctcagtcagcaggggcagggttccgccccttttgtatgccctaccccggagcagtttggggctgaggtcgcatggcctggagactggcccgatgcccaggcaggggaggagcctgcaagatcccccggtgaggcagatgaatctcgtatggatgaggatatgactacctgctcggtttcttgggagggagcggagcaacatgaccaagttattgtttttgttgtcatctaa

SEQ ID NO: 73162 - DNA, 710 bp, Glycine max
  Peptide Sequence Number=SeqID_164847
gactacacgtcgtcaccttcagaggctacacgccctcacctttagaggactacacgtcctcgccttcaaaggaccaaacatcctcatcttcaaaggattacatgtcctcatcttcagaggactacgcgtcctcaccttctgagggctacacgccctcaccttcagagggctacacgtccttgccttcagaggactacacgttctcgccttcaaagggctgcatgtccttgccttcagaggactacacatcctccacttcagaggactacacgtggccaccccctgatcctggaggagggccaactatgcaagtacaaccaaaggaggaggctatcgtgcagctactatgcataccggggcaagatttcacccgtgccgctgcaaagagacgattgcggatcatgcgcaccaacatgaccactcttacacagatatggatgacgttgctacttagcaacattcttcccagtgaccgcaatgccgatctccccctgcggaaggatcatgcccacaaggcacccagtggacctggagaagtccaacagggccctggggatgccagctctggttacgggcctctgtcagtccaacaagggatcgctcctgcaagacacccagtggactcggagaagtccaacagggtcttagggtttccagctctgattacgggcctctgtcagttctacagagtgctcatcacccccaacaag

SEQ ID NO: 73163 - DNA, 896 bp, Glycine max
  Peptide Sequence Number=SeqID_164848
gatttccgaatgttccgttgatagggacaaggggttgcatcagttacaatcccgttcttgttataagtcaacttggctaccctatgagaggggcaccactagaggaagagctcatgcctattattgcacgaggtttcaataagaccaacgtggaggcgcttcagaaggtccacaaggcatgggagatggtgcaaaagaaggataaggaactcagaggcagtaacaacgggcccatcggcaactatcgtgacgaagaggtgcaggcccttagggcagaactcgagcaagcccaatcagtcaaagaaaggttcaaatcaacaactcttaagatccaaaaggagaatgccgaactgagagacgtaaataaagctaccaccaaggccttggaacgaaagaccaaaagggctcgtagggaggaatacagaggggctttatggggcagtaacagcgagcttaagctccggagagaggaaaaggaccaatcacgagtaggcagtttgatcttgaaggatgagctgaaggtttgcctaaggtccaagagaagcttgtctcagcgtttatgtgagatagagatcaacatgttagccatcatcagtaggtaccaagatgaattaaatctagccatggcccatgagcacaaagtggcagacgaatatgcccgagtgtacgcggaaaaagaagctagagggagggtgatcaactcgttacatcaagaggcgaccatgtggatggaccgatttgctcttactttgaatgggagtcaagaacttccccgattgctagccagggccaaagcgatggcggacacctactccgcccctgaggagatccacagactcctcagttattgtcagcacatgatagacttaatgacccatataattaggaaccactag

SEQ ID NO: 73164 - DNA, 573 bp, Glycine max
  Peptide Sequence Number=SeqID_164849
atggtagaagtctctgtggaagcaattgcatcccttactcagtattatgatcagccgctaaggtgcttcacgtttagggacttccagctggtaccaattgtggaagaatttgaagagatcatgggatgtccactgggaggaagaaagccatatctcttttcgaggttctacccctccatggaaaaagtagtcaaggtagttaaaatctcgatacaagagttggaccatgtgaagcaaaataggaacggggtagtcgaaataccaaggaagcatttggaggaaaaggcaaaggcattggcagatcaaggggaatgggcttcgtttattgacatcttgacactattgatatttggcttcgtcctctttccaaatgtggatggattagtggacctagaagcaattgatgccttccttgcttatcaccatagcaaggaaagcccgatcattgctattttggccgatgtctatgacatgttcgaccgaagatgcgaaaaaagcggcccaagaattgtttgctatacactggctctctatgtatggcttgtctcgcacctttttttgtcaagaaagtag

SEQ ID NO: 73165 - DNA, 310 bp, Glycine max
  Peptide Sequence Number=SeqID_164850
atgtcggctcttcgccactggggctgtagtatgttccaagggttgggctgttcgcccattaaagcggtacgtgagctgggttcagaacgtcgtgagacagttcggtccatatccggtgtgggcgttagagcattgagaggacctttccctagtacgagaggaccgggaaggacgcacctctggtgtgccagttatcgtgcccacggtaaacgctgggtagccaaagcctccggtagcacagccgagacagcgatgggttctctgccccagcggggatggagcgaaagaagttttgagaattcaagagaag

SEQ ID NO: 73166 - DNA, 303 bp, Glycine max
  Peptide Sequence Number=SeqID_164851
atggccaaaccttttgctatatcaattaggaattcccttcctaaaatactagtgatcatcttgatgttgtggcttgtattcttgaatcattgtcttgaatttaaacttgaaatcccatttgcatcatttgcatcaatcatcatgatcttcatcaaaacatcaaaggcaatagcttctcaagcgccagtcacactcgctcagcctggaggtgaagatggtgcgcttagcgagttgcgctcgctaagcgcctctatacagctcatccttcttcaagaattgtccccacgcttagccatcagatga

SEQ ID NO: 73167 - DNA, 504 bp, Glycine max
  Peptide Sequence Number=SeqID_164852
tcctacagggtgcccgtcccccccagcaaggtcatgccatcgtgacatagggatcgtgcctgcaagacacccaatggacccagagaagtccaacagggccctgaggaaggcacagggcgagacaccacagcaggctggggatggccagcagcaggcaatagacgcaccgccgccacctccagagcctctcagctcatctacaaaggctagagcattgcctacgacctgtggccgaccagcaagcgaccaagtccaaagccaaaggtacttggcacccattgttacacaatccgtgaggttccgtaacatgctggaaatcaaaaggaagcattgttatgcaatccttgaggttccgcaacattctgaaagccaaaaaggggatgattacgtaatccgtaaggttccggtgcaaatagcaaccaggctcacttgggccttccaggatgttcctccagaaggcggttgcttctggaggaagcaacctagctcgcctgggcgagctgg

SEQ ID NO: 73168 - DNA, 217 bp, Glycine max
  Peptide Sequence Number=SeqID_164853
atgggtggcggcgcctccgctgcttgtggttggtggtgtttggtgtgggcttggccgatagtggtggttggtgtaggcttggccgatggtggtggttctgatgtaggctttaggccgctgggggctaggccggatggtggtgggttcacggaggaaaaaaggggcactgagtgggggctaggggtggctcttggctgtcccggcgcttttgctgtcc

SEQ ID NO: 73169 - DNA, 472 bp, Glycine max
  Peptide Sequence Number=SeqID_164854
tcggattccccttgtccgtaccagttctgagttgactgttcgacgcccggggaagaggccccgaagggcccgttcccaatccgtcccccgaccggcacgcgacgacccgctctcgccgcggaagcagctcgagcagtccaccgacagccgacgggttcgggactgggacccccgtgcccagccctcagagccaatccttttcccgagaggctgttcaccttggagacctgatgcggttatgagtacgaccgggcgtgggaggcactcggtcctccggattttcaagggccgccgggggcgcaccggacaccacgcgacgtgcgaaaagataactctttccggggcccccgccgacgtctccggactccctaacgttgccgtcagccgcacgtcccggttcaggaatttaacccgattccctttcggagtacgcgcacagagcgctatcagacgggcttcccccgtcccttag

SEQ ID NO: 73170 - DNA, 213 bp, Glycine max
  Peptide Sequence Number=SeqID_164855
atgcaatgtggtatcctgtcaatgaaaaacctcgtcgggcgcttaggaggagaccagtcagggtcacagtgtttagcgagaatgctccaaccatgtgggatcgacacatgcttaaaggagcactcaaaccgggtgaccctcaaggcctacattccgaagagtccgttagggcctctccctcctgattcaggtccaacccagaaaacattttag

SEQ ID NO: 73171 - DNA, 615 bp, Glycine max
  Peptide Sequence Number=SeqID_164856
tgtatgactagaggcaatccatctgacttacaaccctttgaccctgagatagataggacatttcatagattagttaggcatcattttataccttttgatcatcctgagcattccattactggtgaatttgtgcattctgttattggtgattttgaacatcctgatttggagcattataattttgagcattctgattctgagcattctgattttgcacattctgagaacatggcacaacctccatcccgtgagaggactctaagggaaatggctgcacctgatttcacctacgaaagcttgtgcatccaataccctgatgaggatggagtggcaaaggactggttgtattaccttgctccaaggtccatcacgagctgggatgaccttaagagagtattcttagaaaaaaatttccctgcttccaggaccacagccatcaggaaggatatctcaggactcagtaatatggagaaaagtatgatagatgctgccagtggtggagcccttggagacatgactcttgctgaagccagaaatttaattgagaagatggcttccaactctcagcagtttagcgccagaaatgatgccatagtcattagaggagtgcatgag

SEQ ID NO: 73172 - DNA, 446 bp, Glycine max
  Peptide Sequence Number=SeqID_164857
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccaggcgtttccccctggcggctccctcgtgcgctctcctgttcctgcctttcggtttaccggtgtcattccgctgttatggccgcgtttgtctcatccacgcctgacactcagttccgg

SEQ ID NO: 73173 - DNA, 210 bp, Glycine max
  Peptide Sequence Number=SeqID_164858
atggttgattataaagaggactgcgtaaaaagaccctttgctggttgctggagctggcacatgtcattagaagtagggaaagctaggaggaatctgtcctctaaaaacccccctaatgcaaagggattttccggaatggacctttcgctcctccataagtttgcatgcatgtatatgacattatggcatccagaacactctttgatttaa

SEQ ID NO: 73174 - DNA, 1488 bp, Glycine max
  Peptide Sequence Number=SeqID_164859
atggcattgtgttctgctatcaccctaatgatcatcttcatactttcttccttccatgttgttggaattcaaatcatctccaaatcgaagctggagaagtgcgagaagaactccaactccgacgacaatctcaattgtactaccaaaatcgtactcaacatggctgttcccagtggctcgagtggtggagaggcgtcgattgttgcggaattggtggaagtggaggaaaattcaagcaggaaaatgcagacattgcgtattactcctgtcataacggtcaacaaaacttctgcatatgccttgtatcagttaacatacatacgagatgttccttataaacctgaagagtattatgttaagacacgcaaatgcgagccagatgctggtgcaaatgtcgtgaagatatgtgaaaggcaagccatactgcgagatgaagagggtcatattatcgagtacactcagccaatatgttgtccatgtgggccccagaggtggatgccttcatcatgtggaaacttctttgacaaattgacaaaaggaaaggccaacactgcacattgtgtgcatttccctggtgattggtttcatgtttttggcattgggcagcgaacattgggatttagtgttcaaatacaggtgaagagtggaactaaagtttcggaagtggttgtgggtcctcaaaacagaacagtgatctctgatgataaattttttagggttaatcttataggagattttgttgggtatacaaatataccatcttttgaggatttctatctggtcgtaccaaggcagggcagccctgggcaaccacaggatttggggagaaacatttctatgtggatgctgcttgagagagtgagatttaccttagatggtattgaatgtaacaaaattggtgtcaactatgaagcttttaatcaacaaccaaacttttgcccttctcccttttggacctgcttgcataatcaattgtggaattttcgggagagtgctgggagttattctttctccataggaattacagaggttcttaatacaaaccttgtgctagaattaagtgcgaatgatgtagagtatgtttatcaaaggagcccaggaaagataataagtgttagtgtccctacatttgcagccctaactcaatttggtgttgctacaatcacaactaagaataccggtgaggtggaagcgtcatatagtttgacgtttaattgctccaaggatatcaccctgatggaggagcaatttttaataatgaagccaaatgaggttacaacccaatcatgcaaaatctacccaaccactgatcaggcttcaaaatatttttgtgcggccgtactaaaggattctgattataatgaagttgatagagctgaatgtcaatttgctactacggcaactgttcttgacaacgacacacaggacgacaaagaagattttacagcagttcttttatctgcagtatcactacataaatacatttaa

SEQ ID NO: 73175 - DNA, 153 bp, Glycine max
  Peptide Sequence Number=SeqID_164860
atggacggtgtgagaaaaatctttgattgcaagagaggcagagaaatgagactgactatggtgggaaccaattcaaagcaaaaagcaaatagagagctgggaaaaaaatcaaaacaatcagagctagctagtctgatgggaaattgcttttaa

SEQ ID NO: 73176 - DNA, 2853 bp, Glycine max
  Peptide Sequence Number=SeqID_164861
atgaacaacttcaagttaggggtagatgtggttagtgctcacaatctattacccaaagatgggcaaggttcatccaatgcctttgtggaactttactttgatggacaaaagtaccgtacgaccatcaaagaaagggatcttaacccagtttggaatgagagcttctacttcaatatatctgacccttctaatcttcactatatggcacttgatgtctatatccactgccacaccaaagctactaactccacttcttttcttggcaaggttagccttaccgggacttcttttgtcccttactctgatgcagttgtcttgcactatccattggagaagcgtggtattttctctcgtgtaagaggagagattggccttaaagtttacatcactaatgatccaaccataaaatcatccattccaactcctgttgttgagtccatgccaacaaattattcaagctcaacacattcagaagttcgagcacctgcaagcacaatgacaaacagtttgccgaatgaaaaggttgagtcaagacacacatttcatcatctccctaacacaaaccatcaccagcaccaacagcactcctctggctttgcagatactcattatgtaacaaagtatgaagctgatgcaatgaaatctgaaccacagcctatgaaactagtacgcactgctacatcagtacaaccagttgattttgcacttaaagaaacaagtccatatcttggtgggggaagagttgttggtggtcgtattgttcataaagacaagactgctagtacatatgatcttgtggaaaggatgtactttctgtatgtcagagttgtcaaggctcgtgagcttcctgctatggatgttactggtagccttgatccatttgttgaggtgagaattggaaattacaaaggtattaccagacacttcgataagaatcagagtcctgaatggaatcaggtgtttgcattttcaaaggaccggatgcaagcatctgtacttgatgttgtgatcaaggacaaggatctcatcaaagatgattttgtaggcattgtgaggtttgacatcaatgaggttcctttgagagtaccaccagatagccctttggctccagagtggtaccgccttgaggacaagaaaggagagaagaataaaggtgagttgatgcttgctgtctggattggtactcaagcagatgaggctttttctgatgcatggcattcagatgccgccactcctgttgacagcacacatgcgatctctgcagtgatgcgttcaaaggtctatcatgcaccaaggttatggtacgtgcgtgtcaatgttgtggaggcgcaagacttggttcctacagagaaaaaccgtttccctgatgtgtatgccaaggtgcagataggaaaccaagtgctgaaaacaaagacagttccagcacgaacactaagcgcactctggaatgaagatcttttgtttgttgctgctgaaccttttgaagaccatttaattatttcagttgaagatcgggttagtccaggaaaagatgagatcattgggaggatcatcataccactgaactccgtggaaaggcgtgcagatgatagaatcattcattctagatggttcaacctggaaaagccagttgctatagatgttgatcagttgaagaaagaaaagttctcaagcagaattcagctccggttatgtttagatggaggatatcatgttcttgatgagtcaactcattacagtagcgacctccgcccgacagcaaagcagctgtggaagccaccaattggggttttagaacttggagtgctgaatgctgtaggactccatccaatgaaaacaagggatggtaggggcacatctgacacatactgtgtagcaaaatatggtcacaaatgggtcagaacaaggaccattgctgataatctgtgtccaaaatacaatgagcaatacacttgggaggtttttgatcatgccacggttcttacagttggtgtatttgacaacagccagctcggggaaaaagctaatggttcttcaaaggacttgaaaattgggaaggtcagaattcgcatctctacactggaaacaggcaggatttacactcactcatatccattgttggttcttcacccaaccggggttaagaagatgggtgaacttcacttggcaatacggttttcatgcacttcttttgcaaacatgctttacctatactcacgaccactgctgcccaaaatgcactacgtaaggccattctctgtgacgcagctagacatgctgcttggaaaatggtttggtgatatctgcatgtggaggaatcctatcacaacagtgctggttcatgtgctctttctcatgcttgtttgcttcccagaattgatccttcccactatttttctgtacatgttcttgataggggtatggaacttcaggtatagaccaaggtaccctcctcacatgaacacaagaatctcacaagctgaggcagtgcacccggatgagttagatgaagagtttgacacattccctacgagtcgtagcccggacctagtgagaatgaggtacgatcgcttgaggagtgtggctggaaggattcaaacagtggttggtgatttggccagccagggagagaggattcaggcactgttaagctggagagacccgcgtgctacatccatatttattacattgagtctcctatctgcgttggtgctctatgttactccttttcaggctgtggctggtttggcagggttttacatcatgaggcatcccagatttcgccacaggctgccatgtaccccagtcaacttcttccggcgcctcccttcaagaacagataccatgttatag

SEQ ID NO: 73177 - DNA, 414 bp, Glycine max
  Peptide Sequence Number=SeqID_164862
atgaacccaagagtaggagaggagcatgtcaagcaatcatctcaccatggtgctgctccagctgttcccgggggactctcagaaaatgttcctttaggtgtcactgaaatctgtggtgaccaagtcagtacttcgctgcaaactagagattctaattcaactcaagaaacagttgctggtggcaattatgagattgggacctcatctaactcagaaaagctgaaggaatcggacactgctgtaaaacttggctcggcaaaggattctgaaattgaattttctaagttggaaaaaactgtcatcttagaggaagaggaagaggaggatccatgcctaatttgtttaataggtgatgtagccacagcttctttatatattcaacttctttggctttcagcattaactaagctttaa

SEQ ID NO: 73178 - DNA, 1605 bp, Glycine max
  Peptide Sequence Number=SeqID_164863
tgccagccctcattggttcagaagagtgtgcaagctggcacctttgcatgtgaattctatatcagcaggagaggaggaatgaaagattcggataaattaacgtgggatcagggtcgatgtctgagtcccgcacaggcacgttcctcggcctcacagaagcttatggtgtcgctcatgttcttggtttccctcacctacatggcttacactctaaagctggtttccacgtccacatcatcaagcacgtgcagccacgctcctttcatcatcaaccacctcttcccttcctcaaacgtaacggagtggccgtcttcatcccaaacttcccgcaccggaaaggggaaacggccggggcgccagaaaacggagctccgccacctggtgttcggaatcgcggcgtcatcgaagctatgggagcacagaaagaactacataaagacttggtacaagaaggacaagatgaggggagtggtgtggctggacgatcgcgtgaagacgaacccaaaggaagggttgccaccaacgaaggtgtccaccgacacctcgaatttcgtatacaccaacaagctggggcaccgctccgcgattcgaatctcccgcatcgtgacggagacgctgcgtatggggcacaaggacgtgcggtggttcgtcatgggcgacgacgacaccgttttcgtgacggacaatctgctgaggattttaaacaagtacgaccacaactacatgtactacattgggagcttgtcggagagtcacttgcagaacatattcttctcctacggcatggcctatggtggaggcggcttcgccataagctacccgttggccaaagctctgagcaaaatgcaggaccgctgtattcagaggtatcctgctctctatggctccgatgatcgaatgcaagcttgtatggctgaactcggtgttccactcactaaggaaatcggttttcaccagtatgatgtgtatgggaacttgtttgggcttcttgcagctcatccagtgactccattggtgtcactgcaccaccttgatgtggttgagcctatcttcccgaatgccaccagagtagaagccattaaacggctaaccattccgatgaagcttgactcagcatctctcattcaacaatccatttgccatgacagaaataggagatggaccatttcagtgtcatggggttttgctgttcagatatttcgcggcatatttacacagcgggagatggaaatgccttcaagaacattcctcaattggtatagaagagcagattacactgcatatgccttcaacacacgcccgtttagcagaaacccgtgtcagaaacctttcgtcttttacttttccaaggcaaaactcaattccactttgcaacaaacagtgactgaatatgaaagagatcctattcctcctccagaatgtcgatggaatatggctgatccttctgctcttgacaaaatagaggtgcacaagaagcaggacccgcatctatgggatagagccccaaggagaaactgttgcagagtgatgaagtcgaacaagacaggaatcttgaagatagaagtggctgtatgtagagatggtgagttcagtgaacctgcttaa

SEQ ID NO: 73179 - DNA, 1605 bp, Glycine max
  Peptide Sequence Number=SeqID_164864
atgaagaggactacttacgaagaagtaagcagccagtgtcctcccagcaggaaacttcatattatattcggtccagcgggattctcacctttgaaaatcaacgctaatttgcgggaacacgctataaatacctcccatggagtcgtagttcattcacagatacacgttctaatgagtgtgaacgaaccccaattactgtctaagattgccactggcgatggacatggtgagaactccccatactttgatgggtggaaggcttatgaagatgatccctttcatcccataaaaaatcctaatggggtaatccagatgggtcttgcagaaaatcagcttgcttctgacttggttcaaaattggttaacgaacaagcctagggcatccatttgcactcctgaaggagtgcgtgatttcaaggccatagctaattttcaggactaccatggtctgccgaaattcagaaaagctgtggctaaattcatggcaagaacgagaggaaatagagtcacattcgaccctgaccgtattgttatgagcggtggagcaactggagcacatgaggtcactgccttttgtttggcagaccccggcgaggcatttttggtccccactccttattatgctggattcgacagggatttgaggtggagaacgggcgttgaacttgttcctgttaaatgtgaaagctcaaatgatttcaagttaacaaggaaagcgttgcaagaggcgtacgagaaaggcaaagagaacaacataagaataaagggcttgctaattaccaacccatcaaacccgttgggaaccatcatggaccgagaaactctaagaacagtggtgagtttcatcaatgaaaaacatatccacctagtaagcgacgaaatatacgctggtacagttttttgccacccaggtttcacgagcatcgcggaggtaatagaggaagacacagacatcgaatgtgaccgcgaccttatccacattgtttatagtctttcaaaggacatggggttccctgggttcagagttggcatcatatactcttacaacgacgcagtggtgaattgcgctcgcaaaatgtctagctttggattagtgtccacacagacccaataccttttagcatcaatgctttctgatgatgagtttgtggaacggttccttgaagagagtgcaaaaaggcttgcgaaaaggtatggggttttctgtaggggacttgcacaagttggcataaagtgcttggcgagcaacgctggtctgtttctgtggatggacttgcgtcgtcttttgaagaagccaacttttgaggccgaaatggaactgtggaaagtgatcattgagcaagtgaagatcaacatctcccctggctcttcctttcattgttctgagccagggtggttcagggtgtgctatgctaacatggatgatagaaccgtggaagtttctctggcgagaatgcgcaccttcgtgaatcagaacaccgaagccaagaaatcttgcagccagagaaacttgaggctgagcttctcgttcagaaagatggatgagtacttggtgtcacctcactccccttttcctcaatcacctcttgttaaagcctccacttga

SEQ ID NO: 73180 - DNA, 942 bp, Glycine max
  Peptide Sequence Number=SeqID_164865
atgaacggtgctcccaagcacgaacgccgctgggcgtccgacaccgtgccggagatggcattcgtcagcgccgggacttcgccgggaactgagtacaactccgtcaccgacgagtacgttgaggtcactctcgatgttcaagacgatcacaccatcgttctccgcggcgttgagccggtgactgtcgttaacgtcgacgacggcgtcgccacaagcggaaacgaaactccggcgtcctctgcgtggtcgccgtccatcaggaggagctctcccaaccggtggcggcagttctcgcaggagctgaaggccgaggcggttgcgaaggcgaggcagttctcgcaggagctcaaggcggagctgcggtggttctcgtggagccaaggcggatctgaagcggcgttggtagctcgagatctcaggaagcagcgcgctcagcttgaacgcaaccgttcggatacgaagaaagcgctccgtggactgaaatttattagcagtaaatccaatggcgttgacgcctggaacgaagtgcaaagcaatttctatagtctagccaaggacggttatctgtatcgcactgattttgcgcaatgcatagggatgaaggactctaaggagttcgctctggaactattcgacgcgctgagtcgtagacggagactgaagtttgaaaagatcagcagagacgagcttaacgaattctggtcgcaaattaccgatcaaagctttgattcgcggcttcagatattcttcgacatggtggacaagaatgaagatggtaggatcatcgaagaagaagtaaaagagatcattatgctaagcgcttcagcaaataagttatccagattgaaagagcaggccgaggaatacgcagctctgatcatggaagagttagaccctgaaagacttggctacattgaggtgggaattctctacaaacgataa

SEQ ID NO: 73181 - DNA, 645 bp, Glycine max
  Peptide Sequence Number=SeqID_164866
atggattgggatttacaagctattgtgggatgcaccaaagcccctgcagccaccgtgatggacaactcgcatctcatgttttttcaacatttatgtcctgaagaacaagatgacctacttttcaattttcaggaattctcggaaaccacaacggtggttgatgagttagaagagctttacaaacctttctaccctcctcatgttcatgttgataataacaaccctcttcccatcgttgcaaattccctacctatccccgatgaagaagtcaaagaactcaaaccatcacacaaagcagcatctagatgtaaaaaaagcaagaagcagcagaagaataagagggtggtgacagcagcagatggtgtttcggacccatgggcatggcgtaaatatgggcagaaaccaataaaggggtcagcttatcctcgtagctattatagatgcagcagctccaaagggtgtttggctaggaaacacgtggaacggagccagttggatcctggagttttgatagttacctacacagcagaacacagcgatcctcaccctacatgcaaaaactcacaacaaaggaacaacagttccacaaccacaattgcacctgcaactccaagaactcatgatggcggaggctatcgaagatga

SEQ ID NO: 73182 - DNA, 1455 bp, Glycine max
  Peptide Sequence Number=SeqID_164867
atggctagtcacattaatggactagccatgatggatggaaagttaatgagttcctcggcaaataattatgactatggagatgctcttggcaaagccatcttgttttttgaaggacaacgctcggggaacttgcccgccacccaaagagtgaagtggaggggagactccgctctctctgatggcaaacttcaaaacgtggatttgattggaggatattacgatgctggagataacgtcaagtttggatggccaatggcatttacaactagcttattgagttgggctgctgtagagtacgagagtgagatatcttcggtgaaccagcttggttacctccacagtgctattcattggggcgcagactttatactgagagcccacacttccccaaccaccctctatacacaggtgggagatgggaacgctgatcacaattgttgggagcgcccggaagacatggatacagcaagggcagtgtacaagatagatgctaattccccgggaactgaagccgcagctgagtctgctgctgctcttgctgctgcttcaattgtcttcaagaaaatagatgccaattattcctccacgctattaagcaagtcaaaatcactgtttgattttgcagacaagtataggggttcttactcgggttcttgtccattctattgctcgtactcaggttaccaggcgagtggagaaagcaagtacttgagttactccataggcaaccaaggttggagtcaggcggtgtctgaattcagctgggataacaaatatgttggagctcagacattactaacggaggaattctatggtgggaagaaagacttggccaagtttaagagtgacgttgaatcatttatatgttcagtgatgccagcaagtagctctctacagattaaaacaactcctggtgggcttctatttactagagacagcagtaatttgcaatatgccacgagctcaaccatggtgctattcattttctctaaaatcctaaacagaaatcacattgatagaatacattgtggttctgcgcttttcaccccgtctcagattagagcctttgcaaaaacacaggtggactacatactaggaagcaatccgatgaagatgtcttacatggtgggatttggcagtaaatacccaaagcaattacatcacagaggctcatccatcccttcaatcaatgttcatccgaccaaggtgggttgcaatgatggtctctcagtttattacaattctgctaatccaaatccaaatactcatgtgggtgcgattgttggaggccccgattcaaatgaccgattcagtgatgcaagatctgactattcccacagcgaacctaccacctacatgaatgctgctttcgtggcttcagtgtctgctttgcttggcaaaacgaccgatcgaaaccaaattcaggactctgcagtttccccatatcgatgctag

SEQ ID NO: 73183 - DNA, 1374 bp, Glycine max
  Peptide Sequence Number=SeqID_164868
atggcttgcgaagtgccaataaaatccatgatgtccagcgcagtcacactcctgacgccgcgccacgtggcagtgatcggcgcgggcgccgccggcctagtggcggctcgggagctccggcgagaagggcatcgcgtggtggttttcgagaaaggggaggaagtgggtggcatgtgggtgtacagtccggaggtggattcggatccgctgggtttggaggcgaagcggagattagtccactcgagcctctacgattcgctccgaacgaatctgtctcgggagagcatgagtttccgagattaccctttcaggaggagggaggggaaagggagggattctcgaaggttcccgggtcacagagaggtgttactgtacttgcaggatttcgctgctgaatttgaaatcggagaattggtgaggtttggaacggaggttttgtttgctggattggatcagtgtggaaagtggaggctgacttcaacatcaccccatactcatcctgtggatgagatttacgacgcccttatcatttgcaacggccattacgttcagcctcgtcttcctcatatccccgggattaatgcatggccagggaagcagatgcatagccataattatagaacacctgagccctttcaagatcaagttgtagttctaattggtagttctgctagtgcggttgatatctctcgagatatcgcaacagttgctaaagaagtccacattgcagctaggtcagttgaagaagataagctaggaaaggtgcctggccatgagaatatgtggcttcattctatgattgacagcgttcatgaagatggtacagtggtttttcaagatggaaatgcagttggtgctgacttcatcatacattgcacagggtacaagtatgattttcccttccttgaaaccaatggggaggtgactgtagatgacaaccgtgtaggaccactctacaaacatgttttcccaccagccttggctccatggctttcttttgttgggttgccttggaaggttgctcccttctccttgttcgaactgcagagcaagtggatagctggaatcttgtctaatcgcattgcacttccttcgaaagaggagatggctaaagacgttgatgctttttactcatcacttgaagcctctggcactcctaagcgttacactcataatatgggcattcttcagtgggactacaataactggattgcggatcagtgtggggttccttctattgaagaatggagaaggcaaatgtatatagccacatctaagaacagggtgctgcgacccgagtcttaccgtgacgagtgggacgatgatgacttggttctgcaagctcaacaggattttgccaattatctcacttga

SEQ ID NO: 73184 - DNA, 657 bp, Glycine max
  Peptide Sequence Number=SeqID_164869
atggcaaagtccttgtcaagtccgtctccaaacaaatataacatgacaacagaggaagtgatcaccatgttcccatcacgcaaagaagaaaaacaaagcagcagcaagtgtttggtgtatgctttggttgtccttgtagccatattgttcatttggcttgtttttgcatctatcgtgttgcgcgtggttgatccccagattcagttgaaatcagctagattgatgcacaacactaaaaatcatagtttttcatcaacttcttccttgaacgtgactatgattgctcgtgtgtccctcacgaatccaaacttgttcggtcgcttctattacgggaacagtagagtgagtgtgctatatggggcttctatagttggtgcttgggaattggaaggtgcgagattggagggtagagaaaccaaagaaatcgatttcatggttcacatgaggttcagcactaagctattggtaataatgagaaatctaaccaatgacactgcccactctgactctgcaggcatgcttaaactcagaagctacgcaaaattaagtggtacagtgcacgtgctgaacatggtaaataagaaaaagaccttaggaatggcttgtattatgaatctcaacctgacctcatattccacacaacatttccaatgctaa

SEQ ID NO: 73185 - DNA, 585 bp, Glycine max
  Peptide Sequence Number=SeqID_164870
atgaagacaacttctggaggaggaggaggagtaggagcagcagaaagtgataacagaactgccaccgtgggaattgaatttaccaaagacaagaatggaatatccctactcgttcttcgaaaccaccgtggagcttcagcaactgttagtttgcacggaggccaggttctttcctggaaaacagaacttggtgaggagttactcttcataagtaacaagccatcaataagagacaaccttttacttactcttgatagtgaagtgagggtagaagggttggaaactcttgactacctggacaacctgtaccagagagaacgcttcacagaacaaggagattctctgacatttgaatcagaggtagaccgggtctattttgattctagcaatattgtaattgttctagaccatgaaaagaagagaacatttgtgatacgaaaggaaggacttccggatgttgttgtttggaatccttgggaaagaaaatccaagtccatattagatttaggggatgaagagtacaaacagatgctatgtgttgatggtgcagcagttgaaaaaccaaatcaccttgtggccaggtga

SEQ ID NO: 73186 - DNA, 1263 bp, Glycine max
  Peptide Sequence Number=SeqID_164871
atgggtgttattatgtggtgtgatgatgacgaagacaatgacaacaattgcggtgacaatgtcatcagtggtgatggtagtgtctgtgatgactataatggtgttgccaatgcgagtgctgaaggtggtggtgacaacaacaatgacagtgatgataacagcaacaatgacggtggtgattgctatagtggtgggaatagaaagatcattaaacacatcctaatggcagagcgcggaggtggcgatcgtggcggcgaccgtggcggtttcggacgtggattcggcgggcgaggacgcggaggtgacaggggccgaggccggcgccgaggcccccgccgcgaggaagaggagaagtgggtcccagtgaccaaactgggccgcctggtgaaggagggaagaatccgaagccttgaacagatctacctccactcgctcccgatcaaggagcaccagatcatcgacacgctcgtgggtcccaccctcaaggacgaggtgatgaagatcacgccggtccagaagcagacccgggccgggcagaggacccggttcaaggccttcgtcgtcgtcggagacaacaacggccacgtcgggctgggcgtgaagtgcagcaaggaagtggcgacagctattcgtggcgcgattattctggcgaagctgtctgttatccccgtgaggagggggtactgggggaacaagatcgggaagccccacaccgtcccgtgcaaggttacggggaagtgcggctccgttaccgttaggatggttcccgcgccgagaggttcggggatcgtggcggctagggttcccaagaaggtgctgcagttcgcggggattgatgatgttttcacctcctccagaggatccaccaagaccctcggcaacttcgttaagactacggaattcatgtatagttctactgttctaccttttgcctgtgtttctaacttagaagacagtctactcttcaagagaggcactatttctcaatgtaagttagtctatggtgtctttgctgcaattgaaggcattcaaaatgcatcatggatcacttgtgtgatttgttactcgtgtgtctatgtgcatgatcctttgttagagaggccagctacttttgattgcttgatgaaaacctatggattcctgacaccagaattctggaaggagactcgcttctccaaatctccattccaagagtacacagatctactggcaaaaccaacaggaaagactctaatcttggaggaggaaagggtggatgcttga

SEQ ID NO: 73187 - DNA, 870 bp, Glycine max
  Peptide Sequence Number=SeqID_164872
atgactgcgccaccgacgaagtacactcaccacaccaaactactcataccccccgaagaagacccacccaaacaccattatcccagactcgtcagaataaccgtcactgacaccgacgccaccgactcctccagcgacgaagaagaagaacaaacataccactgcaactcttccacgcgccaccgacataggaagttcgtcaatgagatttctatcgagtcgtgctccagcgagaacgacggcgtcgtttcgaggaagcgaattcgaagaagaagcaccactacgcccaaagcgacaagagcttcagacactcggcgcgtgtccgacggtaagaaattccgcggagtgagacagaggccgtggggaaaatgggccgcggagatacgagacccagcgcgacgcgttcggttatggttgggtacctacgacactgctgaggaagccgctttggtgtacgacaacgccgccattaagctgcgtggaccccacgcgctcaccaatttcataacgccaccttccggggaggaaactcattgcaatagcaagaatatcttttctcccacttccgtgcttcactgttgctccttgtccgaggaagctgagtccgttacggccaaagacgatgactactcctcggtgtcggagaataaggtcaaagctgagtcagcgtttccgcccgaaatagattttgagtttcgagcttgttcgactgtgccggagagtctgttgttctgcgatgatgattggtctagtgagtttctcaattcttatgaagatttcggtttcaaaagttggcatacggacagaaatcgtgactttttccaagatatcgacgatttgtttgtctcggatcccctccttgctctctga

SEQ ID NO: 73188 - DNA, 315 bp, Glycine max
  Peptide Sequence Number=SeqID_164873
atggcgtccaaccgaagcagcagctgggctcgcggtgaaggagaaggctcgcgaagaggtatgcaaaggaagaacgagaaggctcgcggaagaaggctcgcggaaggaagaaaagcagaagcaagaagaaggcttagtgattccgggagaggagaagaaaactatttcaatattttaaacttttttaatgaagggaagggagtacgagcccatgagaaggtcaacaaaaacgaaaggaagcataagaataggagaatgctagtggaggaaccaagccctttctccattgtcattgttaactgcatggaattctaa

SEQ ID NO: 73189 - DNA, 1027 bp, Glycine max
  Peptide Sequence Number=SeqID_164874
cagggaagaggaaccagttattttcggtgaaaagtacaccggaaagtttttgcctaaagaaatcatggagggaatgcgagacacaaagtcacagcttgaaatccaagaccaagagggtactaatattgggtcctctttgtcaaagctcatattagcaagtggcagtggcacaaacacccttgactcaattttctccaattgcccacaaacaacaaatggcagcactagtagcaactccgtgttagatgatttagaaccctttaggtcttcggggtgtgagtctttaggctcttccgtgtacctccgccaaagggacatcctccaaaaattctaccaagaaagccgaggaaatgggaacaataacgggtcttataatattcccagatccttggcaaatacgtctataaactctgtttgcaggagttcttcgttgagttgttattcgttgacgaagccttgtaagaaaaagctgtacaggggagtgaggcagaggcactggggaaaatgggtggcggaaattagactccctcagaacaggatgagagtgtggttgggaacctacgacaccgccgaagctgctgcctacgcctacgaccgcgccgcctataagctccgtggagagtacgcgcgcttgaactttcccaatctcaaggaccccaccaagctgggattcggtgactctgcgagattgaacgccttgaagtcctccgtagacgccaaaattcaagccatatgccagaaggtcaaaaaggagagagccaaaaagaatgccaccaagaagaagcttcatgatagttcgggcagcactgaccctaatggcgggcagaagatcaactcctcttcttgctcttcgtcatcgctgtcgcagccgttgtcgccaccttcgattttttacgataattgggcgaacgatttgttctcgccggcctcggtttcgacggagtgtcaatcaatggaaacagaggagttgttcgaaggttgttctctggctagattgccttccttcgatcccgagttgatttgggag

SEQ ID NO: 73190 - DNA, 90 bp, Glycine max
  Peptide Sequence Number=SeqID_164875
atggctgatgccctttatatggtctacaatttggaagcaagggagagaaagtcatggctcatgaagcatgccccggaacctcaaaaataa

SEQ ID NO: 73191 - DNA, 2592 bp, Glycine max
  Peptide Sequence Number=SeqID_164876
atgggaagccacaacacaacaaccagctcctcgtctgattctgaactcccttgttctaattatattccgttacccgatggaacccactttcccgcagaagaagctccaagagagctgcttgtgatcttttgtgggttgctggtgcttgtgtccttggtggccttcaatggctacagggcgcatccaaatgatcatcatcacgtgtcgtcatcattgccaacaacgttgttaacagtaacacccaatgaattggaactgagccccgatacagtaccatgttcaacatcggagacgacggtttcacgtggcttgtctgcaggggtttcggagaagtcaagctggcaattgaacagcaacaatgggagcggggaatcgtatccatggaacaatagcgtgctgtcatggcagagaacagcttaccatttccagcctgagaagaattggatgaacggtccaatgttctacaaagagtggtatcacttcttctatcagtacaatccaaagggtgcagtttggggtgacatagtttggggacacgctgtgtcaagagacatgatccattggcttcaccttccactagcaatgatggctgatcaatggtatgacaagaacggtgtgtggactggctctgccaccattttacccgatggtcaaatcattatgttgtacactggttccaccaacgaatcagtgcaggtgcaaaaccttgcataccctgcagacccctctgatcctctccttgttgattggatcaaataccctgcaaatcctgttctattcccaccaccaggcattgatgccaaagattttcgtgaccccaccactgcatggctcacctctgaaggaaagtggcgcatcagtattggttccaagcttaacaaaactggcattgccttggtttatgataccattgactttaagacctttgagcatgtggagggagtgcttcatgctgtgccaggcactggcatgtgggagtgtgttgacttcttcccagtttccagcaagggtgaaaatggcttgaatacttcaatcaatggggagaatgtgaagcatgtcgtaaaggttagcttggatgatgatagacatgattactatgcacttgggacttatgatgagaagaatgttaagttcacaccagatgacttcaagaacgatgttggtattggactcagatatgactatggtatattttatgcatccaagacattttatgatcagagtaaggggaggagagtgttgtggggttggattggagagtctgatagtgaatatgctgatgtggctaaaggttgggcatcagttcagggtattccaagaacagtgacacttgataagaaaactggtagcaacttacttcaatggcctgtggcagaggtagaaagtttgagactgagaagcgaggaatttcaaaatttgaaggtgacgccagggtcagtggtgccactagaaattggaacagctgcacagttggacattgtagctgagtttgagatagataaggaagccttggaaaagacaggccaatccaataaggagtacaagtgtagcacaagtggtggagcaactgaacgtggtgccataggaccttttggtcttctagttttggcagatgatgatctttctgaatacactcccacttacttttatgtcgtcagaggaagcgatgggcaacttaaaacttccttctgctccgatcaatcaaggtcttctttagcaactgatgttagcaagaaaatcttgggaagcttagttccagtactaaaagacgaaaaattgtctgtaaggatactggtggaccattctatagtggaaagttttgctcaaggtggaaggactcctttcccgtcgttgtgtgccaaattaactcaaacagagatcatcgtcaagagtgttgccaatgcagaatccacaaaatggggaaaagtggtttcggccacgttggcggctgctgttattgccttcagctctgacatgtctgcccttgctgatctcaacaaatttgaggctgaaatgaggggtgaatttggaataggatcggctgcgcagtttggctctgctgacctcaggcttgttctgaaagcggtgcatgtcaatgaaaatttcagaagagccaatttcacagctgctgatatgagagaatctgattttagtggttcaactttcaatggtgcataccttgagaaagctgttgcatacaaggcaaacttttcaggtgctgatttaagtgatacattgatggatcgcatggtatctacatcaagtctaaaggttctaaatgaagccaatctcactaatgccattctccttagaacagtcctcacacggagtgaccttgggggagccatcatcgaaggtgctgactttagtgatgctgtgttggatcttcctcaaaagcaggcgctatgcaagtatgctagtggcacaaatcctgtgacaggagtaagcacaagagtaagcttaggttgtgggaacaaacgacgaaatgcatatggctccccgtcatctccccttttaagtgctccaccacagaaactgcttgaccgagacggtttttgtgatgatgcaacaggactttgcgatgcaaagtag

SEQ ID NO: 73192 - DNA, 645 bp, Glycine max
  Peptide Sequence Number=SeqID_164877
atgaaactagcctggtcaccagaaagagcatccaaagcatacatccacacagtccaatcttgtcaggttttccgcgaatcaggagcggcggagtttatttcggccatggcggcggggtggaactcgcagctcatcgtggagacgtggtcgcagggaggagttattgccaccagcgtgggattagccgtggcgaggtctcacacgtgcggacgacacgtgtgcgtagtttccgacgagcgggggaggtcggagtacgtggagagaatgggcgaggcgggcgtaacggcggagatcgtggttggggaaccggaggatgtgatggagggtttggtcggcgtagatttcttggtggttgattctcgaaggaaggattttacgcgtgtgctgaggcttgcaaagttgagtaacaaaggtgccgtgttgctctgtaagaacgcgaattcaaactccaagggttttatatggcggagcctcgtggcgaaaggttcttcgcggcgtcttgttcgttcggcgtttcttcctgtggggaagggacttgacatggcacacgtgtctgcctctggaggtaataatagcagctcggggcatagatggattaagcatgttgatcaacattcaggggacgtgcattttattcgaagatga

SEQ ID NO: 73193 - DNA, 369 bp, Glycine max
  Peptide Sequence Number=SeqID_164878
atgacaccacaccttcttgttacacgacaaacaaaaagtcccagggataatgcatatcatcgaaagtcagttgctgctagtttggtccaatgtgtttatgttctagagaaggacaggcaagaacagcgtgaaggttctgatgctcttgcactgccttggtgggcgttctttcacattcagttgcttcgtacacttgttgttgatgttgatgcttccatctttgctgccattcatgagttcaagcctccatcatctatgtgcaatgacaccttacgtagaggtccacgttatgtaattgccttccgaggaactataaccaaggcaggctcagtttcctgtgacattgagttggatatcaactttgtgtga

SEQ ID NO: 73194 - DNA, 192 bp, Glycine max
  Peptide Sequence Number=SeqID_164879
atgatgagtgaatggaacaagacgagaatgaaatctggagtgaagattggcatcggtgacggtggagagggtggaggaagtggcggcactcatggcggtgctgcgagtgttgagttcggtctgaaaatatggtgctggcaaattgtggaactcggaagtgcagacacgaaaggtttcagacttgagagctga

SEQ ID NO: 73195 - DNA, 2871 bp, Glycine max
  Peptide Sequence Number=SeqID_164880
atggttttttttgtcaattttttggtgaaaaatagtggtaaaaggaaaagagggtgctacgacgccgttctgtgtattatccttccccttccccggtcagcggtgttgttttgttcggaatctgaaatcggaaattggaagcagaagaatagtcttcagagaagggtaaaatcgatgagtaggaacgattccaagtacttctccaccaccaagaagggtgaaatccctgagctcaaagaagagctcaattctcagtacaaggacaaaagaaaagatgctgtcaaaaaggttattgctgccatgactgttgggaaggatgtctcatcattgttcactgacgtggtgaattgcatgcaaacagaaaatttggagctaaaaaagctagtctacttatatctgataaattatgcaaagagccaacctgacctagcaatacttgcagtgaatacatttgtgaaggattcacaagatccaaatcctttgatccgtgccttagctgtacggacaatgggctgcattcgtgttgataaaattactgaatatctgtgtgatccccttcaaagatgcctaaaggatgatgatccatatgttcgtaagacagcagctatttgtgttgccaaactttatgacataaatgcagagttagtagaggacaggggctttttggaatccctgaaggatttgatatctgataataatccaatggtggttgctaatgctgtggcagcacttgccgaagttcaggaaaacagtagtagacccatctttgagatctccagtcacacactgtcgaagctccttactgctttaaatgaatgtacagaatggggtcaagtttttatattggacgctctttctagatacaaggcagctgatgctcgtgaggctgaaaacatagtagaaagagttactcctcgcttacagcatgccaattgtgcagttgttctatcagctgttaagatgatccttctgcaaatggagcttatcaccagtactgatgtggttcggaatctttgcaaaaagatggcccctcctcttgtgacattactctctgcagaacctgagatacaatatgtagcattgcggaatatcaatcttatagttcaaagaagaccaacaatacttgctcatgaaattaaggtgttcttctgcaagtacaacgatcccatctatgtaaaaatggaaaagttagaaattatgataaaactagcttcagaccgaaatatagaccaggttctattggaatttaaggagtatgctactgaagttgatgtggatttcgtaagaaaggctgttcgagcaattggtcgttgtgccatcaaattggagagagcagctgaacgatgcattagtgttttgcttgagttgataaagataaaagtaaattacgtggttcaagaggcaatcattgttatcaaagatatatttagaagataccccaacacatatgagtccataattgcaacactttgcgagagcttagataccttggatgagccagaagccaaggcatcaatgatctggataattggtgaatatgcggaaagaattgacaatgctgatgaacttcttgaaagtttcttggaaaatttcccggaagaacctgcacaagtccaactacagttgctgactgctactgtcaaacttttccttaagaagccaaccgaaggcccacaacagatgattcaggttgttttgaacaatgctactgtggagacagataatcctgatttgcgagatcgtgcatacatatattggcgtctcctttcaactgatccagaggctgctaaggatgttgtgttagctgagaagcctgtgataactgatgattcaaaccaacttgaaccttctctacttgatgagcttcttgccaacattgctacactatcttctgtttatcacaagcctccagatgcttttgtaactcgtgtgcattcagctcagagaacagaagacgaagactatgctgagggaagtgagacagggttttctgagtcacctgcaaatcctgctaatggtcctgcatccccacctactgccaggcaatcagcacctacatctgcaataggtgcaccagccacacctccacctgttgcacctgtgccagatttacttggagatttgatgggcatggataattctattgttcctattgatcagccagctactcctactgggcctccattacctattttactacctgctgcaactggtctgggtttacaaattagtgcacaactgactagacaagatggtcaaatattttatagtttgttgtttgagaacaactctcaggttccacttgatggcttcatgattcaatttaacaagaacacatttggtcttgcagctgctggaccccttcaggtttcacagttgcaacccagaatgtcagctaggacactcctccctatggttatgttccagaatatgtcgcaaggtcctcctagctcagctttacaggtcgctgtgaaaaacaatcaacaacctgtgtggtatttcagtgataaaatctcattacttgtattcttcaccgaggatggtagaatggaacgttccagttttctagagacatggaggtcccttccagattcaaacgaggtttccaaggacttcccagccattgtgattggcaatgcggacgcaacactggaacgactggctgcgtcaaacatgttctttattgcaaagcgcaagaatgcaaaccaggacgtgttttacttctcagccaaactccctagagggataccattcttaattgaacttaccacattgattggaaaccctggcgtcaaatgtgcaatcaagactccaagccctgaaatgtcagcacttttcttcgaagccattgagactcttctcatgggttaa

SEQ ID NO: 73196 - DNA, 309 bp, Glycine max
  Peptide Sequence Number=SeqID_164881
atggatagtgctgagaaggtttttgttaatttgaatcttcacagtgtagtttcttggaatataatgatagctgggtatgggaacagatgtaacagtgagaaagctgcagagtatcttcagagaatgcagtgtgatggatatgaaccagatgatgttacttatgttaacatgctgactgcgtgtgtcaagtccggggatgttagaaccgggcgtcaaatatttgactgcatgccatgccctagtttgactttgtggaatgctttactctcaggctataatcagaaagcggatcatagagaggaagtttaa

SEQ ID NO: 73197 - DNA, 447 bp, Glycine max
  Peptide Sequence Number=SeqID_164882
atgggaagctccaaagttcaaaggctttccgggatgcaaaagcaagtacttagcctatacagagggtttctgcgtgcagcacgttccaaatcggaggaagaacggtgcaagatagagtcaattatatcgcaagagtttcggcgtaatgcggaggatgtagatcgcaaaaattttctctacattgagtacttacttcgccgtggcaacaaacaacttgatcagcttaaaaaccctggtactacagggttatcttcgttgcaacttcattactctcacccttcaacccaaaccctctctcttcaatcccgatttctctccagcgacacctatctcctccctccccagcgacacgtcacctccttgaccaccactgttgtctcatcgtcaccctacaccaccggaattgcaccaccaccccaaaaatgcatgcgaccaagtggatcttga

SEQ ID NO: 73198 - DNA, 888 bp, Glycine max
  Peptide Sequence Number=SeqID_164883
atgcatagacctggctcattttaccaagttcccaagaaatcatatgcctcaaatggtcccttcacgagagtgacatccaacaatggtgactatctcatgaagctcacattgggaacaccaccagtggacgtgtatggtttggttgatacagacagtgatcttgtgtgggcacaatcgtgcgattatgtttatgcttatgctgatgattcagcaacaaaagggatgcttgcaaaggaaattgccacatttagttccaccgatggaaaacctattgttgaaagcattatatttgggtgtggacacaacaacacaggggtttttaatgaaaatgatatgggactaattgggctaggtggggggcctctttcacttgtttcacaaatgggtaacctttatgggagcaaaaggttctctcagtgcctggttccttttcatgcagaccctcacacttcaggtaccattagtcttggtgaagccagtgatgtttcaggtgaaggagtagtcacaactcctttggtctctgaagaaggtacaccagaaacatatttaccacaagaattttatgaccgactagtggaggaattgaaggtgcagattaacctaccacccattcatgttgaccctgacttgggcacacaactttgttacaaaagtgagacaaatttggaagggccaatcttgactgctcattttgagggggcagatgtgaaattgctgccattacaaaccttcatcccaccaaaagatggtgtattttgctttgcaatgactggcactactgatggcttatatatatttggtaattttgctcaatcaaatgttttgattgggtttgatttagataaaaggattgttttttttaagccaactgatttcaccaaaccgtag

SEQ ID NO: 73199 - DNA, 174 bp, Glycine max
  Peptide Sequence Number=SeqID_164884
atggaagcagagaatgttggccatgaagtttggcaagggacaaagtcatcaaagggttcaagacccaacattactgagagaacctggagaaacatacaacacaacagggacattgtgaatagcacttgtagacttgtagaagtggcaccgttaaataagtttatagttccttaa

SEQ ID NO: 73200 - DNA, 1869 bp, Glycine max
  Peptide Sequence Number=SeqID_164885
atggctgaaaaagaatgcatagggtcatatgatggtttggtaagaacagaacatagagcaacaaaggaggcaagaacctcccttgatagagaagaaacagagttgtacaactgggagaaagggttctgggtgaaatgcaacacaagagatgcaagcctggaaggcaggcccaatgggctaacatatgaaaatagatttttggttatggtgattcgtgatttattaaatctatgtgaaatcacaaagggaaaagataacaaagctgttattgcaagtaatatcatgtatgttgtggggcagtatccccggtttttaagagctcattggaagtttctaaaaactgttgtgaacaaattgtttgagtttatgcatgagtcacatcctggggttcaggatatggcctgcgacacatttctgaaaatagtccagaagtgcaagcgtaaatttgtaatcacccaggttggagaaaatgagccatttgtttctgaacttctatctggccttccaaatacaattgctgatcttgaaccccatcaaatacacacgttctatgaatctgttggtaacatgattcaagcagagtctgatgcccagaagagagatgaatatcttcaaaagttgatggtgctcccaaaccagagatggatggaaattatagggaaggcacatcaaaatgctgattttctgaaggatcaagatgtaatccgaaatgtgcttaatatattgcagacgaatacgagtgttgcatcatctttaggaacatatttcctgccacaaatcacattgatctttttggacatgttgaatgtgtacagaatgtatagtgagcttatatcaaaaagtattgcagaagggggaccttttgcatctagaacatcctatgtgaaacttctacgttcggttaagagagaaacacttaaactagttgagacattcttggacaaggctgaagatcaaccacaaattggaaaacaatttgtgccaccaatgatggatcctgttctaggagattatgccaggaatgtgcctgatgcgagggaatcagaggttttgtcactttttgccacaattgtaaacaaatataaagctgccatggttgaagatgtcccacaaatatttgaagctgtattccagtgtacactggagatgattacaaaaaattttgaagattatccagagcatcggctaaagttcttctctttactgcgtgctatagctactcattgtttccctgctttgatctgcttgtcaagtcagcaactgaagcttgttatggattcaataatatgggcgtttcggcatacagaaaggaatattgctgaaactgggctgaacctgttgttggagatgttgaagaagtttcaggcatcagagttctgtaatcagttttatcgaacatactttttgacaattgagcaagagatatttgctgttctgacggacacttttcataagcctgggttcaaatttcatgtcttggtgcttcaacatttgttctgtctggcagaaactggtgccctaaccgagcctctttgggatgctgctacaaatccgtatccatacccaagtaatgcagcttttgtacgcgagtttactataaaccttttaagcacttcatttcccaacatgactgcttccgaggttactcaatttgttaatggacttttggagtccacaaatgacctccccacatttaaaactcatatacgagattttcttgtacagtccaaagaattttcagctcaggataacaaagatctttatgctgaagaggctgcagctcagagagagagggaaagacaaagaatgctttctattccaggacttgttgccccgagcgagttgcaagatgaaatggttgactcatag

SEQ ID NO: 73201 - DNA, 432 bp, Glycine max
  Peptide Sequence Number=SeqID_164886
gggaatttggggccactgtttagccatgatgttggaattataaagggagtaaagaagacaatgttgctgatgggtctggtggaagtgtttaattttccgttggcagtttgtggaggcatagttagagggacagcacgaccctggttgggaatgtacgcgaatctaggtggattttatttcctggccctaccacttggtgttgtttctgccttcaagctccgtcttggtcttgttggactcttcattggacttcttactggtattgttacctgcctgacattgttattggtatttattgcgcggttaaattgggtggaagaagctgcccaggcacaaacactaacaggccaagagcagttattatcatcttcatctaaccaagtttatacgtatctccaaacaccagggcacgatgaaaaagacatggcttaa

SEQ ID NO: 73202 - DNA, 2994 bp, Glycine max
  Peptide Sequence Number=SeqID_164887
atggatccttttgatgatattctaccaacggctcctgctgcacgtagtaagtgccttggttccaatgatactggaactcggctgggtgccaagtttattccaaaggccaaatcgaaacagtttcctcgaaagggaataccagcatcagaacattccacctcatctaaagatggaattttgggaaatgaatgtcaaaatgcagttgcttcagctttaagtatgccagcggaagaacctaaggggtccgttcatcatacacaggtagaaattccaaattcagaggattccacaaatcgtaaacaagttagtgtgaaaggagatagtgcagccttggtagatgattccacaatcaccgcaactgaagttgatgctgatcagaaatctatgaactttttaaaaccaatatgtgaggttactgagggagatccagtatattttgagggggcctcagtcactagcttcgttcctgagactaacctcaataatggcacaacacaaccagttcaccctgctaatgctgtagaaaatgaatttaatgtggctgctccatctgcaacatgctcagccatagataggatgaaagaacaacctaaaattggggaaggttcatttcttgatagcaacaagcttattgacaattcaatccaagttggcacggatttgggcttccaaggttcttcagatgataagattgcaataattcagagcaactttgattcaaagtcaaactttggaaaaaaacaagagggagtatctgcagaatttgaattggatcctttcagcaacatactcccttatcctggtgctgggaatgttcataaatttaaacccaagattaagccacgacctagagttagcaatgtgccagcaattgcttctgattcatctaatgttatgatggaaaaatctgttgaattgcctacatcttgcacaaacgactttcaattttttcagtcttgtggtgatggcagtggtggactaaaccaatcagccagtttacctttgccaacatcagagattcttaggacaactgaattacctgataagtttgatgatactagctcaagtattctctctgaagacaataagagcttggcagctgcaattccttcccaactggattccctaaatgccatgctttcagaggatgcagttcataatggaactacagattggccttctagctttggtaaatcatccagagaggctgcagacattttttctgggctggaatcccttgatgattttctcacccaggctgccactggtacagagcgtcacttgtattgtgccgctgccttaaatctcactgttatggttgactggctcccagccaactcccttcattcttttaatgggaagggtggagaggaaaattttgtcacacctgcttctagttccattaactcttttggggaatgtgatactacccaagttcaaaggtgtcccgagtatcatactcctcaagattcattaaccttcaatgaagctgcagtcttcaatgaggatgatattcacactagcaataggaggttggaaacagaggaaattgtggacttgaatcctgcctgcccaggtgatgatgtgattgattatcaatccatgaaatctggcgaagatccaactttgggaattccagtgcatgaagagttgacaaatgctgcagatagtcccacattggttgattttttgcatgcagatgttacaagggaaaaagaagattccaataagagaaaaaaggatggctcaacatcatgttctctaaggaagaacagaagatgtattgctggtgaggaggataaaggtgctaaaacctcaaggcagctgagaaaacaagcagctcgtaaacctgtaaacagttcactcaatgaggatgttgaagataataatgaccttgacccttcttataattctaatggagatgaacttcaagaaaatgatgacgagtatgaagttgattatccatccaggaagagaagagtatcaaatagttcacagaagaaacctgtggctaaaagtggaaaaacatctcaaaagcctaagaaggctaatgatgatttagaaaaaactgaggaacctcccaaaaagttctctcattcaacccgacgaagaaaaagatgcgtggacaaggctctgctggaaattcctgaggatgaacttgatcgtctaaatatacctattaaggatattattttacttgaagaacatagggagcggctggcgaaaaaagaggcgatgacttcaaatacttcttccaccaaccaaagtggtggagattctcttcatgaggctggttcttataatgaaggggcttatgatgatggagcttatgatgatggggcttataatgatgaggagttcttaggttcagaagatggtagagacccatatgataatcaggccaatgaagggataacatcaacttccgttttactcaattaccagtctttcagggaaaagaagacacctaggggaaaatggtcaaaacaagaaactgaactgttttatgaggctgttagggagatgggaacagatttttctgtgatacaaaagacttttttccctgataaaacacggcatcaaattaagttgaagtacaagaaggaagagcggcagcagcctttacagctaaccgatgctgtaaataacagtgcaaaagatcaccctcattctaagttgtttattgaactactaaaactagcttccaccaaggcagaagaataccccggtagagatgcctcagatttggtgatggcggaggaggttgtggacctaaccgctggaactcatcataggttgtatggattgccttgtatgactatgaagcacggacactccagccccttgccgtgtccggtgtccgacacgcgtctgtgtcagtgtccgacacccacacgacacccgtactacgttctatattttggacattacaggtgtctgcgtgtccgtgtccgtgtcgtgtccggtgtccgtgtcggtgttggtgcttcatag

SEQ ID NO: 73203 - DNA, 4641 bp, Glycine max
  Peptide Sequence Number=SeqID_164888
atggcagtggttggtggcaatgatgatgataatgatgacaataacaatgatcgtggtgggagtagtgatgatgacaatgatggcaatgagaatggcaaaataagggagagtggttgtttagtgtggagtgaaaaagactcaatggtaaaaccaaaagtgtctactcaaccaaaaatatgctacaggcctattcgaccttctgacctggacattttagagcatatccatggcagattatttcccatcaggtacgaatctacttttttccatgatgtggtaaatggacgtgacattgtgtcatggggagctgttgacagcagtcggccggatggtcaaagtgatgaactcattggatttgtaacagcaaggattgttcttgcaaaagaaagtgagatagtggatatgcttggatatgactcagctaaatctgaccaaactttagtctatgttctgacgcttggagtagtggaagcatatagaagtcttggagtagcttcttctctgattcgggaggtcataaaatatgcttcaagtattccaacctgccgagctgtctacttgcatgtaatctcttacaataaccctgcaatcaatttgtacaagaaaatgtctttcaaaagtttttgcactattactcttaactgggatacgagtttccgaaacttttttgaggttgaacttgaactgcaaggctgtgcaagaacggaggcaggaagatcacaaggcgggcaaagtgtaaagaaagtcattctcttgtgtcagcaacacccaacaaaagaaacatggcagtcgaatgttctggctaaggagttagttagttactatgcctatgcctatggctgcttcgacttcaacttcaacttcaacctctctctccgtcgtgggaactggcctcgccttcccgcgccatcctcccgccgtattctcctctgctcgttttcacactcgattgcgcagcaacaaccgtttcttcctatcttcttctcttccaaggctgtttgtggcggcggattgggattattgcgaaggaacaagtctcgcggcggccacgctttcgtcgttggtgaaccctcgtttttgttgccgcagcatagctgtgcctcttgctgctgtcttgcgaggaaacgccgttccaatctttcaacatttgtccctggagcttttctcgataaatcctctttccgcctatctaacaataaactcaaccgttctcccgttcagattccacgtgcaactgttggtccagatgagccacatgcagcaagtacaacctggccagacggtcttgctgaaaaacaagatttaactgtatatgattctgaactagagcagatagagggctttctaagttctgaacttccatctcaccctaagttgcatcgaggtcaactcaaaaatgggttgcgttatctcattttgccaaataaagttccaccaacaaggttcgaagcacatttggaagttcatgcaggatcaatagatgaggaggaggacgagcaaggaattgcacatatgattgaacatgttgctttcctaggaagtaaaaaacgtgagaagcttttgggaacaggagcccgttcaaatgcttatactgatttccaccatacagtgtttcacatccatgctcctacgagcaccaaggcttcaattaaggcagcccctaaagaggctgcagttaaggcagggactgatcatctaagacaatttgaaagtgcacatgattctgatggtgatttacttccatttgttctagatgccttgaatgagatagctttccacccaaagtttcttgcttctagaattgaaaaagaacggcgtgccatactatcggagcttcaaatgatgaatacaatagagtatcgagttgattgccagcatctgcattctgaaaataagctgagcaaaaggtttcccattggcttagaagaacagataaagaagtgggatgctgataaaataaggaagtttcatgagcgttggtatttccctgcaaatgctaccttgtacattgtgggggatattgataacatatcaaagactgtttaccatattgaagcagtttttggacaaactggtgcagacaatgagaaaggttctgtagccactccaagtgcatttggtgcaatggctagttttctcgttcctaagctttctgttggtttgggtggaaattctattgaaagatcagccaatgcaacggatcaatcaaaagtattcaataaggaaaggcaagctgttcgtcctcctgtgaagcataattggtcacttcctgggagtggtgctgatttgaagccaccacaaatatttcaacatgagttacttcaaaatttttcaattaatatgttctgcaagagttcaaatccaccgttcacttcggtcgaattggatcacagtgactctggaagggaaggatgcactgtgaccactcttaccataactgcagaaccaaagaattggcaaaatgcaattagagttgctgttcaagaggttcggagacttaaagagtttggggttacccagggtgaattaactcgttatttagatgcccttctgaaagatagtgaacacctagcagccatgattgataatgtatcttctgttgataacttggattttatcatggaaagtgatgctcttggacataaagttatggaccagaggcaagggcatgaaagtttacttgctgttgctgggacagttacccttgaggaggtcaattctgttggtgccaaggtgttagaatttatagctgaatttgcaaagcctactgcaccacttcctgcagcaattgttgcttgtgttccaaaaaaagttcacattgagggagctggtgaaacagaattcaagatatcatcaattgaaattacggatgctatcaaagctggattggatgaacctattcagccagagcctgagcttgaggtgccaaaagagctgatacaatcaacaaagctagaagagttgaaaaagctgcgcaagccggcctttattcctgtaaatcctgaaacagatgctacaaagcttcatgatgaggaaactgggatctcacggcgccgtctttcaaatggaattcctgttaattataagatatcaaaaactgaaacacaaagtggtgtgatgcggctgattgttggtggtggacgagcagctgagagtcccgagtcaagaggatctgtgattgtgggtgttaggacactaagtgagggaggtcgtgttggcaacttctcaagggagcaggtggaacttttctgtgtaaatcacctgataaattgctccttggaatctacagaggaattcatatctatggagttccgttttactttaagagacaatgggatgcgtgcagcctttcaattgcttcacatggtgcttgagcatagtgtctgggttgatgatgctttcgatagagcaaggcaattgtatctgtcatattaccggtccatccccaagagcttggaacgctcaactgctcacaaactcatggtagcaatgttggatggagatgagcggtttattgagcctacaccaaaatcactggaaaatttaaccctgcaatctgttaaggatgcagtgatgaatcaattttttggtgataacatggaggtatgcattgtaggtgactttactgaggaggacattgaatcttgcattcttgattaccttggcacagctcaggccgcaagaaatcacgaaagagagaaagaattcaacccacccttatttcgaccatctccatctgatttgcagtttcaagaagacactgatgagagggcatgtgcttatatagccggaccagcgccaaaccgttggggttttaccgttgatggagtagacttgttagagtcaattaataatgcatcaacaatcaatgatgatcagtcaaaatctaatgcacaacagacacaaggtttgcagaagagcctttgtggtcatcctcttttctttggtataacaatgggactgctttctgagatcataaattctagtctgaaatctgattacacgtttctgtacaggctcttcacatctgtcagagattctctggggttaacatatgacgtgtcatttgaattaaacttgtttgataggcttaaactaggatggtatgtgatctctgtgacatcaactccaagcaaggtccacaaagctgttgatgcatgcaagaatgttcttagaggcctgcatagcaataaaattactgagagggaattggacaggtatgaactgattcttcagcttccgattgtgtttctccgtgatggtttagtaaatacctttctggttaaaatgcacatggctaaacggacccttcttatgagacatgaagctgaaattaagtcaaatgcctactggttaggattattagctcatttacaagcttcttctgttccaaggaaggacatatcatgtatcaaggatctaacatttctatatgaagttgccactattgaggatatataccgtgcatatgaacagttgaaagtggatgagaattctttatattcatgcattggaattgctggtgctcaggctgcacaagaaatagcagctccgttagaagaggaagtagcagatgatgtttatccaggtgttattccggtgggacgaggtttatctacaatgacacggccaactacctga

SEQ ID NO: 73204 - DNA, 1863 bp, Glycine max
  Peptide Sequence Number=SeqID_164889
atggactttgacgacttagaagaagcgccgataaaggccacgtctcgagtctccaagttcgcgccaaaatcatcaaagctcaaacctaaaccaaaatcagaacctgccccccccaaacctgaaccccaaccacccatctccaaaccagagcctcaggaattcgttgcagcaactgtcaaaaagaatgaagatgatggcgtcgaaacagtgccaccaactcatacgaaacccgaactcgacgccactgtcaaaatggaggaggccgaagacgaaccagaatcagttcgagacgatcccatagacgaagatatccctgaagaagacacagttgtgcgcgaaattgatgtcttcttctctccttctgtcgatgcccagactcagctatacgtctttcagtatcccttgagaccttcttggcgaccgtacgatttggatgaacaatgcgaagaggtaaggttgaagactaaaacttcagaagtggagattgatttatccattgatcttgactcggaccatattgacaaagagtttgccaccaaatacaacatcacaaagcagactttatcaactacgtggaagccatctcatgcaaatggatgtgctgttgggcttcttatgggtgataagttacacctgcatccagttcatgcagttgtgcagctccgaccaacattacaacatcttaattctggtggttcaaaacggaagaacgctgcctccactggagcaaatgctactgtcaaaattgagggctcaaatgaagagaagtctgttgctacatcaaagaagcagaataagcagacaggaccttctattattgagcaaaagagtgatggtgatgagtgctgggttcctctaaagtaccatagctgcaagagtgatatatcctctagatatttgcagcaaatggtgacacaagaaagttctcctataaacttcacaatgagagcgtatgattatgttactgcactgtgtcctggtgggagcagcaacaatttaccaaaaggtctttctaaaaggtatcttctatcattgcccgtggaagagcgtcttaagaaaatgcttgaggatcgtccacttcatcgtttcagtgctattaagcactttgctccagaatattccgagaatgaacttctaggattcctgcagcagcatgcaatattggtgtggggactatggactgcaaaaagttcattgctatatcctgatggtggtgtggaaactttggccagagattattccctactattgtttagcaagagtttgaaagttcagttttctgatgtgagtattcgaggaggtgaacttgttaatcgtgtgagaaactgcctgaagatatttggcgtggaaagaaatgatcttgataaatctactggaaaaccaaatccttactggaagttcagagagcttcctgacgagtcattcaaaaaactctatccagatattgttgaaaaacaggaagaacttttcaaaggtttggaaaaacagttatctggtttttcttcgaatgttggaaaacgtaaaattggtaaaaatgctgtagcaaaccaaggtgtgaacactgaggttcataaatcagaaagttcagatcaacgggtaacaagtctgggcagagtgcctcctgcgaaaatgaccatgtcaaatgaaacccgacatgctctgccaattgccctgaagaaactttttcagactcacaaagtttgcaggctattcatccatttggggatatgcaggcatgatagatgcaatatacctaacctgatttttggcaagacactaagatcatgtggtctgctcacaacacccattgagcatgtaactaggccccatatggtgtcaagaattttgatacaaattctataa

SEQ ID NO: 73205 - DNA, 1879 bp, Glycine max
  misc_feature (3)..(3): n is a, c, g, or t
  Peptide Sequence Number=SeqID_164890
gcntggtgtagaacctaatccggttaccatggtctgcgttatatctgcttgtgccaagttgaaggatcttgaattgggtaagaaagtgtgttcttatatcagtgagttaggcatggaacttagcacaatcatggtgaatgcattggttgatatgtacatgaaatgtggggatatatgtgctgcgaggcagatttttgatgaatgtgccaataagaatttggttatgtacaatactatcatgtcaaattatgtgcaccatgagtgggccagtgacgtgttagtaattttggatgaaatgctgcaaaagggaccacgaccggataaggtgaccatgttatctacgattgcagcctgtgcacagttaggtgatctttctgttgggaagtcatcccatgcttatgtcttacggaatggacttgaaggttgggataacatttccaacgccatcattgacatgtacatgaaatgtggcaaaagagaagcagcttgcaaagtttttgagcatatgccaaacaagacggtggtgacttggaattcgttaattgcaggtttggttagagatggtgacatggaattagcttggagaatctttgatgagatgcttgagagggatcttgtatcttggaacactatgatcggtgcattggttcaagtgagcatgtttgaggaagcaattgagctattcagagagatgcaaaaccaggggattccaggagatagagtgacaatggtgggcattgcttctgcctgtggatatttaggagctcttgatcttgccaagtgggtatgtacttacattgagaaaaatgacattcacgtggacttgcagcttggcacagctttggttgacatgttttcaagatgtggtgatccctcaagtgctatgcatgttttcaaaagaatggaaaaacgggatgtgtctgcctggactgctgccatcggagttatggcaatggagggaaatacagaaggggctattgagctttttaacgagatgcttgaacaaaaggtgaaaccagatgatgttgtttttgtggcactattgacagcatgtagccatggtggctctgtggaccaagggaggcaacttttttggtcaatggaaaaagcccacggaatacgtcctcatattgtccactatggatgtatggttgatttgcttggtcgagctgggctgctggaagaagctgttgatctcatacaaagtatgccaatagaacctaatgatgttgtgtggggatctctactagcagcttgtcggaaacacaaaaatgttgaactggcacattatgcagctgaaaagttaacacaattggcccctgaaagagttgggattcatgtgctgttatctaacatatatgcatcagctggaaaatggactgatgtagcaagagtgaggttgcaaatgaaggagaaaggggtccagaaagtgcctggatcaagctcaatagaagttcaaggattgattcacgagttcacctcaggtgatgaatcacacgcagagaacacccatattggattaatgctagaggaaataaactgcaggctaagtgaggcagggtatgttcctgatacaaccaatgtcttacttgatgttgatgagcaggagaaagagcatttgctcagcagacatagtgagaaactagccatggcttatggattaatcactactggtcaaggtttgccgatggatttcttcaatgagccagatggtggcctcagctttgtgtggatgaactatggtgtccaagggcttgtattcatcctcactgccaattctcaactgatcccattgcttgaggagaatatttgtgagtgcctcgatgatttgggattgggatctgcttcatgtaatcctgatacatttctgcccgtctga

SEQ ID NO: 73206 - DNA, 2586 bp, Glycine max
  Peptide Sequence Number=SeqID_164891
atggcttcaaaatccagatccagtttatctgaaacacccaacaaagcaaccccggctactcccaacaaggcgcgaccatcaactcccaacaaaacatcacctgcaactccaaaagttagtagactcagcaaaggagtgtctaaaccggaatcagaatcaccgtcgcctctgcaaaatttgcgcctgtcttcagaaaaatcgtcaccacgagctttgaattcaaagcctgccactgagcggaaatcaccaagacccacttccaccacacctgataaacaaattccaagagttgcaaagggttcagaattgcaggcccagttgaatcttgctcaagaagatctaaagaaagcaaaggaacagctggttcaggctgagaaagagaaagaaaaggcaattggtgagttgaaagaagcacagagagttgctgaggaagcaaatgagaaactcagcgaggcaatagtggctcaaaagcgggctgaggagagttctgagattgagaagttccgagctgttgagttggaacaggccggaattgaggccgcacagaagaaggaagaagaatggcaggaagagcttgaaagtgtgagaaaccaacatgctttggatgtgtctgctcttctctccactactcaggagcttcagcggatcaagcaagaacttgccatgacttgtgatgcaaagaaccaggcactgagtcatgctgatgatgcaactaaaattgctgagcttcatgtggagaaagcagagattctctcagtggaactgatacgtttgaaggctgtactggattcaaagctggaaactgaggctattgcaaacaacattgtattggagctgcaagcagagatagaagctcttaaggaagaacttgaaaaggcaaagggttatgatgcaaagttggcagagaaagagaattatattgaacagcttaatgtggatcttgaagctgccaggatggctgaatcttatgcacacagtctgctagaggagtggacgaaaaaggttgaggaactagaagtgagagttgaagaagcaaataagttggagagatctgcatcagtgtctttggaatccgtaatgaaacagttagaagtaaacaaagatttgttgcatgaagcagaatctgaaatttctagtcttaaagagaaggtgggattgttggaaatgacaattgcgagacagacaggagatcttgaggattcagagtgttgtcttcatgtggctaaggaagagagtcttgaattgtcaaagaaggttgaatctcttgaatctgaactcgagacagtcaaggaagagaaggctctggctttgaacaacgaaaaactttcagcttcaagtgtgcagaccctattagaagagaaagacaaactaattaatgaattggagatcttgagagatgaagaagaaaagactaaaaaggcaatggaaagcctagcttctgctttacatgaagtatccgcagaagctagagattccaaagaaaagctattggccaaccatgtggaacatgaaaactatgagacccagattgaagatttaaagttggtcttaaaggcaactaatgaaaaatatgagtccatgcttaatgatgcacggcatgagattgacactcttacatgtagtgttgaaaattctaagagcaacatcgaaaactccaaggcagaatgggagcagagagaacatcatcttgtcaactgcttaaagctaactgaagaagagaactcgtccctgggaaatgaaataaataggctgattcgtttactcaaggacacagaggaagaagctaatgccaagagggaggaagaaggccaactgaaggaaaatctgaaggaagttgaggctgaggtgatccacctgcaggaagaacttaaagaagcaaaggctgagagcatgaagttgaaggagagtctattggataaagaaaacgagtttcagaatgtttttcaagaaaacgaggaactccgcttgagggaatccacatcaattaagaaggtggaggagttatctaagatgctcgatgaagttacaagcagaaaccagacagaggaaaatggggatcttactgaaagtgagaaagactacgacatgcttcctaaagtagttgaattctctgaagagaatggacatggaggagaagacttattatccaaaaaggtagagctttcagccaatgaagagggactcaaacaaagggtacaggaagaaagtattcccatggatgacaagtctgaaaaaactgaatctcctaatcctgagaatgtgaatggaaaagtaaatgaagatgcgagcaaaggaaaagatgccttggtagatgccgaatttaaaatgtgggagagctgcaagatagagaagaaggagttctcaccagagagagaaccagagcctgaatcctttgaagaggaagaagttgactcaaagatagagggtggtgagggctttgaccaggtaaatggaacctctttaaaagaaaaggttgatgatattgggaactcgccatcaaagcaacaagtgaagaagaagaagaagcctttgcttggcaagttcggaagcctgctcaagaaaaggggtggtagcaaccacaaatag

SEQ ID NO: 73207 - DNA, 1566 bp, Glycine max
  Peptide Sequence Number=SeqID_164892
atgccagttgaggagaaatcctcaactgctgttttgactatgcctgaaacacattgttcgccacagtgcaaggatgaagaatcaagtgattgtgataaagcatgcaatgcacttctcccatccacttccatagaccaacatcagactactggaagtaggaatgttgatgtcaatgaccagacacatttgggttcacaagtaagcttagagaagctagatagtaggattgactcaaaatctacatcaagggttccaacaagcagtactctgttatgtcaagaaatgaactccactggttcatccctgaaagttagtgtacttgaacaagaacagtgcagagagtctaaacctcctgaagcaatgggaaggagtgcaactagtaggattgtggaaacaaaaactgattctgatatttctgtcaagcaagagaacactgtgtctttgtttccttctgaaaaaggtgctgcaagcaatattgataaagataaaatttcagagaaaatgaacagtgatgaagaccagcagaggcctaagaagaaacaagaagaggattgtccgtatattgatttggaggcaaatattgaaaatcaagaaacagttgctgcaagcaattttagtagggatcaaaattcagtaacaattgttgttgatgaagatcagcaaaggcccaagaggaaacagaaagatgatcattatattgacttggaggcaacacttgaagatcaagaaacaggtgctgtaaccaatatatgtgaggataaaacttcagaaaaaatggacgttgaggaagattggcaatggcttaagaggaaacagaaagctgatcactatattgacttggaggcaacttttcatgaagacccaagtgaagaagggatcaactgcgcgctaccttatgataaagttcagcatgtagatctttctgacacaattatgcagggttctggtatcagttgtcagaaaataccttggaatgagggaaatgccaagttagaagacagagaaagttctggcaagaagctaaagacaattttcggtgggatttatggttctggaggtagagactcttttaatgacagttttacatctcttggaaatgatcttggctcctgttcttcagttgaggacaaaggatgtgaggaagcttgtgatgagaaaatcatccaggaggacttgggaaccctggaaagaaccttctttccagttggcacactgaatattaccaactcactatcagtgatggatagtatgtcaaccaaaggggttggtgagtatgatgaaggatttcaagatgggattcccaatctagagcttgccttagggggaaaaacaaaaccaccaccagctgcgcctaagggtatgctgcctttcttagttggggcagtagacaggcaaaataaccaccctgataacttgggagacaggcaggaggatgaaggtgtcgctgcatctctttccctctctctgtcctttccatctccaaacaaggaacacacaaacgctgcagagcttttgcctgatgggcagcgtgtgaacaacccgtttttcctttttgggagaaaataa

SEQ ID NO: 73208 - DNA, 636 bp, Glycine max
  Peptide Sequence Number=SeqID_164893
atgagggcttgggctttggggttgtgggagtggaggcccagtgggaagaggaggaggggggcctggaggaaggtgagggagaggaaggtggggggtgcgattaggaagaggacggagattagagaagatggagagcgtctgaaaatcggaggcgtggaagtggggaggaagatgagctcgatgagtttcaaggtcaaggacttcttcaatggtgggcccaatcaggccgacaagcttgtggaggacgctacttccgaggccctggacgagcccgactgggccctaaatctcgatctctgcgatctcatcaacgccgacaagctcagtagcgtcgaactcgtccgcggaatcaagaagaggatcgtcctcaagagccctagggttcagtacctcgcccttgtcctcctcgaaacccttgtcaagaactgcgagaaggccttctccgaagtcgccgccgagcgtgtcctcgacgagatggtcaggctcatcgatgaccctcagaccgtcgtcaacaaccgcaacaaggccctcatgatgatcgaagcctgggctgagtccaccggcgagttgcgctatctccctgtctacgaggaaacttacaagaccaaggaagcctttgatgttgcgaggaaatag

SEQ ID NO: 73209 - DNA, 5241 bp, Glycine max
  Peptide Sequence Number=SeqID_164894
atgataaagctcattgatgaggaagcagattcatttgcaaggagggcagaaatgtactataagaagcgtccggagctcatgaaattagtggaggagttctaccgagcataccgtgctttagctgagagatacgatcatgcaatgggagagctacgccatgcccacaaaacaattgcagaagaacattacatgctgaccgatgattcgtcgccgtgtgttgaatcacacacaccaggagtgccttgtccgaattattgcgagtctgagcatgcggagaaagcagatagtgaagttcaaaccttgaggaaaggcctggccaaaatacagtctgacaaggatgctatctttcttcagtatcagaagagtatggacaagttatccgaaatggaaagagatctcaataaggcacaaaaagatgctggaggccttgatgaaagagcgagtaaagctgaaattgaaactagagtgttgaaggaagcgctggcacagctaaaatctgagaaggaagctggtcaagttcagtacaatcagtgcctagaaagtattgctaaactggagactatgttatctcttgcccagctggatgccaaggaatttgatgagaaaacttctaaggctgaacttgaagccaaaattctaaggcaagaactaggccagttggaagctcagaaagatgctggttttcttagatacaagcagtgtgttgaaaatatttcagttttggaggccaagataacccttgctgaggagaattccaggatgttaagtgagcaacttgaaaaagctgaactggaagttaaagcactgagaaaaaatcttgctgaactgaatggagagaaagaatctttagctgtcctttaccatcaatgcttggagaagatatctaaaatggagaatgaaattttgcttgcacaagaaaattctgaaaaactaaatagagaaattgagaaaggggctgaaaaacttaagactgctgaagaacattgtgatatgttggagaaatcaaatcaatctcttcggctagaggctgaaaatctgctgcagaggatagctatgaaggatcaagcacttttagagaagcatgctgagatagagaggctccagactctaatgcaggaggagcattctcactttcttgaaattgaatccactctacagactctgcagatgttgtactctaagtcacaacaggagcaaggaagtcttgtaatggagcttaaatatgggcttcagttgttgaaggatttggagcttccgaaacagggtgtttttaaggaagaaatgcaagagaatgtggaagaaaacaggaccctgaatgaaattactttctcttccactaggtcactgttaagaagacagcaaacggaaatctctaaattaaaggagatcaaagagaaactggaacgggagtttgttgtaaactctgaagaaagcaatgccctccagcaggaagctcatcaaataaagaatgatatccagcacttgaataatagatatcacgctatgctgggacaactacagactttaggcttggatcctaaatgttttgcagcatctgtgaaagatttgcaaaatgagaactcaaatctaaaggaggtctgcaagatggaacgtaatgcgaaagaagctcttcgtgaaaagtcaaaggacatggatgaacttttgatagagaatgaatttatggaattttctctctcaagattaaatgatgaattggatggattaagagcaacagtgaggaaatttcaagagtcctgccaagttctccaggaagaaaaatctatggccgttgatgagaaatcagctctattttcacagttacaaatagtcactgaaagtatgcagaagctattggagaagaatgccttgttggagaagtccctctctgattcgaagattgagctggaagatttgaaggctaaatcaactgacttggaagaattctgcaagttgctaaatgatgagaagtacaatctcctaagcgaaagaagcatcctggtatctcagttggaaagtgttgaggctaaactaagtaacctggaaaagatgtttacaaaattagaagaaaaatatgctgactcggagaaggacaaagaaagcactggcaaccaagtagaagagatccgtgcttcaattttggtgcaaaagcaaaagcatgcaaatcataaacacttgagcgaagtccgactgacaaatttggagaatcttttccatgcactacaggaagaactgcggttggggaagattgaatttgaaaaagaagttgacaaagctgtaaatgctcagatggagatgttcattttgcaaagttgtatagaagatctggagcagaagaacttggctttgttaactgaatgtgaaaagcatgttgaggcatcaaaattttcttacaaagttatttctgagttggagactgaaaactttatgcaactgatggaagaagagtttttgttacatgaaattagaaagcttaaaatggctattcatcaagtgtgtggggctcttcagattgatccatatggtgtgcacgacaaaggaatcaagcaagaggaaatgcctatattgcatattttggacaacattgaggacttgaaaagttcttatgtgaaaagccaagaagagaagcagcagctccttgtagagaattctgtcctcctaacttcacttgagcaaaatcgatctgagagagaaaaaatggagtcagagaaaaagatcatggagcaagacttcgagaaaacgagacagaagaattcaatgttgcagaaagcgaaggttgatcttctagagaagaacaggcaactgaggactgaagtggccaaaggagaagaaagagacaatgcatcaaagtccaaattggcagccctgcatgcagagttgatagatttgcagacaaaaaatcaagtgtttcaggaagaaaataatatgatgcttgaggagaaaaattcactgcttaggagtgttttggacctcaaagatgcaatgtccgtggctgaagatgaaaacagtgtaatacttcataaggtactagctctaagcaacctcaacttggtttatgagagctttctcacccagaaagtcatcgaacaagaagcactttctgaacatctcagcagcaatcttagccgtttaaacggtgacctcaatcaggaacttggtgtgttaaggaagaagtttgaggtgaaagaagaagagaatgtttatctgaatgaggctactaagaggatggataaagagctgcaggaaataaaaaatgcaaattgccgtttaagtcatcaagttgaaaattcagagaatcttctcaagaagaaagatatagagcttctagaaacggagactaggctgaaggctgcagagaaattgaatggggagttttgtagatatattgaggagatgaagatggataaaaaagaatcaagattgaccagagaaaacctagacaggcagattcttgaactatcagaaaatggcatgaatcagaaaagagaaattgaacaccttaatgaagaaaatagaagctttcagtccgtgatgagatcattacttcatgaagttgagcaacacaaggctagagaacaagcactgaatacagagttgcaggacaaaacaaatgaatgccaacattgtgaggctgaggcagcttcgttctatttggagcttcagatttcatccattagtgaagaactgctgaaaggcaaggtcactgagcttactggagtttgcaagagacttgatgatgaaagtgcagggaaaggcttggtgattgaacaaatgatagaaagaatcggtttactggaaaaggaaattagaggactgaaggggcagctatctgcatacactccaacaattacttctttgaaagaggattttgcatctctagagcacacttactttcttttgaccaataaaacttttgccgtaggcaacatagaacagaaggtatcatcttgtttcacccagatattatgtacttgtatttgcttcttcctcgtctcttgtcaaaacagcttatgcagttcacttatattttctatttatccatgtctatcgcgaatgtttttccaggatgtagtgactgagatttgtctccaagaagcaaatagctatcgaagtttaaaaggaaatgaaagcaccttaacaccagatggggttacagatttgctgagcatgcagacaaggattagagcagttgaaaagttaatgatggaagaacttgaaagacatgtggaggaggaaagtttgaccacaaatgtcaaagcagaagctgttacagaaatgactgagcattcaaatttggaagttggcacgtatccagaaattgacgacagaaaagtggtgatgaaaattaagaaagacaacagcaaacgtggcaataatgcatggagaacaaaatctcagaaaaggttgataatgatagacattcctcttgatgactacaaggatgatccagactccaacaagtattgcaagagagatcacactaggtgcaatgatcatatgcttgagctatgtgaaactgatcagcatgatgttacagaagaaagtaaacataattctgtttcaatagaggatgtaattacatgccatgagtcagaaagatgtcaaaattactcttcagaattggagacagagaaggaattaggggttgacaagctagagttgtggaagactcgaaaagagacgacaagtgaagatagcaagaggaaaattttggagaggcttgcctccgattctcagaagcttgccattcttaaaatgacactacaagacttgaagaagaaaccagagacacagaagaaaagcagcaaggtaaatgagattgagtatgaaacagtgaaaaggcatatagaagatgttgaggaagctgtcatgcaacaaataggcatatatgatcaactggcaaaggatattgaagagtgcacatcctcatcttcagacacaaacacaatgcagatggaaaagcaaggaggacacgggcaaagaaaaaagctaacagaacaggctcgaagaggttctgaacagataggaaggttgcagtttgaggtgcagaacatccagtatattctgctcaaattggctgatgtgaagaacaacaaatgcaaaaacaaaaacactagaccaacaggaaaaataacagaaggcgccgtaagggatgtgcttgtggatgttcaaggccttcaactaatgaggactaagtcagacacagcatctagtaaaattgaaggtttgcctaagaagaaataa

SEQ ID NO: 73210 - DNA, 318 bp, Glycine max
  Peptide Sequence Number=SeqID_164895
atgacagttatgaatacaactcgggtgatgaagagtagttatcaagttgaagcaagctttcaaccaagtcaggaagctttggcctatatagagaaggttgctattcctcacccatggagtcaatctaaatgtgtggatgactgctccataggatacgtttccgtgaagccggaatgcggtgattatcggtgtaagcacatgttagctatgcagtgtctgcggaatagttacggaggctttgaggagggcaatactaattgtcttcaaaaaatttccttaattatcttcagcttcttggccacagataagattaagtaa

SEQ ID NO: 73211 - DNA, 5988 bp, Glycine max
  Peptide Sequence Number=SeqID_164896
atggaatcgggggtgggatcgggtggttctggggttgtggtgaagagcagaaactcctcgggttgtttaattgtgcgaaagaaaggggatgggttgggtgctactgcttccacctctcggaagctctatgaatccaagaaaaggccaaacatcaacgtgcctgtgtcctcgagtgattctggttcaagcgacgagttgctgatgcctcctggtagaaggcttggtcccgagactattcgagtttgcaatggtttggttgcctctgagcgggttgggagtgaaattagtcggaagagggatagagtgggacgaattagcggtagtggggagggcattggtgcggagaaaggtttggagcagtgggaaaggaagcgtagtaagttggatgtatacgatttcgatgaatacgatggcatggatgtggagaacatgaggaggaggcatttggatggtcctgggggaggaaggtttatgggatcagtgcatgctgctacaagtggcattgatagggatttcagaacagggtcaagtggacgtgttcttgataagagaaagaactcctatgctgacaggcctagttgcttctatccggaagattatgtgtgtaacagtaggttcaagatgaacaatgatggagctcaggtacctccaccctcgcagagggagaagtttaattcagacgagtccattagggttcaggggaagaatggtgttttgaaggtaatggttaataagaagaaggtgggtggtacatcagaacagtattatgatcatcacaaacccttggaaagcaggcaaaggttgaagaccgaagaaactgccaagaggttgaagaccgaagagactgccaagaggttgaagactgaggggactgccaagaggaatattccaattcttaaaaaaaatgaaaagaaacctgttgataaaccagcattacttaagaggccagagaagaaaaggacagcatcaagaaaatcgttgtcaagcaaggacagtaagggtgatgagggggattcagataacagtgacacatcattgaatccaagaataagaaatactgaagctcgtaagtctgtgaaaaaaataatctctgaggatgagcagactcctgtgcgcgaaaaaaccccaaccacaagaacgaaagaaggaaaaatcaagcgtggtagtggtacagaaaaacagaaactgcgggaacaaataagagagatgctgctgaattcaggttggacgatagactatcgacctcgaaggaacagagactacctggatgcagtttacattaatccagcaggtacagcctattggtctatcatcaaggcctatgatgctcttcaaaagcaatcaaatgatgatgctgatgaggtcaagcccaaaggggatagttcttcttttgctcctattgctgatgaggttctcagtcagctaacaaggaaaactaggaagaaaatggagaaagaattgaaaaagaagaagaaaaggcatgatagtgaaagtgataatgagaaagagcctcaaataagaagatctgccagccacaagcgtgatatgaatagcatggatagtgatagcaacgaggagaaattaagctcctttataaaacagggaaataggtcaatgaaaaacaaaatgtttgaaaatacctctatcagtgctcgctctaaaatccagaatgctacccatcaatcaagtgatggaatagaaaaaccattatttggatgtgatcctcatatacacggacggaagagtaaaaaacatggaagatgtaccttgttagttcgcagttctaacaaaggatcaaattcagaatctgatggctttgttccatatatgggcaagcggacagttcttgcctggttaattgactctggaacagtagagttaagccaaaaggttcagtaccgcagacggaagaaagtcatgctggaggggtggatcacaagagacggcattcactgtggctgctgtagtaagatcctcacagtttcaaagtttgagcttcatgccggtagcaaattgcctcagccatatcaaaatatatatttggaatctggagtttctcttctacagtgccagatagatgcatggaatagacaagagcatgctgaaaaaattggtttccattcagtggatattgatggaaatgatcctaatgatgatacttgtggtatatgtggagatggaggggatttaatctgttgtgatggctgtccatcaacatttcatcagagctgcttggatatccagatgcttcctcctggtgaatggcattgtccaaattgcacctgtaaattttgtggcatagccagtgaaacttctgataaagatgatgcatctgtgaatgtcctacgcacttgcatcttatgcgagaaaaaatatcatgactcttgcactaaggagatggatacccttcctaataatatcaattcatcaagcctttctttctgtgggaaagagtgcaaagagctttctgaatacttgaagaaataccttggtaccaagcatgaactagaagcggggttttcatggtgtctcattcatagatcagatgaagactcagaggcagcttgcaggggacttacccagagggtagaatgcaattccaagttggctattgcactgactgttgaaaaactagttattcctgcagttgctgaactcacacatacatggacaacagtttttggcttcacatatctagatgaatcactcaggcaagaaatgaagtcactgaatatgatggtcttccccggtatagatatgttacagaagctgttggtggaacaaggaaaccatgaaggttctgagaaaatggaaaatggagacaacgattttatcaagaccaaaatgggaaataagtcagatatgggttcttcaactccacaagattctcatggtagtgatgatgttagttcaaatcctgctaatgagacgaatgatgaatgcagcgatgcttctcaggaactaaataaccaagttttggttgatgggattatctgttccaaatctcattctgaggaaatgatgtctgatccaatttcagataaatgtgattctccttctagaactagtaacagtgaactagaaatgaagaataaagtagcggctgctcctcctgttgatagattagattcttctaccaaatgtcaatccatttctccaattgacacttctgttagtagtcacccagtagatattttgaaagttcaagctttggttcaggaaactacttattctgatccatgttcagaagaagaaaaccttgacaagaagtgtcactcatccactgctatgaattgtgattcgtcagagcttgacatcaatccagtgttgaattctcaaatggcagacaatactctgcctactaaagaggtttgtatgaatgacactcttgaagttgttccttcagggaatatatctgaagataatattacaaagagaaataatcgaaatgtagatgaatccagttctgctctcaatcatgctgatgagaagcttcattgccttgtaagcaagtcaattttcaaggcatttgaagcttctgcgatgtgctttgatctggtcgcatcgctctcggatcactttgggtttttcagcggagacttgcgtcgcactcgcatgcaacaatttactgcgaggtacggaatccgtgaattttccggcgagatggaatcgggggtgagatcgggtggttctggggttgtggtgaagagcagaaactcctcgggttgtttaattgtgcgaaagaagggggatgtgttgggtgctactgcttccacctctcggaagctctatgaatccaagaataggccaaacatcaacgtgccattgagtgattctggatcaagcgacgagtcaccagtgcctcctggtagaaggcttggtcccgagactattcgagttttcaatggtttcgctgctgcctctgagcggggtgggagtgaaattagtcgaaagaggtatagagtacaacgaattaggggtaatggtgagggtattgctgcggagaaagggttggagcagtgggaaagaaagcgtagtaagttggttgtgtacgatttcgatgattacaatggcatggatgtggagaacatgaggaggaggcatttggatggtcatggaggaggaaggtttatgggttcagtgcatgctgctagaattggcattgatagggaattcaaaacaggttcaagtggacgaatccttgataagagaaataactcttatggtgataggcctggtggcttgtatccaggggataatgttgatcacagtaggtacaagataaacagggatggactccgggtacctctacgcttgcagagggagaagtttaattcagatgagtccattagggttcaggggagaaatggtgttttgaaggtaatggttaataagaagaaggtgggtgggccatcagaacagtattatgatcatcacaaaccagtggaaagaaggcaaaggttgaagactgaagagactgctaagaggctgatgactgaagagactgctaagaggttgaagaccgaagaggctgccaaaaggaatgtaaatgttccaattcgtcctttgtcatacttggaaatgaaacctgttgagaaaacaggattactcaagaggccagagaagaaaaggatagcatcaagaaaatcattgtcaagcaaggacagtaagggtgatgagggggattcagataacagtgacacatcattgaatctgggaataagaaatactgaagcacggaagccagcaaaaaaaataatatctgaggatgagcagactcctgtgcatgaaaaactcccaaccacaagaacaaaagaaggaaaaatcaagcgtggtagtggtacagaaaaacagaaactgcgtgaacgaataagggagatgctgctggattctggttggaccatagactatcgaccccgaaggaacagggactatttggatgcagtttacattaatccagcaggtacagcgtattggtctatcatcaaggcctatgaagcacttcaaaagcaattgaatgaagatgctaatgaggccaagcccaaaggggatagttcttcttttgctcctattgcagatgaagtgctcaatcagctaactaggaaaactaggaagaaaatggagaaagaattgaaaaagaagaaaaaatatgatagtgaaagcgataatgaaaaagagcctcaaataagatctgccagccacaagcgtgatatgaatagtacggatggtgataacaatgaggagaaattaagctcctttataaagcagggtagtaagtcaatgaaaaataaaatgtttgaaaataccattatcagtgctccctctaaaatccagaatgctaccaatcactcaggtgatggaatagaaaaatcattatttggatgtgatcctcagatacacggacggaagagtaaaaaacatggaagatgtaccttgttagttcgcagttctaacaaaggatcaaattcagaatctgatggctttgttccatatacgggcaagcggacagttcttgcctggttaattgactctggaacagtagagttaagccaaaaggttcagtaccgcagacggaagaaagtcatgctggaggggtggatcacaagagacggcattcactgtggctgctgtagtaagatcctcacagtttcaaagtttgagcttcatgccggaagcaaattgccgcagccgtatcaaaatatatatttggaatctggagtttctcttctacagtgccagatagatgcatggaatagacaagagcatgctgaaaaaattggtttccattcagtggatattgatggcggtgatcctaatgatgatacttgtggtatatgtggagatggaggggatttaatctgttgtgatggctgtccatcaacatttcatcagagctgtttggatatacagggagcggttatatctcatagtttggagctttgttgttttgaagtcaaggggactgaagatactttcttgttattatga

SEQ ID NO: 73212 - DNA, 1068 bp, Glycine max
  Peptide Sequence Number=SeqID_164897
atggctgttgaaaggtccggaattgccaaagatgttacggaattgattggtaaaaccccattagtatatctaaataaacttgcggatggttgtgttgcccgggttgctgctaaactggagttgatggagccatgctctagtgtgaaggacaggattgggtatagtatgattgctgatgcagaagagaagggacttatcacacctggaaagagtgtcctcattgagccaacaagtggtaatactggcattggattagccttcatggcagcagccaggggttacaagctcataattacaatgcctgcttctatgagtcttgagagaagaatcattctattagcttttggagctgagttggttctgacagatcctgctaagggaatgaaaggtgctgttcagaaggctgaagagatattggctaagacgcccaatgcctacatacttcaacaatttgaaaaccctgccaatcccaaggttcattatgaaaccactggtccagagatatggaaaggctccgatgggaaaattgatgcatttgtttctgggataggcactggtggtacaataacaggtgctggaaaatatcttaaagagcagaatccgaatataaagctgattggtgtggaaccagttgaaagtccagtgctctcaggaggaaagcctggtccacacaagattcaagggattggtgctggttttatccctggtgtcttggaagtcaatcttcttgatgaagttattcaacctctttgcatatgcaagggtaaggctgcgtacaacatccctcccccataccttcgcatagcgaagagcctctggacaatgggggcgagccctggtgcagcggtaaagttgtgccttggtgacttgttggtcatgggttcgaatccggaaacagcctctttgcatatgcaaggcaaaaactcgatcagaaagatcggccaaaacggcattgacgctggaaccaaaaataacgctgaggacatcgccggtggtacccgaacaacaagtcggagaggagataatggtaactgtgactgtgatgtcagcggtgaccgtaagtggtag

SEQ ID NO: 73213 - DNA, 528 bp, Glycine max
  Peptide Sequence Number=SeqID_164898
atgcagtggtggcatgtgttgattgctactgctgccctttttcttgttggaaagtcagaggaaacaccgtgtcctttgaataatgtgttgcaagcatccagtgaaatcttacatgaacaagattttactttgctgtcctatctgcttcctgttggttggtttgaaaagtatcatgatcgagtgcttgaggcagagctgttgttgcttactactctaaattttgaactcaatgtggagcatccttatacatctcttacatctgtccttaacaaattagacccatcaaagactgttttggtgaatctggcattaaacttgatcagcaaagggcttcagagctctctatggcttcagtataaaccacatcatattgctgctggagctgcatatcttgcttcaatgtttctcaagattgatcttactgcttatcacaatatctggcaagagtttgaggcaacaccatccattcttcgaggtactcttcacccactcctcccttccttccctttctcccctttcccttgttaa

SEQ ID NO: 73214 - DNA, 1947 bp, Glycine max
  Peptide Sequence Number=SeqID_164899
atggaagagatagagcggcgaagagagggttgcatgaagggagagtttgattcctttgggacagagagaaaggtgaaggctcctgcgatggagcaagcagtgtcactgattggtgccctgaacctggtttctcgcaacctccctcttcccccagacctctttgacaccgtttcttctatctatcaccgatctaatcctctctcttccgaggccgatgcaccggaacaagatttgttggccgaccttcaaaatgcgctgttggagcaacgtcctaactacgcctctgcttccaaattgaacaaaacaagggaaagccgttatcacactcagattcgacaccgcttaacccaactccaaggattgccttcaagcagaggagaggacctacagactatgtgcttgcttgagctttatggactaaagctagctgagttgcagaggaaggtgcagactgacgtgaattctgaatactggctcaatgttaaatgtgcatatccagacaggcaattatttgattggagcatgatgcggttgcgtcgtccgctgtatggtgttggagatccattttccatggatgccgatgatcaaataaggaagaaacgggatgctgagagactatcaagattggaagaacaggcaaaaaatcatatggaaaccagaaaaagaagattttttgcagaaatactgaatgcggtccgagagttccaattacaaattcaagcttttttgaagcgaagaaaacagaggaatgatggtgtacaggcatggcatggaaggcaaaggcaacgtgcaacacgggcagagaaattgagattccaagccttaaaggccgatgatcaggaagcttacatgagaatggtaaaagagagtaagaatgaaagattgactttgcttcttgaagaaacaaataaactacttgtaaatttgggagcagccgttcaacgtcaaaaggactcaaaacaatcagatggcattgaacccttggaagattcagaaactgatttacctgagtcagatggattgaagaatggaatttctaaggaatcacctcttgaggaagatgtggatttaatagattctgatcgtaacggtggtgatactagtgatttacttgaaggtcagcggcaatacaattctgccatacattcaattcaagaaaaggtaagcgagcaaccatctattcttcaaggtggagaattaagaccataccaactagaaggcctccagtggatgctttctttgtttaataacaatttaaatggaatattggctgatgaaatggggcttgggaagacaatacaaaccatctcattgatagcatatcttatggaacacaagggtgtgactggtcctcacttgattgtggctccaaaggctgttctgccaaattggatcaatgaattctcaacatgggctcctagcatcacaaccattctttatgatggacggctggatgagagaaaagcaatgaaggaagagttgtcaggggaggggaaatttaatgttctgataacacactatgatcttataatgagagataaagcatttctcaagaaaatccattggctctacttgattgtggatgaagggcatcgattgaagaatcatgagtgtgctctagcaagaaccctggactctggctatcacattcaacgaagactgctgttgactggtaccccaattcagaacagtttgcaggaattatggtccctgctcaattttctccttccaaacattttcaattcagttcagaatttcgaggactggtttaatgctccctttgcagaccgagtggatgtctctctaactgatgaagaacaactattgatcattcggcgtctgcatcaagtgataaggcccttcatattgagaaggaaaaaagatgaggtggaaaaatttcttcctagtaaatctcagttggtactttgtgatgaattggtgaaataa

SEQ ID NO: 73215 - DNA, 153 bp, Glycine max
  Peptide Sequence Number=SeqID_164900
acaaagaaaaaaaatcagaacggcacgggaagcacggaggaagaagaagaaccgcaaggaacaatcatgaacatgaacgatgacaggaaaaataagcgtcgtaggaagaggaaggcaaacaagaagcataagaagaaagctataggaagatga

SEQ ID NO: 73216 - DNA, 158 bp, Glycine max
  Peptide Sequence Number=SeqID_164901
atgacgtatttcgaagaggatgccattaacggcgacggtgatcgaacgagggacgtcaatcgcaatcacgacggcggaggagaattatacgtcaatttgaggtgggacccacaaccggaggccccgaacactaaccggagaggatcgtcgcgtctctg

SEQ ID NO: 73217 - DNA, 3972 bp, Glycine max
  Peptide Sequence Number=SeqID_164902
atggatgatgaccttttccagaggaacaaaacaccatctggtgtcataaaagcgataaagtttgatgagaatatcgctgttttggagataaatgcagccgggcaggtcactgggtcaagtttgggtttcccaaatgcatctgatgagtgtgccacatgtggctctaaagacaaaaggttctgtgaaggtcattttggagtaatcaaatttcctactcccatactccatccatattttatgtcagaaattgcgcacatcttgaacaagatttgccctgtttgtaaatctattcgtcacaaatccaagggtgttcgattgatctatggaaccaagcggtctaatgattgcaattattgttctgcgtatccatcaatgaaattcagagtttcttccaacgatctctttagaagaactgcaattattgttgaagtaaaggcttcaaagaaaactttggggacagaaatacctgctgattattggaattttattccttgtgatgctcaacaagaagaaaactatgtaaatagaagggttttatctcctgcacaggttcttgcctttcgcttatgtttttcttttgatgaaatgcagctaaatcccgataaaacaccaaatagtatttttgctgatatccagcaaagaaagattggagaaaatgcttgcaattcttctggtttaagatggataaaagatgtggttcttggaaaacgcaatgatagttcattacgtactgtggttgttggtgatccagaccttgagcttagtgaagttggtataccttgtcatattgctgaaagtttgcaggtttctgagtatgtgaataggcagaatagggagaagctgctttattgttgtgagctacgcttgttagagaaggggaaaatagatgtctgcagaaatggtagtaaagttcatctgtataaaaaggaagatctacaaataggtgacaaaatttataggcctcttgctgatggggataaagtgctgataaataggcccccttccatacatcaacattctatgattgctctcacagttagggtccttccaatatcttctgtagtgtgtattaacccactctgttgttccccattacgtggggattttgatggtgattgccttcacgggtatattccacaatcagttactgcaagaattgagcttaatgagctggttgctttagataggcaattgattaacgggcaaagtggtagaaatctgctttcactttcccaggatagtttgactgctgcttatttgctaatggaagatggggtccttttgaatgtttatcaaatgcagcagcttcaaatgctttctatttctgacaaaagattaatacctcctgcagttgttaaagctccttcaagtaatagctcactttggagtgggaagcaaatattcagcatgctcttgccttatgattttgactattcttttccttcagatggtgttgttgttagtgatggggagcttgtatcttcttctgaggcttctggttggttacgcgattctgactacaatgttttccagagtcttgtggaacattatcaagggaagactctaaactttttgtatacagcgcaaaaagttctgtgtgagtggctgtctatgacaggttttagtgtttcactctcagatttgtacctttcttctgattcctatgcacggaaaaacatgatagaggaaatcttttatggcttacaagatgcagagcaggcttgtaatttcaagcagctattgttggattgttattgtgattttctgtcaggaagtatccaagagagtgaaaatgctatcactgttgatgctgatcgtctgaattatgaaagacaaatatctgctgctctcagtcaagcgtcagttgatgcttttaggcaagtttttcgcaatattcaaagtttagctgacaaatatgcatgtaaggacaatgctttccttgcaatgtttaaggctggaagcaagggtaatttgttgaaattagttcaacattccatgtgccttggcatgcaaaattctctggtccgcttgtcatacagattaccccgtcatctttcatgtgctgcttggaatagtcaaaagtggcttgattcaatccagatgtcttctggtacccttgaatctgttcagtcttacattccatatgctgtggttgaaagctcatttttaactgggttgaatccacttgaatgttttgttcattcagtgacaaatcgtgatagctctttcagtgaccatgcagaccttcctggaacactgacacgtagacttatgttcttcatgcgtgatttgcatgatgcatatgatggaactgtgagaaatttatatggtaatcaacttattcagttttcttatgatattgaagaggactcttcatgtgataaaggtttccaagagtatgctataggtggtgaaccagttggggcaatttctgcttgtgcaatttctgaagctgcatacagtgctttgggtcaaccagttagtctactcgaaacatcacctttgctgaatttgaaaaatgttttggagtgtggttcaaggaaaagaaatggtgatcagactgtgtctttatttttgtctgaaaagcttggtaaacagagacatgggaagtgttctgctgattccatggctaaggaaggtgaagacacttctatagataaaaaagagggtgatgattgcatcacagtcacaattgttgaaaactctaagaatcctatacaactggattctgttcgggatttggtgataccttttcttctaggaacagcaataaaaggatttctggatgtcaagaaggttgatgttctctggaataatcagtcaaaagtaaaaaattcttgtaatggtttttctggtgaactgtacttgagggtaactttgtccagcgagggtagcagaggaagattttggggtgtactcctaaatctttgtcacaagataatgcatataattgactggacacgcagtcatccagataacatcaatcatttctcatcagcatatggaattgatgcagggtggcaatactttttcaatagtttggcatctgcaacatctgataccggcaagtccatccttcctaagcatttgtgtcttgttgccaatagtctgtcatgtagtggagagtttgtgggattaaatgctaaaggcatggcactacaaagaaaacatgcgtcagtttcatcaccattcgtgcaagcatgctttgcgaatccaggtagttgctttataaaagctgctaagtctggagtcactgataatctccagggcagtctggatgcgttggcttggggaaactgtctatctatggggacaagtggaatgtttgatatcatatattcagagaaggtagctaagtctgggaatgtgtatgagctgctagaagccagttttgacaagccgaacaataaagctggtactcatttgcacaaatattcatctgacaaatgcggttctgagtttaggcataaaaatggttatgccttgaaagagggaaaacagtggaaaaccattttaagaaattttgtgacggtaaatgatatccagaagctgacttttgcttcgaggtattcaattgatgagctgctaagtgagagtgacaggtcaacaatgctaagggttttgaattttcatcctcgtaaaagtgagaagtttggcattggaccacaggacattaaggttggatggcatccaaaatacaaggatagccggtgcttccatatagtaagaattgatgggacggttgaagatttttcataccgcaaatgcattcttggtgctcttgatatcgttgatccaaaaaagtcaaagatccaggagaaaaaatggtcaggacatggatgtccggaatcagtggtagagagcactgttctcttttgcgagtttagagttatgttattggcattactccagctaattggtggaaatagtttgcagccttcttttgttgtattttactatcttcaaggctag

SEQ ID NO: 73218 - DNA, 789 bp, Glycine max
  Peptide Sequence Number=SeqID_164903
atgcatgtggtattcttggatgcatttcgtgacctcagccaaactggaagctacgcatggggatttgttgcactttgttggatctatgaacattttcctactattacttcttctattgttgctgaagattatcatgagaggaaaccacgtgcttgccgttggaagtctgggaaggcattaccagtgtcgacatatcggaagcggttggatagattgacgtctgatgttgtgtgctggattccttatgacatatcagatggggtccatctattgtcatacacagagagggttgtacaccagtttggttatgtgcagaccattcctccacatcactctgctccatctttacctatagaggatattgatgatagatggattcaattttttgaatatcttgcactatgtgcattggactacatgaactggttctacttcatatctcacccattcatgagtccgacacagcttgaggatcctcctagacatccatccatggtgcatgatgatacatttattgaactagatcctcctcagtatccggtctccacagtggctatgccagaaccacctgcagctgcacctgctgatgtagacatgcctcgacatgcacatgaggtttgccaagcaataatagaaaggttaaaactcctgattaacctgagggtagtcactgaaggaacatacgcatacactgtgaccgaggagtgcccaaggatcgctagcagtgtgactatgcaaggaaatgtatatgttcgatcgagacgaaaatggtgtatgccagatgcatga

SEQ ID NO: 73219 - DNA, 204 bp, Glycine max
  Peptide Sequence Number=SeqID_164904
atgtcagatgatgcaatcctcccaaggaggggacccatcactgtggaagcaatgccttccaaggttattttgatgatgccaaagaatccagagttaagcaaattccaacgattcaagaatcaagtttcaagaatcaagattcgagattcaagaattaagtttcaagaatcaagatcaagattcaagaatcaagagaagacttaa

SEQ ID NO: 73220 - DNA, 633 bp, Glycine max
  Peptide Sequence Number=SeqID_164905
atggacgatatctactaccctgctttcatgaacaagatgttatgggatcaaggggtttatcgtgtttttgacaaattggacgatgacttaaagcacaacttaaagatcaaaggttcaatggtggccaaacaacaaagcttcagcaaaacgaacctaaaagctatgaaggtggtaatggaggaacaaaaactaattcctcaagtggatgtggaagcaatcaaacaaagaaaacaaaagaggcttaccaaagccattgcaaacaaagataaagggccacctgatggatccaacacatctgagagtgatatcaatccttttcttctccaatcatcacagaaccccaccactcaagaaaacaagaagcctctaagctccacgtggaaagcaatgcagaagccttctccaaaaaaagttatcagaaggagattttctattgccttcctcaatctgaacgagcaaaatcttcataagccaagtgaagtcattgagaaacctccacaagaacctatccaaaggcatcacatcactgtgatccctactccttggacgaggtatgactacacccgttctccatcagaagcatacaaggcttttcccttagatgcaattgtatatttggaagctctatcataa

SEQ ID NO: 73221 - DNA, 993 bp, Glycine max
  Peptide Sequence Number=SeqID_164906
atgtcgtcatcattcttgcatctggttgcgcctttcgctagttcccaccatcgtcatcgtgtttgcctttgtcttgacgaggtccatgagcagcctcaagaggcagttgatgcacaggatttttcaggcaagccccacgatacatcagttttgatgaactatgttcatcatgtgatagtcacagtttggaatggagatttgtcctcccatggaaggaaggtagaaaaagttggaaggtctgctccagagattaaagacatagtggctgccacaagattaagtcctctgattgcatattccttagacactggtgacaagggacttatatctgttttgcggagagacaccttccatacctttgatgctcttcatgtagaccaagttgtggacttgttagttgacttgcttgaagtcagttcacaagaagcaagagatgagacatttcaatgggggcatatgttcggctatcctggctgcaagacatttatcgtagcaaattgttggatctatgagcatttttctactattgcttcttatattgctgctaaagattatcatgagaggaaaccacgtgtttgtcattggaagtctgggaaagcattacttgtgtcaatgtatcataagcggttggatagattgatgttcgatgttatttgtgttgctcctggacagtgtgtaaaacactatatggagtggttctacatgatatctcatctcttcatgagtccgacacaacctggggatcctcttagacatccacctatggttcataatgatacatttattgaactaaatcctcctaaacagtcggttgccacacctgctatgccaaaaccacctgaggcttgccatgcaataacagaaaggttggaatgcttgatcaacctgagggtagtcactaaaggaactaaaacatacaatgtgaccaaggagtgcctaaggatcgccaagggtgcgattgcgcaagggaatgtatatgttcgatcgagatga

SEQ ID NO: 73222 - DNA, 570 bp, Glycine max
  Peptide Sequence Number=SeqID_164907
atgcggggatacgaggacctgcggggcggggagcatagtccctatccccgtccccgaattagctgtgggggggggtatcatccccatccccgtccccgtggggaatttttcctcgaccgcagggccccaaatggggcaatccctgcagggatccccgagttgcagggagaattgccatgcctacttataacgtggcacataacaagatggtttataattggtttgttaacattcaaaagaaggttcggagatcctttcgttgcacacgatttgaatcaacgggttgtcgtatcttgggagcagagcacaatcaaatttttcgaccagtgcagtgtggggctttgtatctttttctcatttatttcttctacttttctaacaaaggtcttgttggccttggcggcggtggagaaggcagacataggcagaaggagtggcaaagggtcaatcaaggagagggtgtggtgggagggagaaggggagaagcaagaccacaagggctcaggatctgatgtaggcttagacagtgatggttgtttaatggggtttgaagaaggtgaaaaaggttag

SEQ ID NO: 73223 - DNA, 1449 bp, Glycine max
  Peptide Sequence Number=SeqID_164908
atgggggctgggtggggaagaacatcgacggagtcggcggtggaacaactccccccatcaccgttctccacggctatcgtagattccgatgatgagccaaacacccactctttgcacggattttcacctgcgcgcttctctggtagtccgatcggcggctcctccacctggtcaccgccgtctacggtggatcaccgttggagacgacggactgtggggctttacccagcatgcaggggtaatgacatcatgacaggtgcttacgtgtcctccctacactgtcacgagcacctgccatctgctgctgacctgccacctcctgacgcggaccaacgggaatgcatcggtccaaattgtttggacatgcaccctaccctatttctggaaggagacattgaggatatacctccgcctgcttttaaaagtccttataatcttcgggtaaagcaggatgaaccatcggtcaatacccctggttctactccactggtcaactacgtttcaagcttaacgcccccttatcaaaaggaatttgcagctgaggagggggaagttttgaaccacactatgggcctgggtctacgcagtggatgggggcctagacctttcaaggtaatggactggtggctgcaggacaaagatttccagaaaatggtgtctcatagatggggcaactatcaccctagtgggtgggggttcggatcacctcgaaaagcgcgatccaccccgggaactcgcgccgccgtaggccgccgcacacgcccacacgcgcctcctttcctccgcgcgatttccggcgcgtgctgctcacgcgccgccgtaccggcgtcgggagctgtcccttccggtcccggcagcctcgccgtcacctcctggacctgtttcaggcttcaaatcctgcttccggcaagtcgtttggtcaccccttgtgtgtttgcctctcgacaccatgaccacttggagaaaacttccgattttgtttcagatgataaaagagctgaatgggagaagcttgactatcaattatgtgtcgtgttatggcaatcagttgagccggatatcttggagattctccgatcttttaaatcatgccgttctttttggaagaaagcccaggaaatctttgccaatgatatccaaagcttgtttgatgcaactatgaaagttacagccctcaagcaaaccggtcatgacatgatcgctcatgtgggtaaggctcgggctgccgtggaagaactaagaaagttctttgtagctgattcattggaggaagtgaataggaaacttgacaagttctacatggttcttattttgaggagcttacattcagacttcgatcatgtgcgtgatcaagtgcttgctggggaccaaattccatcaatggattctctcatcaccagacttctccgtgtgcctcatttactgaaggatgagaatcctactgatgga

SEQ ID NO: 73224 - DNA, 1859 bp, Glycine max
  Peptide Sequence Number=SeqID_164909
gtgggagttcaaaagctctgatgattgtgaatgtgtgtccaagtatttcaaatttatctgagacattgtcgtctctcaatttctctgctagagctcgaaattctactttaagccttggaaaccgagacacaattaaaaagtggagagatgttgcaaatgatgcgcgaaaggagctgaatgagaaagaaaaagaaattcatgatctaaagcaagagggtctgaaactcaagcaagcacttaaagatgcaaatgatcagtgcattctactcttcaatgaagtgcagaaagcatggaaagtttcttctgtattgcagaccgatttaaagtcggaacatgttttgctgtcagataaacacaagatagagaaagaacaaaataatcagcttagaaatcaagtcgctcaacttttacggttagagcaagatcaaaaattgcagatacaagagcaagattcaaccatccaaagtttgcaggctaaaattagaactcttgaaactcaattcaatgaagctattaaatctagtgaatctaggtcaacatttgtctatgagacagagtctgctgatcaatccaattccggaccaactggtgatggcatagactcttctgcagtaaccaaaaaactagatgaggaactcaagaaacgtgatgcactgattgagaggttgcatgaagagaatgagaaattgtttgacagattaactcagaaagcatctacagctggatcacctaagttgtcaagtccattagctcgtggatcagctaatgttcagcctcgggatattggaaggaatggcaccaacaacaatacaagttctcgttctatgggtgttcttccttcacctttggccactgataaaaatgatggcacggttgctctagttaaaactggctctgaaatagttaagactacccctgctggtgaatatcttactgctgccctgaatgactttgatccagatcaatatgaagggcatgctgccatatctgatggtgcaaacaagcttttgatgctggttctggctgctgtcattaaagctggtgcctctagagaacatgagatactcgctgaaattaaggattctgttttctcttttattagaaagatggaaccaaaacgagtaatggacaccatgcttgtttcccgtgttagaattctgtatataagatctttgcttgctagatccccagagttgcaatcaattaaggttttgccagttgagtgctttcttgagaagactaatactgggcgcagtagaagttccagccgagggagtagtcctggtaggtctcctgtgttatatgttgatgagcagatccagggatttaaagtaaatctaaaaccagaaaagaaatccaaattttcatctgttgtgttgaagatacgtggtattgatgagcaagtaactggtggaaagctcagggaaattactgaggaggccaaaagttttgcaattgggaacagggctcttgctgcactctttgtacatacaccagcgggtgagctgcagcgtcaaattagatcctggcttgcagagaattttgagtttctatctttaacgggagaagatgcatcgggggggtctactggtcagttggaacttctttccactgcaattatggatggttggatggccggacttggtgctgctctgcctccccacactgatgcccttggccagcttttctttgaatattcaaaacgtgtctatacttctcaactacaacacttaaaggatattgctggtaccttggcgacagaggaggctgaagatgcagcacaagtagcgaagctacgctcagctctagaatcagttgatcataaaagaagaaagttttgtcattgcattggttactag

SEQ ID NO: 73225 - DNA, 345 bp, Glycine max
  Peptide Sequence Number=SeqID_164910
atgggttttctccttgctgcaaatggtcttttggttctttacattgccatcaacttgttcaagatttactatggtgatgattggggtggtctttttgaggccatcactggttatggtcttggtgggtcttctatggctttgtttggaagagtagttgatggagtgataggggcagaagctccatcagcctatcatatggcaccaaggagtgaagctccaagtcaggttcctcctcctgttcctgaagcaacagctggagctattggtgtctcacctgtgagtgtggaattggatggaacaacagctaagaagaaatctgattctattttagcaagggagtgttga

SEQ ID NO: 73226 - DNA, 66 bp, Glycine max
  Peptide Sequence Number=SeqID_164911
atggaggtcacttatttgagcttgatggaagaagggctcaagaacacttgcttggacagctcttga

SEQ ID NO: 73227 - DNA, 471 bp, Glycine max
  Peptide Sequence Number=SeqID_164912
atgtatactcttggctttggcaactgcattggtaggcctattagggtggactcaaacaccctagatgcttgtaagggtagatatgcgatgtggatgctttgggcatttgttaaggggtgcaaagtttcagttcaatcaccaatggaagagtcttcaaagcttgatcaaaattcgacggttgtccaaatttcacctaaccagacggctctggcgaattcatcaatgtcaatgaatgcaaatgattccaatattggcgtaatggatacaatcattaccattaattcaggggcatcgttgaaagtttatgacatcgatggcgagggaaaatccatggttaacatgcataaggttttcagcataaggtattccgttttgatggaggaagaaaatgcccccgctaatgagtgtgcaaccatgaaggtaatccagccagattcggtgcctatggtgtctgaccaggtccatccttga

SEQ ID NO: 73228 - DNA, 300 bp, Glycine max
  Peptide Sequence Number=SeqID_164913
atgaaacaatatcacatcagcaagaaccacattgattctcacaagtggggctcaacaacaaagagtgagtaccaagaacaacaagtggttggtgtctggcatcagcaacagcaaaacattcagagaagagaatgtttggccagacaaccaaagtggggtcatctgaaggatttacatagagcaataaaactttgtcaacctgctttagtatctggagatcctacatcattgacttgtaccattttttgcactttacattcaaataacacagagctaaacatgcatgggagatattgttaa

SEQ ID NO: 73229 - DNA, 267 bp, Glycine max
  Peptide Sequence Number=SeqID_164914
atgcatggctatatcaaggaaacaaagcatagtgcgtttgttccgtgcccctattttaggaacctattgggagggactaaagtagggactaccagtgacaacatatcatcaaagagaaaaactctagatgaggcttctctttcgtcaagcgagtcggagacccagcatgaccacagatcaacctccacttcctatgtttccatggacccgggtataaggcccaataattcccctatgtgcaaaggtgtaagtgccatgtgtgcatag

SEQ ID NO: 73230 - DNA, 540 bp, Glycine max
  Peptide Sequence Number=SeqID_164915
atggaggataatgcggccgcagttgccgccaccagtgccaccgccgaggtggatctgactcacccatccgacataaaccaaacaagccatccagtcctggacatggtaggtcagggaggagaggtgttaggcagcacgggtggcccccatgtggtgcaaaataagaattcttgcccaccgtacggcttacctccaaactatacaccacccaatgcaatgcacgtgcccaacgagaacgccacccactctgttctcgttccccttgaaggccagcaaccccagttggggcatacaccttttgctcagcctgtgggggaagcctgtgaagagccccggggtcatgctctgggtgagttcgaaccataccctacatatgccactgagggaccagcattcaatggcatgcctcagcctaatgccgcgggagctcctcaacatcacccaatgcaacctttgcacttctcggtggggagactacctccagccatggaagaaagagagaagttggatctcataaaagaaaaggttgagggccattaa

SEQ ID NO: 73231 - DNA, 231 bp, Glycine max
  Peptide Sequence Number=SeqID_164916
atgggtgcctctgaagaagaaggtgcactcgatgagaatggtgagacttgggaagcagaaggcttgtatgtgtgtgatgggaatgttttgcctagtgcagttggtgtcaaccccatggtaaccattcagtctacatcttactgtattgctagtgttcaagctgcaactagatattattacaaatgtggggatagttctattccagccatgacccaagagcatttcttttag

SEQ ID NO: 73232 - DNA, 258 bp, Glycine max
  Peptide Sequence Number=SeqID_164917
atgtcatcggactcaccgtctctggatgataaaggtgcagatgaccataatttgtctctgcgtgtcaacgggctcgcttgcctctggttggcaaaaggtgcgggaccatacggttcccccgcatgtcatcggactcgccgtctctggatgaaaaagggtcagtatgacagagattgtggggtggccgacaaaagcgaggctcttgctcctacgtatcctcaatttgtgatgaggaactcagacctacgtagttcttga

SEQ ID NO: 73233 - DNA, 707 bp, Glycine max
  Peptide Sequence Number=SeqID_164918
cattggtacaaggctcatatctcagtatgacacaaggagattctcttcattagatgcttggaccagatacactgataatgttctgggaagaatcattttacctgagaggaaagtagagctatatcacactgagctagatgactttaaggtcgagctggagaggcgtaatttccataaatgcctcaccaatttagccggtgggagcatagacctggctttggtgaaagagttctatgcaaatttatacagttctgaggaccgtccaccaaagcagttcagagtcaggggtcatttggtgaaaattgatgttgccagtctcaacacattcctggagacacctgtgatgatggcacctccaaactctattcctacagtagagcagtttaatgagatggtagcctggcccgggactgaaccttctcttcataaggaagacgaaggtcccacagcccaggtacctcagcatatggaggatgagtcatttgaggccaccatcctagagccatttgatatagaagaagaggcagaggagacacaggctacttcagagccttctacaccagtggtaaacctaccctcacctcagcctgcaccagacccctccactcctcttctacagatgccagaggaccaaactacaccagtcctagatgtggacacttctcctcccactactccagtgcttcagctgacagatgaggaggatg

SEQ ID NO: 73234 - DNA, 189 bp, Glycine max
  Peptide Sequence Number=SeqID_164919
atggattcgaccaaacttgcttcatacgtggctggatgtgatgactctcataatgacccaagtccctcacatgaaagagatgacgctagagagaggcatcagaggctagtgttaattaggctagctttggaaaaggttgctttcaccttctcgctaagccaatctgctgccttagcgagcctccgctaa

SEQ ID NO: 73235 - DNA, 432 bp, Glycine max
  Peptide Sequence Number=SeqID_164920
atgaagccttggaagttgagatatgaagcggaggatgcagaggagggagaggtcgaagccaaggaacttgaaggagaggactttggtagggacgacggagtagaagagggaggcaagggtttggaggaagttagggtgagagtaagagtgagggtttggaggaagtgtgaaaactacattgtgacatttcatgtgattgaaaatcacaccgcaatcgcggtccaatacaattgcaggcgctaccacaacaacaatattgtggtcataattgtgtttgcggactgctatgtaaaaccatgctttaaaggaaattcaggaaggatgaccataatgatattcattaaagataacacccttagaatgtcgatgttgatctctacagagaaaattttcgatgcttggaaatgcaacccaaacttgagcagtatttga

SEQ ID NO: 73236 - DNA, 318 bp, Glycine max
  Peptide Sequence Number=SeqID_164921
atggcattacgggccaatgcacctctcccgtatccccaccttgttactctttttcttcatcatttcaatgttcctttggatgatgaaccatatgtcaaggttaaaaggtctttctccattggtgtcgatgttgttacctcctttggttaccggaaggatgttgatgtcctcacagagctccacgatcttcgagcatttgtgggtgagcattttgatgcgatggatactcgctttgatgggatggatacttgtatcactaggcttgaagatgatatgagcttcatccggcgttgcttcgatccctcggccgactcttag

SEQ ID NO: 73237 - DNA, 261 bp, Glycine max
  Peptide Sequence Number=SeqID_164922
tgcacactggcaaatggtcgtcattttgctaaggaaaatcttgttgtctggttttgttccttgcataacaggccagacaactaccttaaaggaataattaatagtgctttgaaaggacttgatgatactccacaacctaaatccaaggctggtgcaaggtggattgttgttaagaccattgaaagcagagagattgaaggcgcttcgcatccagtgggcacaatattatctcaaagtcagaaatcaaacttaggatgttag

SEQ ID NO: 73238 - DNA, 384 bp, Glycine max
  Peptide Sequence Number=SeqID_164923
atggtgttgcatgcatgcagtgaaattggagcccctggtacccctgactttttcagagtaactagcttggcccttcccaatagccagcttttgggttccatttctgaagacttaggcttgatccaataccttcgccacattgatctttccaacaacttcctcaatggctatctacccaacactatcttcaactcttctgaacttcatgtactttccctctcaaacaatgttatctccggtgaactacctcagctaattggtaaaatgacaaaccttaaacttctcaacctctccgacaatgcctttggcggtttgatcccagaaaagcaattcttgatatatgtaaaacaaagtcagaacataaaacatgaacttgacaaataa

SEQ ID NO: 73239 - DNA, 429 bp, Glycine max
  Peptide Sequence Number=SeqID_164924
atggataatgaagagggcgtgcaggaacagatgaaggccgatctatcggccttaaaagatcaaatggcttccatctcggaggtcatgttaaaactccagaaaaccatagaggataaagccaccgcaaccgcctccagtacagttagggaagcggagccggtgctgcagcccgccttgaatccgggcctagacagaaacacggccatgttcgatcgaaggtatagtctgcaagcttatccttatggcctgcctccggacttcaccccccgtgccaccctggaagatttaagccaagcccctacttttgaggggcaactcccaccttatgaagactatcccgggcaagacgatggggaaggagatacccatcttggccccctgctccacctcaaagatccttccccgcatgaactacccagccgaacatag

SEQ ID NO: 73240 - DNA, 141 bp, Glycine max
  Peptide Sequence Number=SeqID_164925
atgaccatattatatgatgcaatcctccctaggaagggaccagtcaccagagccatgagcaagaggctccaagaggattgggctagagctgctgaagaagtccctagggttctcatgaaccttaagggctccataatgtag

SEQ ID NO: 73241 - DNA, 323 bp, Glycine max
  Peptide Sequence Number=SeqID_164926
ggccctggggtttccaactctggttacgggcctctgtagtcctacagggtgcccgttccccccggcaaggtcacgtcatcatagggatcgcgcctgcaagacacccagtggacccgaagaagtccaatagggtcttggagttgtcaagccctaattacggggcgaaacaccacagcagcctggggatggccagcagcgggcaacagagcaccaccatcacctctagagttcacctcagctcatccacaaaaaggtccgtgaccgacaagtcatcaggcgtcccagctcaagacgttaaagaagcgctactaggaggcaaccta

SEQ ID NO: 73242 - DNA, 786 bp, Glycine max
  Peptide Sequence Number=SeqID_164927
atgttccaagaggacggtccaaacgtaaagacaaaccctcttgctattcatgggggaccagcagttaatgcggtggaggagtgtggacctcggaggccgaagcaaatgaaagtggtaacctctaggaggtttatattgaagacgttgtgtgaggtgggcatcatttgctttgacgggggcaagggggatacttgcttcatacagtcgggggcagcgcacgaagtagagacatgccctgtggcagaggatttactgcaagggataatggatcaaggtcgatttgaagttggtggcacaagcaagggggagcaacatgtgtgcatgcaatcggttgacaaaagcccgagtaagcccaaaccattggtgattcacttcactagagatgctgccacccaaaagcctcaaggcttccaacctatcccgggtaagaagcctatccatttcccttacaagagtgacaaggcggtcccatggaggtatgcccctcaaaagcccgacggaaggaaggacgaatccattggagatgacctatcctctaccaaggttaccaacatctctggcatgagcagtatgacccgtagtgggcaaatcttcgtggcacccgacccgttggtgcagtctaaggacacaaagggaaaggcgaaggtgggcacggaagaaagcgacaaggcaagcctaattctagatgaggagatcccggctaggagatttgctaagggagaggaagacttcagtagaaagaaaatatctactaaagaagcaaatgagttccttcggatcatctag

SEQ ID NO: 73243 - DNA, 255 bp, Glycine max
  Peptide Sequence Number=SeqID_164928
atgcagctaacagagaatcaatttccggaaaaacgtcttccggaagacttccggaagaagcttcttccggaagacaatggaattcttccggaagaagcttcttccggaagtcttccggatgacgttcttccggaaattgtctgtgagtatttccggaagacacaaattattcttccggaagaaccttcttccggaagattaattgctgaagggcagtttcgctacttcactgtttgctgggtgccccagcaataa

SEQ ID NO: 73244 - DNA, 584 bp, Glycine max
  Peptide Sequence Number=SeqID_164929
gtgataagtattacgaaagatatgaagaaactgggcaacacctaggtccatttgctaagcttgttcagaaactgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaattcgctccaagctggactgtatgcacgaaccccccgttcagtccgaccgctgcgccttatccgtcatgcgccggttaaggctaaactgaaaggacaagttttggtgactgcgctcctccaagccagttacctcggttcaaagagttggtag

SEQ ID NO: 73245 - DNA, 499 bp, Glycine max
  Peptide Sequence Number=SeqID_164930
atgggacccaattggaaaactttcactgctcatgaggatgtatggaaagattacttaaagtcccacccaagtcacagcaaacttcgaggaaaaagtatggttgattatgagtatttgaagatcgttgttgggggtggagtttctagcgggaataattctatatcagtcgatccagatgatactgatgcaacaacttttgagccagaaaatagaactgttgggatagaagaattttcatatgatcctaatagtgatacattcataacaccaaataactatgaaccagcatatcagcctccatcaccaaaccaaccaagtccaccatcccacccccctttagattcagagggagttcaagcgctgttgggatcaacaatcaaggcaatcgttctggaaaatctttctgttggcattgggactattgctgtgaattttgaaaaaatatccaacatgatggagaaaagagaaaaagatagagatagagatagagagctcgagg

SEQ ID NO: 73246 - DNA, 315 bp, Glycine max
  Peptide Sequence Number=SeqID_164931
atgtttgtattcaatagtgctttgaaaggacttgatgatactccacaaagtaaatccaaggctgttgctaggtggattgttgttaaaggtacatcctttgtggtacaagtagagggtacatctacttgggttgttgtaactgagaacaagagaaggtacatctcttgtggatcagttcaagtggagggtacatccacttggttgttcaaagagaacaagggagggtacatcccttgtggatctttgcttgtaaaggcttttacaaggttgaaaagaaatctcaaggaccgcaggtcgcttgagaactggatgtag

SEQ ID NO: 73247 - DNA, 234 bp, Glycine max
  Peptide Sequence Number=SeqID_164932
atgggagctggccatgcccgaagtcgttaccttaaccgcaaggagggggatgccgaaggcagggctagtgactggagtgaagtcgtaaaaggtagccgtactggaaggaaagagagggatggggtttctcttgcttttggcatagcgggccccggcgggaggcccgcacgacgggctattagctcagtggtagagcgcgcccctgataattgcgtcgttgtgcctggactgtga

SEQ ID NO: 73248 - DNA, 763 bp, Glycine max
  Peptide Sequence Number=SeqID_164933
atggcatctaagaaaaggaaggctccttctacacctacccaggccagatatgacagatctaggaaactactaccagagaagaatgtggtagtttattacaccgagtttgacgagttcaaggaggaactcaagagaagacattgggatgagaagttaattgattttgctaatagtagcataaacattactattgtgaaggaattttatgctaacctctatgaccccgaggataaatcacctaagcaggtgagggtgagaggtcacttagtgaaatttgatgaagatactctgaacacatttctgaagaccccaacaattttggaggagggggagaatttgtctacttattccaggtttgcactcctgaggcctgatcctcaggagttggctgctaagctttgtatcccagggaggggattcaagataaatgttgacgggcagccgttgaagatactgaggaagaacatgaccaccttagctcagacatggagtgttctttccttctctaacttgatacctacctcccacacatctaatgtgaccttggatagagccaagttaatttatggcatcattatgaagatggatatgaatttggggtaccccatctcccaccaaatatctcttattgcacatgatacattcatacttggattccatgccttgatcacagctctatgcaaggccataggagttcagtcagattctagatccctggagaacttgagccctgccattaacttggcatatatcaagcagaact

SEQ ID NO: 73249 - DNA, 131 bp, Glycine max
  Peptide Sequence Number=SeqID_164934
atggcggaaccatcaaagaagagaaagggttcttcaagtcggagtcaatggcatttcgagactcaggaaatgccgattccttcctctattccctctgcctcattgttttcttctgaagaacagctgatacg

SEQ ID NO: 73250 - DNA, 252 bp, Glycine max
  Peptide Sequence Number=SeqID_164935
atggtatcgacctgggatggtcagtggttacgtccggtattgcttttctgtgcggggctggtgttattaccggtgattcaggagcgcttcccctctttatcggctgcccgtttctttactctcgtcgtcctttttttctggggcgtcgtctgtattcacctgcttgataccgcctggctttactggcgagacggcgtgatccactggggcgaaacgcggattgtttataaccgcacgcgcatgagcttccag

SEQ ID NO: 73251 - DNA, 435 bp, Glycine max
  Peptide Sequence Number=SeqID_164936
atgtcccagagcacgtcggtgccaagcggcgttgatacgcagcgtttccatccgggagataagcaccaggcccgggcgcattgtggtttgtctcaggatgatttctggctgggcgtggtatcgcatttgcgcccgaacaaaggccatagcgtactgctgcgcgccctggcgaaaatcgacaatccgcagatcaggctggcgattgttggcgagggcccgcacaaagcggcgctggagcaggaaatcactgccctggggttacagcagcgcgtagtcatggcggggcatcaatccgatccggaacgctggttcccggcatttgatattgcgctcagcccttcgcacgatatggaaggtgtcccgcagggcgtgctgcaatcgttagccagccgcattgcgaccattgcgacggatgcgggtggaacgggagatgcg

SEQ ID NO: 73252 - DNA, 507 bp, Glycine max
  Peptide Sequence Number=SeqID_164937
atggcagaatcgtcaaagaagcaaaagggatcattctccaccaccgctgctgctggccatcgccgccacggaccatctgaagcacccacaacaccaattcatccttccttatcatctccaagatcatctactctattttcttcagatgatcaatgtctagggtacaattctcaattttcttctaggatcattctagaccctaagtacctaaacacaaatttctttaatgatgagacatttgactattatcaagtgtttcaaaactctggattggttgattttatgtccttgaaattgccttactgtcctgaacttgttaaagtcttttatagcaatttaaaaattcaggatggtattatttcttctgaggtgcatggtatttttatgatcattgatcaatctttgttcttttcactgactaaattacccagtcaaggtgcaccttttgagggcaccattgttgatgattggaaatttgattattctaatcatgacgctcgccgtatg

SEQ ID NO: 73253 - DNA, 279 bp, Glycine max
  Peptide Sequence Number=SeqID_164938
atgttgtgggagtcaccaccaacgtttatcgtggaaaacgttagaaaaaccaaaaatgggtatgcgaaactgagaataagggcttgggagttgtttacgcatggggaagcgcctcggcctcatttttctattctttcttcttcttctttccctcttctctcaatatccgtcaatactaaaccttggaacctcttccttagcccccttcatgcctatttatatccaaaaatggcatttggaggacctgcagcttgcccaggcgagttggagctcgcctag

SEQ ID NO: 73254 - DNA, 321 bp, Glycine max
  Peptide Sequence Number=SeqID_164939
atgcaacatctaatgaagcttcttgaacgggatcaatatattcattggcatagattaaaggatgaagacgtgaatgatgatgatgttaacacaatgttaatgtgtaatcatcaattttcatgtgttggtacgattgagttattatgcaccattggtagaacaccagatggtatattaaacttacttgaagcgactatgacccctactcatgatgccctgctatattacaatgggaggtggaacatgccatgccagcatgagtttgttggttacttgttcataggaaaaaatcccaaaaagtttgacattccttctggatga

SEQ ID NO: 73255 - DNA, 725 bp, Glycine max
  Peptide Sequence Number=SeqID_164940
aacctggacagtttcttcctttctacaaggtcatgacaaaagacaaggttgatacctcaaagccctacactggggcaatgaggggcattgtgcatgagcctcgagtgaacctaggggcagatcaaaaggtggacccttgggtactagtacctattgccttcagaggactgcacgtcctcgctttcagagggctacacgccctcacctttagagggcttcacgccctcgcctgcacagggctacacgccctcaccttcagagggctacaggtccttgccttcagaggactgcaggtcttcgctttcagagggctacacgtcctcaccttcagaggacctcacgtcctcgccttcagaggcctacatgtcctcaccttcagaggactacacgtcctcgccttcaaaggactgcaggtcctcgctttcagaggactacacttccccagcttcagaggaccgcatgcccttgccttcagagggctacacaccctcaccttcagaggactacacgtcctcgacttcaaaggattgcaagtcctcaccttcagagggctacacgccctcctcttcaaaggactacatgtcctcgccttcagaggactgcacgtccttgcctgtagagggctacacgccctcgccttcagagggctgcacgccctcgacttcaaaggacttcacatcctcgcctttggagggccacacgtcctcgactttagaggactacac

SEQ ID NO: 73256 - DNA, 183 bp, Glycine max
  Peptide Sequence Number=SeqID_164941
atggcagaaccacctgctgctgcatctgctgatgtagacatgcctcgacatgctcttgaggcttgccaaacaatagcagaaaggttggaatgcttgatcaacctgagggtagtcactaaaggaacagaagcatacactgtgaccaaggagtacctaaggattgctagaggtacgactgcttaa

SEQ ID NO: 73257 - DNA, 780 bp, Glycine max
  Peptide Sequence Number=SeqID_164942
atgactgatgggttcgatgaggaggccattgcccagatattatgcacatcgggtcaggatttcgcccggaccgctgcagggaggcgggtgcggatcatgcgcaccagcatgaccaccttgacccagatgtggatgacattgctgctcaacaatgtcttgcctagtgatcataattccgaccttcctctgccaaagtctcggctggtgtatgccatcctgacacggatgagcatccatgtggctcagttgattgctgacgccatctatttatttgcaggtatgccacccaccaagcaccctttagacccggataagtctaacagggccctggggtttccgacattgatcacgggcctctgtcactcattcggggttcccgttactcctagcaagtattgctcgcgtaggaaggcacagggtgatgcacctcaggccgcagacgcaccaccaccacctcatcaagctgatcccgctgggtcactaggcatggagcgttatttacagcacttggttcgtcagcaggcggccaaccactgggggcaggtacagatacatgagtgtctctaccagctcagcctcagtcagcaggggcagggtttcgctccttttgcgtgccctactccggatcagtttagggctaaggtcgcatggcccggagattggctcgaggcccatgcgggggagacgcctgcaggagctcccggcgatgcagaggaggcctgtatggatgaggagatgacagacttgctcagtttcttgggaggaagcggagccacgtga

SEQ ID NO: 73258 - DNA, 153 bp, Glycine max
  Peptide Sequence Number=SeqID_164943
atggctctaaattccctacactgtatgaaatctctaaccaacaacagcaacctatcagcctcttgggaagtcataaggaggaacgctacaatggctgttgaattcctagaggaaacagtagggctagcagtacaacaacaaggagcagactga

SEQ ID NO: 73259 - DNA, 180 bp, Glycine max
  Peptide Sequence Number=SeqID_164944
atgtccagcggctttggccaatacggcgatgccgcccataaaagtgccgcaaataccaaggatgtgaatgtgcataaaatttaccagaacagtttaacgcatgcattttaccaaacaacgcctggggttggtattggcggcagcgtgctgcaatatccgcagcctggaaaatgtcggtaa

SEQ ID NO: 73260 - DNA, 330 bp, Glycine max
  Peptide Sequence Number=SeqID_164945
atgataaatgcaggaatgatatgtccattacaatgccatgaagagatgcatgatgtgatcaaggaacaagccagagtactatcagcggcaatgcatcaccgagagaggaaaactctagatgaggcttcactgttatcaagtgagtcggagacccagcatgaccacaaatcgacctccattccttatggctcacatagacccggatccccagtggagtccccatttgccgcaacctaccctacgatgggagtgcaaggagaaacaccaaaggagcgtcttccaaaaaggaaaacgtgtgggagtcaccaccaacgtttgttcgaggaaaac

SEQ ID NO: 73261 - DNA, 646 bp, Glycine max
  Peptide Sequence Number=SeqID_164946
gcttatgcgggatagggcactttatagagtgacatcagacttcgttgatgcagcaattagtggtgctgttggagtgattagtggctgcattcctccaataaacccaactgacccagaacatttatacattttttctgttgatacggaccttcagaagttgtcaaagaaatctacagatgataattcacaaacatggagtacaggcaccccacacagttcttctgaaaaatcttgtgacttccaggttcctaatggggggaataatgatggttcaagctcagaagataaatttgtgattctgctctatcctatcctaacagaattgggattgcacaagcaaatggcaagcattgtcgtagtggtgcgccccctacaggatgcgccagctcagcaaagtaatggtgcctatgtagtgttgctgctatcaatcaatgacatggaagttattcaagatattcctcctgaagctgaactggctgagagtgatgtggccacatatgcttctttaaacaatgatttgaatggcacaaaggctgaccaggaagctgatgtcccaggacttcacaatcttgctgtggctataattgactacaagattttttcattgttctgctatatcaggaaacgggagaaggtaaaaggataa

SEQ ID NO: 73262 - DNA, 131 bp, Glycine max
  Peptide Sequence Number=SeqID_164947
atggtggaaccatcaatgaagcgaaagggcacttcgagtcgaagtcaacgacattctgggtcacaggaaacgccgattccttcctctattccctctggatcattgttttcatctaaggaacagtggatacg

SEQ ID NO: 73263 - DNA, 210 bp, Glycine max
  Peptide Sequence Number=SeqID_164948
atgcatgaaggaatgcatataacacagatgcaacttaggaatgcgggggcccgagaaattgtctccttcttagatacaacgtctagggttagcaaagtgccccaacgtgacacggaccctccgttggtttgtttacagaggggatcaagacagaacccgtatgcgatgcatatgcaaaagacgcaatacgggaatgacaatattcactga

SEQ ID NO: 73264 - DNA, 519 bp, Glycine max
  Peptide Sequence Number=SeqID_164949
atgaatgaagttcttggaggatacttcgctggaaaggttcttggcataatagtgaagttgactgctaaggcgattgctcaaggcataggctgcgagcgtcgtggaaccaagttcatgaataacaggggaaatgaactagaagactacattgggggcactccttgtgaggaactgggcgaagattccaaggaaatatggaaccctattgagcaagttggacttaacattgggccagatgaccagctggatgcaatttgggagaaagctactgagcaagatgaaggaatggatgcaaacgcaaccacttctcaagttcaaaagaaaactaagaagaaaatggacacttcttcgtccaaggttgcttctacttaccagcgtccacctcccactctctttgctcctaacacaacaggtgcaatggcctatgtgtccagaagggtagcatccaagaagcagcaaccttcatccactgtagattgtgtaatgacccgcctcatcgctacgatatcaccactctaa

SEQ ID NO: 73265 - DNA, 243 bp, Glycine max
  Peptide Sequence Number=SeqID_164950
atgtcccacgctgttaaggataatcgaggcaagtggaccccgaaatatgaaggacctttcgtggtgaaaagagcttttttctgggggtgctctaatactcacccacatggatggcgaagagctgtcctcgcccgtgaactccgatcaaggagcagaatcatctcaggccacagtcagaagtcaagacaagccgatggcagaaatcaaccaaggtacttagggacggaggcaaatggaggatag

SEQ ID NO: 73266 - DNA, 189 bp, Glycine max
  Peptide Sequence Number=SeqID_164951
atggataccaatgcacatgcatttttatcttgtgaatcgaaagacagggataggatcgtttcaagcgatggtcaatacggcgccaaatccaagacagggatgaatcgaggcactaggcctgtgatcaacaaatcatcatcccgcgatcggctccacacgttaaggaggccttactgggagacaacctag

SEQ ID NO: 73267 - DNA, 183 bp, Glycine max
  Peptide Sequence Number=SeqID_164952
atgtatgggagtctgcccaaattcacattgacgtttgcattttcggaaggagtggtacccccctattgtttggtcttacttataagatgcaaattcagggagatggctccgaagaagctctccacaaagaggtctaggagggacgcctgtaacatcctggaaatttctacccggaatttttga

SEQ ID NO: 73268 - DNA, 754 bp, Glycine max
  Peptide Sequence Number=SeqID_164953
ggttgcacgccattgccttcagaggactgcacgtcctcgccttcagaggactgcacgtctacaccttcagaggattgcacgtcctcgccttcagagggctacgcgtcctcgccttcagagggctgcacgcctcgccttcatagggctgcacgccctcgccttcagagggttgcacgccctcgccttcagagggctgcatgtcttcgccttcagagggctgcacggcctcgccttcagaggattgcatgtcctcgcctttagaggactgtatgtcgtcgtcttcagagggctgcacgccctcgccttcagaggactgtatgtccttgcctttcgagggcttcacgccctagccttcagagggttgcatgtcttccccttcagagggcttcacgtcctcacctttagagaactgcacgtcctcaccttcaggggactacatgtctttgcctttaaagggtttcatgtcctcgccttcagagggctacacgtcctcgccttcaaaggactgcacatcctcaccttccgaggattgcattccctcgccttcagtgggctacacgtcctcgcttttagagggctccacatccgcgccttcagggaactcaagttcctgggccacccccttgatctcggaggagggccaactatgcgagcacaactagaggaggaggcagaccactgcaaggagatgagtgcagatcctgcgcaccaacatgaccactcttatgcagatatggatgatgttgctacttag

SEQ ID NO: 73269 - DNA, 672 bp, Glycine max
  Peptide Sequence Number=SeqID_164954
atggaggcattgcgcgaggctggtgtaattgaccttgacggtaaaaaaagagattcgtgcttgatgcatccagaggtgttgcacaatgtggaaacttgcccaatagctgaggatttgctgcagggactgataagtaggggtcaaattgaaatctgcagtgcaaagaaggaggaaggaaaggtatgcttgcaattgggtgagagaaacatgagtaagcctaaacctttggtgatccatttcaccaggggcattaccactcatatacctcgaggtatccaggctcatatagcaaagacactaggacccttcccttgtaagagtgataaggcagtaccatggaaatatggcgtacaggggcccaacggaaggcaggacgcgtccgacatacgtgttgggaatggcatgcctgttgctaagatcaaaaatatttccggtatgagtggcatgactcgtagtggatgcattttttctcctcccgaactactggcaaggtcgaaagacaagggaaaggaagaggcggatataggtgagagggagaagacgggcccgaccgtcaatgatgaggcccttattggaaaaattgcaaaggaaggggacgactttagcaaaagagagatatcaactgaggaggcgactggattttcgagaatcattcaacagagtgaattcaaa

SEQ ID NO: 73270 - DNA, 300 bp, Glycine max
  Peptide Sequence Number=SeqID_164955
atgactggtattccgaagccattcgacacgtttagcaggggtgccgcattagagcaggtgccaataggtgctaagtccataatcggatttgctcacaatcaaggaaaagatttagggaggatgagatgtcgaccacagaccacgcgtccagctaaagacgttaaagaagcactcctaggaggcaacctagcaatggctccaaagaagttttctgctaaaagggctaggaaggccaccacaggggagggatctagtgcagcctcgcaagcgaaaattgagtttgacaggcactgtttctga

SEQ ID NO: 73271 - DNA, 477 bp, Glycine max
  Peptide Sequence Number=SeqID_164956
atgaaccctactgattttcggtttctgcttgctccttcttccattgaagctccttcacctgttcttccattgaagcttctaccccttcttccattgaagctccttcagctcttcgacttcatcgctccaacttctccgctcgaagcttcgttaattggttcgtgtactgttgaagaaaggcttgaggtctttgaccgcgagaagtttaacaattgggtggagaagggtgtaactccagccattgaacccagtttaaagctctatgaagatgttttgaatctgggattcaaggttattctactgacaggacggagtgaaaggcgcaggagtgtcactgttgataatttgatcaatgctgggtttaaggaatgggaccagctcatactaaggaggaatcttgcaaacaacccattgattccagcctccttttttcgatggacagcagaatctgcttacctgaaatcatcttggcgctaa

SEQ ID NO: 73272 - DNA, 357 bp, Glycine max
  Peptide Sequence Number=SeqID_164957
atgccgctaaaagcaacagaactatttttcaaaagctggcaaggtcagttgcttttaaatttgatatacttttgccattggaactttgatgacttgcctattgaactattttttctccattggaactttattgacttatgttgccaacttcttcttggacaacttgtaatggtgaaaccttctgaagctgaaaagaaccttgttcaatctaatgcttatggtggagcagccggtgtaactggcccctatggagctgtggaccaaaaattgtatgtggggaatcttcacttcaacatgactgagagtcagctgtgggagagttttggcatgtttcttggtctttgctacatttattag

SEQ ID NO: 73273 - DNA, 387 bp, Glycine max
  Peptide Sequence Number=SeqID_164958
atgactaggggcaatctaggtgatttacaatcctttgatcctgaaatagatagaacctttcatagattagttaggcatagtgttcatcctgatcattctgtgcattttgagcattctgagtattttgttgcttgtgattctgaatattctgattttgagcattcgactactaattttcatactgagaacatggctcaacctccaccgtgtgagaggactcttagggagatggctgcacctgatttcacttatgaaagcttgtgcattcaatatcctgatgaggatcctcataagcatctgtcataccctaatttcgtccggggacctttgcttgatgacatgcgacctttctttggtccttgtgaggtgcttggcacccatcattag

SEQ ID NO: 73274 - DNA, 543 bp, Glycine max
  Peptide Sequence Number=SeqID_164959
atgattacaatagtaaaacaaaaaacaattatacttacaactcaacctatgttaatgaaccaagtagattgggccagagatgcaagagaaggccctagggttcttatgagccttaggactcatcttctccttgaagtgacgtctcctctctctcttcctttctccattccgctgccattcatcttccaagaagcaaaggaatccattgatgaagaagatcctaggcctacaagctccaatggagcttgcatcagtgagtcatcgaggcatcaacaattagaggtgctacaaatggtattagagaaagtctctctcgcagttcggtgtggtttgtggatgtacctagtagaagcttgtgaacatgtaacaccttcagcaaatacacaccaaaatgaaagagatctagaggttgtcaattatgagatgagtgacttcctaggaagttttctaggaagcatactaacaaagtgcattcagtgtaataaaaagaaaaatataaagggtgaaataccggaagacatccatcgttctcttagagcttga

SEQ ID NO: 73275 - DNA, 614 bp, Glycine max
  Peptide Sequence Number=SeqID_164960
gaagagctttaagtagagaagtaagccatgatgctgatgaaggccctcagcgacgaaggcccacaacatctgcacgtaggcaatgggaagttacgcctattgctgaggatgttaagcatgtggatcatgctactaaggaggtccatgaacaacctcaagaggcacctgctgctgatgtagttagtgatgtggagggttttccagacaggcctcacaacacatcagttttgatggactatgttcatcatgtgactgtgatagtttggaatgaagaggaacgttttgagttgaagttgttctcccatggaaggaaggtagaaaaatttggcaggtcagctcctaagattgaaagcttagtggttgtcacaggattaagtcctctgatcgcatgttcgctggacaatggtgatcggggacttgtgtctacttttgcagagaggtggcataaggaaactagtagtttccatttgctggtaggagggaggcaagagcagagacgatacaatgccatggggcatatgttcgtctatcctggctacgagacatatatcggagcaaatgtgacgtggcaaagtggactatggcagctccaacatatttgttgcatctactag

SEQ ID NO: 73276 - DNA, 303 bp, Glycine max
  Peptide Sequence Number=SeqID_164961
atggttgtcatcatcaaaaagagggagaatgtaaataccaccgctacaacctctacggtggtttgtgggcaagtagaggttgtagcggtggttggattggccattaacagcggaggtaagatagacgaagatcagtggatgtatgacattataatgtctgaagaagttgatatgaatgaacaaaatgaagacgaagcgggtgtgaatgaagaacatgttgattattgtgatgcgttcaatacttttcaagtgtttgctacccttgatgatgttctacattgggctcgatctattgcgtattaa

SEQ ID NO: 73277 - DNA, 384 bp, Glycine max
  Peptide Sequence Number=SeqID_164962
atggagctacatcaattggagaagctactgatcctgaggatcctgaccggaggaacagaagcctatactgttgctgaagaatgtctgagcatcgcaagaagctacattgaccaaccaattggaggtcacagatcgagatcaccggatggtatactaaacttacttcaagccactatgactcctactcatgataccctgctatattacaacaggaggtggaacatgccacaccaagatgacttcatgggttactcattcacaggaaagaatccaaaaagatttgacattccttcgggatgtagcatcgacggaatcaaggatgtgatcatgcaagttgcacctcaagggattccccttatggtattcatgaatcataaatggtaa

SEQ ID NO: 73278 - DNA, 177 bp, Glycine max
  Peptide Sequence Number=SeqID_164963
atgggctcaaaaatctatcctaagaatgacccagcctgggttggtgacctagaagatactgaagatgcttttttggtagtcggctctggaagagccagtttgaaaccttttcctgagcttcagcctcctctcagggaggtccctactgccttaggaggcatcaccgtttttctgtaa

SEQ ID NO: 73279 - DNA, 297 bp, Glycine max
  Peptide Sequence Number=SeqID_164964
atgaaaagggaaaatggtgagagaatcagcgatgcggaaagagatcttggggcgatcgcaggaggaaggagcgagaagcgcggatctgaggagcgagaaagcaaccattggagaaggcgaagaagaagggagcaaaactcaaaccctagaaaattgaagagtgggttgttgaggtttatgcacaagagggggagcgcgacgtggatggagaagtgggagccgatgtcgctggttgtgggtgggggcagcaaggaggacgaggcggttggaggaggagacggactgcgtgagggttga

SEQ ID NO: 73280 - DNA, 333 bp, Glycine max
  Peptide Sequence Number=SeqID_164965
atggatgaagatcaatggatgtatgacactatagtgtctgaagaagttgatatggatgatcaaaatgaacaagaatgtggtgtgaatgaaccacaagttgattgttcggatgcgttcaatacttctcagtgggctcgatccgttgctcatgaaaacagatttatggcggtcattataaggtttgacacaaacactggagtggtgagtataggtgtaggaagaatgaatttgttagaagagatactggggattaggaaatgtgggtgtcccttcaagctttgtggcaaaccagtggttagagggcaaggttgggatggtgaagttgatgtctag

SEQ ID NO: 73281 - DNA, 798 bp, Glycine max
  Peptide Sequence Number=SeqID_164966
atgttcttgtgttctatgctgaagcctaaagtagtaaacttcaatcccttattttctcatcatgctaagcgcactgtagctgcgcttagcggtagatgcgcgctgagcccgcagcggcgaaggcctacaacatcggcacgtaggcaacgggaagttgcccctattgccgaggatgagccggtggtagctgcagacgtacatgcacctgatgctgatgctggtcatgatgctgagggatttccaggtgggcggtgtgacccatcagaacatcttgaattgaagttatcctcccatgggaggaaggtgcagaaatttggtaggcttgctcctgaaattaagggcttagttgctgccacaggactaagtcctttgattgcatgttcagtagacactggcgatcggggacttatatccgcgttcatgaagagcatcaccctggatgatgtggtgtctctccttcatcttcctattgttggcgccttccataacttcgagcctctgcatgtcgatgaggccatgttgatgttggtggagttactagaggtctccggagaggaagccagggcagagacaacacagtatcatggaccatactgttggatatatgagcactttccgtcagttgcggagtatatggctgattcggactatgatgaggtgtcaccacgtgcatgtcggtggaatgctacgaaggcgactttgaagtccatatctatagcgacgtacaggcaacgtctagatcgactcaggattcctgatgtctgctggatgccttatggggagcatcgacctgtttga

SEQ ID NO: 73282 - DNA, 932 bp, Glycine max
  Peptide Sequence Number=SeqID_164967
atgagccaatcttggtttgatgtaggacatggatccgataaagaagatggtggcgggaaagagttgggcatggcatctagtatatcttcactaatcgtcataggggctggtggaggtgtcatccgccgccgccgctgtcgccattttccggcggccatttctccggcgaagccagggttaggcttgccttgggaagctccacgcgccgcgcctccgccgttccctccgtcggctccccctgagtccgttccagccctcagtttccagtttccaggtttcatcttgtgggtcaaaatgacttcccctggacctgttttctccttctccgggactcccaccatcacagctgctaaactaaactggaaaaattacccctcatggtctgcttccgtagaactttggtttctcggtcaaggacaccatgaccacttggagaaagcttccgattctgtttcaagtgacaaagagccgaatgggagaaacttgactatcaactgtgctcaagaaatttttgccaatgatgtccaaagcttatttgatgcaaccatgaaggttacagccctcaagcaaaccagccatgacatgattgctcatgtgggtaaggctcgggctaccgtggaagagctgagaaagtttcttgtggctgattcattggaagaagtgaacaggaaactggacaagttttacatggtccttatcttgagaagcttacactcagactttgatcatgttcgtgatcaagtactcgctggggatcaggttccatccatggattctctcatcactaggcttctccgtgtgcctcacgtatcgaaggatgaaaatcctactgatagtgtggagacgtcagcaatggttgcatctcgtggtagaggaggcggccgcaacagcagaggaggccgtagtggaaggggtgaacgtcctcattgcac

SEQ ID NO: 73283 - DNA, 282 bp, Glycine max
  Peptide Sequence Number=SeqID_164968
atgtgttttatgtctcaaaacatatgtgaattttattatgaagagaaagtccattatgaagcttgggaaagatctaacaaactcagtctaatgttcatgagaatgattgttgcagacagtattaagacaactctccctaagaccgataatgctgaagagtttatggggttagtgggagagcgctctcaaacgactgataagtctgttgctgggacattaatgagtacattaaccaccatgaagtttgatggttcgcgtactatgcgcatgtcattgagatga

SEQ ID NO: 73284 - DNA, 132 bp, Glycine max
  Peptide Sequence Number=SeqID_164969
atggatagaagactccaagaagattgggccaaagatgcaagagaaggccctagggttctcatgagtcttagggtagggtaccctagaattgtaggatttttcagcccttgtattttagggcaccaagactag

SEQ ID NO: 73285 - DNA, 480 bp, Glycine max
  Peptide Sequence Number=SeqID_164970
atggagggggttttcccaagtgtagggatgcttgaccctctagagaaattggaatggggcaatagcccaaagccaaagccttctgttgaggaacctcctgaattggagtttagttccttccttccagcctcaattctcaaggacaacaatgaagtctttgggtggatcacccatgacataaagggtttggaccctacacttagcacccacaaattcaacattgaagaggggtttccacccaaatggttattccaaaagagacttaatccaaacataatggaggttgtcaaaagagaggatgttaagcccactttcaagacgaatgcacataaagtcaaggctcgtgacgttaaagaagtgttatctgggaggcaacccgtgattgcgttaagcatcaagtatgatcgtcatcatttgaccatgacccaaacagttatcataggtgtcgaatacaactgtggtgactctactacagtgtga

SEQ ID NO: 73286 - DNA, 315 bp, Glycine max
  Peptide Sequence Number=SeqID_164971
atggttgaagctcactctatctctttccaatggtatccaactacaagttgcctcgacatggtgctgatgcttttcatgatccaaccttatacaggcgctctacctcagggactgctattttactttgctccaaacttaatctctcggtggtctcgaaagcagaaagttactgtcaggtctagtacagaagatgagtatcccactctagatcaatgggctgatattctcaccaagcctctttttgcaccacgatttgaagttcttcaaggcaaactcaatgtgaagagtgtttctcctgaaaactcttccccttga

SEQ ID NO: 73287 - DNA, 813 bp, Glycine max
  Peptide Sequence Number=SeqID_164972
atgaaaactcgagcacgacagctccgcactgtcatgagagcagttactcttgacggcaaaacaattgaggagtacttgggaaaaataaaagggtttgtggatgaacttgctggtgttggtgtccttgttcatcatgaggaatacgttgacgcgctacttgaaggactgtcgtcggattacgcgtcggtggtttctgttatcgaaagcaaaaagcaaactccgtccaccgcaaagattgaagcgttgctctatggacatgaaactcgactcatgcgctacaacaaagaagcacaggctatttgtatcccaacacctataaaactggtggttctcgcaatgcatgtggtcgtggtggtagttgtggtgcctttttggaccgtggtgcgggccatggtggtggtggcttcggccgagatcgtggtggtggacgatttgcaaattttcaatgtcaaatatgtctcaaatttgggcacacagctaatgtttgtcattttcggtatgatgcgaccttccatcctcatgaatctttatctttcattgatcccactacattacaacttatcccatactctactggttcagtcagaacctcaaacacctgggttaatccaaattctaagaattctggtccaattcatagtcaactcagtgtcatgctcactagttcaacctctcaagggaatggccaagctgagaccaataagatccttcttaaaggagttgttggtgctgatggactttactcctttcataatctcaagcttcaagagagtcactgctgatgtctgctgtttcaagtgttgcctctcctag

SEQ ID NO: 73288 - DNA, 243 bp, Glycine max
  Peptide Sequence Number=SeqID_164973
atgatagtgtcattgatgctggtggtggtagcgatgttggtggtggcatcaagtggtggcaatatggtggtggtggtggtggcggtgacgatgacattgatagtaatggtgatggtgatgtcatctagttatggcagtgacaatgatggtggtattggtggtggcaacgacaaaggtggtattggtggttgcggtgacaatgacattgatggtggtgctgatggtgatgtcgatttcatctag

SEQ ID NO: 73289 - DNA, 693 bp, Glycine max
  Peptide Sequence Number=SeqID_164974
atgggttttactttagtagatcttcaaaaggttggttacaacgacgacccattcatcatggcagctcaagatgaatctttaaagaacctaatatgggacgacattttgggcaaatttgacatccctaaaggtgacaaagctaaaaagaaggtcatgtcaacggtcgctactagatgggggcaatttaagtcctcgctaatgacaaaatatgtttatgctgacaatgaaggtcaacaaaaagatgatccttctgttaagtatggttttgatgcagcaacttgggttgaatttgcaaaaagccaccaaacacctaattggcaggactttttagaagaacagacgatgcaaggcagctttgttccgcatggtcgtgaggacatattgaacactgctattggccgaccagagcatccaggtcgcgtacgtgcaacagggacaggtgtgacaatcactcaacaacaattagttgaaatcatcggtaacctgaaggaagagcggaggaaagaagtagaagaagaaaataataacctacaggaagcatggaggaggaaggtggatactagaggcttgtacgtagtgagtgaggagtctactcaactagtggcattgggaaaagtgtatgacagttcatccaccatacacaatgtctcttatgcagatgatgtggttagggtgagagttgtgaaagtttaa

SEQ ID NO: 73290 - DNA, 423 bp, Glycine max
  Peptide Sequence Number=SeqID_164975
atggaggtgccagagggtcctgggactgatgatgatagtggtggagctggagcagaaggagctggaggtgtaaaagaagaaggagcagtagtagaagcctccggtcctcgagcccgtgccttgcgggtccttggaaaagtgatcgtgggatcatccaggttccaacaatttttctttatgtatgccaagttaatggcagggctcaaggacttaaatgtcaatgattatggaactactcctcgggccacgcacagagctgtgatgagtgcgggaaaactgagcttggaggagttagaatatgacaggacgctccaggtctgtgccagtgtagtcaaatccttccttaagagcttccagggtgcgccttctgcattaagtacatatcccttccttgggatgcagagtctagtagctagctcttga

SEQ ID NO: 73291 - DNA, 669 bp, Glycine max
  Peptide Sequence Number=SeqID_164976
atggaaaattcaagcgaagatttttcaaaatctcatggaaacaggctcaacaagactcgcgattggatcgtcgccatcaaagccttcttgctgattcacaggctcttgcttgacgcccaccctgccttccaggacaagatcatgcactccacgcgcctcgacacctcgaggattctcaacatgtccaacttcaaagacgatgcacattccaactcatcggatcaagtgggtttcgttcgggtttactcgctgtatcacgatgcgaaggttgattttgtggcttataggagaaaattaagcaacggtgttgttgaatctgtggagtttagggatgagtttggttttgttgagagagagagagagaggaatgaagttactcctgtgagggaaatgggagatgagagagttttgaagaggttgaaccgtttgctgtggatgcttgatcgtgtcttgggttgtaggcccagtcgtgctgccaagaacaatagcttggtgctggttgcgctttaccaggttgtgagggatagttttaagctttatgcagagatggagtatgagcattatgttgttggatcgatgtgtgaaggcctttttttaattcagtccaaagacttaccacatagacatatgactaacagtggaaattggattttaacggtagggacttag

SEQ ID NO: 73292 - DNA, 534 bp, Glycine max
  Peptide Sequence Number=SeqID_164977
atgggtggtggtgcatggccgttcttagttggtggagcgatttgtctggttaattccgttaacgaacgagacctcagcctgctaaatagctatgtggaggtctgtgatgcccttagatgttctgggccgcacgcgcgctacactgatgtattcaacgagtctatagccttggccgacagatcattgcaattgttggtcttcaacgagggaattcctagtaagcgcgagtcatcagctcgcgttgactacgtcccctgccctttgtacacaccgccccgtcgctcctaccgattgaatgggtccggtgaaggtgttcggattgcggcgacgagaagtcgtaacaaggtttccgtaggtgaacctgcggaaggatcattgtcgatgcctcacaatcagattgacccgcgaacttgtttattcatctaccgtcgggagggaggggatgaccacggcgccccgtgcgcccggcctcctcgtcctcgcgacaaacacaaaccccggcgcttcgtgcgccaaggaactcaaatctgttaa

SEQ ID NO: 73293 - DNA, 450 bp, Glycine max
  Peptide Sequence Number=SeqID_164978
atgtttggaggcaaaagcaagaatcttggcaatttcacaccttttttgccaagaggtgaggcatgccaccgttcatgcacagagaaaggaggggcaaattgggaccaactcttagcaaacaaagaaggagcatctgtcaactggttccctcgatggaaggaaggaagaaccggagttcttatttcatgcggaggatttccaaatgttcccttgatggggacgaggggttgcatcagctacaatctcgttcttgctataagacaacttggctaccctatgagaggggcaccactagaggatgagctctcgcctgtcatttcacgaggcttcaataagaccaacatggagacacttcagaaggtccgcaaggcatgggaggtgttgcaaaagaaggacaaagaactcagggtagtaacaatgggcccatcggtggctatcgtaagtggttaa

SEQ ID NO: 73294 - DNA, 462 bp, Glycine max
  Peptide Sequence Number=SeqID_164979
atgggagctggccatgcccgaagtcgttaccttaaccgcaaggagggggatgccgaaggcagggctagtgactggagtgaagtcgtaacaagggctctcagccacatggatagtttaatgtgctcatcggcgcctgaccctgagatgtggatcatccaaggcacattagcatggcgtacttctcctgtgagatccaatgtagatccaactttctcttcactcgtgggatccgggcgatccgggggggaccaccacggctcctctcttctcgagaattcatacatcccttatcagtatatggacagttatctctcgagcacaggtttaggtttggcctcaatggaaaaaaacggagcacctaacaacgtatcttcacagaccaagaactacgagatcgcccctttcattctgggggaccaggagattggatctagccataagaagaatagaatgcttggctga

SEQ ID NO: 73295 - DNA, 512 bp, Glycine max
  Peptide Sequence Number=SeqID_164980
attttccttccttcgtgggcgcggcggagtgcattcatcgctcggagagtgttttgacgggagctactaggcttcgctcgccgccgactaccaatccaggaggaccccctcggtctccattgcgtgcaccacaaacgactgatacgaaacgggacgctcgctactacgaacacagcgggatttcggacttgtcgtgcgtaagcttacgtacttccttcgtgcgtccatctgctctgtgcggcgtgattttgcctcaggacgcgactaccggaaatatttcagctagaagcacattcgactggttggcgacaccgcgggtaggaacgaaaaatacggaccatgaatcccacggatcgcgtgcgacttacgtacatggacgcgccgatgtcacaccgagggaaggcacttactcgcgcaaagcgttttcggctaaccatcccaagcaccagaaggtcgactcttttgtcagggaagcgacacaaacccagaattcattctctctcctcctatag

SEQ ID NO: 73296 - DNA, 1070 bp, Glycine max
  Peptide Sequence Number=SeqID_164981
atgagagggcagcacgccctcaccttcagaggactacatgtcctcgccatcaggggactacacgtcctcgcctttagagggttgcacgccctcactatcagaggattacacgtcctcaccttcagagggctgcacgccctcgccatcagtggagtacacgtcctcaccttcagagggctgcacgacctcaccttcagaggattacacctcctcatctgcagagggctacacgccctcacctatagaggagtacacgtcctcggcttcaaagggcaacaagtccaaacctttagaggactacatgtcctccccatcaaagggctgcacgccctcgccatcagagggttgcacgccctcgccatcagaggactacacgtcctcgccatcaaactgctacatgccctcaccttcagaggattacatgtcctcaccttcaaagggttgcacgccctcaccttcagaggactacacatcctcacctttagaatgctacaagtgctcaccttcagaggactacacgtcctcgccatcagagggcaacacgctctcgcctacagaggactacacgtcctcgccattagagggctgcacgccctcgccattagaggactacacgtcctcgccatcacatggctgcacgccctcaccatcaaggaactacacgtcctcgccttcaaagggctgcacgccctcgcttttagaggactacatgtcctcgccataaggggactacacgtccgcgcctttagagggctgcacgccctcactttaggaggattacacgtcctcaccatcagagggctgcacgccctcgccatcacaaggctgcacgtcctcgccttcaaagggcaacacgtccaaacctttagaggactacacgtcctccccatcaaagggctgcacccctcgccatcagaggactacacgccctcacctttagagaattacacgttctcaccttcagaggactacacgccctcaccttcagaggactacacctcctcgcctttagaatgctacaagtgctcaccttcagaggactacacgtcctcgccatcagagggctgcac

SEQ ID NO: 73297 - DNA, 580 bp, Glycine max
  Peptide Sequence Number=SeqID_164982
atgacgaatgaagaacaccgaacgaataacgatgtagaagtcgattacggtcgcaattcggaaataagggcatctgggactatggtagctcacccaagcgagttgttgcttagtccagaagaaactggctcgctcaagagagctgcagctcgcccaggggtacttcaggatataccccaaggagagaaagttttcctaggaggggatctcaatggacatgtaggtagcgtggctagaggttttgagggggtgcatgggggttttggcctaggggagatgaatggggagggtaaatccatcttggagttttcggaggctttggatctttctgtagccaatacatggtttaagaaaagagaggaacatcttatcacttacaaaagtggagggacatgttcccagatagatttcttccttatcaggaagtctgataggaagtattgcttgaactgtaaagttatcccgggagagagcttgactacccaacatagagttttggttatggatgtaagaattagagatagggcaaagagaagaagtcctattgtagcaccaaggatcaaatggtggcacttgaagg

SEQ ID NO: 73298 - DNA, 129 bp, Glycine max
  Peptide Sequence Number=SeqID_164983
atggacgttccagtggacattatgcacttgttacacaacaaccacttagaggaagggccaagcagggaggacaacggctataaatcaacaactccgaattggattcaggtttctcctcaacaaggataa

SEQ ID NO: 73299 - DNA, 714 bp, Glycine max
  Peptide Sequence Number=SeqID_164984
atggccacttcacctgtctcgcctcctcctcctcttcctcctcctcctacagacgcatcagcgtctccatctacgttgaagcggacacgcaaggcgacacggctacgaacattggccactagaccacctggggcagaaagacctgtggtcaatgtcgatcctgctaccggcaaggccgaaggtctccacaagaagaaattaagaacatatttggagattgttgcttgtgataaggtcgacataacatatgacacctggaaggaagtgcctactgctcagaaggatttgatatgggaggatattcagaggcagtttaaatctgacttgactaggaaatgggcacttgcagccgacaaagacggtgcgaacgacattgtctgtgaaaaatatggcattagcagggagaaatgggctcagttttgtcagacacccaaagacccctcatgggaggatgtgcggaaaaaggcacaggcctcccagaagcaaaacactgccccccacgtattgtctcgtgggggttatgaatatttagaagaaaagctcatggctgagaagacaaagaaaagactggaagaagctgcccagtctggaagcactgaaagcatcattgaccctccatctcccatcagacgccacgtgaagtggaagatggcccgcacaaagaaaactgggcaaatgacgtctgaggcagcaaaggaaatagctaacaggatt

SEQ ID NO: 73300 - DNA, 428 bp, Glycine max
  Peptide Sequence Number=SeqID_164985
ggtatatgaagagaatgatggtgtaatatttgaaggcagtaaaaaagcgattcagattaaattttttggaaaatatgttgctttgcaaatttgtgatgacgaagatgttgaaaccatgctcgaaagttttcaacaacaaaatcaaatgtcagttttggaattgtacatagaaaaggatgtgactggtggttctatgtttcattctgcaaattctcttacatgtggaaataatttatctaataatgaggcgcaactgccaacaaatgtgagcaacttacatggtgatgatgatgatgatgattatcttgtgtctaactcatacgttgaagagtctttagacgaagatgatagtgttgacgatatatctgatacagacgatgaagtcgccgacatgattcaaccagtaagaattgttcacctagcagaag

SEQ ID NO: 73301 - DNA, 358 bp, Glycine max
  Peptide Sequence Number=SeqID_164986
atgggaaagttggatcatctagaggaaaggctcagggccattgaaggaggtgaagattatgcctttgctaacctagaggagttgttcctagtacccaatatcatcacccctcccaagttcaaggtgtcggactttgacaagtacaaggggaatacttgccccaagaatcatctaaagatctttgcggatttggtcttcgccggcaaaaggatcgaaacgggtctgaaaagaggcaaatttgatcatcctgctttgatgaatgagaaaactggggcaaatgaagaggatgagaatgaggaaggaaaccatgttgaggttgtcattcctacatggccaaacttcgcaccagcccaacaat

SEQ ID NO: 73302 - DNA, 552 bp, Glycine max
  Peptide Sequence Number=SeqID_164987
atggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccggtgtcattccgctgttatggccgcgtttgtctcattccacgcctgacactcagttccggtccgaccgctgcgccttatccggtaactatcgtcttgagtccaacccggaaagacatgcaaaagcaccactggcagcagccactggctaaactgaaaggacaagttttggtgactgcgctcctccaagccagttacctcggttcaagagttggtagctcagagaaccttcgaaaaaccgccctgcaaggcggtttttcgttttcagagcagagatacgcgcagaccaaacgatctcagaagatcatctatatcagataa

SEQ ID NO: 73303 - DNA, 357 bp, Glycine max
  Peptide Sequence Number=SeqID_164988
atgactaggggcaatccaggtgacatacaaccctttgatcctgaaatagatagaacctttcatagattagttaggcatagtgtgcatcctggtcattctgtgcattttgagcatcctgatcattttgagcattctgttgctggtgattctgaatattctgattttaagcattcagttgttaattttcatactgagaatattgctcaacctccacctcgtaagaggactcttagggagatggctgcacctgatttcacttatgaaagcttgtgcattcaatatcctgatgagggtgttccatatgtgaagatcctcataagcatcttaaggagttccatattgtttgttccaccatga

SEQ ID NO: 73304 - DNA, 519 bp, Glycine max
  Peptide Sequence Number=SeqID_164989
atggctccgagaaagctttccacaaagagatccaggaaggacgtcgcggctgaaggaaccagcgccactcccgagtttgatagccatcgttttaggagcgctgagcaccagcagcgtttcgaggccatcaaaggatggtcattccaccgagagagacgcgtccagctcagggacgacgagtacgcagattttcaggaggagatagctcgccggtgttggacgtcgctggtcactcccatggctaagtttgacccagatgtagtcctagagtttttcgccaatgcttggcctacggaggagggcgtgcgggacatgcggtcatgggtgaggggccaatggattccttttgatgcaggcgccctcagccagttcctgggagactcgctagtgttagaagagggccaggagtgcgagtatagtcagagaaggaaccgggccgatggatttgacgaggaggtcattgcccagctattatgcataccgggtcaggattttgcccggactgctgccgggagacgg

SEQ ID NO: 73305 - DNA, 488 bp, Glycine max
  Peptide Sequence Number=SeqID_164990
atgactagagacaatccatctgacttacaactctttgatcctgagatagataggccatttcatagattagctagacatcattttgtaccttttgagcatcgtgagcattctattattggtgagtctgagcattctgtggttggtaattttgaacatcctgattttgagcattctgagaacatggcacaacctccatcccgtgagaggactctaagggaaatggttgcacctgatttcacttacgaaagcttgtgcatccaataccctgatgaggatgtcccatatgttcttaaaactggactaatccatttgcttccaaagtttcatggccttgcaggtgaagacccgcacaaacatctgaaagaattccatattgtctgctctaccatgaaacctccagatgtccacgaggataacatatttctgaaggcttttcctcattctctggagggagtggcaaaggactggctatattaccttgctccaag

SEQ ID NO: 73306 - DNA, 306 bp, Glycine max
  Peptide Sequence Number=SeqID_164991
atgaccacagattcacctccactccttatgttcccatggacccagtccccagtggagtcgccaactgttgcaacctacccttcgacgggagggcgacgcggggctcacgggtgcgtcttccaagaaagaaaaatgcacggagtattcaccaacgtttatttgaggaaaacatcggaaaaaatggaaaggtgtggtctacgaactttaagtgtgaaaggttcgggagttgtttttacgcacggggaagggtgtttcccttgctcctacgtattcctcaattgcgataaggaaatcagacctacgtag

SEQ ID NO: 73307 - DNA, 225 bp, Glycine max
  Peptide Sequence Number=SeqID_164992
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccaggtgggtccttaagggttcaattaatttattgtctcaaaagttgagcatgaaggcaaatgaaagagaaagaagctaa

SEQ ID NO: 73308 - DNA, 301 bp, Glycine max
  Peptide Sequence Number=SeqID_164993
atggttgctttcgttaggcagtatcaatactattctgatatggttccagataggatgcaactacagaacatgtgcaaaaagggagacgataatcgtgatgtgaaaggatcgatgtgggtccgaaaaggaggcaaatttggtcaccctactaggacgactgagaaaactggggcaaataaagagggtgagaaagagggagaaacccatgctgtgactgccattcctatacggccaagtttcccaccaacccaacaatgtcattactcagccaataacaaacctcctccttacccaccaccca

SEQ ID NO: 73309 - DNA, 360 bp, Glycine max
  Peptide Sequence Number=SeqID_164994
atggagtattttgatgtgcaggtggcttggccaggagcccagccttctccttctagagggggtggggccttcgcaacccaggagcctgttcttggggagacagcagcagtagagggggaggatgagctcacccctcctgagccttcttattttgatgcaggtatacacatggctcaggaggaggatgcttctacagaccaaattcatgagccatcttctgcacttgtacctaatgatgccacaccatctacaccagcgcctgagttagagcagcctatctctcaggattcaccagttcctcaggtgttggaccttaatgagcatgcacaggagaaaccacatgatgagcaggacatttaa

SEQ ID NO: 73310 - DNA, 405 bp, Glycine max
  Peptide Sequence Number=SeqID_164995
atgagtttgaggcttcctggttatggaaagcttaaaatcctctgttggatcttccttgtagctttttattctagtatgcctttaccttgttcacgtagatgcatgccttttttagggtcattcaatagcggaaactggtctgattctgatgaccttgataggacagggctaagttgtcgtactatcacaaggaattgggtattttatatgcatagatctcccacaagcaatttagttcctctggacttagaaattgaagctacattgagaaggaatagggctgagagaagaaggaaacttttgcaagatagaacagttgcatccattcttgaggaagaaactcatttttccgattcattatcacctgattcaccatcatcaagggaatccgctactcattgctga

SEQ ID NO: 73311 - DNA, 561 bp, Glycine max
  Peptide Sequence Number=SeqID_164996
acctcacgaggaaatgggcccttgcagctgattaggacggtgtggacgacaattgtctgtgagaaatacggcataagcaaggaaaaatgggcccaattttgccagactcgcagagacccttcttgggaggccatccagaaacagaacactgccccccacgttttgtctcgtgggggttatgaatatttgaagcagaaactcctagctgagaagactaagaagaagctgaaggaagctgcacagtcaggaagcgttgatggtgtcattgactctccatcccccgtcagacgccacgtgaagtggaagatggccgacacaaagaaaacaggggagatgacgactgaggccgcaatgagaatcactgagaagatcgatgttctcaccgctgctattggacgtccagagcaccctggatgtgtccgggctgttggagccggtgtcaccatcaggcaatacttcggatcggctccacggacgtcctgcagctcttccttgctacctcctgaagaattgcaacagctgacccagcaaatcagggaccagctagaggagagatcatag

SEQ ID NO: 73312 - DNA, 306 bp, Glycine max
  Peptide Sequence Number=SeqID_164997
atgaccaaacatcaaagatcaacaaagcgtgatctatcttactgggagtatgttgatgcattacattctgtgcaaaatagtaattttttagtcaaacatagtgcatcatcatctgaccaaggaattccaagaaggacaatgccgatgttggatcaatttcatctgtgcattcatgattccattgaaaacattgttgatatcaaagctgacggtaactgtggatatcgtgcaattgatgccttattagatatgggtgaagattcatggtctttggtgcgcaaccatttgcttaaagaaatggtctga

SEQ ID NO: 73313 - DNA, 828 bp, Glycine max
  misc_feature (1)..(1): n is a, c, g, or t
  Peptide Sequence Number=SeqID_164998
nccatgcgccagttgttccgggagtctggctacgagacagaatatcgcatactaagtgcagatgactatggtgttctgcagacacgcaaacggattattctggtcggtagaaaaggatgcatgacagggttctatcctgaacctgaaaaatggaatcccgcagttagagtagcagaagtatttaatgatcttccatctctcaaagcagcagacggtcaggtttccccctgccaattgaaaccctacgctggaaaatggctgtatgaggctggaataaggaatgatgcaatgcctgtgacttggcatcagtcgcgtccgaatacagctcaagatctggagatctatagaagggttgtagagcaatggaaccagaagcagaagcgcctagaatacaatgagcttccagattacttaaaaactcataacaacagaaccgcttttgtggacagatttaaagttgttgctgctgacttaccttcatctcacacggtggtcgctcatttatcaaaagatggacactactatattcatccagatatcagccaaaaccgctcaatcacaccgagagaagcagcaaggcttcagactttcccggacgactattattttgaaagtattaaaccgaaaccaggaagaacagccgcattcaggcagataggaaatgcagttcctttgattcaagatagctatgctgctgttgttgaactggtcaagaatgcttatgacgcagactctccaaatgtagatatttgcttcaaagccaaggaagatcggatggggtacacagtcacggttcaggatcatggccacggcatgtctagagatact

SEQ ID NO: 73314 - DNA, 270 bp, Glycine max
  Peptide Sequence Number=SeqID_164999
atggccaacttcaagccttaccctggatatgccactaaggggccaacatttggtggcatgccccagcctaacaccttaaggggccctcagcatcgcccgctgcaacccttacatttctctgtgggaagactgccacctgccatggaagaaagggagaaatttgatcttatagaggaaaggctgagagccattgagaggattggagattacccttttgccgacatgacggaactgtgcctagttcccgatgtcatcattgttcgcttctag

SEQ ID NO: 73315 - DNA, 522 bp, Glycine max
  Peptide Sequence Number=SeqID_165000
atgaatgtcggattttttggtattcagtacagtttcggacttcagcagacggccgtaaatcctatttattcttttttgggtgcccatgctgagcagcttcctatcctgaatctggccgggcctatcacagggttattgatacagcctctgataggagccatcagcgataagacctggagtcctaagtggggacgaagaaagccattctttttgctcggtgctctattttgcagcattgctctatttttattccctttcagttctaccatctggatggcagcaggtttgttatggatcctggatgcggcgaataatacagctatggagccttaccgtgcttttattggtgataagctccctgaagaccagcagacattcggctttcagatgcagagcctgtttgtaggagcggaaatatctcgcaggaaattctacgaacggcggtattccggtctgggtttactattcgtttttcttaggttccttctgctccattgcatcggtagcctggtctgtgtataa

SEQ ID NO: 73316 - DNA, 606 bp, Glycine max
  Peptide Sequence Number=SeqID_165001
atgtgtgatagtgtaattgacacatttcttaacattaaaggcaagacaatagatggtttgaatacttgtcaagatctagctgagatgggtatacgtgaccagttacatccaaggtctgatggactatcattcgttgatcttttgatccttgctagtccacttacgatgttgaattccagttacaatgcaaagcaaggaatcattcggtgtttcgatcaggaaggcaaaagataccaagaaagaaggggaaaagggtccttagttttcctgaatcctagcccgcccaggctagcctctagctcgcctgggccaccaaatgccttcaaggttaagaaaccagctcgcctgggcaagcttatgactttaggactaagccttagctcgcctgggcgagctgcaagtgccccaagtgacccttttcctataaataagcgtgctaggggggctgagagggggttccatcatagagtagtgaaggaaattgagagaattaagagagaagaagaagaaagaagaggaaacgaagctgaggcgctgccgaatcacgattgtgatcaatctttacgttgttccttgttcagtgttcttcatgcgaacgtcagttag

SEQ ID NO: 73317 - DNA, 783 bp, Glycine max
  Peptide Sequence Number=SeqID_165002
atggcgtcgtttcgttcgcgaagatcctcactccctccgaagccaacaacggcaacggcttctccgtgccgtgcttctacaccgactcgtgcttccctccgctcctctgccggatctggcactgtcaacatcggcattgcggaaattgtcgccgcttcatggtcgaacaacagcgacaactctccggccgtcggggcttcagcgccgcccgcgaccacagcagcggacgccgccacggtgcctctccccgttgacgtcgccgccaccgaggacatcatcgtctttgccgcggccaccaagaacgggactatacagttaaacaatagttcttattcatttttgaaatccgatgcaagcaaaatgattcatgctgctgaaagactgggtacgggtattgagaccgatggaattaccacccttgtgctgaacacttctgcctacttttttaagaaaaccgttgatctcattgatttcaaggagaatcgtcaagtgagttatgaatacaagcgctatgaaaacccaacgactgtgcttctggaggagaagataaggtttgttgtcattattaaccccagtatattggagggggctgaatcaactgtgatattggcatctggaatgtcgaagaaaactaggaaaggaaagagtcccggaaagggtgggaatcgattttggaagtccattgtgcttggctttaagactcccatggaagccatcgaaggtatgtctctgttctatgttaatgatgaaaatccattgttcagtggtctgtctctgttgtga

SEQ ID NO: 73318 - DNA, 393 bp, Glycine max
  Peptide Sequence Number=SeqID_165003
atgcagagtctccaaagctcaggcctaccatctattatgagcacatatgagttcctgactcaggtggcttggccaggagtccaaccttctccttctggagggggtgggacctccgcagcccaagagcctgagcaggcaatagaggagctagttttagcagaggatgagctcactcctcttgagccctttttagttgctgtggatacatctatagctcaagagggggtatcttcaccagattccatgccagagccatcccctacacctatatctgaggacactatgccatcagtaccagccatggagccagagcaacccattcttcaggatgcaccagctgctccagttttggatttaaatgaagatcaaccacaggatgagcaggatgtttaa

SEQ ID NO: 73319 - DNA, 237 bp, Glycine max
  Peptide Sequence Number=SeqID_165004
atggggttgagcttagctattataggggcttcaatgaggtccttcaatggtgattttccaccatggagatgcagcggaaggcaaaggagaagaggagaggggaggcaccatccactagggaataaaccatggaagaaggagtttcaccaccaagaatgtgccttggataagaagcttgaagaggatgctttaatggaggaaaagaaagaaagagagcaagagagagggagagcatga

SEQ ID NO: 73320 - DNA, 375 bp, Glycine max
  Peptide Sequence Number=SeqID_165005
atggcttttctttggattggtggacggagacccagcatggcatttcacttgctatattccaagtttggtttacaatttgaggcaagattcgacgaactgattcggggtctaaggacacatgatttgggagacatatcagcatctcaactagctcagcttgatgagacgcaaaggaggaccatcatagaggagagggaagtcacagatttgatggaaactcaccaggaatcattggttgatgctccaatggtggagttgtctcatgtggttgctgagatgattagagccaatgaaactggtgagaataaggaaatagaggacaaggttgaatcaacactttgccaatggtggaaggtttggagaagatttagataa

SEQ ID NO: 73321 - DNA, 1977 bp, Glycine max
  Peptide Sequence Number=SeqID_165006
atgggaagtggagtttcaacactctgttggtgctctgggaccaacaacgagcccgacgttattttcagcgccaccgacccactggacgaaaccctaggccactccttctgctacgtcagatcctccgcacgcttcctctctcccactcactccgatcgcttcctcagtccttctacttcccttcgtttctctccgacccatacccgacccgaatttcacgaaaccgggttcaaagccatttccggagcctccgtcagcgccaacagctcccttccgacaacagtcattcacttggacgaagaggtgaacggagtttcctccaggggtaatatcgtaaatggcttcgaaagcacggcgtcgttttccgccctcccgctccagcccgttccccgaggcggcgagcccttcgaggtcagcggcttcttcctctccggtccaattgaagccaacgccgtctccggccctctcccttccgccgccgcctacggagtcggcggcggcgatgttcctttctcggcgccgctggccggactttacagtaagaagaacaagaagaaggtgatttcggggttccggaagaccttcaaccggaacacgccggagaagaagcggccgtgggtggtgccggtgctgaactttgccggaagaaaagaaagcgagggaaggccgcagcagccgccgcaggcggcggcggcggcgagcaatgtgcagtgggcgttggggaaggctggtgaggatcgcgtccacgtggtggtgtcggaggagcttggatggttgttcgtcgggatttacgacggtttcaacggcggcgacgcgccggagtttctgatggggaacctctaccgcgccgttcataacgagcttcagggtttgttctgggaacttgaagaagaagaacaaccgttaccgcaagagagcaatccagtggtggaaggaacggagagtaaacggcgtaagctgtgggagcttcttgccgaggatggactcgacctttcgggttcggataggttcgcgttttccgtggacgatgcgttgagcgttaacaacgccaatgctgggtctgctgtgagtagaaggtggttgttgctgtcgaagctgaagcaggggttgacgaagcagaaggagggtgaagggagagggtggaatatggggaatgaggagaaggagagggagaatcaagagaagcattgtgggaggaagaggagagtgggaccggtggatcatggactggttttgagtgccttgtctcgggcgcttgaagtcaccgagcttgcttatttggatatgacggataagctgctggacacgaatccggagcttgctttgatgggttcgtgtttgttggttgcattgatgagggatgaggatgtgtatgtcatgaatgttggggatagtcgggctattgttgctcactatgaaccgaaagaggttgattctagtgttgaattgggaagcaagagaggtgttgagtccggtgcccagagcatagttgaggtccccctgggtttgggtcaaattgggagtgctcaacaaaagaggttggtggcattgcagctgtccactgatcacagcaccagcattgaagaagaagtcattaggattaaaaacgagcatcctgatgatgcccaatgtatagtcaatggcagagttaaaggtcgccttaaggtcaccagagcatttggggctggatttttgaaacagttcctgatcctctcatctgatggtttatatcaatatctaaacaatgatgaagtggtttctcatgttgagagcttcatggaaaaatttccggaaggagatccagcccaacatttaatagaagaactgctgctccgtgcagctaagaaggctggaatggattttcatgaattgctggatatcccacaaggagatcggaggaagtatcacgatgacgttactgtcatggtgatatcacttgaagggagaatctggaaatcatcagggaagtatccatga

SEQ ID NO: 73322 - DNA, 327 bp, Glycine max
  Peptide Sequence Number=SeqID_165007
atgattgaattagttcaacaagatttgcaccaccaccatctttatcctaatgagagcacccttatacataggtacatggtggttgatgcaagctccattggagcttgtaggcctaggatctttttcatcaatggattcctttgcttcttggaagatgaatggcagcggaatggagaaaggaagagagagaggagacgccacttcaaggagaagatgagtctagaagaagctcaccaccataggaggccatggataagagcttggaggaagaaggagatgaatgaagggagagggaaagaagagcacgaaattttgtgctctaaatga

SEQ ID NO: 73323 - DNA, 969 bp, Glycine max
  Peptide Sequence Number=SeqID_165008
atggctgaagcaaatcgatccaaaaccagaatggaaagcatagaagaagccatagccaagctagcctctaaccaactccatgtcaccaccaaactagataaactcattcaacgtattactgtgttggaaactagtcaacaccactcacccacacctccatcttcttcctctgtgaaggcacccctcgcacacacgcccttgccaattccgtcgccacgccccgcactcatgccgcaacaccccacacccttgccagcttcgcttaccagcagaggagacactacgaggaaacttgtagcaccatttcaccctaccttgcctcttgagagcggcaagaacatccaccgtggtacccgtcttcctcttaacgtgcttagtgttggtaacagagtaccgcagaccatccttgagaaggttcttaaggactccgcgagccaaacgacaaatcccgagtttcataatgttctgcatgttgtcgcacaacaccaccttgtgccccttggctcctcccttgcctccttcccacgaccaccatatctgctgccatcacctccaccaccaccaccgaagccacgtcctccaccacgaccacagtcggcgcgggtttgcgctttgtggacaatgatgttcgaccgtaaagctgatatcttgttgctgatcactttgttggacgtgtatgccaaaaccggtgatcttgacgctgcacagaagatgtttgataatatatgcaagcgagacattgcttcgtggaatgccatgatttctaggttggctcaaggaaaccgtcccaatgaggctatagctttgttcaacaaaatgaaggatgaaggatggaggtctaatgaagtaactgttcttggtgccctattatactcatgtacctttcttctttctatactctcccttttgtttcagcttgattttcttattgcccacttttctttttctacacctccatctttcccatag

SEQ ID NO: 73324 - DNA, 369 bp, Glycine max
  Peptide Sequence Number=SeqID_165009
atggctagtaatgagagtagaagaatgataactgggaatttgaggaaacatgtgcttgcttttggtgacaagttgaggatgcttcctagtttggcttgggagagtgtgtggaagatggggcgtgatgatccaagaagggtcatccatgcattcaaagtgggtttctctctcatcattattgtgtctttgctctatctgttggagccaatcttcaatgggattggagagaatgttatttgggctgtcatgaccgtcgtggtagtgttccaattcacagcaggagtactcaaactgggtgtatttacccccaaggcctacactccgaagagtccgtcagggcctctccctcctgattcaggttcaacctag

SEQ ID NO: 73325 - DNA, 174 bp, Glycine max
  Peptide Sequence Number=SeqID_165010
atggatcacaacattgaatatgatttcatacttctttcttacattcaagaaccatctcaatatttattcacaatctcaaaattaaaaattgtagctatcagcctcaaccgtacgtcattcctcagctttgtgcttgacctaactaaagggaaggttgaaggagggaatgagtag

SEQ ID NO: 73326 - DNA, 894 bp, Glycine max
  Peptide Sequence Number=SeqID_165011
atggcggatgtggcggggaggcggaaaatggcggaattttttttttttgtccgcgcttcaacacagcgcgacctcggaaccagccacgaccactgcaaccagcctcggaaccagccgcgcgtgacccgctgcacacagcagccagcagcgacgacccatggcgtgaacggcggcgacgagcacggcagcgacgagcacggcgtgaacgacggcgacgcgaacggagaagacgacccagaaccgcgacctcgacttatactggtaaagtggaaggaggagttgaaggctaaagaggaagccctagcactagttgaggaggaacgccactctaaggaagcagccgagtctaacaataagaggaagctcgagactttgcgtctgaagatagagatagatttccagcgccacaaagatgatctactaagacttgagcaggagctttctcgccttaaagcatctgctcagtctgccgagttgcataaccaatcaagcacttcacctacaagtgactcggagggtgcaaagccccaaagagagaccattgctaggctgcttcaagaattggataatctggaggacctttcggagaaagaagtaaacagcaacagagaatgcattgtatgtatgaaagatgaagtctccattgttttcttgccgtgcgcacaccaagttatgtgtgctagttgcagtgatgagtatggaagaaaagcttggaaggctcaagcgcttgtaggggtcaacctcctcaattggatagtccctaacctctcaagcgtcaaacttgaaaggtgtatgtgcttccgattggtctcctacgctagacgatcaacaacctctcaagcattgagcctaaaaggcatgtgcttgttcaagatgaccttcttggctgaatga

SEQ ID NO: 73327 - DNA, 1905 bp, Glycine max
  Peptide Sequence Number=SeqID_165012
atgggttgcaccatgagggaaaagcatatcagagctaatcggagaccccgatcggtgaaaccggactcggattcttgcgacaaagatgccatatccaaatccatagcggagtctggtcttaagcccttcaaataccatctggatctcaacgattcttcccagagtccgaattcaaaccctaatgtagaggaaaccgggtggggttactgtacagaggaacaattggaagagattctgttgaaaaacttggaatttatatacaacgaagctgtgtcgaagcttgttgcgttgggatatgatggggatgttgctgttaaggccatactgcgaaatgggcattgttatggtggcatggatgtgctgacaaatattttgcacaattccttggcttttttgaatactaatagtgatggtgatggtggtggttatagtagtaatggtgggaatttgcatgagtctgagcctgtgttctctgatttgaggcagttggaggagtactctttggcgggtatggtgtgtttgttgcaacaagtgaggcctcatttgagcaaaggggatgccatgtggtgtttgctcatgagtgatcttcatgtcgggagggccagtgctatggagattccggtgccggacaatgggagcactgtgccggctaccggtgagggtggtgccaattcggctggtgttatggcgccggctttgtgtaggtttcatggggggtggggatttggaaatgggggaggcttggaatttcctgtgaacgggatattctcttgtggtgcagagatgaatttgcagctgcaacgagacattgagtttccgaagaggttaaatctttctccttcgatgaagtccttattgaagagaaatgttgctatgtttgctgctggttttagggcgaactccaagcaattgcaggcgcaggtgaaggcctttcccggccggagtactgcacctaatttggattctttggatgtgtccgggacagaagtcctggctgagcagtccggaggagattcagagaatcttgataaccaagatgctgtgaattcggtgctgagtaaatttcgtgatttgaatcttgatgagaatttggacttagttgccgaagatcagaaggatgaggtgatagtctctttatttcatcagattagggatcttgagaaacaggtcaacgagcgaaaagattgggctcatcagaaggcaatgcaggcggcaagaaagctaagcagtgatttgactgagctcaaaatgttgcggatggaaagagaggagactcaaaaattgaagaaagggaaaccagaacttgaggacacaaccatgaagagactctcagagatggagaatgccttgagaaaggccagtggtcaactggaccttgcgaatgcagctgtgaggagattagaaactgagaatgcagaaatgaaagcagagatggaggcttccaaattaagtgcatccgagtcagtgacagcttgcttagaagttgcaaaaagggagaaaaaatgcttaaagaaacttctagcttgggaaaaacagaaagctaagctgcagcaagatatttctgatgaaaaagagaagatattgaagacacaagaaatattggttcagattagacaatgtcaaaaggaagctgagagtaaggttattgattggacttacatctcgcatgtcggaataaaagtaacatacttcaaccccaggtgtagcttaatttgcaaattgagcttcttggggtggactttacttgctttggaaaggcttgaagttgaaacccattggaagcgccttgtggccagggacaagccaacgcccaaacagggatcagtccacacccaagagtgggtggaatcacctcatggccatagtgaaaaaaaagtgtcaaaatcagacatcaatatgacttag

SEQ ID NO: 73328 - DNA, 135 bp, Glycine max
  Peptide Sequence Number=SeqID_165013
atgcccaacacagtgatgaggacacaacaaagggcaaggaccatgaagcacttgaaggcccaagtggagaaagataaaggcccagagacagaggcactaccaagactattaattgttgctgaaggcccaagttaa

SEQ ID NO: 73329 - DNA, 468 bp, Glycine max
  Peptide Sequence Number=SeqID_165014
atgaggaagtgccaaagatatgtcgggaaagttgtttgcaaatcaaaaaaccaaggggagttaggaattaaaaacattttcatctttaatgatgttctcttgggtaaatggagggggtggatagggcttaagaaggaggaagtcttggagaaatcttctttgtggtggagagacttgtgcagaacttgtggaggaatgaatgaaagattgaaagtgccacccaagggtagcagaggaattattgttgaagctgctaagttttatgtgttttggaggactttatatggtgggaatacgagattgaatgctcaggggttggtattgggagttttaatgcatttttggtgggttcttgatgaggacaaggcaaggaataagggtgatgtgaaccacgaggtggaatgtttgatacaggctacgaagatttggatgacgccacttccagtgaaggaagataagttaggatag

SEQ ID NO: 73330 - DNA, 429 bp, Glycine max
  Peptide Sequence Number=SeqID_165015
atggaaatatttattcaatcaattgatcctggtgcatggattgctattgttaaagaaccttttataccaactaaagaagtgaatggtgagttggtgcctgaagaatgggatgagttgaaagatgatgagaaaaaaagagtgtgcataagtgcaaaggaaatatggaaaatgcttgaagtcactcatgaaaaacactatggatatgatgagctaaacatcaaaatcctcaactgtcttacaagaacttgggaaccaaaaatcacaacgattaaggaatccaaggacttagcatcaatgtcaatggaagctctcttcgtaaaattgtttgcatatgaacatgagttaattcaacaatctcatgcagaagaaacagaaaagaaaagaaaaggaattgccctcaaagttagttcttcaaaggaagatcgctaa

SEQ ID NO: 73331 - DNA, 456 bp, Glycine max
  Peptide Sequence Number=SeqID_165016
atgaaaccccttctcgacttcggaatcgcgttcctcctcctcctacattccttccttacttccgacatcccttaccccaaagcaattttcgatttgaaggatacaattgtgaagggatttgggtttacggcggaaaatgatgttaagcttacggggttcgatccgagagacgccacggtagggcattccgtggagtaccaattcgacctcgaaatcaatcacaaggttattcccttcaagcttctcgaagatgtgaaacactgggattacatggatcttcccattttccaagccgaggccccaatcggtttcgtccagaaacaggcttcggctgacgggcttcccgttttggcttcgttcgttctcgctatgatgaagaaagatgattggagacgccacttcaaggagaagatgagtcaagaagaagatgagtcaagaagaaggtcacaaccatag

SEQ ID NO: 73332 - DNA, 387 bp, Glycine max
  Peptide Sequence Number=SeqID_165017
atgtggtgtgcggtgagagattccggtggccattactgccctaagaagaccgatgatttatgcggcgatgtttgtggccagccaaaagatttagtgccaattgctaccggccacgagtatgaggagattcaggctgatcttgaggagatgtgtgaagatgataaaggatacaacttttggcaaagattctgctcttctaggttgggttcattatggttgctgacttgtgtggaggtagaggctgctgctgtcggaaccaccgaagaggaagcaggggtgccaagttcaaaagatgtggcaggacttgaagaaggaaacaacaaatccccagaaacaaaagttgcacttgctgtagggctggacttcaaagtgattagtactgattag

SEQ ID NO: 73333 - DNA, 255 bp, Glycine max
  Peptide Sequence Number=SeqID_165018
atgccgaaaactttgttgaaggatgtcgagggaacgtcggtcgtggaggctgagtctcctccttttcagactctgcaaacactaggcttctcaaattcatatcacaactaccaaatactggacgcggatcctctcctgcagccgcgtctccaaccaccaaatgagtttggggcttttggtttttccctaaaaagagaagttcaatggacggagtcaagcttgcattacataggagtggaagagaataatatgtag

SEQ ID NO: 73334 - DNA, 616 bp, Glycine max
  Peptide Sequence Number=SeqID_165019
atggcccgcacgaagaaagctgaccagatgacgtctgacgcagcaaaggaaattgttgagaaaattgcgtcacagggttcctttgtcccccatggatgtcaggatgtccttactgttgccattgggctggagccgatgcaagcacagggacttgcattgcatccggagcctaaggttggtccctcagctgctcgtgccagcacaaaggagagttgtgttgatccctccgggaacaatccagagacgggtgactcagacaaatgcaggttgtacatcgaagaaaatcctccccacctggttgccctgggaaaagtttatgagggatccacaactgttcacaacatccctttgttgcataatcaagtgaaggtcggtgttgaggaggttaaagatgtagcagctcctgttcctgtacccactgacgaggttaacttagtgggacagacacttaacaccttcctagcttggccaacacatctgggagctgtgggacccgcaaaacttgctgataggccggatcatgaggttatgtgggatgctaccatgtttggggtgtttaatcaagacttcccattgtacataaagcacgaagatctgtctgaaattgcacacggtg

SEQ ID NO: 73335 - DNA, 1679 bp, Glycine max
  Peptide Sequence Number=SeqID_165020
gaggtagtggcgtgcagctgaccggatcgtgcgggtgctgctgcgcagcagcacttcgcgcgcgccttcggctgcaggtagccgaccttgagcgtgaagccgtgaatgttcggcagcggctcgccgggcacgtcgtcccagctgtccagcagcggcaggaagtggatctgcacgtccggccggccgtcgccctggctgtcggtgaaggcggcgccttccagcacgttggacgagagcacgccgctgcgaaacgccagccactgcgcgccgtggctcagcgcctgcaggccgcgatcggcgccgaacaggctgatcggctcgcgggtgctgacgttgatcgacatgtgcagatggtcgtggaagtttttgcccaccggcagatccgcccgcacctcgatgcccaactgctgcaggtggtcgcgcgggccgatgccggacagcatcagcagcttcggcgaaccgaccgcgccggcgctgacgatcacctctttggtggcgcgcgcggtcacttccgcgccgccgttctggctgtagaccacgccggtggcgacgttgccctcgaaggtcagccggtgcgccagggcgttcagtttcaccaccagccgccgttcgtcgcgcaccgccttcaggtaggtgcgggcggtgctggcgcgttcgccgttgtgggtggtggtttggtagaaaccgacgccgtgctggctgtcgccgttgaagtcgttgcggtagggcaggttcagctcctggccggcgcggataaacgccatgctgagcgggtggcggtagcggttttcgctgaccggcagcagcccgtcggcgccgtggtagtcgtccgacaggctttcgttggcctctgcgcgtttgaaatagggcagcacctcccggtagctccatccggtgcagccatagcgctcggcccagtcgtcgtagtcctgcggctgaccgcgcaggtagatcatgccgttgaccgaactgctgccgcccagcaccttgccctgcgcgatctgcatgcggcggttgttggcgtgcggttccggctccgtttcgtagggccagctctttttggcgatgatcttggccacgccggccggcatcttgatgaacaggttattgtcgtcgccgccggcttccagcagcagcacccgcgcctgggtgcggcggatcagctgcgccgccagcacgcagccggcggaaccggcgccgacgatgatgtaatcaaaggtattttccgacatgacagctctccgtgcgcgattgggatactggcagacaagctgcgccctgatgggaaggcggggcgattacagcgttttcagcatggtgacttcgcaatcgacgtggccggtggcgcccatcgcgtggtcgatgtgttcgaagcccaggtgttcgtacagcgcaacggcctgcgtcaggctggcggtggtctcgaggtaacaacagcggaagccgtgttggcgggcgaaatccagcgcctgcagcgccaggcgtttcgccaatcccttgccgcgcaacaccggcaggaaatacatctttctggcaattcgcatatatcgtccgcgccgccccttggcagcggccggcggatggcccgcccgcccgccgggcaaacctttgccgttctaaccctccgaatcaaccccattaaagcgcttgcgccgggcaggcttgttaagaagccttga

SEQ ID NO: 73336 - DNA, 252 bp, Glycine max
  Peptide Sequence Number=SeqID_165021
atgtggtgttatgagtggaaaaagagtgaggctttgagagttggaaggccaaatctggatttagtggtatttggaggtgttgagaggaacgaagataagggctacgtgggagtacgtgagctcagtgaaggtgggcaactggggatggtgggtttatgtgtgatctgtggatgtggagagttgaattgcaccatcgcccgaccgccacctagtaccacatgtgatgggtaccccataatcctacaagcttga

SEQ ID NO: 73337 - DNA, 324 bp, Glycine max
  Peptide Sequence Number=SeqID_165022
atgactgtggttgaatatgcagccaagtttgaggagctgactctcgagactaggcgtcctattataggagtacagttccaatatggagtactgctactaggggatttgcaggcggtagtggtagcaaacccaatactttctccactcatatcatttgttacagatgtgggacacactcaaagagactattcacgacccaagaaagagcaaaatggtggaggcccgaatgaccaaactagacatccaaaggccatgggaagagtctttacccttaatggtgctgaagcttcaaaatccaaagatctaatccaagatttctggtag

SEQ ID NO: 73338 - DNA, 62 bp, Glycine max
  Peptide Sequence Number=SeqID_165023
cggagcttcacaaaggcatgctagatccttattacttgactgttgactgttcaagcattctg

SEQ ID NO: 73339 - DNA, 93 bp, Glycine max
  Peptide Sequence Number=SeqID_165024
atgacaaacgacttgacaacacatgcatatgaggatcaaaaggtctttaaaggttgtaatgggaccaaggacaagtacgaaattgaagattaa

SEQ ID NO: 73340 - DNA, 360 bp, Glycine max
  Peptide Sequence Number=SeqID_165025
atgatgtcaggactcaaagttcacttaagtaggtgttcattcagttatttctttgattcttgctttcatattttaatgttcctcatattcaacactagtgctttgaaaggacttgatgatactccacaatctaaatccaaggctgctgataggtggattgttgttaagtgtaatagacaaaaaggaatcactaaatgtggctactacgtgatgcactggatgtccacgataatcttaggatctttcaggaataatttggagacgtattttaatgaagttagaccattggaagcagagagattcaaggcgcttcgcatccagtgggcacagtgttatctaaaagttagaaatcaaacatag

SEQ ID NO: 73341 - DNA, 639 bp, Glycine max
  Peptide Sequence Number=SeqID_165026
atgaataagaaggcttgttcctcgtcgtttgttctcttgagtctagagatgtgtgcttatttctctagtctgttaagggaacgacttacttggaagggtgattacccgttgttcaaactctttcccactactttgtctctttgggggaaggcggtgttatatccgtttgataacaaggagagtcaagagttcataattctagaccattttgcccaaaatcaagggcttcatcggtcgatatttgactactttacaaggtgtcggaaactagttccaatcgggaggttggctttcacggtagagggaggggggaagctaaggatgttcgccattggtaactatgttagacaaaggctcattaagccgctgcatgattgggctatgaaggttttggcctccattcccaatgatgggacttatgaccaaggtgcccccttgagtactatgggggggctccacagggaaatctctccttccaattccaatctcgttgacgcgacgcgggattcctcgtatcatcccgacttatcatcgacgggcgataagtctctatataagcttattagacttgcaaagaagatagagaaaaccacctttgcatcagtggttacacctatggcgactaaggaagcagtctga

SEQ ID NO: 73342 - DNA, 330 bp, Glycine max
  Peptide Sequence Number=SeqID_165027
atggactcgggaaggttcaagattagtgtaccatgtgacggctgccccaataaggctctcttgaaagaaatgcatcaacaacttttcatctttcacgggcttgtcccaccgcaaaatgcaagggttatggttgtgggcaaaactgagggccctccgaagtgtttggcaggggcaaggcttgaagttggctcgattgtggtggggtatttcatgtgtcccccctatgggttgagggataggtgcatgactagatcaaggttgttggctctcaatgagtatgtgagtggagttattgacattctcatcgggagcagtgtgccacattgggtg

SEQ ID NO: 73343 - DNA, 519 bp, Glycine max
  Peptide Sequence Number=SeqID_165028
atgcagcacgccgcacaagcgcgcgggctggcgatcaacattcaggccgtcccggtggccgatttcgaacgtatcctgccggatgcggacgtggtactgctcggcccgcaggtgcagtttgaagctgcccgcctcaccgccatcgcagccccgcagggcaaggcggttcgccgttatcgacatgatggattacggcatgatgcgcggcgaacagatctgcatgccgaagccgtggcgcgctacagcaacgcgaagatcatcggcctgtgtaacgtgccggtgaatatgcaccatatgatcgccggcatgttacaggcgccgtttgacgaggtggcgctgcgctttgccgggctgaatcatctggtgtgggtgcatcaggtgctgtgccgcggcgaggacgtgaccgccggggtgatcgaacagctgtgcgaaggccaggcgctgaccatgaataacatcaaagagatgccgtggtcgccggcgtttctgcgcgcgctgcaggcaattccctgcccttag

SEQ ID NO: 73344 - DNA, 378 bp, Glycine max
  Peptide Sequence Number=SeqID_165029
atgcgtaactacaaaattgccgcgattccggcagacggtattggcccggaagtgatttcggctggcattgaggtgctgcaggcgctgacgcggcacgatgaacagctgacgtttgacgtgcagacctttgactggggctcggactactacaaacagcacggcgtgatgatgccggaagatggcctgcagacgctgaagcagtttgatgccatctactttggtgcggtgggcgcgccggacgtgccggatcacatcacgctgtgggggctgcgcctgccgatttgtcagggcttcgatcagtactccggcaacgtgcgcatcgcggcctgccagaagaggtgggcactgaagtggcgattttcacccgcgtcggcgtga

SEQ ID NO: 73345 - DNA, 501 bp, Glycine max
  Peptide Sequence Number=SeqID_165030
atggcgctggtgcagggcaccaccagcttctacctcctgcgctttttgctcggcgtggcggaagccggcttctttcccggcatcattctctacctcagctactggttcccggcggcgaagcgcgcgcaggttaccgccatcttcatggccgccgccccgctctctaccgcgctcggctcgccggtctctgcggcactgctggagatgcacggtctgctgggctacgccggctggcagtggatgttcgtgttagaagcgattccggcgttgctgctgggcatcgtggtgctgtttttcctcaccgaccgtccggcgcaggctaaatggctgaacgcagaagagcggcgctggctgcaggagaccatgcaggctgaagagcaggcgcggtcgatgcaacatggccacagcagcgcctggcgcgggctggcggacaagcgcgtactggccctggcgctggtgtacttcggcacgtcggccgggctgtacacgctgggcgatctg

SEQ ID NO: 73346 - DNA, 2133 bp, Glycine max
  Peptide Sequence Number=SeqID_165031
ctggcgcaggacgccggcatgaacggttgtttgtttaaaccgctggagcgcgcgcagctgctgcaggtgatcaccggcgcgccgatgaacccgacgcgcgacgataccctgctgacgctggaaaatctggcggcgaataatccgcaggcgtggcgcgatctggtcaccaccgcgcgccagcagaacagctacgatctcgcccagctgacgcaggcggcggcggagcatgaagatggtgcgctattacagcagctgctgccggaggtcgccggggcggtggccgagctggacgcgctgttcctgcgtgccctggaaacacctattcctgaagaggtgatccatgcagtaccgcttagcgcaggagccgcagctcgattctggccgggggcttttgcccagcgccagcagctgatgaatttcctgcagcgccacccgctcgatatcctggtgctggattacatgctgggtgaagaccagctcgacgggctgcaaatggtgaaacagctgcgcctgcactacccgcagctgaagattctggtgtcgtccgcggtggagaaaccagcgattgtccagctgttgctgaaagccggcgtgcagggatttgtcggtaaaagccacgatcaggaggtgctgatcgatgccatccatcaaatctgtcgcggcaagcgtttcctgacgccggacatgatgctggagctggataaattccaggagagcgatcgcgagatgcacgactacctgacgccgcgccaggcgggcgacgacatctcgctgctgctgcgcgagctgagcccgcgcgaaatcgaggtgattcgctgttatctcgacgggttgagcattacgcagatcgccggtaaatacgcgcgcagccgcaaaaccatcagcggtcagaagcagaccgcgctgcgcaaactggggctgcgctcggatctcgaactgtttaagtacaagcaatatttcaccgagctggtgaccacccaccgttatcatacagacacgatgacggtggatgacataatgcagctgacaatgcggtggtttgggccgaaggaagacaaggtttcgctggaatatattcgccaggtgccgggcgtacgcggcgtggtgggcgcactttacgatgtgccggtgggcgaaacctggccgcaggagaagatccaggcgctggtcgatcaggtgcacgcagccggactgacggtcgaagtgattgagagcgttaatattcacgacgacatcaagatcggcctgccgagccgcgatcgctacatcgccaattatcagcaaagtatccgcaacctggcggccgccggggtaaaagtgatctgctacaacttcatgccggtgttcgactggatgaagacggatatgaattatgtgctgccggatggctccatcaccatggccttcgagaaacagggcatcgataaaagcctcgatgaagtggtgaaagaggtgctgggcagcgctaacggcttcgcgctgccgggctgggagccggaacggctggcaaaagttcaggagctgtttgccaaatatcaggacgttgatgacgcgaagctgcgtgaaaacctcgcctatttcctcaaagcggtgatcccggtgtgcgaagaggtgggcgtgaagatggcgatccacccggacgatccgccgtattcgatcttcggtctgccgcgcgtggtgaagaaccgcgacgatctcgactggatctgtaacgtcgtcgattctgaagccaacggcatcacgctgtgcaccggatcgattgccgaggatccgcagaacaatgtctatgccattctggccgaattctcgcgccgcaagcgcatcccgtttgcccacgtgcgcaacatcaggatcatccgcgataaagatttctacgagtgcgcgcatccgacggaatatggctcgctggatatgtataaagtgctgcagtcgatgtatgacaacggctttgacggctatatccgttcggatcacggccgctttatctggggtgaaaccgggcgcccaggctacgtaagcgttgatgggctacgatctggcgctcacccttgcggctttttcagtaacggcaccagcagcgccgcgacgaaaaagcctgtcatgatcagccagaacgcgtcggaaaaggcctgg

SEQ ID NO: 73347 - DNA, 315 bp, Glycine max
  Peptide Sequence Number=SeqID_165032
atgcaaaacgtgtgcctaaaagcaagggactcactatggtacttggataatggctgccctaggcacatgatggctggaaagtccaaacttaccgactttgtgtcaaaagagggaggatatgtcactgtcgcaacctacccttcggcgggagggcgacgcgtgactcgtgggatgcgtgttccacgaaaggaatacgcgcggagtcgccaccaacgtttatttgaggaaaacgtcggaaaaaccggaaaagacgcgatctacgaacttttaagtgaaaggttcaggagttgtatttacgcacggggaaggtattag

SEQ ID NO: 73348 - DNA, 336 bp, Glycine max
  Peptide Sequence Number=SeqID_165033
atgcatagatctcccataggcaatttagttcctctaaacttagaaattgaatctacattgcgaaggaacagggtcgagaagagaaggaaacttttgcaagacagaacagttgcatccattcttgaggagaagactcatttctctgacttattatcacctgattcaccatcatcaagggaatccgccactcaattacctgaagtcattaccatggcagaagagcatgacagaggattacccttgaggattactcaagtagttcagtaccacaatttttcaccagcattgcacgtcctgaagtgcaagctaacaacatcaattacccacattccttaa

SEQ ID NO: 73349 - DNA, 177 bp, Glycine max
  Peptide Sequence Number=SeqID_165034
atgaccggccctctcgatgagtcgatctcttgctttcccaagggtggacccttggtgagaggactacacgtcctcgccatcagagggctgcacgccctcacctccagaggactacctgtcctcgccttgagagggctacacgccctcaccttgggtactagttaccctcaccagtga

SEQ ID NO: 73350 - DNA, 366 bp, Glycine max
  Peptide Sequence Number=SeqID_165035
atggatcgggccagcagttgttgttgcgagaccgagttgccagttgccagcctcttgccaaaccagccagtagaccgggatagacgatcgttcttgtgtcgacatatttacgggagcatatccaacctacgctattgggtggtccgttccgcagcagacaccccaactttcaaacgggtgtttcgaatcggggtagactactcatctcgaccatcaagatcgttatcgggacagctcttagatatactgctcttctactactacactagatatgcgcgagcggtaggtccagactcagaactgcttgtccggctcgtattataccagagtaaagcccaacatgcccacgggaccgccctcaactag

SEQ ID NO: 73351 - DNA, 195 bp, Glycine max
  Peptide Sequence Number=SeqID_165036
atgttgattgatgttggaaatgcattggcgtgtgcatgttgtgtatgttcgtggggggcgaagtgcactaaccttatagtgtctttggcacttgctttgggtcacgttcatacgttggatgttgttgtatgtcatgggggcttaagtgcactgaccttgtcggacgacccagacgtgggtaacaagcatggttaa

SEQ ID NO: 73352 - DNA, 364 bp, Glycine max
  Peptide Sequence Number=SeqID_165037
atgactagaggcaatccatctgacttacaaccctttgatcctgagatagataggacatttcatagattaattaggcatcattttataccttttgatcattctgagcattccataactggtgaatctgtgcattctgttattggtgattttgaacatcctgatcttgagcattataattttgagcattctgattctgagcattctgattttgcacattctgagaacatggcacaacctccacctcgtgagaggactctaagggaaatggctgcacctgatttcacctatgaaagcttgtgcatccaataccctaatgaggatgtcccatatgttcttaaaactggactgattcatttgctccaaa

SEQ ID NO: 73353 - DNA, 960 bp, Glycine max
  Peptide Sequence Number=SeqID_165038
atggtggtgggcacgcacgcgctgttccaggaacaggtgaaattcaacggtatggcgctggtgatcattgatgagcagcaccgtttcggcgtgcatcagcggctggcgctgtgggaaaaaggcgaagagcagggtttccatccgcatcagctgatcatgaccgccaccccgattccgcgcaccctggcgatgacggcctacgccgatctcgatacctcaaccattgacgagctgccgccgggccgtacgccggtgaccacggtggcaattcccgatacccgccgcagcgacatcatcacccgggtgcaaagcgcctgccacgagggccgtcaggcctattgggtgtgtacgctgatcgatgaatccgacgtgctggaagcgcaggcggcggaagccacctggcaggagctgaaagtggcgctgccggacctgcaggttggtctggtacacgggcgtatgaagccggcagagaaacaggcggtaatggcggcgttcaaggccaacgaaatccagctactggtggccaccacggtgattgaggttggcgtggatgtgcccaacgccagcctgatgatcatcgaaaacccggaacgacttggtctggcgcagctgcatcagctgcgcggacgcgttggccgcggtgccgtcgcctcacactgcgtgctgctgtacaaagcgccgctgagtaaaaccgcgcagaaacgcctgcaggtgctgcgcgacagtaacgacggttttgtcatcgcccagcacgatctggaaattcgcggtccgggtgaattgctcggcacgcgccagaccggcaacgccgagtttaaagttgccgatttactgcgcgatcaaagcttgattccggaagttcagcgcgtggcgcgccatatccaccatcattatcccgaacaggctcaggcgctgatcgagcgctggctgccggaaaccgagcgctacagccacgcttaa

SEQ ID NO: 73354 - DNA, 180 bp, Glycine max
  Peptide Sequence Number=SeqID_165039
atgggatcttcgttagcaattggatgttcagctcggcttgatgtttgcgtttgtggtagttgtgaaggtggcataaagggggatgaaggatggtattgttggtcaaaggatgttagttgggcggtagttgtagttatggacatgagggttgtggagatgatggttgtggttgaggaataa

SEQ ID NO: 73355 - DNA, 217 bp, Glycine max
  Peptide Sequence Number=SeqID_165040
atgactgaaaatgttagtcagtttgtcagattgattgtgaaggaatgcattaaccgtatctcgtgtcgcaacctacccttcggcgggagggcgacgcgagactcgcgggatgcgtgttccacgaaaggaatacgcgcggagtcgccaccaacgtttattcgaggaaaacgtcggaaaaaccggaaaagacgcgatctacgaacttttaagttgaaag

SEQ ID NO: 73356 - DNA, 663 bp, Glycine max
  Peptide Sequence Number=SeqID_165041
gacaaacaacatggatttgttggtatctctatttacacgtttgggatttttcctcaaacaaatacagaaaaagacagggtagcatctcaacgagcccgtgatttttttgttggttggattatggaacccctgcaatatggagactatcccatttccatgaagacaaatgcaggcgtaattcactacaccaatctcaatgtctcagacaattctgacgcccttaagaaccaactgagagatttcactgcagacatggcggcaaatatctgtcaacggacagcaagtaattcgtcactgcaagacgtgacaagggtgaaatacttgcatggatatattggtagcgtgcttgatgccttaagtgatcttgagaagggacttactcaaagaattaatcaaaccagaacatacactgacacagatggatcaaatataaaggggtattttgcatggtctttcctggatttgttcgagttgctagatggatacaagtcgagctttggcctatactacgttgatagggatgatccagagttgaagagatacccaaagctctctgcaaaatggtacaaccggtttttgaagggtagaaggacctctatagttggaactattgaacttgagaaggatccatcacttgtttttgtttcccaattatttgagtag

SEQ ID NO: 73357 - DNA, 837 bp, Glycine max
  Peptide Sequence Number=SeqID_165042
atgtacatttccaactgtaagcaggaacatgagcattcaagtatctctgcggcaaagctgttggccgagaatggcgtaaaggatcttgtaatcctggaggcttcaaactgtattggcggtaggattcggaaggaaaacttcggcggtgtgtccgtcgaactcggagctggttggattgtcggagttggcggcaaagagtccaatccaatttgggaactcgtcgctgaatatggccttcgaacatgcttctctgactacacgaatgtgccatacaacatatatgatcgcaggcgagactctatttctttttccatttttttgcttctgttgctctgccgattgctctgttccataattcctgttatcgttcattccagtggaaagatattttcgagtggaatcgctgcggactcgtacaaaaaagctgtggactcggcaattcgaaacttaacgaaccaggaagaagccgatcgccaaggcaatagctccaaaacaactgaaccaccttcgtcgccattagagctagcaattgatttcatcctccatgattttgaaatggcagtgagttggtttatggatgtctgttctgaaactgtgaaagttgtggatgcagaggcagtaccgatatctacctttacagcgtttggcgaaagggaatttttggttgcggatgaaagaggttttgattatttggtatataaaatggctgaagattttttgttgacatctgagggtaaaatactggacactcgtctcaaactcaaccatggtaataatgggttggtccgttacattatctttatacgcctactccggggcttcttctctgcactctag

SEQ ID NO: 73358 - DNA, 1536 bp, Glycine max
  Peptide Sequence Number=SeqID_165043
atgccccaaccaaacgtcgcatctctaaatgctgcactttctggcttctcgcgaaacgggcgtcgcggagaagctctccgggtgttccggcgagctgggttgggccccttgaggcccaactcggtcactattgcgtgcatgctcggcgttcctcgtgtgggtgccaaccacgttgagatgatgcattgctgcgcggtgaagttaggggttgaatttgatgcctatgttgccacctcgcttgtaactgcgtattgtaagtgtggagaggtggtttcggcttctaaggtgtttgaggagttgcctgttaagagtgtggtgagttacaacgctttcgtttcgggtttgttgcagaatggggttcctcgtttggtgttggatgtgtttaaggagatgatgaggggggaggagtgtgtggagtgcaaactcaattcagtgacgttggtgtctgttctttctgcgtgtggtagtctacaaagtattcgttttgggaggcaggttcatggggttgttgtgaaacttgaagcaggtgatggggttatggtgatgactgcacttgtagatatgtattcaaagtgtggtttttggcgttctgcttttgaggttttcacaggggtggaagggaataggagaaatttgatcacttggaattccatgattgcgggaatgatgttaaataaagagagtgagagagctgttgatatgtttcaaaggctggaatctgaagggttgaagcctgattcagctacttggaattccatgatcagtgggtttgcacaactaggggagtgtggggaagcttttaagtactttgggcaaatgcagtctgttggtgtggctccatgtttgaaaattgttactagccttttgtcagcatgtgcagattcatctatgttacagcatggaaaagagatacatgggttatctttaagaactgatatcaatagggatgattttttggtaactgctctggttgatatgtacatgaaatgtgggcttgcttcttgggcacgaggagtttttgatcagtatgatgcaaaaccagatgatccggcattttggaatgcaatgattggtgggtatggaagaaatggagactatgagtctgcctttgaaatctttgatgaaatgctggaagaaatggttcgaccaaacagtgcaacatttgtcagtgttttatctgcttgcagccacacgggtcagccaaagcctgagcattttggttgcatagttgatcttttaggtcggtctggtcgattgagtgaagctcaagacctgatggaggaattagcagagcctcctgcatctgtttttgcttctttgcttggtgcttgtaggtgttacctagattccaatcttggggaagaaatggccaagaagcttctagatgtagaaccagaaaaccctgctcctctggtggtattgtctaacatatatgctggactgggaagatggaaggaagtagaaagaataagaggggtgatcacggataagggactggacaaactctctggctttagcatgatagaacttgcatga

SEQ ID NO: 73359 - DNA, 177 bp, Glycine max
  Peptide Sequence Number=SeqID_165044
atggagtttccaaaggcattccaacctagaaggtatggcatgatacactgcatagacaagaagcataagtacaatcaaaatgagcaaaatattaatcatgttgagtgcacaggaaaattggaatcactaaaaaaaaacttcgtaccccattacccagaggctcttcgctatgcgaag

SEQ ID NO: 73360 - DNA, 1158 bp, Glycine max
  Peptide Sequence Number=SeqID_165045
atgaagattgttgcggaggcagagccatttggcagcgacgagaattgtgtagaaggtgaggaggaatgggtggtcgagctttgtgtccctgaccttgggtcaaaggaggatgcgtggggcttgccattaacaggaggtgggaagttgccatgggaaggggaatcgacatggtttcgactgtgggtggtgactttgcagtggaagaagatagaaagtgttgcgagttcgacaatggcggcctcgagggggtccgggttggctgaggaaggtacgacttccgtcattggagggcggcaggtcggaccaattgttatgaacagagggtttttaccttgtattcgaggacaagcaattatgcctaaccctaaggtcttcttctacatgaccatcgatgggaaacctgttggtcgcatcgtgatggggctctacaccaatgtgactcctcacaccgccaagaacttcggggcgttttgcaccggcgagaagggcggtggccacttcaccgccggaaaagaaactcgcggcgagtcgatctatggtgccaagttcactgtgaagaagcacatttgtctcgatatcctctccatggcgaacattgatcccgaaaccatcatattgaagaagggaaaacttggaagggaggagcaagaccgcgccggccatggtggtggaggaggcggtggtttgtgcatcaccattctcattgctgatcttgttgatggctctgctgcaccagcaaagggggcgatatcaaagacggtgagtgctggggcagttgcagagggcgatttggtggaagatgaaggcacgtgctgtggtggtcgcatgggaaattggcttttctgcgctcctgtgaagaaatatggtggtggaggtggcgacgacagatacaatggttgtggaagagaggcgtctatactttctagaggcaggcaaggacattttatggttttagtggtcttcatgaaggctagcaattggttctactcgcaaaatcaatcccaagggattaagctgggtgcacataaggagaaggtgggtgctagtggatggctatgtggaaagactatgatggaaagaggtggactggtgggtggtgtggtctggcgtggcagccatgaaagacagggtaacggcatgtcagaccaattattatga

SEQ ID NO: 73361 - DNA, 1398 bp, Glycine max
  Peptide Sequence Number=SeqID_165046
atggtaaaaagtcaatatgttttgagtaaagaaagggtgagcaatattgttgaagaaggatctgcattgggaactggaaatgtgcaaatggaagagagaaaaaaagagaaagataaagcaagatattctcttcctccttcttcttctcacagcattaaacgccgtcgttttcatgactccataattcaccggaagcagaacaacaacaagaagcagcagcagcagcgcgagttcacatgggattgggaacaaccgcgagaagcagaagaagaatcgtcatcgaagaaggttctagaacaagaacacacaacaacaccaacaacgccgatgccgatggagctggagcaggagctaggttcaacaacaatccagcgttccttcgacgcgcgctacacccgccacgcgcgcgactcgctcggcgaattgcctgacagcttcaccatcaccgacccctccatccccggccaccccatcgtcttcgccagcccgggcttcctcaagctcacgggctactccctccgcgaagtcctgggccggcccgcagccatcttccagggcccacgaacatcccgaaaatccgtaatcgaaattcgcgaggccgttagagaggagcgaaacgcgcaggtcgttttactcaactaccgcagagacggtacgccgttttggatgctttttcgtgtttcccctgttttcagcagcgacggtggcgccgtcgtgcactttgttgccgtacaggtaccgcttcagaaaaaagaagggtccggagtgagggatttcgggttcgggtgctgtcggaaggaagtgtgcgtggattcgttggcggagattgatcgcgtttgttcattggagcaagtgctcgaacctgatgtcagagctttgtgggatgcagaagtggagagagaagagccgtgtgaggcgagtgatgatgagaagcgaagtgctgttactgccatggacagtatattttctgtgctaacccattacagtgaggccacagggagattggtgtgtagaaagaggtccagcattcctgacgtgggtcttttaagcacatccttgattatttctcttggtagaatcaaacaaagctttgtattaactaatccgcatttaccagacatgcctattgtttatgctagtgacgccttcttgaaattgacagttttctgcaacactaacaggaaggacaaaagctcattttggaattttcttcatatctcacccgttcgtgatgcttctggcaaggttgcatactttgtgggagttcaaatagaagacaacaataaaaacgatgatagccattgtttgagtcctgagaagagacaacttagtgtggttggtgtagtcaaggttgcagtgaggagtttatcaatgactgcgggatcttctgagtcgtag

SEQ ID NO: 73362 - DNA, 2880 bp, Glycine max
  Peptide Sequence Number=SeqID_165047
atgtccaccgttgcattagagactctcttccctctttgccgtagaaaaccttcatttcaccgccataaaccaatccctctcagacccttctttgtgacttgctcttccaacctcaatgatgatgcatccttcatcttccaccaacaacctcgcaaaactctctctcccgtgcatgcagtttcccacacagacacatctgtcctccactcccttcaatgccctcacaccatcaccaacactttcctaatcaacacaaccgaaacggtggagggaaagatttttgtgagattagatcacggaaagggtttgagggatcgggagcttacggtgggttgcaatcttcccggaaaatggattcttcattggggagttacctatgttgatgatgttggaagggaatgggatcaacctcctcgtgatatgataccccccggatctattcttataaaggactatgcaatagagacccctttgaaggagtcatccttatccgccgaaggagatacgcttcacgaaatcaggattgatcttaaagccaacaatggaattgcagcgattaattttgttctcaaggatgaggaaaccgaagcttggtacaaaaacaaaagaagagatttcaaggtttctttggtcaacaaccttaaggaggataatagcataattggacctaaatggggctttgatttatggccagggaatttgggacagatatctaaaatgttcctccagtcagaagaagctgaccaagatgacagcagtgaatctagagttccagagcaagacaataatcaaccagaaagtttttgtgaagaagtgcctataacaaagaaggttttagtccaaaactctatcagtgtctccaccacaaaatgccatgagtctggggcagttaaggaacttttacttttggaaactgatctacctggagatgttgtccttcactggggagtttgtagggatgattcgagaaagtgggaagttccacctcgtcctcatccaccaggaacagtagcatttaaagaaagggctttgagaactcaatttcggccaagagatgatggaaaaggatctttagcactaatcactttagaggaagaattttcaggctttatgtttgttcttaagcaaaatgaaaatacttggttcaagtacaatggacatgatttttatatccccctctcaagttctagtagctttcttaatagtggcaacaaagagggccagtcagaaggtatgcagagggaagtgactcaagaggctagtcaaaagagttctttctttgcatttactgatacaataaccaatgaaataagaaatttggtcacagacaattcctctgagaagattcaaaggacaaaatcaaaaatggcacaacgaagcatttttcaagaaattgaaaggctggctgctgaagcctataatatattcagaatctccattccaactttctctgaggaaactgctgcagaacctgaggtaactattgtggaacctgagacaagtattgtggaacctcaggcaacaactattgtgatacctgagacttcagtggaatcagagacacagtccctggatccaaaaatatgctcaggaacaggcacagggtatgaaatattatgccaagcgtttaactgggaatctcacaaatctggaagatggtacatagagcttaaagaaatggcttcagaactagcatcacttggtttcactgtggtttggttgccaccacctactgaatctgtttcacctgaaggatacatgccaaaggatttatataatttaaattccagatacggaaacattgatgaactgaaagatttggtgaaaagatttcatgaagttgggatcaaagttcttggagatgccgttttaaaccaccgctgtgctcactatcagaatcaaaatggtatttggaacatatttggaggccctcttaactgggatgatcgtgcagttgtagctgatgatccacattttcagggcaggggcaacaagagtagtggagataattttcatgccgctccaaacattgatcattctcaggagtttgtgagaaaggatctcaaagaatggttatgctggttgaggttgatatttttagacccaaattttcttcagcttattcttaacaaaagaatgttttgtcagtttaattgtatacttttctccgtgaccttcaggaaagaagttgggtatgatggatggaggcttgactttgtgagaggattttggggtggttatgtaaaggactacatagatgcaagtgaaccttatttttccgtgggagagtactgggattccctcagttatacatatagtgaaatggatcataatcaagatgctcataggcagaggataattgattggatcaatgccactaatggtacctctggtgcatttgatgtcacaacaaaaggaattcttcaccctgcattggaaagatgtgaatattggcgattgtcagatgagaagggaaagcccccaggcgttcttggctggtggccatctcgagctgttacgtttatagagaatcatgacactggttccacccagggtcattggagatttcccagtggaaaacaaatgcaaggatatgcctacattcttactcacccaggaactccatcagtgttttacgaccacatttcctctcacgataaaagtgaaatagcaagtctaatatctctcaggaagaggaacaagatccactgcaggagtagagttcaaattagtaaagcagaaaaggatgtttatgcagcaatcatagatgagaaagtagctatgaagattggacctggacattttgaaccaccaagtgactcccagaaatggtcattagctattgagggaaaagactataagatttgggaagcatcataa

SEQ ID NO: 73363 - DNA, 376 bp, Glycine max
  Peptide Sequence Number=SeqID_165048
atgaatgtgaaaagaaggattaaagtcaatttcaatgttaatggtgtggaactagaagctccacaagttagcacatgggaagggtatgtggattggaggaacaagcctgctcttagaggtcgccatggaggcatgcttgcagcctcctttgttctggtggcggagatattggagaatctggcgtttttggccaatgctagcaacttggtgttgtacctgaggcagtacatgcacatgtcaccttcaaagtctgcgaacaatgtcaccaatttcatgggaacagcctttcttcttgccctcctcggtggtttcttatccgatgcctttttcaccacttatcgtgtctacctgataagtgcagttattgagttcctgg

SEQ ID NO: 73364 - DNA, 237 bp, Glycine max
  Peptide Sequence Number=SeqID_165049
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttccaaattgaaaaggtggctctaatatcaaaaggatggttcccacaaggatgtaggaatcccaagtag

SEQ ID NO: 73365 - DNA, 426 bp, Glycine max
  Peptide Sequence Number=SeqID_165050
atggaggagtttgacgcacaggtggcctggccaagagaccagccttattcctctagagggggtggggtctccacagcccaggagcctgttgtaggagagcatcatccacagaagatggttcaaggcaaatttgtcccaaatttcggggagccactgggtatggaagctaagtgcctgaaaaaaaagggcaagtatggggaaggaacaaatgcaaaagtgaaggttattctatggatgaatgctctcctagaacctaagcttttgaatcctagaaaaaccatgaattgttggcagcctaaccccattacaagcctagaaagtccttcggattcatttttgtgtgttcattgctgtatgataggagatgaaatgcaaaggttggaacttgtgttggttgtttatgatggaataagcctaaacacttga

SEQ ID NO: 73366 - DNA, 178 bp, Glycine max
  Peptide Sequence Number=SeqID_165051
cattttcatacactatgtgatgagaatcctgaaactagccaaatacaggctaaaggctcaagtggagaaggataaagcccctgagtggagaaggatgaaggcccaagtggagaaggatgaaggcccagaggcagagacactatcaagactattaattgttgctgaaggcccagattaa

SEQ ID NO: 73367 - DNA, 564 bp, Glycine max
  Peptide Sequence Number=SeqID_165052
atgacagatcgtgtgagcgcggaagatgacgtaaatctccgcgtgtcaatgcgcttgtcggccgcgattgacgaagggcgcagaagagacgttagtctctgcgtgctatcaggtttttcgtcttacagacagcaaaaaagaatgtttatacggataaccacttgggtatttccgcccgtcagcgtgactcaaaagtcaatagcaaaaagagtttatacggataaccactcgggtatctccgcccgtcagcgtgactcaaaagtcagtatgacagatcttgtgagcgcggaagatgacgtaaatctccgcgtgtcaacgggcttgtcggccgcgattgacgaagggcgtaggaagacgacgttagtctctgcgtgctatcaggcttttcgtcttacagacagcaaaaaagagtttatacggataaccacttcgggtatttccgcccgtcagcgtgactcaaatgtcagtatgacagatcttgtgagcgcggaagatgacgtaaatctccgcgtgtcaacgggcttgtcggccgcgattgacgaagggcgcagaagacgacgttag

SEQ ID NO: 73368 - DNA, 303 bp, Glycine max
  Peptide Sequence Number=SeqID_165053
atggcaggcggctcgtcgccgttgagcgccgccagcaggcgtttaccggccatgcgtcccatctcctcgtacggcagcacaatgctggtcagcggcggcgaacataccgccgccagcgggccaccgccgatgctggcaatcgccagctggctgggcaccgagacgccggcctgcgtgacaggccatgatggcgccgcacgccacttcatcgctggtacagatcaggacgtccagttccggccaggtgagacggatctctgccagcaggctgtggccggcggcaaaggtgggcatttttggtga

SEQ ID NO: 73369 - DNA, 425 bp, Glycine max
  Peptide Sequence Number=SeqID_165054
atgggaacaaatcaaactggaaaaaggttctatcaagtcaagattaagggcctagatgtcaccagccttaaggagttggggcggttgatgggacctctccaaatgcaagccttccgcaaggccaagattgcaattgtggtcagggattcggcaagagagttggatcgtgtaaagcaaactcgaaacgacgtagtgggcctaccacgaaagtacttagaaggcaaggcaagggatatggtgaatcaagaggagtgggtcccgtttatggacgtattagcattgctaatctttggggttgtcctctttccaaacgtggatgttttggtggacctagccgcaattgatgctttccttgcatatcaccatagcaaagagagcccggtggtagccatcttggcggacttatttgatacatttgaacgaag

SEQ ID NO: 73370 - DNA, 745 bp, Glycine max
  Peptide Sequence Number=SeqID_165055
caccgcccggacatcagcgctggcaagtgtagcggtcaccctgcgcgtaaccacccacaccccgccgcgcttaatgcgccgctacagggcgcgtcccattccgccattcaggctgcgcaactgttgggaagggcgatcggtgcgggcctcttcgctattacgccagctggcgaaagggggatgtgctgcaaggcgattaagttgggtaacgccagggttttcccagaattcgatcacatgcagttcaaagggcttgaagattatgaacttaggagatgcccaacctactgttggtataaagaaggttcattgtttgaggatgatgatgcttttgatccacatcttgagcgcataaagaatgaagctggtggagatgaaagtggtgaggaggagacaacatttatttatgttgatcaacaatatctaaaagttgggcttgggcatgaaaaaataagtgaactcgaagcttacatttcagtttttgcaactattgaacttacatccataagcatccagtatcaagcttatcgataccgtcggcctcgagggggggcccggtaccagctttggttccctttagtgagggttaatttcgagcttggggtaatcatggtcatagctgtttccttcgggaaacctgtcgtgccagctgctttaatgaatcggccaacgcgcggggagaggcggtttgcgtattgggcgctagcggagtgtatactggcttactatgttggcactgatgagg

SEQ ID NO: 73371 - DNA, 411 bp, Glycine max
  Peptide Sequence Number=SeqID_165056
atggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccggcagttcgctccaagctggactgtatgcacgaaccccccgttcagtccgaccgctgcgcccttatcccggtaactatcgtcttgagtccaacccggaaagacatgcaaaagcaccactggcagcagccactggtaattgatttagaggagttagtcttgaagtcatgcgccggttaa

SEQ ID NO: 73372 - DNA, 354 bp, Glycine max
  Peptide Sequence Number=SeqID_165057
atgatggttgccatggatgaagaagctttagggtggttccaatggtgggaatcttggaacccaaaccattcttgggaagggttcaagatcgcaatctcccaaaggtttcaagcttctaacctagggaatccttttcaggcattgttggcgctagaacaggaaaaagcagtgcaagaattcataggccaattcgagaagcatgtcggaatggtgaaggggttggaggaaccgtttatggtgaaggtgtttcttaaagggctaaaagaagatatcaacactaaggtaaggctctatgaaccaaaaaacttgatggaatctatggtcaaggcttgtaagggagaagataagaattag

SEQ ID NO: 73373 - DNA, 762 bp, Glycine max
  Peptide Sequence Number=SeqID_165058
atgacagccattgccaacggtatcgcgcatcacggtggctttgtgccttataccgccaccttcctgatgttcgtcgaatacgcgcgtaacgcagcgcgcatggccgccctgatgaaagcgcgccagattatggtctacacacacgactcaattggtctgggcgaagatggcccgacgcaccagccggttgaacagctggccagcctgcgcgtgacgccaaacttcagcacctggcgaccgtgcgatcaggtcgagaccgccgtggcatggaaagcggcgattgagcgccatcacggtccgaccgcactgattctgtcgcgtcagaacctgctgcagccggagcgcagcgcgcaacaggttgagaacatcgcgcgcggtggctacatcctcaaggattgtgacggcacgccggacgtcatcctgattgccaccggttccgaagtggagatcacgctgggcgccgaagcgaaactcagcgccgacggccacaaggtgcgcgtggtgtcgctgccgagcactgacgtgtttgataaacaggacgtggcctatcgtgaatcagtgctgccttccaccgtgcgtgcgcgtgtggcggttgaagccggtattgccgactactggtacaaatacgtcggcatcgacggcaaaattgtcggcatgaccaccttcggcgaatccgcgccagccggcaagctgttcccggcctttggctttaccgtcgagaacgtggtgagccacgccgaatcgctgcttaagcctgcctga

SEQ ID NO: 73374 - DNA, 165 bp, Glycine max
  Peptide Sequence Number=SeqID_165059
atgtcataccctaatttcgtccgaggacctttgcttgatgacatgcgacctttctttggtccttgtgagaaggctgttgcttctggaggaagcaacctggctcgcctgggcgagctgagctcgcctgggttctatccctttcctagtattatgaccagcccctaa

SEQ ID NO: 73375 - DNA, 483 bp, Glycine max
  Peptide Sequence Number=SeqID_165060
atgccgagcccgaccattaacttggcctacatcaggaagaacagttggaacgttaatgatctaacagttgcttttcggggggctagaagggcgaaggtgaggcccgctgatattccatctacttctacagctctttcagtcctagctcatgttgactctcaatgctttgaagccatgcttcaaaggaaggtgaaggtcccacagcccaggtaccccaacaagtacaggatgcttcctttgagaccaccattccagagccattcactcttcatcatgaggcagagatcacttgagggcacatcagagcctcctattccaatggcagacctctcctcaccacagcctgcagctgatccttccactcccagacttgagataccagaggacctgaccacaccagtcttagcactaaacacctctcctccagctactccaatacttcacttgacaaataaggatgatgctcagactcagggtacctag

SEQ ID NO: 73376 - DNA, 360 bp, Glycine max
  Peptide Sequence Number=SeqID_165061
atggcttacgaacggggcggagatttcctggaagatgccaggaagatacttaacagggaagcgtttccccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccgtcatgcgccggttaaggctaaactgaaggacaagttttgtgactgcgctcctccaagccagtactcgtcaagagtggtagctcagaggaccttcgaaaactccctgcaggcg

SEQ ID NO: 73377 - DNA, 240 bp, Glycine max
  Peptide Sequence Number=SeqID_165062
atgctacgatgcgaaaggtatttctctcagttcaaatatgatattgaaattcccaacggtgagagttctcggaattgggttgcaaacttggtgcttaaattttacgacgatccaatgatgaatgaatccgatatcatcatttttctgagacaggtttggtggtctgcgagaaaaagaaagagttttaagaggagaaaagagaaaaacgaaaatgaggcgaagaggagacacctgacttaa

SEQ ID NO: 73378 - DNA, 480 bp, Glycine max
  Peptide Sequence Number=SeqID_165063
atgagggcgcacactgccaactcatatcaaaccacaagagaccttgttcaggtggctccgctccctcccaagaaaccgagcaggttagtcatatcttcatccatatgggattcatccgcctcaccgggggatcctataggctcctcccctgcctgggcatcgggccagtctccaggccatgcgacctcagccccaaatttctctaggataacactccatgcccagtggcccagcaggatcggcctgccaaggcgatggcggtgtgcctgcggcctgatgtgcgtcaccctgcgcctacctaggtgtgcaatacttctcaatgaaggctcgggtgatcgatggtcggattacattattgggggtgatgggaactctataggactggcagaggcctatgatcagtgcctgaaaccccagggccctgttggacttatctgggtccagagggtgcctagtagcgccatacctgcaaacaaataa

SEQ ID NO: 73379 - DNA, 1512 bp, Glycine max
  Peptide Sequence Number=SeqID_165064
ggcatcgtggctgtcacgggcggccatgctaacaataaacatcaatttcttcaggattccgattatgagtcagacatcaaccttaaaaggccagtgcattgccgagttccttggtaccgggttgttgatattcttcggagtgggttgtgtcgctgcactgaaagtggcgggtgccagttttggtcagtgggaaatcagtatcatctggggtctgggcgtggcgatggccatctacctgactgcaggggtttctggtgcacatcttaacccggcggtgactatcgcactgtggctgttcgcgtgcttcgacggacgcaaagttgttcctttcattctttctcagtttgccggcgcgttttgcgcagcggcgttagtttacgggctttattacaatcttttcatcgacttcgaacagacgcatcatatggtgcgcggcagcgtcgaaagtctggatctggcaggcatcttctcaacctatccaaacccgcatatcaattttgtgcaggcattcgcagttgaaatggtgattaccgctattctgatgggcgtaatcctggcgctgaccgacgacggaaacggcattccgcgcggcccgctggctcctctgctgattggcctgctgattgcggtaattggcgcatccatgggcccactgaccggattcgcgatgaacccggcgcgtgatatcggaccgaaagcgttcgcctttatcgcaggctggggcgacgtcgcctttaccggtggcaaagacattccttacttcctggtaccgctgtttgcgccgggcactaccagctcccgcgctgtcgtaatggatcatgacgcgaacatcgtcagcgtgtcacagcgcgaatttgaacaaatttatcctcgtccaggctgggtagaacacgacccgatggagatttgggcatcacaaagctccacgctggtcgaagtgctggcgaaagccgatatcagttctgacgaaatcgccgcaattggtatcaccaaccagcgtgaaacaacgattgtctgggaacgtgaaaccggaaaaccgatttacaacgccatcgtctggcagtgccgtcgtacttctgaaatctgcgagcagctgaagcgtgatggcatggaagagtacgtccgcagcgccacgggtctggtggttgacccgtatttctccggcaccaaagtgaagtggatcctcgaccacgtggaagggtcacgcgagcgtgccaaacgcggtgagctgctgttcggcaccgtcgatacctggcttatctggaagatgacccagggacgcgttcacgtcaccgactacaccaacgcctcgcgtaccatgctgttcaacatcaacaccctggagtgggatgacaagatgctggacgcgctggatatcccacgcgcgatgctgcctgaagtgcgtaaatcttctgaagtgtacggccagaccaacatcggcggtaaaggcggtacgcgtattcctatcgccggtatcgctggtgaccagcaggcggcgctgttcggccagct

SEQ ID NO: 73380 - DNA, 676 bp, Glycine max
  Peptide Sequence Number=SeqID_165065
atgcgcgcacgcattctcgatagcctgctgttggccgcggcaggtgtgccgcgtgaagcgccacataaacaaatcacgtatacattaggtcagcaggccttaaagcgctcaggcgaattgcagtggcacttgctggaaagcccggcacgactacgtatttataccatcgactcgctctgtgccaacctggctagacagatgccattattgagccgctttggtacacaaccggccgtgactgaagatgcctgggcctattaccgcgaagcagcgggactggcgctacaagccatggatgaagatacgctaggcgaacccgtgcgtcgcgtgctgcgctatatggataacgaccaggccaagctggaagccctgctcatgtccatgctggccaaacgtgaacaatggctgcacttaagccagaccaatgaccgtgaacaggcgcaagacgcactgatttacttaatagaaagtgagttacaggcagcattgactgcattccctgcccgtttgcaacaatcgctgatgccgattgcacgctatgctgccagccagttaccgcctgaacatatcctcgcgcaattgctggactggcaaataccgttcacagcagctatagaagacttgccaggctggcgtgcgctagccgaactattgctgaccagtagtggctgtttac

SEQ ID NO: 73381 - DNA, 624 bp, Glycine max
  Peptide Sequence Number=SeqID_165066
atgggtgaagtagaggaggtgcaagagcagataaaggccgacacagaggtcttgaaagagaaaatggccacaatgatgaaggccatgatgagcataaaggagataatggaggtcaatgcggatgcaatagccgctaccagcaccattgctgaggtggaccaaaccaccccctatggtctcaaccaaataaatcatccaacctcagatatggtaggtctggaaggcaaagagttgggaggtatgggcagccctcatttagcgcaaaaaaaaaaaactaagcatgccttcccaccatatatgccttgcctcccaactatacaccacccaatgtggcatacactcccaatgaggatgtcaataattgaaagccaacaacctcaaactgaccatgcacatgtctctcaaaccatgggggagacacatgaaatttcccaccacaatccagcctacttcgagccttgccttggatatgccactgaagggcaagcagttggtggtatacccctgcaaaacactttggagaggcctcaatttcgcccccaaccacaacccttctatggaaaaatagtgggttacacaccttcaagctttgcggatttggtcttcgctggcgaaaggatcaaa

SEQ ID NO: 73382 - DNA, 276 bp, Glycine max
  Peptide Sequence Number=SeqID_165067
cacttggttcgccaacaggcggccaaccaccgggggcaggtgcagatacatgactgtctctaccagctcagcctcagtcagcagggccagggttttattccttttgtgtgccctactccagatcaatttagggctgaggtcgcatggcccggagattggcctgaggcccaggcaggggaggcgcctgcagaggctcccggcgatgcagaggaagcccgcatagatgaggagatgacagatttgcttaatttcttgggagggagcggagccacatga

SEQ ID NO: 73383 - DNA, 591 bp, Glycine max
  Peptide Sequence Number=SeqID_165068
atgagtcttcattcttcatctagtgttaatgctgagggttctactcctaaggaccccttgtataagatattagatgagttgagatcccttaagttgtggaaagaaaaacaagagagaaaagaaaaaggaaaaaaaagagtagaagaaataagtcaagatgaaaaagagaaaataagggaagaagaaagaaggaaaatgctaaaagagttaagaaaagaaaaaatgcctcctatggtagtcataactcttgaaagaaagcctcaagaggcaaacattaacctcccatacttccatggaaaggacaatttagaggctaacttagattgggaaataaggcaaccccttaaggctagtatgcaagagaagactagctccataaagtgctttaaatgtcttggaagtgggcacattacttctcaatgccccaccaagaaaaccatgattatgaggggccaagacatttatagtagccaagatgaggctactacttcaccttcctctagtgaaagtgaagaagcaaaaggggaagaatctagtgaagaaatttacccccaagaagaaggacaacctttaatggttaagaaggagtga

SEQ ID NO: 73384 - DNA, 351 bp, Glycine max
  Peptide Sequence Number=SeqID_165069
atgcatagaccatggttatcaaaagataaattagttactctgtgggggctttgggtgatcgcagccatcggcatcgtctggatggcgaatgccacttctattgacctgtcactggctgaccggcagttcgatttcgctagccagcggttctcgctcaaacatgattttttctatgaaacagtcatgcacatctacgcgaaacatctattaacggtactctggctgggattgctgttcctggcatgggccccggtaaagttgattggtaaccggttatctccagccacacgctctcaattgcgctggatcgtttttctggcactgctaaacgccatctttgtcagctgctga

SEQ ID NO: 73385 - DNA, 99 bp, Glycine max
  Peptide Sequence Number=SeqID_165070
atgtgtaggtcttgtgcactttcgttcgcacgcctttttcaaaaagatgccatctcgagcatcagtcgtgcccaggaattaatgaagcattgggcttga

SEQ ID NO: 73386 - DNA, 330 bp, Glycine max
  Peptide Sequence Number=SeqID_165071
atggtggaaccatcgaagaagcgcaagggttcttcaagtagaagccaacgacattctgaggctcaggatactccaattccttcctccatttcctcctcctcattgttctcatcggaagaaaaacgtatacggtacacaaacctcttctcctctcgttctatcattgaccctaagttcatagatatggatttcttttctgatgagagtttcaaatgcattcaagcatttcaaaattcaaatctcattccttttatgtctttaaaactgcttgtgtattctgaattgaagtaccttgatttcagaggtctatgggataaaaatggtcattga

SEQ ID NO: 73387 - DNA, 417 bp, Glycine max
  Peptide Sequence Number=SeqID_165072
ggcgaggcgcaagaggacttgaaagactcccgtatggaaggtattaacttccagcagctggtacagcaggcagtggagggcagcagtgacgtcaaagcgcaggaaaactacgatagcgtcacgcgcctcgacagtttctccacggatctgacgctggataacgggcaactgacgctggcagctatgcagggaacctcttctatgctgtcgttgaccggagaaggctcgctggatctggtcaaagagacggcggacacgcgctttaacgtccgggcgctgaattacagccttcaggtggatcagatcctgcgtaagcatctgcaggatgaagcgaaacgtcggcttaatagctgggcagatcgtaataaagattcccagaacggcaaggatgtgaagaaactgctggataagctttga

SEQ ID NO: 73388 - DNA, 171 bp, Glycine max
  Peptide Sequence Number=SeqID_165073
atggaggagtttgacgcacaggtggcctggccaagagaccagccttattcctctagagggggtggggtctccacagcccaggagcctgagagcatcatccacagaagatggttcaaggcaaatttgtcccaaatttcggggagccactgggtatggaagctaagtgcctga

SEQ ID NO: 73389 - DNA, 1335 bp, Glycine max
  Peptide Sequence Number=SeqID_165074
atgtatagttttttggaagataccggaataaaattccaaattgaaatccacagcgctcctgtttgggtgaaagtatggtatcttgatcctgaaattttccataccgcccctatgttttttctatcaacagatgtaccggaaaatgaccacgtttcaaaaacaatctgtcataaactatatgatgccaatgaatcgacaaagctggctcaatatatattactgggaaaaggaggtgcccaattactggacgaaatgaatctggaaagagatatttatcatctgaatgaagcacatgccctacccgctgcattttatttattaagaaaatacaatggagatttaagcaaagtaaaagagaaacttgttttcacaacgcacactcctgaagaagcgggaaatgaaaaacataatctgaaattatgttatgacatgtcttatttttcaggctttagtatggaagaagccaaaagcatagaaggagtagatgatgaacgtttcaatcattctctttgtgcattaaaaatggctaaagttgccaatggtgtttcacaacttcacggtgtggtttccagagcaatgtggagtaaatatcccggaatttgcgaaatcaaatcaatcaccaacgcccaggaatttaaatactgggcagataagcgcctctacaactccaaagatgaaagagacgatcaggcatttgattaccgtaaaaaatatttaaaaaagagactctttaaaatcgttgccgatcaaacaggaaatcttttcaatccaaacatttttactatagtctgggcaaggagatttgcaggttataaacgtgctgatctgcttttgcacgataaggacagattttacaagttattgaataatcctgaacatcctgttcagataatttgggcagggaaaccctatccaatggattattctgccatttctacgttcaatacactggtagaagaaagtaaaaatcataaaaacatggctgtccttacaggttatgagctttctttaagcaaatcactaaaacagggttcagacctatggttgaataatcccagggttccaagagaagcttcaggaacttcaggaatgactgcagctatgaatggttctgtaaatctttcgacagatgacggctggattcctgagtttgcaagacacgggcaaaactcttttgtcgttcaaaaagcagattacctgaatatgagcatctacgaacaggacaactatgatttaaaccagttatatgaaatcctggaaaaccagatcctccaacctactacgataatgcagacagctggaggaaatacagtacaatgccatggacgatgttaa

SEQ ID NO: 73390 - DNA, 129 bp, Glycine max
  Peptide Sequence Number=SeqID_165075
atggcacaaagagacaaatttgtcactgaaatgattgtcagcatagagtatgtcaaaatggaatggaaggttgctgcagcccctaaattagtgagagatacaactctacgttccaaagacaaagaataa

SEQ ID NO: 73391 - DNA, 675 bp, Glycine max
  Peptide Sequence Number=SeqID_165076
atgccaactgccatccttcttcttcaccaacagtaccaaagtgggggtatcggtctggaagaggtgagagtatttcaagaggaattggtggatagcaggaagtgggtggtgttgcgtgagggtgatggagaaagaacgaccgacatggtggaactgcatggtcagtgtgtcgtagttggtgacaacaggtccaagttgtttcagccattgaatgccgagagcaatgttggctccactgatgggaaggacggtgtcgttactgacagtgacctgaagaggaatggcaatgatggtgaacagactcgtacaggcgaagggcttccgggtagtaatactggaaagggcgttgaagctaatgaggacgtgggcgaggttaggagaaggtgggataggtggttcggtactagaggtttcaagtgcacaagccttattcgtgtttgcgagttgggtgatagcttcctcgaggcggttcgtggttttggaacgggtgttgtgttctgccatgacagcgctggcaggtcagaccagtttgacgggttcgcatccttgaattcgagaccaaggataatctccaatgagaagagagagaaaaaggagaaacataagggacactttgaagggcatttcactcccttcgatgggagcctgaatcttgaaggaagaccgtcacattga

SEQ ID NO: 73392 - DNA, 427 bp, Glycine max
  Peptide Sequence Number=SeqID_165077
atgccccatcacttcttcttcttcttgatgccaagtatcatcattggggtggtgggttcagaaagttgttgtgtgtttggttcctctcttgcttcagatcctgagacaaagcacaaatggtacggatctggtgtgctcaagcaagagagatctgccatagcaagtgaagatgatgagtggagaacttctaaagtggccaaaactgatcatgacatgtcttctgcctccaaagcaatgctctttcagcaaagaaacaactctttgttgagatctaatgctacccttttctctgatggccatcatcaccaatcacaaatgttgagcttctcttctccaaagtcagagtctttgttggtagataaggcttcctcaaatgccacattgcctttttcttaccaccaattgtctagcaacaccagaaatgcag

SEQ ID NO: 73393 - DNA, 195 bp, Glycine max
  Peptide Sequence Number=SeqID_165078
atggaggcgcttgcgggaacagcaaggagaagatgtagaagagttgttcttttgagctcatgctatggcagtatgacagtggtggacctcatgtgcagtgacatgacggtgctggagctcatgcgtggcaacgtgataatgggcgtgaaggatttcgaaaatcaccaaatgcaaattcacttagtcccttattag

SEQ ID NO: 73394 - DNA, 312 bp, Glycine max
  Peptide Sequence Number=SeqID_165079
atggttaagcaagggtcacaactaaaggccgattatgaggttagttgggacaaagatggattctttcggaactcaaggaatcaaattcaagagaagaataacatggtatccacaagggcagctgatcattacagaagcgaagctccaagacgtcaggcctacaattctcgccacagtccagatactgtgcgccccaggagattcaagtcattgactgttacttgccttacgccttacggtgcaagaacaacggaatggttggtgtggaaatatgcttctaaagcacagaatgagagttattttctgtcataa

SEQ ID NO: 73395 - DNA, 2238 bp, Glycine max
  Peptide Sequence Number=SeqID_165080
atgtctccctcgttcacatcgacgccaaccttttccacctcttcttcttccgcctccgacaatacgttcaaactctttggtctcactccatctcttcatataatactcattcgtcccaaaggaaacaatatgcaatgcccaaaaaacatggcattggaagaagacccaacaacacttctcaagctcgagtcagcatgttccgacctaaaaaccctacttcgagcctccgaggaaacagaagaaaacctgggaaacacagacacaaggctcgatcttttacaaagatcactctccacagcctccaagagaatcgtccctttacaatccctagccatgtcgaggaaagccctcgactcgagaatcaccagagccttggccccggcacttgcactcctcaacacgttcaagttgacagaatgtctccagaacagtctcgtcgagctctcgacgaggctgtcctcggagaagccgcttcagaagcggcttgagaggcttctggagtacactaaatacgtggatcaactgaacgaggggttaagcaacataagtgatgaggtggaagtggtgatccagaagctgcaggaggtggtggagttcataagccggacaaaggcggcagaccagtaccgggaggcaaggctgagggaggctctggggactctgaaggggctgtatgagattgaggtggatgagatgagatttcaggggctgctggaccaggcgttggtgcatgtgcaggatgagtttgaagggttgttgctgaggatgaagcttaggaacctgcagggggatttggtgcaccaacatggtgatgatttcagggaattggggtcggaactggaaattgaagtcctcagaagaatttcaaccacacttgctgccaatgattgcctagacatatgcattgatatatacgtcaaggcaagatatagaagggctgcaaaggcactaatgaagctaaacccagattacctgagaacatacaccccagaaggaatcgaagaaatggagtgggaaaccttagagacagccacaaccctttggatccaacacttggaagtggcagtaaagaaagtcctccttgcagaaaagaaactctgcgagagagtcttgggagatttcatggagggactaatctggccagaatgcttcatcaagatttccgacaagatcatggccgtattctttcgcttcggcgaaggcgtggcccggagcagcaaagagccccagaagcttttcaaactcttagacatgttcgagtccttggagaaactcaagcccgagatgtcacaaatattcgaaggcgaacctggcttagacatatgcacaaggttccgcgagttggaaaaactcatcatcgatgcttcgagcaaagttttatgggaattcggcctccaaatcgaaggcagcatcgacggtcttccacctgctcaagacggttctgttccaaaacttgtgagatacgctatcaactatctcaagtacctcaccacggttaattacagaacatcaatggttaaggttctccgaacacaacaaacatgggaagatagaagtatcaatgacatgtcttcggacgagggtttgttaaagcatgcaattagcaatgtcatggaggcgctgcagcggaacattgaggcaaagcgtatgtgttgtagggacaaggttttggtgcacgtgttcacgatgaacacgtattggtacatttatatgaggacgaaggacacagagcttggtgaggtgttgggtgagaggtgcatgaaagaggattacaaggctgtggcggaggaaagtgcttacttgtatcagaagcaagcgtggggtggtttggttagggttttggatggaaatgatgtgaggggggaagggaaagggagtgtgggaagagtggtgagtgagaagattgaagcttttttcaagggtttgaatgaggtttgtgagagccatgctagaggggtgtatagtatacctgatgtggatttgagggaacaaatgagggaagctactgtgaggcttgtggtgcctgcttatgccgagtttttggagggttattcagggttgttgcagaggaaagggtacccgagtgttgagagggtgaaagagttggtggggaaggcttttgattgggggaagttgaagaggaggacttctgcagcttctagtgattggaatgctgcaaggaactctgggtctttagagagggatgttagatcaggcaatggtggaggtgatatttga

SEQ ID NO: 73396 - DNA, 591 bp, Glycine max
  Peptide Sequence Number=SeqID_165081
atgcttttcgccagtttgactagcgagttacctgcagcggggcatttgtttattttgaaggtatatgatgaattcggtacaacaatcttgtatttcaatgaaggatttgtagtttctgaaaaatatgttgctttgcaaatttgtgacgacgaagatgttgaaactatgatcgaaagttttcaacaacaagaacaaatgtcagttctagaattgtacatagaaaaggatgttgttagtggttctatgtttcattctgcaaattctgttacatcatgtgaaaataatttatctaataatgagtcgaaaccgccaagaaatgtaaacaatttacatgatgataaagatgatgatgatgattattttgtgtctaactcatacgttgaagagtctttagacaaagatgatagtgttgacgatatatctgatacagacgatgaagtcaccaacatgattcaactaagaattgttcatccaacaaaaggttggtgtcattcaataacttggaaacaaattagtggcaccaccgcgcaccacgcaacactttcaactaaacaaattggaggtaacaccaacataacatttgttgtgtaa

SEQ ID NO: 73397 - DNA, 1749 bp, Glycine max
  Peptide Sequence Number=SeqID_165082
atggtggtggttttgtcggatcaggatgaattcgacgaggagcccggcgaggttgtcgattcggcgccaccgcagaaggtcggcgaagagagacaattcagcggtttcaagaagaagcttctcaaacgcggacagggttgggaattccccaacttcgacgacgtcgtaactgttcgctgtgttggaattggaacattgctcgatggaacaacgtttgattacactagggagagggatcgacctagaacgtttgctctgggcaaagatgatgttgctgctgggttggaccgtgggatttgcactatgaagaaaggggaggtggcattgttcacgttgcccggagatggtggtgatggtgattttacgcgtgattccgacggctcggttgtgcggtttgaggtggagctcgtttcgtggatcacggtggtggatgtttgcaaagatggtggagttgtcaagaagattatggagaaggggagtgggaacgagcgccccggtgatcttgatgaagtgctggtgaagtatcaggtggtgcttgatgatggcactgttgttgtggagacaccggaaggaggagttgagtttcacgtgaaggatggtcatctttttcctatattgccgaaagtaatcatgactatgacaaggggagagaaggctgaattaattgtccaaccacagtatgcctttggggagaaggggagagaagctggcagtgggctctgttcaattcctccgaattcagtgctgcatgttaatattgaattggtatccttcaaacctgtcataaatgttactggtgactccaaggtgattaaaaagattttgaaagaaggagagggtgttttcacagccaatgagggtgcaaatgttactgtgaggtttacagctatgctagaagatggcactgtatttgagaaaagaggaattggtgaaacacaacccttggaattcataactgatgaggaacaagtaattactggtctagaccgagccgtggcaacaatgaagaagggtgagagagcgatagttagcatacatcctgattatgcatttggaaatgttgaagtgagacgagatcttgctattgtgccaccaggcgcgactgtagtctatgacgttgagatgatggattttattaaggagaaagcaccatgggaattgaatagtaaggagaaaattgaggtggctgggaggatgaaagaagaaggaaatgtattatttaaaggtggcaattatcagcgagcagggaagaaatatgaaaaggctgctgattttgttgaagaagatggatcctttggggatgatgagcaaaagcaagctcagacactgagagtgtcatgctggttgaacggtgcagcttgtagccttaaacttaatgactttcctggagcaatcaagctatgttcacaggtgcttgatgttgaattttgcaacgtgaaagctttttacagacgagcacaagcatatatagaaactggagattaccttttagcagatgtagacatcaagaaagctcttgtggtggacccacaaaacagggaggtgaaggtaatccagaagaaattgaagcaacttcaagctgacagtgacaaaaaagatgctaagctatatgaaaacatgtttgcacgtaaaacaaaggactcgcccatggctataaagagattgaaggttgaaaaagatgagagggaaaatgaagaggttgcaagaatggaaattgatgaagttgctgatagcccagtgattcaatag

SEQ ID NO: 73398 - DNA, 198 bp, Glycine max
  Peptide Sequence Number=SeqID_165083
atgacgaggcaatcgtgtcatcaaaccaccctaaagggtctgtgtcatcaaaccacgaaacatccaactttatccgatgaggcgaaaaggaagtgtttgtgtgtggttaagtatctggttgcgccgaagaggaagaaggagatggaggtcgagactcgagaattgccaatgcagggaacattgtctaacagaaaataa

SEQ ID NO: 73399 - DNA, 1441 bp, Glycine max
  Peptide Sequence Number=SeqID_165084
atgaccgggaggtgggttttgcaacgagcacgttgttatctgctgggtgagcgggcggtggtactggagctggaaccgccggtttcgctcgtcagccagcagcgcatctggggattgtgccagcggctgcagcagaatgagcagatcgcggaggtgattccgggcatgaataacctgacgctgctgctgcgcgatccgcagctgaaagcgctggatgctatcgagcgtttgcagcgctggtgggaagagagcgaggtgctgctggccgagccgcgtcaggtggaaattccggtggtgtatggcggcgcgggcggaccggatctggcggaggtcgcccgtgcggcggagctgacctcgcaacaggtggtggagctgcacagcagcgcggattacgtggtctatttcattggctttcagccgggtttcccttatctcggtgggcttgatgagcggctgcacacgccgcgtcgcgccgagccccggctggtggtgcctggcggttcggtgggcattggcggcagccagaccggcatctatccgctggccgcgcccggtggctggcagctgattggccacacgccgctcaacctgttcgatccacaacagcagccgccgacgctgttgcgtcccggcgacagcgtccgcttcgtgccacaacgggagggcgatcgcggccgccacggctggcggcaatacggcatcagcctgagcggcgcactggatgagccttcaatgcgcacggccaatatgctggtcggcaatgcggaaaacagcgcggtgctggaaattgtgctcggtcagttcaaagcggagtttcgtcgcgacggctggtttgcgctgaccggtgccagctgcagcgccgaactggatggccagccggtgtggaccggctggcgtctgccggtgaaaaaaggccaggtgctgagtctgtccatgcccacgcgcggtatgcgcagctatctggcggtgaacggcggtttcgccatcgatgcgatgctgggctcacacagcaccgatctcaaagcggcctttggcggctggcaggggcgtaaactgcaggatggcgatcagctgccgctgggcaagccgacgcgccgcttcagccatcaggctggcgtccggcagctgctgtggggcaaccgcatccgcgcgctgccggggccggaatacaacgaatttacccacgacgcgcaggacgcattctggcgtaacccgtggcagctcagcccgcaaagtaaccgcatgggctaccggctgcagggcagtccgctgcagcgcagtgtcgcacgtgaactgctgtcgcacggcctggtgccgggtgtggtgcaggtgccgccgaacggtcagccgattgtgctgatggccgatgcgcaaaccaccggcggctatccgcgtatcgcctgcgtcatcgaagccgatctctatcagctggcgcagattc

SEQ ID NO: 73400 - DNA, 2663 bp, Glycine max
  Peptide Sequence Number=SeqID_165085
gaggcattgatgtatcaggcatatccactcgccaaaattgtgctgcgccgtgtgctggtggtattgattggcgtactggcgctgccagtgatgctgttccgccaggatcgcgcgcgcttctacagttatctgcaccgcatgtggtgcaaaaccagcaccaaaccggtctggctggcgcaatcggaagcggcaggcggtatctactgtggtgcgacaaacgcattgtcccggtgttatctcgcggcatttcagctacacttaaacctctacaagattttggaggttgtacaagtatgagcgagaaaattcctgtaggtatcagtgcctgcctgctcggggatagcgtccgattcgatggcggccacaagcgttttgcctttgcaactgacgagctcgcgccatttgtgcgcttcgaacctgtctgcccggaaatggccatcggtctgccgacgccgcgcccggcgctgcggctggtcaaacagagcgacgatcagatccacctgtgtttcagcaaagacggcggggaagagctgaccgacgacatggcccgctggtctgcggagcgcgtcaaatcgctgcaccatctgtgcggctacatcctgtgtgccaaatcgccgagctgcggactggagcgcgtgcgcgtctacgagcctgacactaacaacaatcgcaaagccggcaccggcgtgttcacctcgttcctgcagaaagagctaccgtggctgccgctggaagaggatggacgcctgcacgatgacgcgatccgcgaaaactttatggggcgcgtctatgcgctgcatgagtttaacgatatgtggcgcagtgggctgacgcgccacaagctgattgccttccacagtcgctacaaactactgctgctgtcgcatgcgcaggatgagtaccgcgagatggggcggtttgtcgcggcgatggaacagtgggagtcactggatgcgtacgcctttgaataccgtaaccgtctgatgcacctgatgtcgcaccaggcgtcgcgccgtaatcacaccaatgtgctgatgcacgtacagggctattttcggccgaagctgagttcaccgcagcgtcaggagctggcgcagctgattgaccgctaccgtcgcggtgtgcagccgttgctggcccccatcaccatgctgaaacattacatggcagagttcccgcacccgtggctggcgcagcagcgttatttcgatccctacccggaagcgctgcgtctgcgctacggccagccgaggtgctggcgctgttcatcgccacgcccggccagtggcagcaacacagcatggcccccaaacaggcggcttttatccatcaaaacctgtgcctgctgcagcagtcgctggcagaacgcggtattcaagctgcactttcatcagtgcgatgacttcgctgcgtcggtcgactatctggcgaccttctgccagcagcacaaggtggatgcgctgttttacaactatcagtatgaaatcaatgagcgtcagcgcgacgctgcggttgagaagcagctcgatcagcagggcgtggtgtgccaggggttcgatgacagcctgctgttaccgccgggcagcgtacagaccggcagcaacagcatgttcaaagtgttcacgccgttcagcaaagcgtttatccggcgtctgcaacaggggctgccagagtgccatcacgcaccgaaagcgcgcgccggggcacccgtggccgccggcaaaaaaatagcggcattcgattatcctgtggaaaaattcgacgaaacctggtttcccgccggagaagaggcggcgctgaagcagctgcgccagtttgcccagcagcgggtggaaaaatatgaccagcagcgcgacataccggcgattgacggcaccagccgcctgtcgccgtatctggcgattggtgtgctgtcgccgcgtcagtgcctgcatcgcattctgaaggagcacccgcaggcgctgaacaacggcagcgcgctggtgtggctgaatgaactggtctggcgcgaattttatcgccacctgatggtggcctttccggcgctgtgtaagcatcagccgtttgtcgactggacgcgcaacgtcagctggcaacagaataagcaacaccttaccgcctggcagcagggcaaaaccggttatccgattgttgacgcagcgatgcgccagctcaatacgctgggctggatgcacaaccggttacgcatgatcaccgccagcttcttggtgaaagatctgctgattgactggcgcgagggtgaacgctatttcatgcagcagctgattgacggcgatctggcggccaataacggtggctggcagtgggccgcgtcgaccggcaccgacgccgcgccttacttccgcatcttcaacccgacgacccagggcgagcgctttgataagcagggcgagtttatccgccggtggctgccggagctgcaagacgtgccggacagcgccatccatcagccgcacgcctgggcggagaaaaataacaagaaactcgattatccggcgccaatcgtggaacataaggcggcacgcggtcacggagccgttatgaacaatttcgagttagaacagatcgtcaatcagcaactcaacaccagtgccttcagcgactatgcgcccaacggtttgcaggttgaggggcgtgagcag

SEQ ID NO: 73401 - DNA, 255 bp, Glycine max
  Peptide Sequence Number=SeqID_165086
atggaaatttatgtgagtgatcgactaggaaaaagtgtgtgtgatgacaaaaagctcaaaggtcaagaacacttcatgataacaaagatgatgatctcaagaatcaaagatgagttcaagattgaatcaagaacacttcaaagttcaaagaggaagtttgatttcaagaatcaagaatcaagtttcaagattcaagttccaagaatcaagatcaagattcaagactcaagaatcaagaatcaaaagaagacttaa

SEQ ID NO: 73402 - DNA, 615 bp, Glycine max
  Peptide Sequence Number=SeqID_165087
atgagaggccctctcaaagagtcaacctcttgctttcttgtaaggttaaagtcctttggtacttgcacctattggctcgccttcagaggactgcatgtcctcaccttcagagggctacacgccctcgccatcagaggactgcatgtcctcaccttcagaggactgcatgtcctcaccttcgtagggctacacgccctcaccttcagaggactgcatgtcctcaccttcagagggctacacgccctcgccatcagaggactgcatgtcctcaccttcagaggactgcatgtcctcaccttcgtagggctacacaccctcgccattagaggactgcatgtcctcaccttcagagggctacacgccctcgccatcagaggactgcatgtcctcaccttcgtagggctacacgccctcaccattggaggactacacgtcctcgccaacagagggctgcacgccctcaccttcagaggactacacgtcctcgccttcagaggactacacgtcctcgccttcaaagggtcatgtaccttcacctttgtagggctacacgctctcaccttcagaggactacatgtcccccattttcaaagagggacatgccttcacctttag

SEQ ID NO: 73403 - DNA, 354 bp, Glycine max
  Peptide Sequence Number=SeqID_165088
atgcccttttgtgggcgagcgaggcgagactcacgggtcgacaaaagcggggctcttgctcttacgtaccctccatcgaagaggaaatcagacctacgtagttcttttgggggtgaatcaagcgattctttttacttggaaggcggtcattttaaggcgttggaccttaaaaatgatcctttttacttgctttcgaaaaagttacggaaactcacagattgcgtaacaatacttccttttgatttccgtcacgttacggaatttcacggattgcgtaacaacgggtgccaagtacttcgaagtggtcaatcaaaggttgcatgccatcaagcaatagtccccggacgaaattag

SEQ ID NO: 73404 - DNA, 276 bp, Glycine max
  Peptide Sequence Number=SeqID_165089
atggtgaaagttggaacctcttacgtgccgatccaacgtctcattttcgccaaaagttggcccagggcttcccggtatcaacagggacaccaggatttatttattctgcgaagtgatcttccgtcacaggtgctccagtggcttctgtttctatcagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 73405 - DNA, 1305 bp, Glycine max
  Peptide Sequence Number=SeqID_165090
atgatgatgcgctctgaagcgatggtggcagatgctgcaatgccaaccgaacaaggtctgctggaatatcacctgtataccctgccacgtgccactacgattgccgaaaaccagaccaagcaagtcgccctgctttctgcacagcatattccagcgcgtaaagagctggtattggcgggtgcagattattactaccaaggccagtaccgcgatatcgagaaaaagcaaaaagtgcaggtatatgttgaatttgaaaacaaggaaagtagcaagctaggcctgccgctgcctaaaggcaccatgcgtgtttataaaaaggatagtgacggcactgcgcaatttgttggtgaagaccagatcgaccatacgcctaaaaacgaaactgttcgccttaagctcggcaacgcgtttgatgtgactgctgagcgcgtacaaactgatttcaagaacctaagcaagcaaaaccaggctcagatttatgaaagtgcttataccctcaccttgcacaacgcaaaaaaagaagcggtgaccgtgaccgttcaggaaccgattaacggtgactggaaaatactgaacgaatcacaaccacacaaaaaaacaaatgctcatcaggccacctggaaaatcaatgtgcctgctgaagacagtgatatccaactgcgcttgaacagaaagcctgcaaacatgagtgctcattgctgtccaccacccacccctcaaccagaacactcaccacaaaaaagctatcgtcgagtgctttggattgccctgatcgttaactttagcatgtttatgatagaggttgcttcaggcttgcacgcaaactctgtttcgctactggctgattcactagacttttttggcgatgccgccaactatggcctgagtctatgggtattaggcatgcatgtatccgtacgtgccagggcttcactggtaaaagccatttccatggggctattcggcttgtgggttcttggcagtgccgtttcccatttcatttcaggtattgtgccctccccagaaaccatgagtgctattggcttgctggcccttctggcaaaccttggggtcgcatggctactgtatgcttatcgtcatggcgacagcaatatgcgtagcgtttggttatgtactcgcaacgacgccataggaaatgtggcagtcatcctggctgcggccggtgtgtttggtacaggatcggcctggccggatttaatggtagccgtcgtgatgtcttgcctggcattgcatgcagcatggcaggtcatagcccaggcaaaaagcgaattacaccgtcattaa

SEQ ID NO: 73406 - DNA, 195 bp, Glycine max
  Peptide Sequence Number=SeqID_165091
atgtacatcaagtatggctcaaaatatatcatgaagcatggccaacaaaacatgttatccaatgaaacaaaaacccccacacttattcccaaaacaattccaaagctccaaaattccttaaggatatgtgagcttcaatacaaggaaagggaaacaaggctcaaatgggctatcaaaggaattaagtcaaggtaa

SEQ ID NO: 73407 - DNA, 1335 bp, Glycine max
  Peptide Sequence Number=SeqID_165092
atgcgcgtccgggacgcaggtcttgcgccgcagcgcgcgctgcgcctgtcactgctggcagtgctggttgcctcgggtgtcgctcaggcggccgatacgcaaaacagtgaggccaccctgaccgttgatgccagcgccagcgcggaagcgcagcagacgcaggccgcagcggactacagcgtaccggtgacgcgggccggcaccaaaatggcgctgaccgcacgtgatattccccagtcggtcaccatcgtcagcaagcagcgcatgcaggatcaacagctgcagtcgctgaacgacgtactgagcaacaccaccggcatccacggtgtggccgctgatatggaccgcatcaattactattcgcgcggtttcctgatcgataattacatgaccgacggcattccgaccgcgtttgcccagcgctggaacctcggtgatgctcagaccgataccgcgctgtacgagcgcgtcgaagtggtgcgcggcgcaacgggcctgctgaccggaccgggcaatccttccgccgccatcaacatggtgcgtaaacatgccgacagcaaagagtttaccggtagccttgaagctggctatggcagctggaataggcaacgttacgtcgccgatctttctgcaccgctgtcaccggaaggcaacgtgcgcggtcgcctggtggccggctatgaagacaaaaacagcttcattgaacgctacggcgccgataagaagtttatctatggcgtggtcgacgctgatgtgacggacgccaccagactgtctgttggttatgaattcagccaggtaaataccgattcaccgatgtggggcggtgcgccgcgctggtacaccgacggcacgcagatccactcccgtcgcggctataacaccgcacctgaatgggcttacaacaacaaagaaaataaaaaggtctttgttaacctgcagcagaatttcgataacggctggaacatcacccttaacggcacgcataacgagatgttcctcgacagcaagcagctgtatctcgacggttacttcgataaaaccactggcgcaggcgtctctggttatgccggctatccggtggtgggcggaaccggctacaacaccggcaaacgtaaggtggatgcggtcgatgccttcgccagcggtccttatgaactgctggggcgccagcatgagctgatggtcggggtgaactacagccgtcaggacaacaaatattacagcgcctgggccaacatttcgtcagccgagctgggcaacttcaaccagtttaacggcgatttcccggaaactgactggaatccgcgtgaacctgcggccgacacccaactg

SEQ ID NO: 73408 - DNA, 249 bp, Glycine max
  Peptide Sequence Number=SeqID_165093
atgccccggcgatatcgtgcccgtgagtacgacgaggacatgtacgaagttgaacgggaccattatcatcgtaaacaccaacatcgaccgcgaggcggacgtcattacaaggaggaagtaatctgtgaacaacctcgagccccgagtcccccaccggtcgaggagtttgatcgtcttcgcattcgagacgatgcaggacctgaattgatccgggaaccccctcgtgagacatcaaaagagctccggaag

SEQ ID NO: 73409 - DNA, 60 bp, Glycine max
  Peptide Sequence Number=SeqID_165094
ttccttatttaggaattgaatcaaatagggcccctttaactcagtggagagaacgccatg

SEQ ID NO: 73410 - DNA, 1449 bp, Glycine max
  Peptide Sequence Number=SeqID_165095
atgccgactgcgatgctggaaagcacaacggctgccatcacgggtgaaaagaacaacgttttacctttgcattttagtgcgcgcggtgtcgatgcgcagcaggcgatgctgaataatgaattacgaaaaataacccggctggaaatggtcctggcgattgtcggcaccatgaaagcgggaaaatcgaccaccattaatgcgattgtgggtaccgaagtgttgcctaaccgcaatcgtcccatgacggcgcttccgacgttgattcgccatacgccgggtcagaaggagccggtgctgcatttctcacacgcctcgcccatcgatgaactgatccaactgctgcagaaaaagcttggcgattacgatcgcgcgaagctggcccagcgtctggaaattgataaagacatgaatacgctgctggcgcgtattgaaaaaggggaagcctttgagaagcatcacctgggggcacagccgatcttccattgtctgaagagccttaacgatctggtgaggctctcccaggcgttaggggtcgaatttccgttctctgaatatgcggctatcgaacatatcccggtgattgaagtggagttcgtgcatctcgcggggctggatgcacatctcgggcaactgacgctgctcgacacgcccgggcctaatgaggccggacaaccgcatctgcaaaaaatgctcagcgaacagttgtcccgcgcgtcggcggtgctggcggtgatggattatacccagcttaaatccatatcagatgaagaggtccgtcaggcgatttccgcggcgggtaaatccgtgccgctgtatgcgctggtcaataaattcgatcagaaagatcgtaacagcgacgatgaagaacaggtccgggcgatgatctccggtaccttaatgaaaggcaatatttcgcccggccagatctaccccgtttcgtccatgtgggcgtatctggcgaaccgcgctcgctacgagatgaatacgcacgggcaactgccggatcatcaggagcaaccgtgggtgcaggattttgccgaagcggcgctgggacgtcgctggcgcacggcggacctggacgatattgaccatgttcgtcattctgccgatttgctctgggaagattcgctctttgaacaaccgatccgcaagctgatttacgccgcctatgctaatgcctcgctattcgctctgcgttcggcctcgcataagttgctcaactacgcccaaaatgcccgggagtatctcgacttccgctatcaggggctgacggtagcctttgaggcgctggaactcaatatcgcacgcctggaagaggacatggcgcttctgcagacccgtcagcgcgtggtgagcgatgaggtgaaacatgaggttgagcaggcgctaaacgctaccgcggactttatggtgtcacaaaaaacggcgctgtatcacgcgatgggtgat

SEQ ID NO: 73411 - DNA, 275 bp, Glycine max
  Peptide Sequence Number=SeqID_165096
atgccgaagccacggactgagaagcaggttcgaggtttcttgggaaggattaaatggtgtttgatgaatcctcctgtgctcgtgccaccggtgcccggaagacctcttatcatatacatgagagtattagatgagtcgatgggctcaccgtttgaggtagtatatgctgagtgtcgcaacctacccttcggcgggagggtgacgcatgactcgcgggtgcgtgttccaaggaaggaatacgcgcgagttgccaccaacgtttatttgaggaaaac

SEQ ID NO: 73412 - DNA, 405 bp, Glycine max
  Peptide Sequence Number=SeqID_165097
atgggtaacctagaggaagtacaggaacagatgaaagtcaacatgtcgattttgaaagaacaaatggcttctatgatggaagccatgttgggaatgaagcgactaatggagagtaacgtggccaccgccaccactactagcatggctgccgaggcagacccggctctctcgactgttgcgcaacatcccgttccaaacattgtgggacgagggagaagcacactgggccatgtcaacaatccccatctggggtacaaccgaggtgcttacctctacggtttaccacccaactacacaccactagccatgcatgaagacgcgggtcacgttactcccttcatcctcgaaggggagcctcctcagcatcctgatggggtccacgaggatcctcaagagcacacttag

SEQ ID NO: 73413 - DNA, 54 bp, Glycine max
  Peptide Sequence Number=SeqID_165098
atggcggtaattagaggaaatagcgtggtcactattgaggtgcttcaaatttaa

SEQ ID NO: 73414 - DNA, 549 bp, Glycine max
  Peptide Sequence Number=SeqID_165099
atggggacatggggttgcatcagttacaatctcgttcttgctataaagcaacttggctaccctatgagaggggcaccactagaagaagagctcgcgcctgtcatttcacgaggtttcaataagaccaacatggagatacttcagaaaatccacaaggcatgggaggtagtgcgaaagaaggacaaagaactcatgggcaataacaatgggcccatcggtggctactttgaggcaccagaggaagacgaagaggtgcaggcccttagggcagaactcgaacaagcccaaacagtcaaagaaaggttcaaattagcagctcttaagatccgaaaggagaacgccaaactaagagatataaatacggctaccaccaaggccttggaacaagagaccaaaagggctcgtagggaagagcacggccggaacaagtttcgaggggctctgtgggacagcaacagtgagcttaagctccggagagaggaaagggaccaatcacgagtagacagtttgatcttgaaagataagttgaaggtttgctcaaggtcctaa

SEQ ID NO: 73415 - DNA, 408 bp, Glycine max
  Peptide Sequence Number=SeqID_165100
atggattcatcttcatctactgaaaataaaaagcttgagggaaaacttgatgccttggtcaacctagtaactcagcctgccatgaatcagaaatatacacttgttgcaagagtctatggtctatgttcttctgcagatcaccatatagatctttttccttctttgcaggaatctggagtcaatgagcaacctaaagcttatgctgcaaacatttataatagaccccctcaacatcaaaaccaacaacagcagaataattatgatctttcaagcaacagatacaatccaggttggaggaatcatccaaatttgagatggacaagtcctccacaacaacaacagcctgtccctcccttccagaatgttgctggtccaagcaagccatatgttccgcctccaatgcagtaa

SEQ ID NO: 73416 - DNA, 666 bp, Glycine max
  Peptide Sequence Number=SeqID_165101
atgtctttaaaattgccacattatcctgaacttgttaaggtcttctactacaatttaaaaattcaggatgacattatttcctctgaggtgcatagtattccaatgatcattgatcaatcattgttcttttctttgactcacttacccagtcaaggtgcacattttgagggcaccattgttgatgattggaaatttgattattctagtcatgatgctcgccgtatggtttgcaatgaccaggctgaaatgaccggtagattgttggccggatcattgacatttgataatcgcatcatgcactatataatcgttagaattttgcttccccggtcttcaaatttggctcaagcctttgaggaggacttgattttgatgtgggctttccttatcggtcgacagatcgactgggctcacttggttcgataccgaatgcataaggcattacgggccaatgcacctctcccttaccctcaattgataactctgtttttgcgtcattttcaaattccgcttgatgatgaaccatttgttcaagtcaagcgttcctttgctattgatgctggtgcagtgacttcttttggataccgtaaggatcgaaatgttcaatggctaaagaaagatgcacttcctcctcaagatgagcgtactccttctcctcctccttag

SEQ ID NO: 73417 - DNA, 309 bp, Glycine max
  Peptide Sequence Number=SeqID_165102
atgccttttgttaaagtcaagagatctttctctatcggtgcgaatgtggtctcctcttttggataccgcaaagagagggatggttcttgggtaaagaaggacgctcccgcacaggccgcagaagacccctctccatcaccacctcctcagagagatgattcttcacctcttatgcagcgcattcttgacagactggatggactccacactttcgtcggtgagtgttttgacgcattggaaagccacattgacgccattgattcacggtttgtaggaatggatacccgcatcactcagcttgaggaggat

SEQ ID NO: 73418 - DNA, 312 bp, Glycine max
  Peptide Sequence Number=SeqID_165103
atgtggaccaccacgggggagaagcttgccgcccagctcgcccaggcgagcaaggttgcttcctccagaagcaaaagccttctggaggaatcttctggagggcccaagtgggcctgctttcgaagaagttacggaaactcacggattgcacaacaacacctccttttggtttccgccacattaccgaatttcacggatcgcgtaaccctgcttccttttgacttccggcgcgtctcgagacttacatattgtgcaacaaagggtgccaagtatcttgaaacagccaatcaaaggttgcatgtcatcaagtaa

SEQ ID NO: 73419 - DNA, 247 bp, Glycine max
  Peptide Sequence Number=SeqID_165104
gtcgactctagaggatcccacatcaaaggcttctgctaggtggattgtcgtcaagtgtaatagacaaaaaggaagtactgagtgcgactactatgtgatgcgctggatgtccaccatcattttaggaacttttaggaataattgggaagcgtattttaatgatcctagaccattggagctaaagagattaaaggcattgcggatccaatgggcacggttttatctccgagttggagatcaggcctag

SEQ ID NO: 73420 - DNA, 372 bp, Glycine max
  Peptide Sequence Number=SeqID_165105
atggagagaagtatgattgatgttaccagtagtggagccattggagacatgacccctgttgaagccagaaatttaattgagaagatggcttcaaactcccagcaatttagtgccagaaatgatgccattgtcattagaggagtgcatgaagtagccacgaattcatcttcatcagatgagactaagaagcttgaaggtaaactagatgtcttggttaatctggtaacccaactggctatgaataaaaaatctgcacctatcgccagactctgtggtttatgctcctctgccgactaccacacagacctttgcccttctgtgcaacaatctgaagcaattgaacagcctggagcttatgatgcaaacatctaa

SEQ ID NO: 73421 - DNA, 618 bp, Glycine max
  Peptide Sequence Number=SeqID_165106
atgacatcaaaaacccaaacctcattttccataaaatctcaaaaacaaaataaccaaaaaatatataataattcatttaaaaagaaaacaaaacaatttctgtttaaaaaaaaacacacactttccggaagaagtggttcttctggaacaattccggaagaaccacttcttccggaaatttcttccgaaaatttgaaaggtcatccggaagaggtgttccgggagacttccggaagaagtgttcttccggaagacgtttggttacttccggaagaacacttcttccagaaactttccggaacaggttcttccggaactttcggaacaacccctagcgggtcttccagaagcctccgctgtgagccattttccccattttttttggtgtctcctgctctcgtcttctaccctaagtgcataataaaagcaaagggaaggttagggacacctacctcgaacagaaatggcgtccaaccgaaagaagcagcagttgggctcacggtggaggagaaggctcgcggaagagggaagaaaaggaagaaaagcagaagcaagaagaagaggctgagtgattccgggagaggagagggaaagctttttaaatgtcagcaaaactga

SEQ ID NO: 73422 - DNA, 160 bp, Glycine max
  Peptide Sequence Number=SeqID_165107
cacaagacatgtgaggatatacatggagaaaaatgaagaaacaataatggagaaggtaaagctgaagataaatggaggttcaatgagcacctacttgaagctcttatgctctgattaccacttgatggaagcttgcttgagaagcttctatggagactag

SEQ ID NO: 73423 - DNA, 264 bp, Glycine max
  Peptide Sequence Number=SeqID_165108
atggcgaggacgtgtagtcctctgaaggcgaggatgtgtagtcctctgaaggcgagggcgtgcagccctctgaaggtcgtgcggacgagggcgcacactacctacttacgtctaaccataagtgacctcagtcacgtggctccgcttcctcccaagaaaccgagcaagtcagtcatatcttcatccatacagactcctcccctgcctgggcctcgggctagtcttcgggccatgcgacctcagccccaaattgctccggagtag

SEQ ID NO: 73424 - DNA, 717 bp, Glycine max
  Peptide Sequence Number=SeqID_165109
atggggatgagggactgcattaattataaccctatgttggccataagacagttaggatatcctatgagaggtgcgccatcagaggaaaccatcacacctttcatctcacgagggttcaacgaaactaatacaaagaaacttcagaagatccataaggcatggaataaagtgggaagaaaagataaagaacttagaggaagaagcaatggtgtcataggcggctatcacaaatggttaaaatctagaatgcaagggatagcttggctcaaaaagctaaaggatctgaatggggaagaggcaaaagtgcttgaggagagtgaaaaggtgcaagccttgaaggctgagctcgaaaagacaaaagtagcaaaagagaagctgaaggtggtagtcactagagttaggaaagaatatgataagctaaaggatatcaacatgaccacgactgaggcgctagactgggaaatgaagaaagccagaaaggaggagtggagcagaaacaagtttcgaggcgctttgttaggcagcagtaacgagctcaaacttagaaaggccgagagagacaaatcaaggatggagaacatgatgttagaggataagttgaggaattttcagaggtcaaagggatgcgaaggtgtcggtcttgcggagagtcaagagcttccgaggctgttagccagagccaagacggtggctaacacatactctactctcgatgaa

SEQ ID NO: 73425 - DNA, 597 bp, Glycine max
  Peptide Sequence Number=SeqID_165110
atgggtgaagtagaggaggtgcaagagcagatgaaggccgacatggaggccatgaaagagcaaatgaccacaatgatggaggccatgatgagcataaagaagataatggaagccaatgcggttgcagttgtcgttaccagcattgttgctaaggtgaacctaacgcccccatctggcctcaaccaaatgaatcatccaacctcagatatgcacgccttcccgccatatggcttgcctcccaactatactccacccaatgtggcgtacactcccagtgagaatgttaataactccactcccatactcattgagagccaacaacctcaatctgatcatgcacatgtctctcaacctatgggggagacacatgaaattccccaccacaatttagccgaattggagccttgcctcggatatgccactgaagggcaagccgttggtggtatacccctgcaaaacactttggaggggccctcaatttcgcccctaaccataacccttctatgggaaaataatgggttacacaccttcaagctttacggatttggtcttcgccggcgaaatgatcaaagtgggtctggaaagaggcaaatctga

SEQ ID NO: 73426 - DNA, 618 bp, Glycine max
  Peptide Sequence Number=SeqID_165111
atgagacaatttggactgcaacaaattattccagatgacccaccaaacctagatcaactccacgacaaagatatgggagggagagcaaatattttttggcctcaccatcatcgtcattggattgtcaaatggaatcattggaatgattatattattcatggtgaaatggatcaaggcttttctggtcacgcgtctcaaggatgtcaacaaaattttcaaccagtatggttatcatcatatatgcctcaatactcatttcaggtcccttttacctcaaatgtttttgatgacctctcgcaaatgtttcccaccactttgaacactacaccatctgcatataatctaacaccatcgacttcttgttatcgttcatcattatctactcaaatgcgtgacatgggtcataaagatgaggaagatgatgatgatgataacaacaataacaacgatgatgatgatgatgatgataacaacaataacaacgatgatgatgatgatgacaacggtgatgatcacgtccctcaacaacaacacataattacacgtgaacatcctagaacaagaggaggtagaggtcgtagaccaagagaacaacaaacacagacaaatccagtctaa

SEQ ID NO: 73427 - DNA, 177 bp, Glycine max
  Peptide Sequence Number=SeqID_165112
atggctggagtttggacttctttatacatatgcatgggcagggttctacctataggttgttttaccattgtcagaagtatatggttatttctagaacagcggattgctgtaagggaagatgctaaagcaaatttggcagctgctttgacattctgttgtatggtctataattgttaa

SEQ ID NO: 73428 - DNA, 81 bp, Glycine max
  Peptide Sequence Number=SeqID_165113
atggacccgggaaggttccagattagtataccaagtgacgatttccccattttatcatttgcgcctattggactaatatga

SEQ ID NO: 73429 - DNA, 288 bp, Glycine max
  Peptide Sequence Number=SeqID_165114
atggtgcgtggttcacactcgacgcgttctatggaatttcgactggcccagggcaccgttactcttttttcgaatttcactcctcaaagagaggaatgtgtgacggattctgtggagagtctgggtttcagaggtgtggatgagagttttggagatacaactcactggttcgtttttcattcccaaaccccacctcatgcacaaatcaacactccttcttgttggacgccaatccaagttgagaggaggattgagttcaatgagcattggaaagtaggatttgactaa

SEQ ID NO: 73430 - DNA, 219 bp, Glycine max
  Peptide Sequence Number=SeqID_165115
atgaggctaagtcatcaagtgctaaaagtgacagttgagcttagctcattaggtaacaacaacaacaagaagaaggccagggtacaaaattccatagcacaccacagtgcctatttcgagaaaagagctttggaggcaacaagaggagcagcttttgcagagagacttaggttttgtaagcttattattcttagggtttcatctgtaatggctggctaa

SEQ ID NO: 73431 - DNA, 1113 bp, Glycine max
  Peptide Sequence Number=SeqID_165116
gcctacaagctccaatggagcttacatcagatggcatctaagaagaggaaaacaccctctacacctactcaaaccaaatttgatagatccagattcacatcccaagaggcttgggagagatacactgacatagtgttgccacgaaagctactaccagagaggaatgtggtaatctattatacagagtttgacgagttcaaggaggaactcgagagacgccattgggatgagaagctgactgatttttctaacaacaatatagacatcgccattgtgaaggagttttatgccaacctctatgaccccgaagagttggctgctaagctttgtatccctgggaggggattcgagcttaatgctgatgggcagcctttgaagattctgaggaagaacatgaatactctagctcagacatggagcgttctttccttttctaacctcattcccacctcccacacctctgatatcacattagatagggcagccttaatcactgctctttacaaagccaggggagtcatttctgattctttgacattggagagcctcgatccagctattaatgtggcttatgtgaagaaaaactgctggaacctagatgacctctcagttactttcagagggccgcgcaaggccaatgggaagaggtttgaggctcccccatcttctgaggttcccccttcctcagctccagcacctattccatctgtcccatttgcatccacatctgtttttccagctcctttatctgcaggaccatcagaatttatatttacacctcaaatgagcccagccttctcctctggagggggtggggcctccgcagcccaggagcctgcttctgaggagccaacagtagtagcaacagagggggaggatgagctcacccctcccgagccttcttattttgatgcaggtatacacatggctaaggaggaggatgcttctacagaccagatcccagagccatccccaacacccatacctgatgatgccacaccatttgcactagcaccagacttagagcaacctatctctcaggattcaccaactgctcaggtgttggaccttaatgatgcacaggagcaaccacaggatgagcaggacatttaa

SEQ ID NO: 73432 - DNA, 177 bp, Glycine max
  Peptide Sequence Number=SeqID_165117
atgtgtttccgtgaagaaattccaagccgaggtgcttccgtaacacttctgagacgttttcgtgagcaaattcgtgaacattttccgttcttcatccgttcttcggtcttcaaccggagcaaaaaccccgcttttgtcggccaccctcaagagatcattaatggtccaatgccttaa

SEQ ID NO: 73433 - DNA, 465 bp, Glycine max
  Peptide Sequence Number=SeqID_165118
atgtggaagcaaagcttccaagcttattttgatgataccaaagactcaagtcaagaatcaagattcaagcaagtttcaagaaatcaaagagtcattcaatcaagaatcaagattcaagagaagactcaagatatgcaagaacttcaagaaaagcatcaagataaggaaagggaagaatcaaaagaattctcaaactgtgtcgttttgaattctttgacaagggagaagggagacacaaaagaattcaggtggttagtccttcattcttttggaaaagggagaagagagacacaaaaagaattcaagcggttagtccttggtgaattctttttggcaaagggagaagagaatgaaaagatgaatagcacaagttttcaaggttttgaaaaccagaaaacttcagaaagcttttggtacaaagaagaagaagaagttcaaagagatttagggcttgtaaaagattga

SEQ ID NO: 73434 - DNA, 270 bp, Glycine max
  Peptide Sequence Number=SeqID_165119
atgtatcatggaattgttacaaccttagccgatgttcatcatgttccagagcttaagaaaaatctagtctctgtgggtgtcatggattcaaaaggtttttcttcttgggttgatggtggagttatgcaaattagaggaaaagagaagttgtgcacactacaaaggccatattggactacatccattctgaatgctaggggccttcgagagtttcatcattgggaaggacaaggtacttcctctccatcatcgatgattactcaaggatga

SEQ ID NO: 73435 - DNA, 147 bp, Glycine max
  Peptide Sequence Number=SeqID_165120
atgacacttaaaggagaagatgagtcaagaataagctcaccaccatatgaagccatggataagagcttgaaggtagaagaacatgagtggaggcagaagcccactaatccaagatcaagtccaagattctccactaagtgtgcttag

SEQ ID NO: 73436 - DNA, 255 bp, Glycine max
  Peptide Sequence Number=SeqID_165121
atggatgcctcagagccctacacagaggcaatgagagccaccatcctcaaaaaccctgagtgggaaccactgctaaaccaacgggaagagcaatgcaaacaacgcatgcatgagggagaactgccaggaaaccacattacaagcgaaacctcaaagagagttgggcttcgtcctcaaaaggaaacaacaccagaaaatctagccttccatggattcaaacagaaaacgcaattgaaacatgaagcagaaacgtaa

SEQ ID NO: 73437 - DNA, 426 bp, Glycine max
  Peptide Sequence Number=SeqID_165122
atggcctcaagaaagagagcaagagctgaagacatcccttcatcatccaacccacctccttcgatagcaaccatggaaccagatgcccaacaagcaccacccataattcctatgttgcagagcttattcaggaggcagctggtggcctggcttgaagcccagtttcctttaggaagagcccctgaggttgttcctcccagtcctataccaacaaggacagagcctgcactagctgagtcgcaacctccagtagtaaacccacttgcttctccggaggttgagatactatctcctccaccagctccaccggcaccacctttgatactcattcctgatgactcagatgctgaagttgttgctcctcctgactcaccaacccactacctagaggatggttcagacttttctgattggatggactattga

SEQ ID NO: 73438 - DNA, 597 bp, Glycine max
  Peptide Sequence Number=SeqID_165123
atgcaacaggcctttagaagaactgcaactcagattagtaagttggtggatgacatggctaaccctgcggtcagacaacaggaagagcgtgcagagattgaaacgcaccaagaaagcatttttaaagttacctcaatccatcatcagatgaccactgaagagaaaacgtctgaagtctccagtactccagaatattcatgcccagccattgctagctatgttggaggaacagagaaaggtagattggaactcagtgtggaggatcaaaaagtctcttttgacctctttgaggccatgaaacactcagatatgggtgatgcttgttctgatacaacagtgatacaacagtttcctttggaaaaagaattgggtgatgagatagacaacttagtcgataatgaagagtgtgatgatccgaaagacaattgtgttgatcatgtggtttctgaagaattggagaaaatgagaccaccagaaaatcccaaagcagaattaaaaacccttccagcacatctaaagtatgtattcttggaagatgacgagactaaaccggtcataattagtaactctttgaagaaggaagaagaggatcaacag

SEQ ID NO: 73439 - DNA, 330 bp, Glycine max
  Peptide Sequence Number=SeqID_165124
atgactaggggcaatctaggtgatttacaatcctttgatcctaaaatagatagaacctttcatagattagttaggcatagtgtgcatcctgatcattttgtgcattttgagcattgtgagcattttgagcattctgaatattttgttgctggtgattctgaatattctgattttgagcattcaactactaattttcatactgagaacatggctcaacctccacctcgtagaggactcttagggagatggttgcacctagtttcacttatgaaagcttgtgcattcaatatcctgatgagggtgttccatatattctcaagactggactaa

SEQ ID NO: 73440 - DNA, 333 bp, Glycine max
  Peptide Sequence Number=SeqID_165125
atggcattagaagaaggggaggtgaagatcgagaagttcgatggcagagattttagcttttggaagatgcagatagaggattatctatatcaaaaaaagcgttatcagatattgtcgcaacctacccttttgcgggcgagcaaggcgaggctcacgggtgcgctttccaaaggagcaaaatgcgcagagtcgccaccaacgtttatttgtggaaaacgtcagaaaaaccgaaggaaaccggtcataaagaatattccagattcgggagttgtatttacgtttgaggaaggtattagcacctctcacgtttgtcccaaaggacaacagccttaa

SEQ ID NO: 73441 - DNA, 441 bp, Glycine max
  Peptide Sequence Number=SeqID_165126
atggaagtgagggacaaggttgaactccttctatatagagacctagatgagctaaaaagccttcttcaaaatcttatggctttcactcttatccaaggaattttgggggctgcaccttcaaaacctaaggaagataagggtaagaccatagagaaatccacccgaaagactagttcccaagcaaggactagcaatattaaatcttcaaatgtcttgggagaggagcctacttctttcccttcctttagtggaagtgaagatgaagtaaggggtgaagagtctagtgaggaagtctaccctcatgaagaaggtgacctcctaatgcaaggagaaatgatagttaaccaacaagtgaaggtaccttcctccattgggacatataaggatgaagttaattgtgatatagttcccatggaggcagggcatattctcttaggatga

SEQ ID NO: 73442 - DNA, 429 bp, Glycine max
  Peptide Sequence Number=SeqID_165127
atggcaagcaaagatggctcatggcagtcaccgggggtcaatggtagtggaggaggagctctagcttttcatctcaaggaggtgagcttagctattagagagctaatctctagattctttaggaatcttcttaaggaatcttctcaaggaggtgagcttagttatgagagggcatcctcttcaagcttcttatccaaggcaattcttggtggtgaagctcattcttccttgtcttattccctagtggatggtgcctcccatctcctcttctcctttgccttccgctgcatctccatggatagatttcgggcccatggtgatgcaatcctccctaggaagggactagttaccagagtcatgagcaagaggctccaagaggattgggctagtgctactaaaggaggccctagggttctcatgaatatcagg

SEQ ID NO: 73443 - DNA, 162 bp, Glycine max
  Peptide Sequence Number=SeqID_165128
atgtggaccaccacaggggaggagcttgccacccagctcgcccaggccacccagctcgcccaggcgagcaaggttgcttcctccagaagcaacagccttctggaggaagaatctggaaggcccaagtgggccagattgctattcgtaccctttttttactaa

SEQ ID NO: 73444 - DNA, 367 bp, Glycine max
  Peptide Sequence Number=SeqID_165129
atgactagaggtaatccatctgacttacaaccctttgatcttgagatagataggacatttcatagattagttaggcatcattttataccttttgagcatcctgagcattctgttactggtgagtttgtgcattctgttattggtgattttgaacatcctgattttgagcattataattttgaacattctgattttgaacattctgagaacatggcaaaacctccaccccgtgagagaactctaagggaaatggctgcaactgatttcacttatgaatgcttgtgcattcaataccctgatgaggatgtcccatatgttcttaaaactggattgatccacttgttacccaagtttcatggtctagcag

SEQ ID NO: 73445 - DNA, 360 bp, Glycine max
  Peptide Sequence Number=SeqID_165130
atgaggcttcactgttatcaagcgagtcggagacctagcatgaccacaaatcaacctccactccctatgtctcacacagacctgggtatagggcctagtacctcaatgcgtgtgcaaaggtcttgccgaggtgagctaaggcttagtcctgaagtcaccagctcgcccaggcgagctggttccttaaccctaaagttgtgtggtagcctaggcgagccagaggctagcctggacaagctagagtccaggaaactcaaggaaaggacgcttttgtcccccttttttggtatctttcacattcttgatcaaaccattgaacgatctttcgttttgcacggtaactggtgtcaaacaacgtag

SEQ ID NO: 73446 - DNA, 144 bp, Glycine max
  Peptide Sequence Number=SeqID_165131
atgggctcaaaaatctaccctaaagttaatgagaaccctaaggccttctttatcagctctagcccaatcctcttggagccttttgctcatggctctggcttcttggtatggaaagctaaatcctctgttggatcttccctgtag

SEQ ID NO: 73447 - DNA, 774 bp, Glycine max
  Peptide Sequence Number=SeqID_165132
atgaccgagtactaccccttgggccgaaggctctccgctgttcctctttcttcttcacttcgctcgagtggtgcgatcccaaggcggctttatgaccttggaccatgggactttgtgcttgggttaccatctaggtcgggtacctcttcagtggggatggttctggggttctcatttgaactgaatacctatccgtacactacaaagtcggcatattcaatgttgtctcagttagggggagtagaagaaccagtggagagcttcaagttactgtggatattaaaagttccaaacaaggcaaagcttcttatttggagagcactcaagtatcgtcttccgactattgacaatctggtggagaggaatggtgagttatctagttttgttggagtgcttttcttgaaagtctctaaatttacctctcgtgttgccaacctcggtgaaagctcttctatggctacattcagtggtcttcaaatacaacatcttgtcttcaaggatggttgggataaggaaatacatttctttgggtttgatatgtatgttgggataggaaggccttcacacggcgtgatattgatgaagggaggtgtgaaaaggatccaccacagcctcagatctctatgggaagaatgtatgcctaagtgtgatgtagctccatgtggagcttgtaggccttggatcttcttcatcaatggattcctttgcttcttgaggtctaattgcagcggaatggagaaggagaaagatgaatggagacgccacttcaagtag

SEQ ID NO: 73448 - DNA, 424 bp, Glycine max
  Peptide Sequence Number=SeqID_165133
atgcctaaatatgaccctgaagttgtcatggaattttatgcaaatgcctggccaactgaagaaggagttatggataagcgctctaaagtgcgaggccaatggattccttatgacacagatgccatcaaccaatttttagggaatccattgatcttagaggagggacaacaatgtgaatacactaagagaagaagtcaatttacaggttttaatgaagaggctataggtcaactactttgcttcccaggacatgattttgtatggagcatagcagggaagcgattcattatggcacagatcaatgttcatgtggcccaactcatttcagatgctatccatcagtttgttggtactgaacctcctaggcacccagtggacccaaaaaagtccaacaaggcactaggatttcctgagttaatcatag

SEQ ID NO: 73449 - DNA, 225 bp, Glycine max
  Peptide Sequence Number=SeqID_165134
atgacaaaggaagtgatccacggtcacaactctgcaatgcctcgactccacttttcttcttcctcttcttcttcttcttctatgtgtttctctactagtttcaggctgctgcggaaactcgcccaagcgagctgcttgcttagggctaaagattcgtcagcttcaaccctaaccaagttggtcatggtgcaacaaacaagattggctcctgaggataccacgtag

SEQ ID NO: 73450 - DNA, 312 bp, Glycine max
  Peptide Sequence Number=SeqID_165135
atggaggtcaagacagctacagtcattgccacaagtaccgccactaaggtggacccaactcacccatctggcctcaatcaagtaaatcttccagtcttggatatggtagggcagggaggcaaagcgttaggaagtaccggtggccctcattttgtgcaagttcagaacaagaattccttcccaccatatggcttgcctcccaactatacaccacccgatgttgcacacgctcccgatgagaatgtcaataacttcactcccatacacattgagagccaacaaccccaatctgatcatgtacatgtctcttaa

SEQ ID NO: 73451 - DNA, 570 bp, Glycine max
  Peptide Sequence Number=SeqID_165136
atgattatgaagggtcaagacatttatagtagtcaagaggagactacttcttccccttcctcaagtggaagtgaagatgaagtaaggggtgaaaagtctagtgagaaagtctaccctcatgaagaaggtgacctcctaatgtgcaaagaaaggaaccattcactgtttcgattaggaaagcaaaaaataccaaaaaataagggcaaaagggtcttttcattgagtttcctggaccctagctcgcccaggctagcctatggctcgtctgggcccccaaattacttcagggttaaggaactagctcgcctaggcaagccagttacttcaggagtaagcatcagctcgcctgggcgagctgccattgccccaagtgcctattttcctataaataggcatgctaaggaggctgagagggggttccagcattcagtagtgaaggaaattgagagaattaggagagaagaagaagaaatgaagctggggcgctaccaaattgtgattgtgatcaatccctacttcgtttcttgttcggtgttctttgtgcgaccgtcggttagttttatcttttaa

SEQ ID NO: 73452 - DNA, 327 bp, Glycine max
  Peptide Sequence Number=SeqID_165137
atgagggttcactgttatcaagcaagtcggagacctagcatgaccacagattcacctccactccttatgttcccacggacccggaaagacaaagaaaaagaacaaaagggaagtcatggtaaggaaagcacattgattgatttgcctaactctctaacaaaggtcccaagtgcagtcgccaactgtcacaacctacccttcggcgggagggcgacgcgagggatcacgggtgcgtcttccaagaaaggaaaatgcacggagtcgccaccaacgtttattcgaggaaaacgtcagaaaaaccggaaaggtgtgctctacgaactttaa

SEQ ID NO: 73453 - DNA, 255 bp, Glycine max
  Peptide Sequence Number=SeqID_165138
atgcacgagacatcagggtttagcagtccaggagacatcatagaacatagaaacattgttagatctcttgcaggagaggccaaaaggtggcttcattcatttaagggaaacaatatgaagacgtgggaggaagtggttgaaaagtttctaaaaaaatacttccccgagtcaaagactacagaagggaaggctgctatctcatcattccaccaattcccggatgaatccctgagtgaagcattggagagattttga

SEQ ID NO: 73454 - DNA, 243 bp, Glycine max
  Peptide Sequence Number=SeqID_165139
atggcgagtccgatgacatgcgggggggcaagcgagcccattgacacgcagagacttacgtcatcttctgcacctttgtcatccacaggcggcgagtccgatgacatgcagggttaccttatggttatccgcaccttttgtcgaccagaggcaagtgagcccattgacacgcagagactaacgtcgtcatctgcaccttttgtcaaccaaaggcaagcgagcccattaacacgcagagactaa

SEQ ID NO: 73455 - DNA, 276 bp, Glycine max
  misc_feature (263)..(263): n is a, c, g, or t
  Peptide Sequence Number=SeqID_165140
atgttcagcccctttggcacttctctctctttcgaatttgcttggaaaaatcgtttccgtgaagaaaatctaagccgaggcgcttccgaaaacgcttccgtaagcgattctgtggaaattcttcatcgttcttcaccgttcttcatccgttcttcgttcgttcttcgttcttcaacgggtctgatttcctcatcgcaattgaggatatgtaggagcaaaagccccgcttttgtcgaccaccctcaagagatcgttaatgtccnggggatcctctag

SEQ ID NO: 73456 - DNA, 369 bp, Glycine max
  Peptide Sequence Number=SeqID_165141
acttatcaaggtaacccttgtggcgtctgtccagacttatcttccttcaccggaagtggcgtctaccctgacttatcttccttcaccggaagtggcgtctacccagacttatcttccttcaccggaagtggcgtctaccctgacttatcttccttcaccggaagtggcgtcatccaaaacctccgtagcctgtatcaaacgatccgccccgtaaggttcacatcatattcacctatattgttcgaaaaaaatgatagtcggcgtcggccaggaaagaggaccgatcgaggtctaaaaaagaagcttcacaggatgatgccgttcgaacatttcccaatcgacatcatccaattgttattcagggattga

SEQ ID NO: 73457 - DNA, 499 bp, Glycine max
  Peptide Sequence Number=SeqID_165142
atgacacatcagcaagggaattttgaagcatgggtacaggttccttacatctacgttgagaaggaacagagtcaagaggagaagaaattactgcaagacaggacagtagcatccattcttgaggaagaaactcatttttctgattcttcatcatccgaatcaccatcatcaagggaatccacgacttatttaccagaaaccgtttccatggctaatgagcaccagcaaagagttacccgtaaggactattcaagcaattcagtgccgcaattctttaccagcattgcacgtcctgaagtgcaagttcacaacataaactaccctcattctttgattcatttaatacaggggaacttattccaaggattaccaaatgaggacccctatgcacatttggcgactttcattgaaatctataacactgtaaagatgcatgcgtgccagatgaagccattagactcagtctattttcactttccttggcaggagaagccaagag

SEQ ID NO: 73458 - DNA, 207 bp, Glycine max
  Peptide Sequence Number=SeqID_165143
atgggtggtggtgcatggccgttcttagttggtggagcgatttgtctggttaattccgttaacgaacgagacctcagcctgctaaatagctatgtggagaatcccgtgaaccatcgagtctttgaacgcaagttgcgcccgaagccattaggccgagggcacgcctgcctgggtgtcacacatcgtttccccaacgcaaacatgtaa

SEQ ID NO: 73459 - DNA, 138 bp, Glycine max
  Peptide Sequence Number=SeqID_165144
atgccctcctttcgcgatttggagcagaaatgggcaccaaaggttgaagctttgttgggcaacaatggtggaggaagaaaagagaaagctattttctcacgtttctctgcgtccgtcggggccagttttcgaaagtaa

SEQ ID NO: 73460 - DNA, 351 bp, Glycine max
  Peptide Sequence Number=SeqID_165145
atggactgcgagccgtatgagatcaggaaattctcaagtacggttctaggaaaggaattgactcacctgattccgaccgaggagaacagctcatctgacagggagacaatgcggaagttgcggagtctgtttacaacggaatattatgaggctatgcgactggaaacaagcttgataccctatgaccgaagttatatactttataacataggccttatccacacaagtaacggagaacatactaaagctttggaatattattttcgggcgctcgagcgaaacccattcttaccccaagcttttaataatatggccgtgatctgtcattacgtgcgactatctccactatag

SEQ ID NO: 73461 - DNA, 234 bp, Glycine max
  Peptide Sequence Number=SeqID_165146
atgccgatctccccctgtggaagtatcagttggatcgcgcccacaagacacccagtggtcccggagaagtctaacagggccctggggtttctagctctggttacgggcctttgtcagtcctatagggtgcccgtccccccagcaaggtcacgccatcatgacatagaatcgcgcccgcaagacacccaatggacccggagaagtccaacaggatcctggggttttcagctttga

SEQ ID NO: 73462 - DNA, 726 bp, Glycine max
  Peptide Sequence Number=SeqID_165147
atgccgcgtctgaaaggcagcgcggtgcagggcagtttcaccctgattgagagcaaaaacggctggcgcggttttatcgatttcagcggcaaggcgcgacgccaggtcagcgacattcgctggctatcaccgacgcagctgaccttcagcgtcgacagctggatggggccgtttcagccggtggtgacgatgacgcgtgacagcctgaccggatacgtgctggtgggcaacgtgcgctatccgaccacaggtagcaggctggcgcagataccggccggtattgccccggtactgcccacgcccgctcagctgcagcgtgatttgctgggcggtgaagcggcgctgtgggcggagaacgtcaatagccgggtgattgatacgcggctgtggccgcgcgcctttgtggtggcggagcggctgtggtcggcgcaggatgtgaccgacagcgagaatatgtaccagcggctcagcgcgattgatcgctgggggacggtgtcggtcggcctgcagcagcatcagcaggccgaggtgcagatgatgcggctggctaacagcagcgatatcactccgctgcgcgtgctggcggaagtgctggaaccggcgcagtattacacccgccagcacctgaagtttcaggccgggcattatgactatttcgagccgctgaaccggctggcggacgtgttgccagccgagagcgagccggtgcggctgctggataagcag

SEQ ID NO: 73463 - DNA, 156 bp, Glycine max
  Peptide Sequence Number=SeqID_165148
atgccttgcataattcagcatgacgaggtcgatgatgtacatgcgattcgtaatgatcacgatgaagggtcatgggaacacctccaacgtccccgccgcattccgatggtcattaggaggctatgcctaaaaagactagacaatccacacaactga

SEQ ID NO: 73464 - DNA, 132 bp, Glycine max
  Peptide Sequence Number=SeqID_165149
atggctggtacattcttccttttgaaacagcaaaatagtttagagattatgagcgtgaccttgttggatatccctggtgggggaaatagagtggtaaagagttttaagcatctttggagggggatggcttaa

SEQ ID NO: 73465 - DNA, 390 bp, Glycine max
  Peptide Sequence Number=SeqID_165150
atgtccaaatcttatggatttgggatgaccggccctctcgatgagtcgatctcttgctttctcataagggtggacccttgggtacttgtacctatcgcctttagaggactacacatcctcgccttcagaggactgcacgtcctcaccttgagaggactacacgtcctcgccttgagaggactgcacgtcctcacaatcagagggctgcacaccctcacctccagaggactacacgtcctcgccttgagagggctacccgccctcgccttgggtactagttaccctcaccttcagaggactacacgtcctcaccttcagagggatacacgccctcgccatcagagaactgcatgtcctcaccttcgtagggctacacgccctcgcctttag

SEQ ID NO: 73466 - DNA, 153 bp, Glycine max
  Peptide Sequence Number=SeqID_165151
atggataagagcttgaaggaggagaagatgagaggaggaagaagcatagaaggagcacaaaattttgtacctcaaatgagcccactaatccaagatcaagtcctagattctccactaagtgtgcttaggtgtcatgagacatgtaaagcatga

SEQ ID NO: 73467 - DNA, 714 bp, Glycine max
  Peptide Sequence Number=SeqID_165152
atgacgctttattggcacagaataagttgctttctaggcaacttgagatttgaacaaaaacactcggttatacattgtaccatttgtggtgaggctcatgaaataggccaatgtattcccattgaagaaaacactcaagaagttcactatatgggaaataaacagagacaaggatatactcaaggaggattctcaagcttccagcagggtccttataatcaacaaggacagtggagatcacaccctggcgatcaattcaacaaggaccagggtggatcttctaacaggccaatccaacaagggcctaacatctttcagaggactactaagttggaggagactttgacccactttatgcaagtgggacaactggccaagcaaatagctgacaagacatccaacagttttgtggcgaatacagaaaagaatcccaaggaggaatgcaaagctgtgatgacaaggagtaagaggtttgtggaggcggaggatgaggatagtgtagtgtccaagaagaaagcttccgaaaagaaagataaggtgataggtgaaagcaatcaggaaaaagaaaaacaaataatggccaagaaaaaagaagatggccacaaggcacaaaagtgtggggaggaaatgctctttagtgtaaatggtgattgcctatggcagttctatttcattttagcagtttcatgttgcgcgcttagtgtgacaacatga

SEQ ID NO: 73468 - DNA, 210 bp, Glycine max
  Peptide Sequence Number=SeqID_165153
atgaattttgcagcgaaaaagcctatagaattcaccccaattccggtgtcctatgctgacttgctcccatattcacttgataattcaatggtagccataaccccagccaaggttcataaacctccatttttccgaggatacaacttgaacacaacatgtgcttatcatggaggagccccggggcattccattgagcattgtagggcctga

SEQ ID NO: 73469 - DNA, 634 bp, Glycine max
  Peptide Sequence Number=SeqID_165154
catctgctgcagcgtcaggtggatgcgatcatcgtttccacgtcgctgccgccggaacatccgttctatcagcgctgggtcaacgatccgctgccgattatcgcgctggaccgtgcgctggatcgtgaacacttcaccagcgtggtcggtgccgatcaggatgacgcgcaggcgctggcggctgaattgcgtcagctgccggtgaaaaacgtgctgtttctcggcgcgctgccggagctgtcggtcagcttcctgcgtgaaatggggttccgcgaggcgtggcagggcgatgagcgcccgatcgatttcatctattgcaacagctttgaccgcgccgctgcggcgacgctgtttgaaaaataccttgaagaccacgcgatgcccgaagcgctgtttaccacctcgtttggcctgctgcagggggtgatggacgtaacgctgaagcgtgacggccgcttgccgacagacctggctattgcaactttcggcgaccacgaattattagactttctggagtgcccggtgctggcggtagggcagcgccatcgcgatgttgctgagcgtgtgctcgagctggtgctggcttcgctggatgagccacgcaaaccgaagccgggtttaacccgtatccgcc

SEQ ID NO: 73470 - DNA, 475 bp, Glycine max
  Peptide Sequence Number=SeqID_165155
gttgcagggtgtgccatttgtggtggagctcacaattctggctgctttatctccaatgaataaccagctcatgaagtcaattatatggggaatcagccaagacaaaatttcaatgcagggacagtggaggaatcaccctggaaaccagttcaacaaagaccagggtggtccatctataaggccacaacagcaagggcctagtctctatgatcaaacaacaaagctggaagagactctagctcaatttatgcaggtatctatgtcaaacaataaaagcacagagtctgccataaagaattttgaagtccaagtgggacagctggcaaaacaattagcggataggccgtcaagcaactttagtgctaacactgagaaaaatacgaaggaagaatgtaaagctgtaatgacaaggagcagaatggcaattcaggctgatgaaagtagagctgaagagaaggtagagggatataaataa

SEQ ID NO: 73471 - DNA, 1321 bp, Glycine max
  Peptide Sequence Number=SeqID_165156
cctgaaggacacgccgatcttcccggtgtcgatgaaaaaacacctgccggtgtggccggaagggcgcgagggcggcaagctggatcaggaaggcatgcgctatgcgggcctgatcgccgacgagatggccaatccgccggccgattggctggtgatgtcgcgccgctacaccacgcagtcgatcgacacctcggcgctggagccggacaacgccaacggctggttcgacgccgagacgcaaacgctgcatctggtggtgccgacccagtcgccgcaggaagtggccgacgagatgccgcgcatgctggccaagcgcaacccgccgatcactacaacttcccgtattacggcgcggtggcggcgatgtacggcgacggccacccggtgcgcctggccaacgatcgcttcgagcagttccagacggcgctgaagcgccacgcgttcgacatgaattaccgcatcgcggtgaataagcagaccggcgtcatgcagtcgttcctcggcgacatgaccgcggacggcggcggccgcagcaactttaccccttcggtggtgatggtcggcgcgaccgccgcccagtcgatttactacttcccgaaaagcgatctgtcttcggtcgggctggcctcacgcgccatcgacgccggctcggcgcgcggttacggcacgctgcagagcatggccgccaccgagatgatggtggatgagctggccgccgagctgaagatcgacccgatcgagttccgcctgcgcaacgtgctgaaatccggcatgaaaaacacccagggggcgatcccggccggtgcgatccgcgccgatgaagtgctggagaaggcggcgaagcatgagatgtggctcaagcgcgccgaacgcaaggccgagtttgagagccgccatcccggcaagcgctatggcgttggcttcggctgcgtgcagaaagacttcggcaccggggcggaaacctcgttcgcccgggtggagctgagcgaagacggccgcatcacgctgcatcacagcggcgcggagatgggtaccggcatgtcgacctcgcagtctgtgctgtgcgcacagtggctgggcaaaccggccgacgaagcgcatttctcggtcaccgactggtcggtgctgccgatggtcaccagcggcgatccctacctgatgtcgcatgaggagcatgacaagctgcaaaccaaccctaactggacgccgagctactgttcgccgtccagcgccagcaactcagcctattacttctcgcacagcacccgcgaagctgcgcgcctgatcttcgatcacggcatctggccggcagcgatgcgct

SEQ ID NO: 73472 - DNA, 345 bp, Glycine max
  Peptide Sequence Number=SeqID_165157
atggcccaagcccgcggcttgttattcatctaccgtcggagacgccatcgcgatggggatggccacggcgccctgcgtgcctcggcacctggcgctcctgcgtcggccgtggcgactccccattcggcccgtcttctgaaacacggaccaaggagtctacaaatctgtgtgcgagtcaacggggagacccgtaggcgcaaggaagcagcgaaatgcgatacttggtgtgaattgcagaatcccgtgaaccatcgagtctttgaacgcaagttgcgcccgaagccattaggccgagggcacgcctgcctgggtgtcacacatcgtttccccaacgcaaacatgtaa

SEQ ID NO: 73473 - DNA, 716 bp, Glycine max
  Peptide Sequence Number=SeqID_165158
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttggtcacgagttacgatatcattaagatcatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 73474 - DNA, 627 bp, Glycine max
  Peptide Sequence Number=SeqID_165159
atggttctacacgggaaaacaattggggttaatgtagaggatgatgattcatacattgatacttatgttagtcctttgtccacacaaatgactcctaacatcgtcggggatgaagaagttgacgacgttcatgttaatcgtaatgatcatgatgaaggagaattaattaacatcgtcaaatgtaattttctaattatgcccatggctactccacctggcttgcctcctcctctttttgctcctcctcctcctcctgcaatagcatcacagtctccgtctaccttgaagtggacacgcaaagccactcggctacgatccttagccactagaccacttggggcagagagaccggtggtccacgtcgatcctgcgatcaggaaggccgacggtcccaacaagaagaaattaagaacatatttagggattgtcgctcgtcataaggtcgacgtgacatacgagacttggaaagaagtccctgctactcataaggattttatatggaaggatatgcaggctgaatttgatatccctaaagcatctgacggtaggacaaagaagaaaatacttcaaactatcggggagcagtggagacagtttaaatctgatttgacaaggaaatggggatga

SEQ ID NO: 73475 - DNA, 402 bp, Glycine max
  Peptide Sequence Number=SeqID_165160
atgaccaccctgacccagacatggatgacgttgctgctcagcaacatccagcccagcgatcataattcccgacctccccctgccgaagtgtcagctggtatgccacctaccaggaaccctctggacccagataagtctaacatggccctgggttttctggcattgatcacgggtctttgccagtcgttcggggttcctgtcgcacccagaaaggtgatccggccaccgataacccgagctttcatagagaagtactgcacagctagacaggcacagggtggcgacccgcaggccccagacgcacagccgccaccccctcaggctgatccagctgggtcatttgacacggagcggtatttacggcatttggttcaccagcaggcggccaaccacagggcgcac

SEQ ID NO: 73476 - DNA, 330 bp, Glycine max
  Peptide Sequence Number=SeqID_165161
atggatcccgtcaagtacatcttcaaaaagcccgctctcactgggaggatagctcagtggcaggttctattgtcagaattcgatattgtctactatcgtaacctactcttcggagagagggcgaggcagccttgcctgtccgatacggcaatgatggtggcccgggtgatgttggggtatggctatgagcccgaaatgggtttaggcaagaacaacggcggcataaccagcttggtaagcactagagcaaaccgcgggaagtttgggttaggctataaacccatgcaagcggacataaggaaaagtatcgtggaaagtgtcataccctaa

SEQ ID NO: 73477 - DNA, 333 bp, Glycine max
  Peptide Sequence Number=SeqID_165162
atggctaactttctagtagaattcgctagaaacgacacaaccaccccaaactggtggaaccttttcgttgatagtgcatccaatgtaaaaggaagcagggcaagaatcattctcgaaggcccttacaatatctccctagagcaagccctcaagctcaacttcagagcctcaaacaaccaggcagaggagaacaacactagagcatacattctctccaagctaatcagcaccaagaaaaccgggcatctcaagactgttatccaggagacacttcaaactcccaccatagacactaaggaagttatggtcggagaaaagaaggaactagactag

SEQ ID NO: 73478 - DNA, 1189 bp, Glycine max
  Peptide Sequence Number=SeqID_165163
atgacttcgttagctactgagagatataggagtaggggtactcctggccagggtcggatcaaaactggcggtgcgactatgtacgatagtacatttgtcggggttggcttcaatcccccggtgagtgatcatgaagccggggaacttgcctctgcctaccccgaaagtacattttttagggttgaggcacatatcagtatagttggtgcacattcaccattttccattggcatttttgaccatgacgacgttcgcaagccaagtggagtacctgacttctctgataaacttgacgagctctttgatgggtcttgggcctttgtcagaggtgtcatctcgcggatctatatcgaaatcatcgtcctcgcttgcctggttctctacatagcactgtcgtgtttgcttttggtctgccttgacatttacaatctcctcggtcagggtagggaatttcattttcaaaggcggcgtggagactatggccctaagctcgttaagcgtgtccacgtagcctctggtctctactctctcgcctataaagccaaggagtggactgtcgtaaggatggacagtgtcaggggagaccttaagtctttggaaagtttttcaatacaagatattagtggaattgtcctagtcgatgacgaccttggacaccatgaagtttgcaatgatgatggagacaaccactgggtcattctggttaacggggttgatacccttgaagtccctatccgtgaaagtgataagagggagacttcgttgcgatggtgtattgaaaaaattgatgttgatgtcccgaatggcgtgaagattgtgctttcgggactggctggactgttctccttaggaaaatctgcccataatggtgttgattacacctctgatttgctgggggggttccttcctgttcttatggaggttgtctctcacaccgctgttgctggtctcgttcttgcttggtggttgtccgaccttttgacaaactgggctagcactcgtacttggacccttttggaagaggctaacgcttgtctagcttatgtctcttgtccgacttgtgtgaggagcatggaatgcaatgctacctctgggttaagttttcagatctggacggtgatgcgcccaaatctatccatgaagtttttgagagactcgattgtcgtctgcttgtcacagactgaccaag

SEQ ID NO: 73479 - DNA, 372 bp, Glycine max
  Peptide Sequence Number=SeqID_165164
atggagatgcagcggaagacaaaggagaagagctcaacaacattcctcgaaaaacaatatgatatgatgcgtgagacatacaagacatccatgccatttttacactatcgtaacatggtggtccttgtcccacatagacgtaggccaaatatttattgtcacaacctacccttcggcgggaaggcgaggcgaaacaaaatggcgcatcttctcatgaagaaaatgcgtggagtcgccaccaacgtttatttaacggaaaatgttagaaaaaccaaaaaagacgaaggggacagatgtcgtaccggatgtcacgacatcacgcttcagaacatgcagattatatgtgtccgtatgaacagattaaacaagtaa

SEQ ID NO: 73480 - DNA, 288 bp, Glycine max
  Peptide Sequence Number=SeqID_165165
atggcgtgtcttcttatgaagaaaacgcgtggagtcgccaccaacatttatttaagagaaaatgttagaaaaaccaaaaacgatgaaggtctgcgcattttgaaaataagggttcgtgagttgtttacgcacggggaaggtatacgcacgggaaagggtgttgcccttgctcctacgtatcctcagaccttggaaccctttactcagcctccctcacgcctatttatagcaaaagatagcattaggggtcatggcagctcgcccaggcgagctgttgcttcaacctga

SEQ ID NO: 73481 - DNA, 399 bp, Glycine max
  Peptide Sequence Number=SeqID_165166
atggagtctctgggtacccaacaattcagtggtttccaaaaggatctcttgaacccaaaaagaacaaatgtgaagattgctacagctccttccaatgtagtggtgcttacatctgaaaattttaatgaggttgtcttagatgaaaccaaagatgtcttggttgagttttatgcaccctgtcttacccgaatggaagaggaagttgagaagctgaagggttctgcctcaaggcacgggaagatttacttgaaagctaccaagaattacttggaaaaaggttctgattatgctaataacgaaatccatcgcctacagcgcatacttgacaagtccattagtcctgcgaaggtcgacgagttaactctaaagaaaaatatcttgtcgacatatgctgcttga

SEQ ID NO: 73482 - DNA, 186 bp, Glycine max
  Peptide Sequence Number=SeqID_165167
atggccgttttaagttttgctaaaaacaagttcccaaaatttttgtctctctcaaatactgccacaccaagtgctcctgcaaaacacaaagctaaaaaagtcgcaaaacagtcacttacaacagtcgctaaacaggggacgcgactgaaatgcaagaaagaacgctacacaaaacaaaacaactaa

SEQ ID NO: 73483 - DNA, 285 bp, Glycine max
  Peptide Sequence Number=SeqID_165168
atgaagctaatcttgatgatttttagcaacttgttgagtgagggacatcctgctctaattgctcgacatcgaccatttcctgtcacgcatcaagctgcagagaggtggttacatcacatgcaacatgcattagacagtactacagatatagatgatgactcaaagaccaaaatgatgaactttttcaggcacactgcatattttttggtggctggagatgagctaaagaatcaaaaccaacatattccatgcaaacatgcagcagccaaaaaggatgattcttga

SEQ ID NO: 73484 - DNA, 315 bp, Glycine max
  Peptide Sequence Number=SeqID_165169
atggcagagcacaatactcagtccaagaccacagaccacctcgaagaagctatcacctgcctcacccagaaccagtccaccctcacagatgcccaccatgatctcacccttcgcctagactccatccaagaccaactcctccagtttcagcttcaccttcccccacccccacccccacccccacccccaccgtcacccccaccctccccaacaccaaccccacatacccatccctatagacactccctcaagcttgaagtaccacacttcgacggccaagacgccattgttggactagcggcctcaataacttaa

SEQ ID NO: 73485 - DNA, 1119 bp, Glycine max
  Peptide Sequence Number=SeqID_165170
atggcaaagctgttgaactctacgttaggatcaatttgttccctggctaggctatctgtaagcacacagaagtatacattacatggtcattggctccagacgtccacggcaactggtcggctttcaatggaggaacctaatcttcagtgtgttgagcatgcagtagaattcaaaatgaaagatgaaaatgaaggtgatgctgacgagagttattgtacaattaatgctcgtgatttctttgttcctactcaggacaactggttactgttaacagcagattattctcagatagaattgagattgatggctcacttctctaaagactcttcacttgttgaacttctcagtaagcctgatggtgatgtctttacaatgatagcagcaagatggactgggtgtcctgaggtttctgtgtgttctaaggagagagagcagaccaaaaggatggtgtatggcattctttatggtatgggggtcaatagccttgcagaacaactggattgcacttctgatgaagctgctgaaaagattgctaacttcaaaagctcttttcctggtgtttcttcctggcttcttgaagccgttgcgtcttgtcgcagtaaaggatatgttgagactcttaagggaagaaaaaggtttttgtcaaaaataaaatatggcagcagtacagaaaaatcaaaagctcagaggcaagctgtaaattccatttgtcagggatctgcggcagacataattaagattgcaatgttaagaatttactctgcaattgtcactggatttgatagtccagattccagttcttcactagcaaccaagtttcacatgcttaaagatcgttgccggattctgttacaggtacacgatgaattaatgttggaagttgatccttctgtgataaaagaagcagccctactattgcagacaagcatggagaatgcgttcctttgcatgtcaaacttaaggttggaagaacatggggatctttggagccatatacatccgataaattcaacaatgccactcttgtggctgaatcctgaagcacagaggtttggtgtggtggggaattatccgaatgcccaagggaagaattatgacgaagaggcttacggtgtatag

SEQ ID NO: 73486 - DNA, 165 bp, Glycine max
  Peptide Sequence Number=SeqID_165171
atgtggttcttcatgaggaaaaatcctggtgcttgggggtatttcactcggtttggaacttccttgagactcattgatgcaatcctacccctccaagggaattggatagaagactacaagaagattgagccagagatgcaagagaaggccttaggggctccataa

SEQ ID NO: 73487 - DNA, 732 bp, Glycine max
  Peptide Sequence Number=SeqID_165172
atggcggaaccatcaaagaagcacaaaggttcttcaagtagaagtcaaaggcattctgaggttcaggatactccaattccttcctccatttcatcctcctcattgttctcatctgaagaacaacatatacggtacacaaaccttttctcctctccttctatcatagatcctaagttcatagatatggatttcttttctgatgagagttttgaatgcattcaagcatttcaaaactcaaatctcattccctttatgtctttaaaatttcctgtgtattctaaattgtctggtattcttcatcaataccagctacttgcaaagacaccttgtcctcaaggtggaaattttcacgtaatgcgtcccactgttcccacaatgtttcttccggtggtatcccgtgtcattaaaccaagaccagcaaagaatagggtctatgacttgtgtgacagggtcgtgatgtggtttgaggatggaacagtgaaatacattgtgaattttggaagaaactgggagagtcaaacgataagccacgacaccaatagcttcagtgatctggaagggcccataatattgtttggaaagcttgtggaaagtggtcctggacaaggatgtttggcgcgagctattaataaggtccaaaggtcttggcgtgtggttagcatgttgtcgatggcttctacctgtgacgatcctggaatgtatgtggtaatggaaagtggagccttgccatag

SEQ ID NO: 73488 - DNA, 924 bp, Glycine max
  Peptide Sequence Number=SeqID_165173
atgacgatgaaaactctctttggtaaattactagcctatgaacatgaattgactcaacaatcttatgcagaagaaacaaaaaagaaaaggaaaggaattgcacttaaagtgaaatcctcaagggaagaatacaaggataattctagcagtgaggaagatgcaaagaacttcaatttgatggtaagaaaatttggaaattttcttaggaattccaaggacaaaaaattctccaagtcctctaagaagattgacaacaacaacaactacacatgcttattgtttgaaaagaaaggaaaaaagggtagaaaacaaaagaaattctacatagcaagggaagatagtgcatcaacaaccttcaactcttcaagtgatgaagaaatttcaaacatatgcttaatggcaaaatccatgaatgacccgtcaacaagtgaagaagaacttttagaagaatttaatgaaatgcatgaggaagctcaaaggcttgttgtgttaaacaaaaagctgaaaagtgaactgaaattgcatatcaataaattggcttcaacacaaggtgagttgaatgtattgaagcaagaaaatgaaaagcttgtttcaagatgtaaagccactgcttgtgataacacctctacttcctttaacttggatgattacaagtgtttgcaaactaagtttgataatttcaaaaaggatcactatgctgaatgtataaaattgcaaactgagttatcctactttaaagatttatttggaaaattaaacaaaggaaagagtgatcttaatcacatgcttagtgtgcaaaagcatactacagataaaaccgccttggggtataacaagcaaacctccttttcagagaaaactcagtttgtatcctcaaaaggggtaaacccaaacaaggtcactaaaaagaggaacatggtgtaa

SEQ ID NO: 73489 - DNA, 624 bp, Glycine max
  Peptide Sequence Number=SeqID_165174
atggaacaggcaaactacaccaataaatatttacaaattttaggagaaaccattaaaactaaggtagttcctaagcaaaaatcggttgaagaagccttagttgaaggagtaggtgacaatcatagtgaattaccaaacaagattggtagtttacttaaggtcattctggaaactccccaaacctcagaaaatacttccaaaatggtaacaagaagtacctccaaattaattaatgttattaatgaagatagtgaccaaaacttagataacacaactgagataagatcagtgtcagaaaagaatataaattcaattaattccaaacattggaaaacaccttccaaattatattatcaacgtccaactgcccctgaccttctattagaagaaagaggagaaaacaatttcaagagttttagtgcaaacaacatctatgaatggaacatagatgcacaaacggagtataatatcatgaatacactccaacatatgaccatggtggctacggcttaccaaacctcccacgaatgttcagaagagaccattatagacatcttagtggtaggattttctagacaactgaaaggatggtgggataattatctcactaatgaggagaaataa

SEQ ID NO: 73490 - DNA, 341 bp, Glycine max
  Peptide Sequence Number=SeqID_165175
atgcaggcagaagaaagcacgaaagcacaaaggcacaagcacaagacaagctttggtgtaaagcacaacaagcgcgctaagcgcacttccaagaattcaaaaatagtaagggattggcgcttagcgcatcctacaactaagcccaactatgaaagctcaattccagaattgatctggggcttagctcaggacagcgcgcttagcgctgctacaataaatttttccagagaagaagtggcgcttagcgcatcatctccgttaagcccactgcttgaagggtctaagcgcttagcacgagcaagctcaggcttagtgcgtgaagacatggcgcttagcacaag

SEQ ID NO: 73491 - DNA, 204 bp, Glycine max
  Peptide Sequence Number=SeqID_165176
atgtcctatcaggcaatcctgtcggtggacgcgagcttagcggaagatgagctcgctcagcgcagtgaagacggtgcgcttagcgagttggctttcgctcaacgcctctatacagctcatccttcttccagaattgtccatgcgcttagccatcagatggggcgcttagcagatgatgcatttagccagatgatgagtggctga

SEQ ID NO: 73492 - DNA, 747 bp, Glycine max
  Peptide Sequence Number=SeqID_165177
atgggaacaaatcaaactggaaaaaggttttatcaagtcaagattaagggcctagatatcaccagcattaaggagttggggcggttgatgggacctctccaaatgcaagccttccgcaaggcgtatagaaagattttagatttgaccatagcaaagatatcctcaaaagttgttatatcactcacccaatactatgaccagcctttgagatgcttcatgactgtcaaagaatttgaggagattctaggatgtcctcttgggggaaggaaacggtatcatttctccgggtttcttctctccttgagcaagattgtagttgtggtcagggattcggcgagaggattggatcgtgtaaagcaaactcgaaatggcgtagtgggcctaccacagaagtacttagaaggcaaggcaagggatatggcgaatcaagaggagagggtcccgtttatggatgtattagcattgctaatctttggggttgtcctctttccaaacgtggacggtttggtggacctagccgcaattgatgctttccttgcatatcaccatagcaaagaaatcctggtggtggctatcttggcagacttacttgacacatttgaccgaaagtgcgagaagagtagcgcacggatcatctgctgtttacccactctttctgaggcagaacaatcaactggtttcctcgatggaaggaaggaaatgagggagttctcttctcatgtggggactacccaaacatcccattga

SEQ ID NO: 73493 - DNA, 498 bp, Glycine max
  Peptide Sequence Number=SeqID_165178
atgacatcaaagactcttgaaagttgggtagggggtattttaaatcatcatattctaaggcagcacaacattccaataagtcctaagattgcaaggcagcatgattttggtaaaattttagtggaatcgggctctgagaaagctattggctctaacctaggctacaaatcagaaatcaagcaaaccttagatcaacacattgaaagtgcttcactttcatcagaaatcaatagcagtgcttctcaagtggattcaccccaagctattattactagtcctggtaatgctaatgcagtagctgctgctgctctagaaaataaggatctagcattcgtagtcgctcaacttggttcaaattcacaccaaagcaacaacaacaacaatactgatggtgatgatagccaattttatcctctcctacctttcaatcactccagcctaaaagacaaaagttggaaaacaaagaaaatgaatagagaaatgggtgcagctatgtga

SEQ ID NO: 73494 - DNA, 315 bp, Glycine max
  Peptide Sequence Number=SeqID_165179
atggataaatttgatatctttgtccctcatcctctcacaaacgcatctttgcttattcaactttcaccggaatgtgggtgcaagccattggtctgtttgcttaaacgacctgtgctcctgagtttggacttccaaagaccgttcaataagagattactcgtcttgcacgttggtgggggtgccgtaaaacaacaaggacaacccttcccttgtattcaggaatcctctacaacaagagacccacggtctcttaatcccttttcagaaataagaagaagagaagaagaggtctctcttaaaagagatagattgtaa

SEQ ID NO: 73495 - DNA, 359 bp, Glycine max
  Peptide Sequence Number=SeqID_165180
gatgagatatggggatctgcaaaacaaaggactttgacgctcaagcttgttgctcgtgtgctgaagtgtgtggatcgtgttgagggttcaatgaaacctgtatctgatgttcagggtagttgtcttgacaagtggagggcgaagagtttgtcgagcccccaagtgtggacgagtgtttgttcaatgtcgggtgtgacttgtcaagcccccgagcctagacaagtgtttttcggactgcttctgtcaagttgtccgggaggaacatgtctttggcgtgtcaagtcatctctattggcggttcctcatcagaggatacttgctgaggtgcctttgacagcaagtcctcctcttcggagagg

SEQ ID NO: 73496 - DNA, 417 bp, Glycine max
  Peptide Sequence Number=SeqID_165181
atggaggccatgaaagagcaaatgaccacaatgatggaagccatgatgactatgagaaaaatgacggaggtcaacacagctatattcgttgtcacaagtactgccactgaagtggacctgactcacccatcaggcctcaatcaagtaaatcacccaatgtcagatatggtaggtcaaggaggtagaacattgggaagtacaagcggcccccattttgtgcagtccagagcaagcattccttcccaccatatggcttgcctcccaactatacaccacccaatgttgcacactctcccgataagaatgtcgataactccgctcccatacccattgagagccaacaaccccaatctggtcatgcataagtccctcaacccatcggggagacgcatgaagtaccccgagaccacactctag

SEQ ID NO: 73497 - DNA, 213 bp, Glycine max
  Peptide Sequence Number=SeqID_165182
atgataaatgatggaacatacggatttggagatcccacggtcatgtggctccgtatgccaccggactcttgggtcacagtaacaaaaggtggggtggtcgacaaaagcagggcttttgctcctaccatttcgtttctaaacgaccatttagaggaaacactgggtccgacaaaaataggagaaaatcactcaaagtgtatcaatctcacacat

SEQ ID NO: 73498 - DNA, 180 bp, Glycine max
  Peptide Sequence Number=SeqID_165183
atgacagcacaatggagaaggaagagagagaggagatgccacttcaaggagaagatgagtctagaagaagctcaccaccataggagaccatggataagagcttggaggaagaaggagatgaatgaagggagacccactaatccaaaatcaattccaagattctccactaagtgtgcttag

SEQ ID NO: 73499 - DNA, 292 bp, Glycine max
  Peptide Sequence Number=SeqID_165184
agaattcaagggactaaccacctaagaattctttgtcttaacacattagaggatacatcctttgtgtcacaagtagagggtacatctacttgggttgttatactgagaacaagagaaggtacatctcttgtggatcagttcaagtggaagggtcatatagtgctcaatggaatgccccgaaactccctcatgataagcacatgtcaagttggggttgtatcctctgggaaacgaaggttgagaaatctttgttgggcttatgactgccattgcattatcgagcagataggga

SEQ ID NO: 73500 - DNA, 507 bp, Glycine max
  Peptide Sequence Number=SeqID_165185
atgagtggaaagggattgcagcatgttcggaaatcactttctcaatatcagcgtcttagagcatgtttggaaatcaaatgggataccaattgggaaagaggatttgtagtttatgtaaagaactcaaaaacttcgacatccttaccttcaggaacacttgaaaggtggcaacgccactcaaaaaggcacgacttcggctacgtggcggtggtgggagcagcaggtccacttcggcttcaagtacttcacggcgggaaacaaaacgtcagggtggtagcgggatggagttcacggcgggatgaagtagttcaggcaatagcggtggcgctaggtttttggagggacggtgtacctacaagcaccgtcttttatgacttccatcaaaactacaacgacggggttatagacaaatgtcgttgtacaacaaacgcgccacataaaaacttatataattacgtaaatgtcaccgtgttgacaactacgacaggttcttcaacactgacgtag

SEQ ID NO: 73501 - DNA, 249 bp, Glycine max
  Peptide Sequence Number=SeqID_165186
atgcacatagatcaaaatggcctaactctcttaaaattgtcccctgtggagtcgccaactgtcgcaacctacccttcggcgggagtcgctaccaacatttattcgaggaaaacattggaaaaactggaaatgtgtggtctatcaactttaagtgtgaaaggttcgggagttgtatttacgcacggggaagggtgtttcccttgctcctacgtattcctcaattgtggtgaggaaatcagacctacgtag

SEQ ID NO: 73502 - DNA, 153 bp, Glycine max
  Peptide Sequence Number=SeqID_165187
atggggaccactaaggggaaaaagagggaggtggttgtcgtccagctcgcccagacgagctgggttgcttccaccagaaggcaccgccttctgttggaagatcctggaaggccaagtgggcctgattgctatttgtacacccctgtttactaa

SEQ ID NO: 73503 - DNA, 310 bp, Glycine max
  Peptide Sequence Number=SeqID_165188
attcttatgtatcatctgtgccaattttaatgggcttaacttctctgacaaaaatgagcaagtccaatttcacctcagtgttttggatcatgatcttgctatgttggaagagaagtttgttactattattgatactagtagcaatgaagagaaagttcattataaagcttgggaaagatctaacagactcggcctaatgttgatgagaatgactgttgcagacagtattaagacaactctccctaaaattgaaagtgctaaaaggtttatggggttagcgggagagcactctcaaacagctgataagtga

SEQ ID NO: 73504 - DNA, 503 bp, Glycine max
  Peptide Sequence Number=SeqID_165189
ggcgcggcggtcgctgcaaaacccagggcgcgagcccgggcggagcggtcgtcggtgcagatcttggtgggacgggggaagcccgtctgatagcgctctgtgcgcgtactccgaaagggaatcggcctgcccaccctggaaacggctcagccggaggtagggtccagcggctggaagagcaccgcacgtcgcgtggtctccaaggtgaacagcctctggttcgatggaacaatgtaggcagggaagtcggcaaaatggatccgtatcttcgggaaaggattggctctgagggctgggcacgggctgcttcgcgcgagagcggtcgtcgcgtgccggtcgggggacggattgggaacgggcccttcggggcctcttccccgggcgtcgaacagtcaactcagaactgtgctctgaatgtcaaagtgaagaaattcaaccaagcgcgggtaaacggcgggagtaactatgactctcttaaggtagccaaatgcctcgtcatctaa

SEQ ID NO: 73505 - DNA, 345 bp, Glycine max
  Peptide Sequence Number=SeqID_165190
atgagagacaaggacatcaaatttatgcatattattagcattgtgactgttgtttacagtaatgacataaacctgaaaatcctaatgagtcattggagacatctaacaacaaccttcaaattgctccaagcatcatacaaagtattgcttgatgacatcagaacttacgagcgattttcctcctcaaatctcagccagcctgcatcagtcagactttgcaccttatgtttcagggtcatacaatgctctatggaatgccccgtaactcccccatgtaagcacatgtcacgttggggttgtatcctctgggaaacggaggttgagaaatcttttctagtcttataa

SEQ ID NO: 73506 - DNA, 387 bp, Glycine max
  Peptide Sequence Number=SeqID_165191
gtcgactctagaggatcccctaaatcaattcaaggagcatttaaaagtacaaaaattcagattggtaagctggtagaagaagtgactcaagctatgggtagaagagaagaagaatttgtagaggaagaattcaacaatgtgacagaatgtctagtcagtgaaaatgaaggggaagagttagcttgtattgaagagctagatggtccagaagataagtctgctggtcatgtgatgtttggagcattagaaaataatagaccaatggaaaagcctaaagtagaattgaagacccttctagtgcatctaaagtatgtattcttagaggacaatgagactaaacctgtaataattaacagctccttgcagaagaaagaagaggatcaactg

SEQ ID NO: 73507 - DNA, 456 bp, Glycine max
  Peptide Sequence Number=SeqID_165192
ggtgttacattggtgagctgcccctcctccgcaccatacatagaagcggcagaagaatcattagaaacggctttccaatccttcgaggtggtgagttgtgcctctgtggaaccaagtccgttgctaccttctctttccaacgcggccataatggtggcacgtgttatgctcaggaacggatttgagcccggaatgggtctaggcaaggacggcctcggaaatgccgacgtagccgatgttaagggaaatccgtacaagtatggattggggtacgaacccgggatgccggggaggaggaatgtgccgtcaagatttcgggcagacagagtatggcccgaccgtcttagccaatctttcaccagtgccggaatggtgtccgaggaagaagtggccgcagtaggagaggagttccctcaagacctgtcaaatttcgtgcatgttcatttaaaagcttaa

SEQ ID NO: 73508 - DNA, 462 bp, Glycine max
  Peptide Sequence Number=SeqID_165193
atgttggtggaattacttgaggtcagcgctacaaaggcgagagctgagacaattcagtgtcatggctcttatgttcgactatcgtggctacgcgacgtgtatcagatgaagatcgagagtgggggttacacttggggtgctgctgcacttgtgcacatgtatgataatttaaatggcacatctaagagcacaacgagacagcttgtaggatatatcactctattacagtgttggatctacgaacatttttcgtccgttggttccgttgttcctgccgagaattatgatgagaggagaccgcatgcatgtcgatgggcctctagcaaggcactgcccgtttccacatatcacaggcatctggatagactgagccctgacatggtgtgctggatttcgtatggtgaccaccgttcatttagagaatttgaggtcatctcattattttccagccatcttagatga

SEQ ID NO: 73509 - DNA, 777 bp, Glycine max
  Peptide Sequence Number=SeqID_165194
atggccttgagaaagcttcccacaaagaggtccagaaggacaccaccggagagggctccaacgctaccctgcaagctaacatggacttcgaccagcaccggttccggagcgcagaacatcagtagcattttaagaccatcaagggatgggaagatagcccgtaggcactgggcaccacttgtgacacccatggctaaattcgatccgaggataatcatggagttctacgctaatgcctggcctaccaaggaagggtggattcctcttgatgcagatgccctcagtcagttcctagggcacccactgatcttggcagaggaccagcagtgcgagtacagccagaggagaagacaagtctctggctttgatgaagaggctattgcccaactgctatgcataccggggcaagactttgcccggaccgccacagggagacggtttgaaagtattgcacccacgagacaccttatggacccagagaagtccaacagggccttggggtttcccgctctgatcacgggcctctgccagtcctatgaagtgcctatcacccctagcaaggaggaccaacagccagctacagaggatagaactccagatgcacaggaccccagtcctttcccttggcctactcccgagcagttcaaggccacagtggcgtggcctggggacgagaccgagtttgagatgcaggcagggcccccggggaccttcggaggtggagacgcaacccatgaggatgaggacatggccgacatgttggacttcctcctgtga

SEQ ID NO: 73510 - DNA, 459 bp, Glycine max
  Peptide Sequence Number=SeqID_165195
atggggtgggaatcatacgcacatcaactctctcccttgctggccaagtcatgcacgtctactacttttacggacaatagaaacaaacataatgctgagatccaattgaagtcgtcatatctgctgctcattgaactagacggtaataccaatatggggatgaagtcttccatcctcctgttgtgttatacaacaagatccacaattctattgtcgaatctcactaggaaccgatgcatctccgatattttctcccgcaacgtaagcatcacgatcatcacagccaaacacaatgcaaggttatgctatacatgcaaacttgacttcatggagatctccaacatgttgacggatcactctgacatgtcccttaagcatggtacaacaacactaggcaaatccgtaaaacaacacatgtcaaagaaaaaccattggggtgacaatagatctgatctctga

SEQ ID NO: 73511 - DNA, 384 bp, Glycine max
  Peptide Sequence Number=SeqID_165196
atgaaaatattatgtgagaattatactggtgaaattttagtactattcaaagacataatgatgcaatcatatcttccaatgacattggataaaatgtttcaagaagattgggtcagaaatgcaggagaagaccctagagttttcataagccttaagggtttcataattgatatcttcaatcatctttcttccatctccattccgttgccattgatcttcaagaagcaaatgactccattgatgaagaagattcaaggcctacaagctccatatggagctaaatcatgtggtattagagcttgtaggccttggatcttcttcatcaaggagaagatgagtcaagaagaaacttaccaccataagaagccatggataagagcttga

SEQ ID NO: 73512 - DNA, 156 bp, Glycine max
  Peptide Sequence Number=SeqID_165197
atagaggaagcaaaagaacatcacctagatgaagatgctctaatgccacataatgtagctccatgtagagcttgtaggccttggatcttcttcatctatggaggcctttgcttcttgaagatcaatggcaaaaaaatggagaaggaggaaaagtga

SEQ ID NO: 73513 - DNA, 873 bp, Glycine max
  Peptide Sequence Number=SeqID_165198
atgtggatgcttaacaagcttagctccccctacagcgacaccgaccagaaactagcctcgtacttcctccaagccttcttcaaccgcatcacccaagtcggggaccgaacctacaaaaccttagcttcagcttcggagaaaacatgctcctttaaatcaacccgcaaaacatactcctttgtcaccgtcggcgccaatatgcagaaggtcatgaaggaaatcagagccagaatggagaaggaggttgatttggacattggattggaagggtttgagttcgtcaaagggtttgaagaatgtttgaggtggtttagggtttactttgaggccttggatgggagttttccgcggacaagcaacgagcatttgatgcttgagagggaggcggggagggcggtggtggacctggtggcgtgttctctggcggagtccgtagagaggtggggggtttgggttttttggggagaatgggggtggaggaacggacaagaaggtggcgtcggggagaaggtggagatagggaaaggggaagaagagagaagaagaaggggaacaaacacaaagaagaagaggaatggacgtgaagaagaatggacgcgagacttggaaaaatcaaaagaattctcagactgtgtcgttttgaattctttgaaaagggagaagggagacacaaaagaattcaggcgattagtcctttgttattttggaaaagggagaagagagacacaaaaagaattcaggcggttagtccttgtagaattctttttggcaaagggagaagagagacacaaaagaattcaggcagttagtcctttgttcttttggaaaagggagaagagagacacaaaaagaattcaggcagttagtccttag

SEQ ID NO: 73514 - DNA, 537 bp, Glycine max
  Peptide Sequence Number=SeqID_165199
atggaggaaggatgcacaagcattgctgctacgatgttgctaaatcagtttgcgaaggagattaatagaaagaaaaggaaaagagagaaggagagagaaaggaggatcaacaactcaacgatgttccgatggacactgaggtgggattggttcaacaataggtattggaagaggaaattccacaggatgacaactaggccaaacagcattgggaccaaacttagatattattgggttcaaatatgtaaaatgattggcatgaaaggaactgcactaggaccagaaggaagacccatattcatggcaattggtgtagcacgtgcaatggcaggtaatgggttcaatggagttgcagatgtagacaatttcttaaatgggattcccccataccaaacaaaaacaatcaaatggattgtttattcatttggttccaacaattctggacaacttggacatggcaacattgaggagaatgaatatgttcagtccaagtgtatgtatgaggttggtttcgggatggactttttggtattgtag

SEQ ID NO: 73515 - DNA, 375 bp, Glycine max
  Peptide Sequence Number=SeqID_165200
atggtggttgccgtagagttggcggtggtgcatctatggctggctgctactggtcctcctactgctactgctatgcctgaccctattgttgtcctgttaatcggaggccggataagctttgtgggagtaatcgacaccctagagaacaggcaaaggctcgggatcaaggccagaaaccctagtgctctgttggacggggaagtcagaattatgatcgttggggatgatgttgttgagaagcagtgtcatccatatctacgtcagggtggtcatgctagtgcgcatgatccgcacccatctcctcgtcacactctgtgcgaagtcctgtcctcgaatgcacagcagctggcctatggcctcctcatcaaatcctga

SEQ ID NO: 73516 - DNA, 306 bp, Glycine max
  Peptide Sequence Number=SeqID_165201
atgaatgagcagaccgtcggtctccattccccactaaacaaaaaccagagagaggaggaagaggcgagtacgtcgttcatgtcgacatgtgttggcaaggggaaatttccatactgcggactctggcgagcatgcggttggcagagatgtggtggacgaggtggcggcagcgggggcaaaagtggtagagacggagactggggttgccctaacccaagttgtgggaatttgaactttgcgagaagggccgaatgtaacaaatgtggtgctccatctcccactgtttttatcatgttggatgcttga

SEQ ID NO: 73517 - DNA, 231 bp, Glycine max
  Peptide Sequence Number=SeqID_165202
atggcagcggaatggagaaggaagagaaagatgagacgccacttcaaggagaagatgagtctagaagaagttcaccaccataggaggccatggataagagcttggaggaagaaggagatgaatgaagggagagggagagaagagcacgaaattttgtgttcaaaaggagctctgaaatctgaacccactaatccaagatcaattccaagattctccactaagtgtgcttag

SEQ ID NO: 73518 - DNA, 1488 bp, Glycine max
  Peptide Sequence Number=SeqID_165203
atgagaggcaccatgcatgagcctcaagcaaagctaggggcagatcaaagttctcattcatcgatatttcctacatctactgtccaatcttttgaatttggggtgatcgaccctctcgatgagtcaatctcttgctttctcataagggtggacccttgggtactagtacctatcgccttcagagggctgcacgccctcgactttagaggactacacgtcctcaccttcagagaactacatgtcctcgacttcagagggctacacaccctcgccttcagagggctacatgcccttgacatcagaggactacacgtcctcgactccagagggctacacaccctcaccttcagaggatcgcacgtccccaccttcagagggttgcacgcccttgactttagaggactacacgtcctcaactttagagggcttcacgtccttgcattcagagggctacatgtcctcgccttcagaggactacacctcctcgactttagagagctacacgtcctcgcctttagagggctacacaccctcgcctttagaggactacacgtcctcgacgtcagagggatgtacatcctcttcttcagagggctgcacgtcctcgtcttcagtgggctgcatgccctcgccttcagagggctacacgtcctcgccttcagagggttgcacgtcctcgccttcaaagggctgctcgtcctcgccttcaaagggctgcacgtcctcgccttcagatggttgtacgacctcgccttcagtgggctacacgtcctcaccttcagagggctacatgtcctcgcctttagaggactacacctcctcgactttagagagctacacgtcctcgccttcagagggctacacaccctcgcctttagaggactacacgtcctcgacgtcagagggatgtacatcctcttctttagagggctgcacgtcctcatcttcagtgggctgcatgccctcgccttcagagggctacacatcctcgccttcagagggttgcacgtcctcgcctttaaagggctgctcgtcctcgccttcagatggttgtacgacctctccttcagtgggctacacgtcctcaccttcagagggctatacgtcctcgacttcagagtgttgtatgtcctcgccttcagagggatacacgtcttcaccgttagagaactcaagcaacattctgctcagcaaccacaacttcgatctccctctaccgaagtgtcagttggtctgtgccgtcatgacataagcaggcataaggcgaggcaccacaacagcctggggatggccaacagcaagcaacagatgcactgccaccacctccagagttcacctcagctcatctacaaaggctggagcgttgcctacgacctgtggccgaccagcacgcgaccaagtccaaagccaaaggtaagaaaaagtactaggcccgtgaccgacaagtcatcacgcctccagctcaagacgttaaagaagctctactag

SEQ ID NO: 73519 - DNA, 175 bp, Glycine max
  Peptide Sequence Number=SeqID_165204
atggccacaatgatggaggccatgatgagcataaaggagataatggaggtcaatgtgactgcaatagcctctaccggaaccattgctgaggtgtacctgaccccccaatatggcctcaacaaaataaatcatccaacctcagatatggtaggtctggaaggcaaagagttgggag

SEQ ID NO: 73520 - DNA, 621 bp, Glycine max
  Peptide Sequence Number=SeqID_165205
atgaagagctttagtgaactgatcatagacaagatcatgtgcaccctcactcagaattttgatcacatagtggtggcgattgaagaatctaaagatgtagagatcataaggattgaggagctacaaggatttttagaagcacaagaattgaagttgattcaaagtggcaaatcaagctttgcaagcacagagtgttggcacaaaaaaggaaaaggaaagggaaaacaaaaagtaaaggaccaaaaaatcaatgatgcacatgaggattttgattcaggcccagttttgcttatggtcacaaccaataaaggtgctttatcttcagaagcttggtatctaaatactggattatctaaccatatgacaaggcataaggagtggctcattgatctagatacaagtagatccagaaaggtcaagctagcaaatagtagaaccttgaatgctgaaggagttggcaatattcttatcagacgaaaggatggtaagacaacattgattgagagtgtgtggtttgtgcatgaaaggcttgccagaacatcctacactccacaacacaatggtctagcagaaagaaggaacagagcagtacttgatatggcaaggagtttacttaagtag

SEQ ID NO: 73521 - DNA, 193 bp, Glycine max
  Peptide Sequence Number=SeqID_165206
tgctttgaaaggacttgatgatactccacaacctaaatccaaggctgctgctaggtggattgttgttaaggagcaacttgaaatagtggtggacactgtggtacaggggcagtcttggtgtgggcgacaaggaacaaagttcatgaacggttggggcaatgaacttgaagaacacattgggcactccttctag

SEQ ID NO: 73522 - DNA, 504 bp, Glycine max
  Peptide Sequence Number=SeqID_165207
atggaaaaatccgacaagatgaatttcaaagagaagaaagaaaagaaaggatatatcacttgggaagataatgtcataaattattcaagtaattcaaagaagaaaatcataagtctagttggaagtggaagttactggaagttggaagttggaaatgaaagtaattggaagttgaaagttgaaagtggaggttggaagttggaagttggaagggggaagttactaaaggttgaagttggaagttggaagggggaagtggttgtcatcatcaaaaagggggagaatggggagaatgtgaatcatgcaagctttgatgatgtcgaaaagaaatcacatgtttgtcatcatcaaaaagggggagaatgtgaatccttgtttcaagattcactaaagaccaagccttgccttaaaacaaagtgctttcaagacatgcaaggctctggtaatcgattaccaggaagtgtaatcgattaccagaagacagggttgagaaatagctgttga

SEQ ID NO: 73523 - DNA, 195 bp, Glycine max
  Peptide Sequence Number=SeqID_165208
atggcagcggaatggagaaggaagagagagaggagacgccacttcaaggagaagatgagtctagaagaagctcaccaccataggaggccatggataagagcttggaggaagaaagagatgaatgaagggagggggagagaagacccactaatccaagattctccactaagtgtgcttaggtgtcatgaggcatga

SEQ ID NO: 73524 - DNA, 564 bp, Glycine max
  Peptide Sequence Number=SeqID_165209
atgagtgaaatagaggaagtgcaagagcagatgaaggccaacatggaggccatgaaagagcaaatggctccaatgatggaagccatgatgagcatgaaaaaaatgatggaggccaatgcggctacaattgttgccacaagtaccgccactgagatggaccctcctcacccatctggcctcaatcaagtaaatcctccagtctcagatatagtaaggcagggaggcgaagcgttaggaaggacacatgaagcaccccgagaccatactctagccgactttgagcctcaccatggatgtgccattgaggggcaagcagttgtggaaagagtccctcctactatggtggaaagggagaaattggatcatatagaggaaaggctaagggccattgaaggaggcggagattatgcctttgctaacatggcagagttgtgcctagtgcccgacgtggtcattcatccaaagttcaaggtgtcggacttcgataaatacaacgggactacttgcccccaagaatcacctgaagatgtacaacaggaaaatgggggcatatgtgaagaatga

SEQ ID NO: 73525 - DNA, 336 bp, Glycine max
  Peptide Sequence Number=SeqID_165210
atggaaaccatatccaagcggtttgaagagtttcatttttgtggcaaagttactctaaagagtaaactttgggaaattgtttaccctgatctaaactctatgtgtgctcctctagaaaagtcaaatgtagtgcatcatcatctgaccaagctaaaccaagaaggatcataccaatgttggatcaatttcatccatgcattcatgattccactgaaaacattattcatgtcaaagttgatggtatgggtgaagattcattgtctttggttcgcaaccatttgcttaaagaacttgcaaaatggtcttatcagtatatcaacctatttggtggcatag

SEQ ID NO: 73526 - DNA, 96 bp, Glycine max
  Peptide Sequence Number=SeqID_165211
atgggggaggaggttgctgcccagctcgccaagacgagctggtggattagtttagaagaaacattctcacccagattgtgcggcaattggctttaa

SEQ ID NO: 73527 - DNA, 1095 bp, Glycine max
  Peptide Sequence Number=SeqID_165212
agaggaaagtagagatatatcacactgagctagatgagtttaaggctgaattggagaggcgcaatttccataaacgcctcaccaatttagtcgatgggagcatagacttggctttggtgaaagagttctatgcaaatttatacaattctgaggaccgtccaccaaagcagtctatagtcagaggtcatttggtgaagattgatgtggacagtctcaacacattcttggagacacctgtgggccatccagggaagattctcaggaaggatttgactacactagctcaggtgtggagtgtcctctcatactccaacttggcccccacatcacacacttctgacttgacagtggatagagctaggatgatctttggcctagtctctcgcgtggatatgaacataggagcactgatctctggccagatgacctctatagcccaatcgaacacttctagtcttgggttccctgctctgatcaccgcattatgtagagccagaggggttgtctctaatagcctcacttttgagcagctgagcccgatcattaacttggcctacatcaggaagaactgttggaaccccgagtatctaatagtttctatccgaggggttaggagagtgagggctaagctagctgagctcccttccacttctgcggctcctactccagcgtccatgtcagcatctccttctgttccaacccagatagattcccaacgccttgaagccatgcttcagagatctattccctcagttgagaagttcagagagttggtagcctggcttgggactcagtcatctcttcatagggaagatgaaggtcccacaactcaggtaccacaacatatggaggatgagtcctatgaggccactatctcagagccatttactatagaggaggaggcagacgatacacagacgacacaggtagctgctgccactcctgagagatctcttgaggccatttcagaacctccaacaccagcagtggatccatcttcaccacgcaacagacccttccactcctcttctagagatgctagaggacccgactacaccagtcctaactatggagacttctcctccagctactcca

SEQ ID NO: 73528 - DNA, 267 bp, Glycine max
  Peptide Sequence Number=SeqID_165213
atgaaaagtgataaagcctcacaagatatacactctatctctcaagcttgtagtgagcttcaaaacaaggaaagggaaacaaggctcaaaagggctatcaaaggaattaattcaaggacgcatcaacaagaatcaagccaaggctattgtgcaaacaatcaatggggcaaaacacaccaaatgattataatgatggatggctcaaattctcacaaaggtaaaatcatcactttcaaattgagctttcaaaactatcatgacatgtag

SEQ ID NO: 73529 - DNA, 1382 bp, Glycine max
  Peptide Sequence Number=SeqID_165214
ggctacacgccctcgcctttagaggactacacgtcctcgccatcggagggctgcatgtcctcaccttcagagtactaaatgtcctcgctttcagaggactacacatcctcgccttcagaggactacacgtcctcgccctcagaggactacacgtccgcaccttgagaggactacatgtcctcgcgtttagagggctacagtacctcgcctatagagggttacacgtcgtcgccttcagagggctacacgtcctcaccttcagagggctacacgccctcactttcaaaggactacatgtcctcggcttcagaggactacacgtcctcgcgtttacagggctacatgtccacgcctttagagggctacacgccctcacttttagaggactacatgtcctcacctctagagggctacacgcgctcgccttcagagggctgcacgccgtcaccttcagagtgctgcacgccgtcaccttcagaggactacacgtcttcgccttcagagggatgcacatcctcgccttcaaaggggtgcacgccctgcccatcagagggatgcatgccctcaccttccgaggattgcacgtgctcgccttcaaaggactacacgtcctcgcctttagaggactacacgtcttcgcctttagaggactacacgtcgtcgccttcagaggactacacgtcctcccttcaaaggactacacgtcctcgcgtttagagggctacacggtacacgccctcaccttcagaggactacacgtcctcaccatgagaggactacgcgtcctcgctttcagagggcaacacgccctcgccttcagaggactacacgtccttggcattagaggggtgcacgccctcaccttcataggactacacgtcctttcctttagagggctaaacgtcctcagcttcagagggcttcacgccctcaccttcagaggactacacgtcctcgccttcagagggctacacgccctcgcctttagaggactacacgtcctcaccttcagaggactgcacgtcctcgcctttagagggctacacgacctcgctttcagaggactacacgtcctcgcctttagagggctgcacggcctcaccttcagaggactacacgtcttctccttgagagggttgcacgccctcacctttagaggactacacatcctcgcctttggagggctgcacgccctcaccttcagaggactacatgtcctcgccatcggagggctgcacgccctcaccttcagaggactgcgtatcctcacctttagaggactacacgtcctcacctttagaggactgcatgtcctcaccttcagaggactgcacatcctcaccttcagaggactgcacgtcctcgcctttagagggctagac

SEQ ID NO: 73530 - DNA, 477 bp, Glycine max
  Peptide Sequence Number=SeqID_165215
atggcttctccacctgcctcccttcctcctcctccccctcctcctcctcctgctccttcgaacgcatcggctttgccaccacttggtgccaagagaccaatagttcatgttgatcctgctaccggcaaggccgacggtccccacaggaagaaattaagaacatatttggggattgtggtgcgtgataaggtggacgtcacctacgagaactggaaggaggtccctactgctcagaaggacctaatttgggaggatattcaggtggaatttgaaatcctagaggcttctgatagtaggacgaaaaggaagttacttcagaccgtgggcgagagatggaggcagtttaaatcagacctcatgaggaaatgggcccttgcagccgatcaggacggtgtggaggacattgtatgtgagaaatacgacatcagcaaggaaaatggcccagttttgccagactggcagagacccttcttggag

SEQ ID NO: 73531 - DNA, 141 bp, Glycine max
  Peptide Sequence Number=SeqID_165216
atggaaatttatgtgagtgatcgactaggaaaaaaagttgtcatcatcaaaaagggggtgattgtagaagcaaagcttcatgatgaatcaagaatgattcaaagatattttgatgataacaaagatgataacaaaagatga

SEQ ID NO: 73532 - DNA, 84 bp, Glycine max
  Peptide Sequence Number=SeqID_165217
atggctgatttttcaagtttaaaacggcaacgaactgcagccataccaagtgctcctggtatttttcacacaaaatatggataa

SEQ ID NO: 73533 - DNA, 177 bp, Glycine max
  Peptide Sequence Number=SeqID_165218
atgaagctttgcttctacagcaagatgagaggccttccgggtaccggtggcataagcacgggaagttcaaacgcctcaggaagcctcgaacctgcctctcggtacgggtttatggcatctcaaggatggctttcaccttttcggggtccacctctatccctttctggcttacgatga

SEQ ID NO: 73534 - DNA, 378 bp, Glycine max
  Peptide Sequence Number=SeqID_165219
atggcgagagtgcccagaattcgttgcacgcgcaccagttcggcaaggcgtgagtgcccagaattcgtggcgcgcgcacgtggtctgtgcgctgccgaattcccgagaaacccgactttcgttcacgtgacgaatatagtggcagggggcaaaaacagccgttcggcaaggcgtgagtgcccagaattcgtggcgcgcgcacgaggtgtgtgcgctgccgagttcccgggaaagccgactttcgttcacgtgacgaatatagtggcagagggcaaaaacagccgttcggcaaggcgtgagtgcccagaattcgtggcgcgcgcaggtggtctgtgcgctgccgaattcccgggaaacccgactttcgttcacgtatag

SEQ ID NO: 73535 - DNA, 516 bp, Glycine max
  Peptide Sequence Number=SeqID_165220
atgggtgggaatggactttctcttggagatgaaatttgtttgacactgagcagtcttctgaagcccaatgtctgggtttccaacagctttgggatattaaaatccctcctaaagctttatcatttgcttggagattgctttgggataggcttcctactaaggataacctatctaggacataagttgagattgacaatgatctctttcccttctgtcaaagcctacctgagtccgcctctcatctgttcttcacatgtggtaaagtcttgcctttgtggtgggaattcaattcatgggttagggaagatagagtcctccactatagcccgatggataactttcttcagcactcaactacagcaggaaggaaggaaatcaatagaagatggaaaatatggtggttggctgctacaaagtcaatttggaaactcagaaatgacatggtgtttcatgatcagtcttttgatatctctaagctggtggacaatacaaatttcctcacttggtcttggctga

SEQ ID NO: 73536 - DNA, 321 bp, Glycine max
  Peptide Sequence Number=SeqID_165221
atgtaccctaaggctcgtaagaaccctagggccttttcttgcatctctggcccaatcttcatggagtcttctatccaatgcccttggaggtatgattgcatcataaaggactccattgatgaagaagatccaaggcctacaagctccacatggagctacatcaggaacacttggagaaatccaattaagggagaagggagacacaaaagaattcaggcagttagtcctttgttcttttggaaaagggagaagggagacacaaaaagaattcaggcagttagtccttggcgaattccttttggcaaagggagaagagaatga

SEQ ID NO: 73537 - DNA, 820 bp, Glycine max
  misc_feature (3)..(3): n is a, c, g, or t
  Peptide Sequence Number=SeqID_165222
ggnttgtattaactacaatcccgcacttgctataagacagttagggtaccccatgaggggagcaccggcggaagagagcctctctcctttctttgtgagagattgtagcgcgcaaagtttcaagattatacaaagagtccacaaggcgggggaaagcccgttaaggaaagataaagaacttaggggcatccgtaatggcatcatcggtggttatcatgaatggctgaaagttcgtacacgagggttagattggctctccaagttgaaaattatcaacgaggataacttcgaagctccggaagaggatgaagaagtccgagctctaaaaactaaactaggaaaagcaagacttgccaaagaaaaattcaaggctcgcaaggaagagcatggccgagacaattccgtggagctttgtggggcagcaacaatgagctcaagcttcgaaggggagagagaccaatcacgagcacatagcatggtcttaaaagaggagttagctgcttgctcaaggtccaagagaagcttgtctcagtgtttatgcgagacagagaccaacatgttagccatcgtcagcaagtaccaagaagaattaaatctagccacggcccacaagtacaaagtggtgaacgagtatgcccgagtgtatgcggaaaaggaggctagaggaagggtgatcgactcgttacatcaagaggaaacaatgtggatggaccgatttgctcttactttgaacgggagtaaagaacttccccaattgctagccacggctaaagcaatggcggacacctactccgcccccaagcttctcagctcgtgctag

SEQ ID NO: 73538 - DNA, 504 bp, Glycine max
  Peptide Sequence Number=SeqID_165223
atgcaaaatagtggggtcaccctaagggctgaatctcaacacttcgccagtgcacatgatgacaatccatatgtagctttcatcccttactttgggcatatggctactccacctagctctcctcctcctcccacagaagctatatcacagtcaccgtctgctttgaagcagacaagaaaagccacacgactacgatcattggcgactagaccagttggggctgacagaccggtggtccacgtcaatcctgctaccgggaaggctaacggtccccacaagaagaaattaagaacatatttggggattgtcactcatgataaggtcgacatgacatacaagacttggaagcaagtccctgctgctcagaaggatttgatatgggaggatattcaggcacttgcagccgacaaggacagtgtcgatgacactatatgcaaaaaatacgacattagcaaggagaaatggacccaattttgtcagagccgcagagacccctcgtgggag

SEQ ID NO: 73539 - DNA, 1290 bp, Glycine max
  Peptide Sequence Number=SeqID_165224
atgttgctaagtagcaacgtcatccatatctgtgtaggagtggtcatgttggtgtgcatgatccgcactcatgtctttgtagcggcacgggggggtgaccaagggactgataaagggaaactactggcccctcacccgggagcgcaagtctcggcgaggacgtgtagtcctttgaaggcaagggcgtgtagccctctgaaggtgaggacgtgtagtcctctgaaggtgagggcctgtagccctctgaaggcgagggcatgtagccctcaaaaggcgagggcgtgtagccctctaaaggcgacgacgagttgccctctgaaggcgagggcatatagtcctctgaaggtgaggatgtgtagtcctctaaaggcgagggcgtgtagccctctgaaggcaagggcaagcagccctcggaaggcgagggcgtacagtcctccgatggcgagggcgtgtagtcctctgaaggtgagggcgtgcagccctctgatggagaggacatgtagtcctctaaagggcatgcatgcccctctgaaggcgaggacgtgtagtcctctgaaggtgagggcgtgcagccctctcaagacgaagacgtgtagtcctcttaaggtgaggaagtgcgaccctctgaaggcgaggacatgtagtcctttgaaggtgagggcacgtagcccttggaaggtgagggcgtgcagccctctaaaggtgagggcatgcaacactctgaaggcgagggcatgcaaccctctgatggcgaggacgcgtagccctctaaaggtgagggcgtgcagacctctgaaggcgaggacgcgtagtcctctaaaggtgagggcgtgcagccctcaaatggcgaggacttgtagccctctgaaggcaagggtgtgcaaccctctaatggcgaggacgtgtagtcctctaaaggtgagggcttgcagccctctgatggcgagtgcatgtagtcctttgaaggtgagggcgcagagccctctaaaggtgagggcgtgcaaccctctaaaggtgaggacgtgcagccttctaaaggtgagggcgtgtagccctgttatgtcgaggatgtgtagtcctctgaaggcgaggacgtatagtcctatgaaagcgaggacgtgtagccctctgaaggcgaggacgtgtagtcctctgaaggcaaggatgtgtagtcctctgaaggcgagggcgtgtagccctctgaaggtgaggacgtgtagtgctccgaaggtgacagcgtgtagctttctgaaggtgagggagtgtagtgctcaaggacagaacgtgtag

SEQ ID NO: 73540 - DNA, 324 bp, Glycine max
  Peptide Sequence Number=SeqID_165225
atgcagctatcgcaagagcccatgaacaagaaaccaagaaggctcgcaaggaagagcatggccgtgacaaatttcgtggagctttgtggggcagcaacacgtttatgcgagacagagaccaacatgttagccatcatcagcaagtaccagaaagaactaaatctagccatggcccacgagcataaagtggcggacgagtatgcccaagtgtacgcgaaaaaggatgctagaggaagggtgatcgacgcgttacatttagaggcaacaatatggatggaccaatttgctcttaccttgaacgggagtcaagagcttcctcgatga

SEQ ID NO: 73541 - DNA, 1107 bp, Glycine max
  Peptide Sequence Number=SeqID_165226
atgggccatcgggctggcatcctcggcaaactgcgcgccgcgcatcacgcgcacattatcaatacggttgaccgcgcgcgagccgagatcggaactgaactcctgatcgcggaagaccgtcagaccttctttcaggctgagctggaaccagtcgcggcaggtcacgcggttgccggtccagttgtggaaatattcgtgaccaatcacggcttcaatgccgagatagtctttatcggtggcggtttccgctttggccagcacgtatttggagttgaagacgttgaggcctttattctccatcgcgcccatgttgaagaaatccaccgcgacgatcataaagatatcgaggtcatattcgaggccgaaacgctcttcgtcctacttcatgctggctttgagcgaggtcatcgcccagtccgcacggtcgaggttgccgcgatcgacaaaaatttccagcgccacgttacggccggaacgggtggtaaagctgtcgcgcagcacatcgaaatcaccggcgaccagcgcaaacaggtagcagggtttcgggaacggatcctgccatttcacccagtgacgcccatcctcgtgctgaccgctcgccagcttgttaccgttggacagcaggtacggatagctagccgcgtcggcgatcagggtagtggtgaagcgcgccagcacgtccgggcgatcgagataccaggtgatatgccggaagccttcggcttcacactgggtgcagagcgcctcgccggatttatacagcccttccagcgcggtgtttttatccggatggatttcattaatgatggtcagggtaaagttgtccggcagctggctgatgatcagtgcgccctgctcttcgcggtagtgcggccacggattgccatccaccgccagcgacagcagcgtcagcgcctcaccgtccagacgcaattcagcctgctgtgcgccaaggcgttttacctgactgacggcggtgacgcgcgtggtcgccgcatcaagatcaaacgtcaggtcgatatcggtgatggtgtagtccggcgcccggtagtcgtggcgatatttaatttgcggctgttgcgtcataaatccttctcgcatcgttaa

SEQ ID NO: 73542 - DNA, 222 bp, Glycine max
  Peptide Sequence Number=SeqID_165227
atgccagcgcagccagacacgctccagcagctgtgccgttacgtcggccagtttgcccagcagggcatagagaatgatggcgaccaccaccacatcggtttgcagaaactcacgggcgttcattgccagatagccaataccggagttggccgagatggtttcggccacgatcagcgtcagccacatcagaccgagggcaaagcgcacgccaaccataattga

SEQ ID NO: 73543 - DNA, 195 bp, Glycine max
  Peptide Sequence Number=SeqID_165228
atggagcagcgaaaacagcaggcaacagcgcttttaatcattcttaccttgcccgtgacggaagccgctaatgaaaacccggcaatctgcggtgaccatgcgggttattacgctggcggggagtccgcgttttccttcacgttccacggcgctgctgagtgtgtgccagcgggcgctggaagcgcgtggcgttga

SEQ ID NO: 73544 - DNA, 624 bp, Glycine max
  Peptide Sequence Number=SeqID_165229
ccgctgatgccgaaaagctggcacttcaccagccatgcgcacagctggcagcccgtcgcgggcgatatggtggcggtaacgctggccgacagcggcgaacaggcacagctgctggtggtcgaaagcggcgagaatgccgcgctctgtctgctggcgcagagtgcgctgacggtggcgggcaaagggatgcagctcggcgatgccatcaagatcatgaacgatcgcctgcagccacagttgcaggagagcagcgcgcccttcgcccgcgcgcgccttcacgtcacccgacaccagcgttattttgcagctgccgcagattccggcccgacacgaatagggaatgcgaaagccctgcatctccagctgttccacgtttccaccacctcaccggcaccgtaagcgcgcggcgtctgccgttccagcacttcaaccgtatcgccgacgcgcacgataccgctgttaagcgcaatcagattcaggccgaaatcgatatcaccgctgccgtcctgcgcgctgcgaaagcgctgcagcgtggcgagcggttcgccctgcggatgcttgcgaccgctttcggtgccgatggtggtaaacacgcagcggctgcacggcttcggcatctcgaag

SEQ ID NO: 73545 - DNA, 291 bp, Glycine max
  Peptide Sequence Number=SeqID_165230
atggtcattaccaagttcaaggtgccggactttggcaagtacaaggggactactcgctccaagaaccatctaaagattgtcagtacaattctaatatggctccggataggatgcaactacaaaaagtgtgcaaaaagggggctcgaatctttcaaagaatacgcccaaagatggagagacttggcaactcaagtagcacccccagaagctcccggcgatggagaagaagcccacgaggatgaggagatggccgatttgcttgacttcttgggagggagtggagatacgtga

SEQ ID NO: 73546 - DNA, 213 bp, Glycine max
  Peptide Sequence Number=SeqID_165231
atggttaatcctcctgctaagactggtaatgataatactaataatactgctgttataactactgaccatacgaataatgatacttttgaccattttaatcctgcgattttcatattaaatactgtagttaaaaagttaatagctcctactaatgaagaagctcctgcaatatgtaaacttaaaattcctacatctactgcatgtcctggatga

SEQ ID NO: 73547 - DNA, 274 bp, Glycine max
  Peptide Sequence Number=SeqID_165232
agagcttaagacttattttgattcaaaaatccagccacaactcagcaccactgtcgcaacgtgcccttcgcgggcgagcgagggcgaggctcacgggaaaccggtcaaaatgaaaattctaagttcgggagttgtatttacgcttgaggaaggtattagcacctctcacgtcgacaaaagcggggcttttgctcctacgtaccctactttggagaggaaatcagacctacgtagttcttccttaagcgtgaatcaagcgattctttttacttga

SEQ ID NO: 73548 - DNA, 480 bp, Glycine max
  Peptide Sequence Number=SeqID_165233
atgaaggtcgacatggaggccatgaaagagcaaatgaccacaatgatggaagccatgatgagtatgaggaaaatgatggaggttaacacggctatagtcgttgccacaagtaccgccactgaggtgaacttgactcacccatctggcctcaatcaagtccagagcaagcatttcttcccaccatatggcttgcctcccaaatatacaccacccaatgttgcacacactcccgataacaacatcgataactctgctcccatacccattgagagccaacaaccccaatctggtcatgcaccgtacactgagaccactgagggacaagcatttggtggcatacccctgccaaacactttgggaggacctcagtatcgcccacaaccacaacctttgcattttgcattggaaagactgcctcctgccatggtggaaagggagaaatttgatcatatagaggaaaggatgagggctattgaatga

SEQ ID NO: 73549 - DNA, 666 bp, Glycine max
  Peptide Sequence Number=SeqID_165234
atggtgggaattgtaacatgtggatgtggtggtggtgaagcaaagcagggctctcgtggcgtggcattttccgacgaggaggtgcggctggcggtgaggcacccgaagaagcgggcaggtcggaagaagttccgggagacgcgccacccggtgtaccggggggtgaggaggaggaactcggataagtgggtgtgtgaggtgagggagcccaacaagaagaccaggatttggctggggactttccccacgccggagatggcggctcgggcgcacgacgtggcggcaatggccctgaggggccggtatgcctgtctaaactttgctgactcggcctggcggttacctgttcccgccacggccgaggcaaaggatatacagaaggcagcagcagaagctgcccaggctttcagaccagatcaaaccttaaaaaatgctaatacaaggcaggagtgtgtggaggcggtggcggtggcggtggcggagacaacaacggcgacggcacaaggggtgttttatatggaggaagaagagcaggtgttggatatgcctgagttgcttaggaatatggtgctcatgtccccaacacattgcttagggtatgagtatgaagatgctgacttggatgcccaagatgctgaggtgtcactatggaatttctcaatttaa

SEQ ID NO: 73550 - DNA, 180 bp, Glycine max
  Peptide Sequence Number=SeqID_165235
atgacctttcctccaaaaggcactggtataacaaacttagaatgtgttgttctacctccgggcagtagtaatgaagctatcccacttgaagcaactgttaaaacaatgcctccattagaccgtatagcagatgataaagttttccagacaaaggtcttgctagtgccaccatatccatag

SEQ ID NO: 73551 - DNA, 672 bp, Glycine max
  Peptide Sequence Number=SeqID_165236
atgggaaaaaccaaaagtcccttcacatgccaaaatctccacacgctaaaccctagacctcgatgtcgcaccttcaagcttttttgtcgaccttcttcttctgccgtcgcacacaccttgccttgtctctccggcgacctggaccgctacctacgctgctccatgccacagaacttgtcgctccgagtcacggttcttgttagcggaggcttcgatagcagctctctggctgctccacgccgtcggccactcctgcactgctttctacctcaagatattgttccaaattatgctcaccaagacacattactaatggaaattttgcaggttgatgtaccgttagaagtggttcatttaaccgatgaatactggaacaatgtggtcatatttctttactttcaatgctattctatgtttgtagttgctcacttgctccaaatccagatgtttgtagttcctggaagtggtggtaatattttaacaaagatatgcctgcttccggtctgtctttcagccaatacaattggtggtattgggttgggtaggggtggtggtggattatcagaccattcactagctgatccttctgtcatagggcatcatgggggtggtggtccagatctagcacaccaaatggacggggtgttaactatggtggtcagctacctgtag

SEQ ID NO: 73552 - DNA, 639 bp, Glycine max
  Peptide Sequence Number=SeqID_165237
atggggaagaacaagggtcgtcaatcgcacttagctgtaaagcaaattatggtgaagggtactacctcaggttcacgtaaatcccaaacatctgatacttctggtctggctggtttcttggatgttgtccaagcaaatcagaatgcttatactgcttcacagaataatcttgtaggcaaggtgctcgtaaaaaaggcagggacaagttctgcaaaaactgatgatgtcgcacaccaagtgtttgataatttgtcagaatgcaatgctaaatctgaatctttcccagaggtttcttgcaccttaggggacaatgattcaaccactgatgatgattcatctcactcctgtggctctaagtcatcaccgcagctagatgacaataagactcccactccttgggtcaatcttttcaaagatagcagaagcccttccaaaggttttggaatgaagttctcccctccaccctctgatgatgaagtgctgttggaagaaattgatttgcaacccctggaagaggcttggggacatagccttattggctatgtggctggccacttcctaggaaagaaagctctgctggattgttgccaaaaatggggagtcaagttttcattctcagctcatgcaagtggttggctg

SEQ ID NO: 73553 - DNA, 228 bp, Glycine max
  Peptide Sequence Number=SeqID_165238
atgactcactcagcgaggcagatccgctcagctagtggcatccgcttagcgaggcatacaactcacttagcggattgggaaaccctagaagaggataagctagagatgtgctcacccagcgtgcagccagcccacccagcaaggatgttgtcttttctcgcgctcagcgtgccctatctcgctaagccaaaattcacttactctcacttagcgagtcagtctcgctaa

SEQ ID NO: 73554 - DNA, 201 bp, Glycine max
  Peptide Sequence Number=SeqID_165239
ggtatacttaccctatgtgggatgcatgattcacaaggcaaacccattttgctctgcgcttgcaatgataatactgtacacctctatgatctgccatcctgcaagaagggaattcgggctgacgttgggattgagaagaggcagaaaaagagagaatctgagctgtggaagtatccttggcacaaagctgtgctcaagtag

SEQ ID NO: 73555 - DNA, 669 bp, Glycine max
  Peptide Sequence Number=SeqID_165240
atggcggagtgggttgagctttcaagcccaaagacttcaaaaggccggtttgtcccgaaagggcatgtaggcttatttgggttggaagtggttcggtttgagggttcgtatcctcagaagtgtggtcctcatccgcggcaagaagaaaaaatcgaggggcacaacgtgaggcgtcagacgggaagaggaggaggtttggccgaaaagggtaagaggggtaggttagggttgttggtggaaacaggggctggtaagggtggagcaaagggagttgtggaaggtggtggggcaaaggatggtcctgaagatgctaaggcaaaggtgggtcctggaggtggtgaggcaaagcttgtcttcaatgaggcgtgcaagtcccgtgacatgcacaagggaaaacggctggagagcctgcacctcgcgacggatgttggggtcgaggctagagataaagcagctgaggagaaaggaagagggcaaaccaacaatcctgttggtgagggcttcgaagttgttcaggatcctcgtacagcgagtgggcaaatcgggcctcaatggcttgaaggaaggaaggccaagtgggcgttggaagcaagtttggccactgtctcctctaagcgttccatgttcgatttagaacatgttgtgtcagccatgagaagaaggcaatga

SEQ ID NO: 73556 - DNA, 132 bp, Glycine max
  Peptide Sequence Number=SeqID_165241
atggggagtgagagactaagttggacatgtggtgatgaagtggaattgggtgagtggcactgtgggggcaagtttgacaaagtcataataagaacagttggaagtcatatttggccatcccaactttcgtaa

SEQ ID NO: 73557 - DNA, 210 bp, Glycine max
  Peptide Sequence Number=SeqID_165242
atgtgtagattggtgttgcgttgtgacttaggcggtggacgaggcagcactgtacctaacttggaagcgctccaacagtgcattgttgtggctctgatcaaaagcttcctcgacaaaggattggatgatgaggaaggtcgtgacagtagcggtggcgaaggtgcttcgattgagaaaatttttcatctcaaaataaggctctgtgtttag

SEQ ID NO: 73558 - DNA, 1941 bp, Glycine max
  Peptide Sequence Number=SeqID_165243
atgcagacccttaatgaggtctcacaaacatgccctcaatgttgttgttgcagctgcacaaccccatttttcaactcaccaacatcacaacaacacaacacagcaccaaaaatcagaaacagttctgccgagtggcgccacagcttcgcggtcacaacaacatcctctatattcccaaacactcaattcacaaaccatgagtctcttccatcgcttcatgaatcattcaatgagttcaccaaagcgtacactcagtattctgagactgaacaagttgaccatgttagagccaaggactattcccacctctcactctccaaccaaacttgccttgattacattggcattggcctcttctcttactctcaacttcaacaccatgaaacatcaaaaggccaagtaccctcatcttcaattcctcaaacaccacctaattactcagatattccattctttagcttgtcttgcaagactgggagcctaaagactttgttgcttcatggagggcaagacacagaatttgaggctgcaatgaggaagagaatcatgagtttccttaacgtatctgaaaatgattacttcatggttttcacagcaaacagaacctcagctttcaaacttgtggcagattcataccaattccaaactagtaggaggcttttgacagtttatgactacgagagcgaggcggtggaagtgatgattagctcctcagagaagagaggagccagggccatgtcagctgagttctcatggccaaggctgaggatccagacaacaaagctgaggaagatgattgagagtaagagaaagaagaaaaagaagagaaagggtctatttgttttgccacttagttcaagagtgacaggagcaaaatatccttatctttggatgagcatagcacaggagattggatggcatgtgttggttgatgcatgtgcattggggccaaaagacatggactgttttggcctctctctctttcaaccagactttcttatttgctctttctacaaggtcttcggggaaaacccttctggatttggatgccttttcatcaagaaatctgctatttccagcttggaatcttacccttctgcaggaattgtcaaccttgtaccagaaaagcagcctcatcaattatcagatgattcttctggcactgacttggaacttaaaaacaaaccatcaccagcatgcctacatgaagagaaactatttcctttatcatatttctcaggtccaatgcaaactaaacaatcagaaatagttgaagaaggagaaccacctgactcaaaattaaaagctcctcaatgttctgaaattgaggaggtacaacaagaggcagttcagaaccttaagaaaagtagtaaagtcgaagaaactgacattcaatgtaggtgcttagaccaagtggattctttaggattgattctcatcactaaccggtcaaggtaccttataaactggcttgtaaactcaatgcggaagcttaagcatcccaacacacaaggggttcatttggtcaagatttatggtccaaaagtgaaatttgatagagggcctgctttggcattcaatatatatgattggaaaggtgaaagggtcgagcctgctcttgttcagaaacttgctgatagaagcaacatatctatcagctatgcattcctgcatcatatttggtttgctgataagtatgcagaagagaagggaaaagtcctacaaaccaaagtggttggaggccaagaaggagtgatgacaacaaccaacaagaaagatagtgttggaatcagtgtggttactgctgcattaggcttcctagctaattttgaagatgtctataagctttgggcttttgttgctaggttccttgatgctgactttgtggagaaggagaggtggagatatattgctatcaatcagaaaatagttgaagtttag

SEQ ID NO: 73559 - DNA, 1763 bp, Glycine max
  Peptide Sequence Number=SeqID_165244
atgcggctaatgcagctggaattgtggtcactatgctgttgcgaagagccgtagtttttgccacaatccttgatattgcagaaaatggcaattgtagaaaaatgcaactgatgcggctgcaattgcagtcacgatgctgtcacagagagcccaatgaccttaactttgcggctgaaaagcacggtcacagaccgctttttaaaaccttgggatactgcttgcgtgcaggtcaatccaatgatctcacaaaagaagattgcaaggaaacaagttcagtggttgtttgcttcggggaaatgttaatagactttgttccaatggtgggaggagtgtcactggctgaagcacccgctttcaagaaagctcctggtggtgctcctgccaatgtggctgttggtatctctagactaggaagttcatctgctttcataggcaaggttggagcagatgaatttgggtacatgttggctgacattttaaagcagaacaatgttgagacttctggcatgcggtttgactctaatgcaagaactgcattagcttttgttacacttagagcggatggcgaacgtgagttcttgtttttccgcaatccaagcgctgatatgctccttcaagagtcagaacttgataaagatctcctaaagaaggctagaatattccattatggctccatcagcttgattgatgagccatgcaagtcagctcaccttgctgctatgagcattgccaaaaactctggttgcattctatcatatgatccaaatttgagattggctctatggccttctgcagacgccgctcggaaaggcataatggatatatgggatcaagctgatgtcataaagataagtgaggatgagattacatttttgactggtggtgatgatccctatgatgataatgtagttttgaagaaactttttcacccaaatctcaagcttttaatcgttactgaaggttcacagggttgcagatattacaccaaggcatttaaaggcagggtttcaggtgttaaagttaaacctgtagacacaactggagctggcgatgcatttgttagtgggattttacactgcatagcttctgaccaaactatttttcaggatgagaaacgtcttcgaaaggctttatattttgccaatgtatgtggtgccctcactgtaactcagagaggtgcaattcctgcactacctacaaaggaagctatcttgcaattcttactagaagcagctcgtgagcttgcaaatcttggattggagatgaagcttacatctggaccaaagaaagcagcgctggaacatatgagagagaagatagaggcatcaaccgagaaaattcgtatgacaaagataaatgaagaacaggcacggaaggtagtggcacgcggtggaggagatggtgcaagtgatggcacgacggaagaaagggaggatgggagatcaagttcttctcaggatagtgcaatccaagatggctccactgtttccagcacaagggaatcaaatggaggaacggctgggaatgttccataccaaaataatggtcagaaagttccagtgaccaatgagcataaactgcagcctcctagtgaaggagaaggaagaaacaaaaagaaagttaactttcgaagaggaaaagggattggtgcagtgcccaaaactaggtcttcaactcctgacatggttccagctttaatgcagatggaagaacctgagagtactatggtaatacgttactgcactaaatacatttttggctga

SEQ ID NO: 73560 - DNA, 429 bp, Glycine max
  Peptide Sequence Number=SeqID_165245
atggatgaagttggtagtagctctgagtggagcaaagaacaagataaagcatttgaaaatgccttggcaattcatcttgaggatgcttcagaccgatgggagaagattgtggctgatgtaccagggaaaaccttggaagagattaaataccactatgagctcttggttgaagatgttaaccggattgaatctggttgtgtgcctttagcatcttataattcttctccagagggctcaacaagccaaggagctggcaagaagggaggccactcttggaatagtaacaatgaatctaatcatggaactaaggcttcaagatcagatcaagaatggcgaaagggtattgcatggacaaaggatgaacacagtatatgtcattttgaacagcacaaggtaggttcgattgcactgtggcagaggcaattctga

SEQ ID NO: 73561 - DNA, 870 bp, Glycine max
  Peptide Sequence Number=SeqID_165246
atggacgaattgagtcaaagagatggtctaggatcggtgtatggattccttgagccgcaggctatactaaatgcaaatgatagacgtggacaatgtcaagaatacattgaaaaatggcttaaggaatcgaaccgacatgtctatctaggcgcttatttgaataatgcatttaagactttggaaaccaacagtgaggggaaatttggtcacagtacaccgcggtggattgaactgaagagtcacgttcaaagtggagcctatgagtgtggctattatgtcatgcattggatgtggaacataatcgtcgggcagttgaagactaattggacgctgtggttaaatgatggcacgccgctagacatcgacacgatcacaacattacggaaaaaatgggtagaatattttgttgagttggttcttgcccagtttagaagagctaacgggaaggttgatgaaccagctgtcaggttgagttgtttatattacaactctagatctttcaacaaaccccatgtctctgatgcttctttgactctctcaacaacccttttgttcaagggtaatataagacataattcattttgctattacttgactcaaatattttacttgtgggatacaataccgagacaagttctgcacaagaagcctacaacactgctccatagtttagaggcatggattgttgcttttgaaattgaatatggacaatgggttgaagagaaagaaaggcggaatgaagaacttagacatgcattggctgctactatggaaaaatttaaggcactagaaggttttgtaaaccagcttgatttcgcttgcatggccccacgccattccaacggcactaacttgctcatatacatataa

SEQ ID NO: 73562 - DNA, 204 bp, Glycine max
  Peptide Sequence Number=SeqID_165247
atggacgacgatcaatgggcatattacagtgtgatgtctgaagaagttgatatggattttcaaaatgaagaagattgtggtgtgaatgaaacacatgttgattgttcagatgcttttaatacttctcaggtctttgaaacccgagaagatgttttggagtgggctcgaacggttgcccatgaaaatggttttgttgcagtaatt

SEQ ID NO: 73563 - DNA, 705 bp, Glycine max
  Peptide Sequence Number=SeqID_165248
ggactcacactgcctcctgagcctgaggttggtccttcagctgctcgtatcagcacaaaggagagttgtgttgatccctcagggaacgatccaaacacgggtgactcaaacaaatacgagttgtacatcgaagaaaatcctccccacctggttgccctaggaagactttataagggatccataaccattcacaacattcctttgctgcatgatcaagtcaaggttggtgttgaggaggttagagatgcagatgctcccattcctgtacccactgaagaggttaagttagtggggcagacacttaacatcttccttccttggccaacacgtcttgtcaagcgtttatcagaacaaggagctatgggaccggcgaaacctgcagataggccagatcatgatgtcgatgatcccctatatctgatgacattgaccatcccacaggtttttctaatgctggcgaggctcacgggtgcgctttctaaaggaggaaagatgcgcggagtcgccaccaacgtttatttgggaaaacgttgggaaaaccgaaggaaaccggtcaaaatgaaaattctaagtttgggagttgtatttacgcttaaggaaggtattagcacctctcacgtcgacaaaagcggggcttttgctcctacataccctcctttggagaggaaatcagacctacgtagttctttcttatgcgtgaatcaa

SEQ ID NO: 73564 - DNA, 105 bp, Glycine max
  Peptide Sequence Number=SeqID_165249
attatggttagaaccagaggtttgggttgggctttaggtagagttataagaagagccctagggagagaagtttttcaggtggaccccacgacacatcagctttga

SEQ ID NO: 73565 - DNA, 243 bp, Glycine max
  Peptide Sequence Number=SeqID_165250
atggggaataagtgggaagtaagaaaaagtagtaaaccccaaaaccaaaattacaaattaagctttcaaaagctcatttggctagaggcttataataacaaaatgcctaaatcatctcccaacatgcatgtgaagcaagaagtatcaacaagagtcaagccaaggctattgtgcaagcaatcaatggggcaaaacacaccgaataaaatagatgatgatggctcagattctcaccaagggtaa

SEQ ID NO: 73566 - DNA, 576 bp, Glycine max
  Peptide Sequence Number=SeqID_165251
atggctgcaagtgacattgctattcttagagatagagcccacataccaacaaagaaaaggtgtgccatctgtggtggagctcacaattctggctgttgtatccccaatgaagaaccagctcatgaagtcaattatatggggaatcagccaagacaaaatttcaatgcaggtggatattcgggatttcagcatggccaaccatataattcacagcagggacagtggaggaatcaccctggaaaccagttcaacaaagaccagggtagtccatctacaaggccacaacagcaaggtcctagtctttatgatcgaacaacaaagctagaagagactctagctcaatttatgcaagtatctatgtcaaaccataagagcacagagtctgccataaagaatttggaagtccaagtcggacaactggcaaaacagttggcggataggccgtcaagtagctttagtgcaaacactgagaaaaattcaaagaaagaatgtaaagctgtaatgacaaggagcagaatggcaattcaagcggatgaaagtagagctgaagagaaggtggagggttataaacaatag

SEQ ID NO: 73567 - DNA, 519 bp, Glycine max
  Peptide Sequence Number=SeqID_165252
atggaagagctttttaagaggtggaatgaatatcttgacaacacacgatcaagggtcagccaaccaccattgatcaattatgatttttgtggaagagagcattacaatgacaattgtcatctctactccatgaatgactctaggtgggaacaggagttaagtccttacaatcaatatgaagaagaaagaactcctaatcttgaaagtgtgtttgaggaattcatggcataccatgatatctcaaaagccaatcaaaattcaatgaaaaatcatgaaattcattttggcaagagctactcaatagaaaaattttcaaggggaccagagttacaaccctactatcaaaatgaagcagaaagaggttccaatctggataatttgttgatgcaattcaaggaaacaactaaatcaactcaacgagcattccaaagtgcaaaaatccaggttggtgagctggcagaagaagtgactcaatttatggccagaagagaaaaagactttgtagaggttgaagcttaa

SEQ ID NO: 73568 - DNA, 274 bp, Glycine max
  Peptide Sequence Number=SeqID_165253
acttcaaggtgggggacccttatacaccgttaggcataacattgatggggctccgaaaaaagtggagaatggggaattggcgaacagcgctactgcaataacttcgcggggctccagactcgaaggtggaggacacatgaacagcgctttggcaataacattcatggggctccgaaaaaagtggagaatggagaattggcgaacagcgctacgcaataacttccggggctccatactcgaaggtggaggacacatgaacagcgctaggcaataa

SEQ ID NO: 73569 - DNA, 162 bp, Glycine max
  Peptide Sequence Number=SeqID_165254
atggtttttcacttaaggcttgtaatgagcttcaaaacaaagaaaggggaacatagcctcaaaggggctatcaaaggaattaattcaggcaagtatcaacaagagtcaagccaaggctattgtgcaagcaatcaatgggacaaaacacaccgaataaaatag

SEQ ID NO: 73570 - DNA, 243 bp, Glycine max
  Peptide Sequence Number=SeqID_165255
atgtcacctgacttcacgggtcaggatttcaaaggtgcagaagacgatgtcatgatagaaaaagatggtgcgatcgacaaaagcaaggcttttgctcctacgtatcctcaatttgtgatgaggaactcaaacctacgtagttctttagaaagcggtgtgagactaaaagagtctctactggaagatgctgacatctccggagacggtgcagatgaccatattggtctctgcttgtcaatctga

SEQ ID NO: 73571 - DNA, 432 bp, Glycine max
  Peptide Sequence Number=SeqID_165256
atgagggttcactgtaatcaagcaagtcggagacctaatgatgcaatcctccctaggaaaggaccagttaccagagccatgagcaagaggctccaagaggattgggctagagttgataaagaaggccttagggttctcatgaaccttaggctaagctctagcttctcaaggaagcttctcaaggaggctcatcttggtggtgaagctctttttttccatggcttattccttaatggatggcgcctcctctcacctcttctcctttgtcttccgctgcatctccatggtgaaaaatcaccattgaaggacctcattgaagctcaaagatccagcctccatagaagctccacaagcaagcttccatcagaggttgagctaagcgcgccctgctgcgctgagctcaactctctcactgcctttgagtttttgtag

SEQ ID NO: 73572 - DNA, 237 bp, Glycine max
  Peptide Sequence Number=SeqID_165257
atgagggacggcaagaagtctttgtatgtcattgggatcagggtgaattctggaattggccttgagggaaagttcctcgtcgcgttggaaccggcaccaaagttggcgttgccgggtgggcgagtcatggttggagccggagcttggggggcctccctttggatgggggtgggtgctctaggctgtacgggtgctaaattggaggagttcccgacacgagttgagaagctcaagtga

SEQ ID NO: 73573 - DNA, 162 bp, Glycine max
  Peptide Sequence Number=SeqID_165258
atggagtcaagaatcacaaaggttgaagaagggaaagacattcttcaagcgacaccacgtcgccacatcatctggggggagattgtagaagcaaagcttcatggtgaatcaaaggtgattcaaaggtgtttagatgataacaatgatgataacaaaagatga

SEQ ID NO: 73574 - DNA, 279 bp, Glycine max
  Peptide Sequence Number=SeqID_165259
atgacactgagaagagcccaagcttctgcttccattggagagggaaagcaattaatggttgctgtttttgccttgatgaagttgtcatgcttgtctctcaaacaaaatccaataccaaaggttttcgtttcttcaaacagagcagcatcaatgttacaagttatgaactcgtctagaggaggcttccaactaatgtcattaaaaattgtagaagtttgcgagattggattggacagcatattgatgttcctccactctgtgaaatgctgccacgattag

SEQ ID NO: 73575 - DNA, 285 bp, Glycine max
  Peptide Sequence Number=SeqID_165260
atgaagtcgcttagaggaaaagagatcgcgttggtgaaagtgcagtggggacccgacgagggtgattcaacctgggagttagaggatagggtgagagaattgtacccaaggtctcattttgagcattttgatatatctattacctactttcgaaaacgggccccgacgggtgcagagaaacgcgaggaactagaaccagagaggcggcacgcaaaccgagacaggatttcagcatccaaaaaggttcaattttttttcttccttatggctgagtatgatgtctaa

SEQ ID NO: 73576 - DNA, 864 bp, Glycine max
  Peptide Sequence Number=SeqID_165261
atgacagataaaaaagtgacgctaaccctacaagataacaactccgtggaactggatgtgatgcaaggcacgctgggacaggatgttgttgatgtccgcgcccttggctcaaaaggcctgttcaccttcgaccccggttttacctctacggcgtcctgcgaatcaaaaattacctttattgatggtgatgaagggattttgttacatcgcggtttccctatcgatcagctggctacccactcaaactatctggaagtgtgctacatcctgctgaacggcgaagcccctactcaggcgcagtacgacgagtttcgcactaccgtaacccgtcacaccatgattcacgagcagattacccgcctgttccacggcttccgtcgtgattcacacccgatggcggtgatgtgcggcgtgaccggcgcgctggccgccttctatcacgattcattagacgtgaatattgaacgtcaccgtgaaatcgccgccttccgcctgctgtcaaaaatgccgaccatggccgcgatgtgttacaaatactccatcggccagccgtttgtgtatccgcgtaacgacctctcctatgccggtaacttcctgcatatgatgtttgctacgccgtgtgaagagtacaaagtgaacccggtgctggaacgcgccatggaccgtatcctgatcctgcacgctgaccacgaacagaacgcatcaacctctaccgtgcgtaccgccggttcttccggtgccaacccgtttgcctgtatcgccgccggtatcgcctcgctgtggggacctgcgcacggtggtgccaacgaagccacgctgcgtatgctggaagagatcagcaccgtggatcacatcccggaattc

SEQ ID NO: 73577 - DNA, 2808 bp, Glycine max
  Peptide Sequence Number=SeqID_165262
atgcagaacagcgcgatgaaaccctggctggactcctcctggctggccggcgcgaaccagtcctacatagagcaactctatgaggatttcctgaccgatcctgactctgttgatgaagtgtggcgctcgatgttccagcagctgccgggcaccggtgtgaaacctgagcagtttcactccacgacgcgtgaatacttccgccgcctggcgaaagacgccacccgctacacctccacagtcaccgatccggccgctaattccaaacaggttaaagtgctgcagctaattaatgcgttccgcttccgcggccatcagcacgctaacctcgatccgctcggcctgtggaagcaggagcgcgtggcggatctcgatccggccttccacgatctgaccgacgccgattttcaggaaagctttaacgtaggctctttcgccattggcaaagagaccatgaagctggccgatctttatgccgcactgcagcagacctactgtggttcgattggtgcagagtacatgcacatcaacaacaccgaagagaagcgctggattcagcagcgtctggaatcggtggtgggccatgcgtcattcagcgcggacgagaaaaaaggtttcctgaaagagctgacggcggcagagggcctggaaaaatacctcggcgcgaaattcccgggtgccaaacgcttctcgctggaaggcggtgatgcgctggtacccatgctgcgcgaaatgattcgccacgccggcaagagcggcacgcgtgaagtggtgctgggcatggcgcaccgcggtcgtctcaacgtgctgatcaatgtgctgggtaaaaaaccgcaggatttgttcgacgagttctccggcaagcacaaagagcacctcggtaccggtgacgtgaagtaccacatgggcttctcgtcagacgtggaaaccgaaggcggcctggtgcacctggcgctggcgttcaacccgtcgcatctggaaattgtaagcccggtagtcatgggctcggtgcgcgcgcgtctggatcgtctggcggagccgggcagcaacaaagtcctgccgatcaccattcacggtgacgccgcggttattggccagggcgtggtgcaggaaaccctgaacatgtcgcaggctcgcggttacgaagtgggcggcaccgtacgcatcgtgattaacaaccaggtgggcttcaccacctcgaatccgaaagatgcgcgttctaccccttactgcaccgacatcggcaaaatggtgctggcgccgatcttccacgtcaacgcggacgatccggaggcggtggcgtttgttacccgtctggcgctggattatcgcaacaccttcaaacgcgatgtgttcatcgacctggtgtgctaccgccgtcacggccataacgaagccgacgagccaagcgcaacccagccgctgatgtatcagaaaatcaaaaagcatccgacgccgcgcaaaatctacgccgatcagctggaaagcgaaggcgtggccacgcaggaagatgccaccgagctggtaaacctgtaccgcgacgcgctggatgaaggcgagtgcgtggtgccggaatggcgtccgatgagcctgcactcgttcacctggtctccgtacctcaaccacgagtgggatgagagctacccggaaaccgtggacatgaaacgtctgcaggagctggcgcgccgcatcagcagcattccggaagcggtggaagtgcagtcgcgcgttgccaagatttacaacgaccgcaaagagatggcggaaggcaacaagctgttcgactggggcggcgcggaaaacctcgcttacgccacgctggtggacgaaggcattccggtgcgcctgtcgggtgaagactccggccgcggcaccttcttccaccgtcacgcggtgattcacaaccagcagaacggttcgacttacaccccgctgcaccatatccataacggtcagggtcagttcaaggtgtgggattcggtgctgtcggaagaagcggtactggcgttcgaatacggttacgccaccgccgagccgcgcgtgctgaccatctgggaagcgcagttcggtgacttcgccaacggcgctcaggtggtgattgatcagttcatcagctccggcgagcagaaatggggccgcatgtgtggtctggtgatgctgctgccacacggctatgaagggcagggtccggagcactcctccgcgcgccttgagcgctatctgcagctgtgtgctgagcagaacatgcaggtctgcgtgccatcaacgccagcgcaggtctaccacatgctgcgtcgtcaggcgctgcgcggtatgcgccgtccgctgatcgtgatgtcaccgaagtcgctgctgcgtcatccgctggcggtatccagccttgatgagctggccaacggcagcttccagccggcgattggtgagatcgacgacctcgatccgcagcaggtgaaacgcgtagtgctgtgctccggtaaagtttattacgatctgctggagcagcgtcgtaagaacgagcagaccgatgtcgccatcgtgcgtatcgaacagctctatccgttcccgcacaaagcggtgcaggaagcgctgaagaattacgcccatgttcaggatttcgtctggtgtcaggaagagccactgaaccagggcgcatggtattgcagtcagcatcatttccgcgaagtggttccatttggtgcgtcactgcgttacgcaggccgtccggcttctgcttcaccggccgtgggctatatgtccgtacatcaacaacagcagcaagacctggtcaatgacgcgctgaaccttggttaa

SEQ ID NO: 73578 - DNA, 387 bp, Glycine max
  Peptide Sequence Number=SeqID_165263
atgagtgattcggcagatttggattcctatatacccactcgtgcggtacttcatttttgggaagaggttttgattgatcaaaaagaagaatctacttcaaccgatatgcccttaggcacggcaatacataacatagaaatcacactcggaaagggtggacaattagctagagcagcaggtgctgtagcgaaactaattgcaaaagaggggaaatcggccacattaaaattaccttctggggaggtccgtttgatatccaaaaactgctcggcaacagtcggacaagtgggaaatgttggagtaaaccagaaaaatttaggtagagccggatctaaatgttggctaggtaagcgtcctgtagtaagaggagtagttatgaccccgtag

SEQ ID NO: 73579 - DNA, 234 bp, Glycine max
  Peptide Sequence Number=SeqID_165264
atggcagccaatctctttccctcaataagatttaattggtcaaaacgtgcctgggcctattctgcttcttcaaatcccgactctgctagaattctcaaagaaggaatctccacctttaacgggagcacaacttccatcccgtacaccaaagagaatggggttgccctagtagatcctcaattgccccatttatcttgggccgataaggcgttgaattatggtgttggattttga

SEQ ID NO: 73580 - DNA, 713 bp, Glycine max
  Peptide Sequence Number=SeqID_165265
atggcattgtccgaagagtttgatgccttgattgcactgggtgcaattatccgtggtgaaacttaccactttgaagtggtttccaacgagtctgcgcgcgggatttcagaagtgcaacgcgatacaggcgtacctgttgccaatgccattctgactacagaaaatgatgaacaggccgaagcacgcgttgccgtaaaaggggctgaagccgctcaagtcgcgattgaaatggcgaatttggtgtccggtgctgcaccagccaagagcaaaggcagcaaaaaccgccgcaaatcccgcgagctggcactcaaagcgttgtatcgtaatcgcatgaatgctggcgatgtcaaacaactgcggttggacagcctggatgatcctgactacttaaaagcggatgaaacttatttcaagcaactgctgaccggtgtgctagaacatactgaagatattgatgccatgatcagtcagtttattgatcgccagcttgatgagctcagcccgatagagcatgcgattttgcgcatttctggttacgagttgatgtttgatgtcagcatcccttaccgcgtggcaattaatgaaggcgtagagctggccaaaacctacggcggcatagatggccataaatacattaatggcgtattggataagattgcagcccagggagccgacggtctctgtggtatttccctaatctgttgtcctcgcag

SEQ ID NO: 73581 - DNA, 294 bp, Glycine max
  Peptide Sequence Number=SeqID_165266
atgccgcagccgttctccacggacaccgagatcagtggctacctcttcgacttcctcttcgcggcgcaggacgcatccacttcgtcacttctgtgggcggtggcgttgctcgaattgcacgcagagctgctcgcaaaggtcattggagtgaagctcgtggtccacatccacccatgccgtcctctgccagagagagaaaacgacaaagagaaagggagatacaaggcaacaatgagagaggaaaatgaaaggttaggggaaaatgaagggtcagtagtgtacccgagaagataa

SEQ ID NO: 73582 - DNA, 201 bp, Glycine max
  Peptide Sequence Number=SeqID_165267
atgaagctggaagagactcttgctcagttcatgctagtatcaatgtcaaatcaaaagagcacagaatcagccattaagaatctggaagttcagggaggctggatctttgagcttcaatgtggtcctttaatggtgattttccaccatggagatgcagcggaagacaaaggagaagaggtgagaggaggcgccatccagtag

SEQ ID NO: 73583 - DNA, 321 bp, Glycine max
  Peptide Sequence Number=SeqID_165268
atgtgggtgtgtttcagtgtgtgtgtgtgtttctgtgtgtgtgtgtgtgtgtgtgggtgtgtggctgtgtatgtgtgtgtgtatgcagcaagatctcagctgcagcaaggacttaaaataaattatgggaagagcagctttggggtgttgggccaatctgaacaatggctaatccagaggaggttcctatggggtggtggccttgatcagaagaaaattgcatgggttaaatgggactactggctcatggaacaagaacctttaagggagaaatatcccagattgtataacatatcctgtcaacatcagaagcttatttag

SEQ ID NO: 73584 - DNA, 258 bp, Glycine max
  Peptide Sequence Number=SeqID_165269
gcggcgaaccacagggggcaggtgcagatccatgagtgtctctaccagctcagcctcagtctacagagccagggtttcgctccttttgcgtgccctactccagatcagttcagggctgaggttgcatggcccagagattggcctgaggcccaggcaggggaggcgcccgcagaggctcccggcgatgcagaggaggcccgcatggatgaggagatgtcggatttactcggtttcttgggagggagtggagccacatga

SEQ ID NO: 73585 - DNA, 54 bp, Glycine max
  Peptide Sequence Number=SeqID_165270
atgccatatgaggatatgaatccaacacaggctgcttttgcagtagtgaataat

SEQ ID NO: 73586 - DNA, 606 bp, Glycine max
  Peptide Sequence Number=SeqID_165271
atggagatggagactgattccgaaccaagagtgtctttggtacaagtgggtttttgggaggatggggtgtggtattggagttttgtgtggaggagatcgtggttgctgtgggagatccctctgttggacgagtttatgtttgctattaatctagcctctttgcatccaaaagaagaggataaaattctttggagaggaacggcctctagtaataacttagtaaaagatgccgaccataggattgtccaaggcttggaaggtggtgtggttggtccctttggtgttctcgaaacaaaatggtttttgatgggagtgttttcgatttcaatgttgtggttgagatcatcaagttcaaagcttggtcttggatttcagctaagtggagaatccattgtgttgcttaaaattgttgaggtaacatgggcaaaggtggtggtgatatccgatcatgcaaagcatgttgtggattgctacaaaactacaattcatgagtgtgattttcgagtggaagcccacttgagaggcacgggtgcaaatgtaccaaaaatcagttctaaaagggaaatttacaacttagccattggctataataaatggcagtattaa

SEQ ID NO: 73587 - DNA, 1563 bp, Glycine max
  Peptide Sequence Number=SeqID_165272
atgctccaaccatatgagatcagcataggcttaaaggagcactcaaacccggtgacccccaaggcctacactccgaagagtccgtcagggcctctccctcctgattcagcgatagcaacatctctagcgattcccggaaattctttcaattattcatccgactgctccgatagaattcccaaacatcagagagacggagaagagattgaaacctccacttgtactgtcttcatacgattcctttttctccctccaggaatattatctcgcaaatcccaacggtggaagcctctgggtttctgcgggaaagaaaaaggctacaatgagaagggtttttctcttagttcagacatgatatcgaaattcccaacggatgtcctattcttttctcaaattcaagtgtctggcatccgttctggctgcacaaatgcacataaattcactagcattaatcttgtaggagggttacccaaaggcagcaaagggatgttaggccttgcaagatcagaacttgcagtgccaactcagcttgcactgttgaagaaactccctcaaggacatgaacatcctcgggatgtgtccaaacatgtcaaaaccactcctcttgttgtcaaccactttgacacaggtcctttgtttgaggaaggaagggcaacgggggcaccaaaattagcaccatcactcgttttgctgaattccaaagttttgtctataagccttttgttaaagatttccttaagaaggctcaatagagtggcatcagtgactccctttgaggcatgtttcgattcgagaagcattggaaattccatcactggctttgttgtaccaactattgatcttgtacgtgctacaagggggagtgcaatggcgaagaaaaatgtagcatgccccgcatttgttgatagagggacaatggcaacaatgtcgttttttaaagcctcaattgttataggtgcgcatcaattggaggaaaatcttttggtgtttgatgtggcttcctccaaattaagcttcagctcttcgctttcgctccacaatgtgataacgccttgcggccctgtagttttcgtccctgaccttcgaaggattgcggaaccttccagaatccgttatagggtgctgaccgtatcaactggtccgacctgcctcccgtcctccgccatgccggagcaccacacacgccaggttaccaccgataaattggaagaagcggttaaaaccctctcccaggacaactcatctctgaacaacaaaatcgataccattcacgcgtccctcaccgccaagattgacgcacttttcgatcgtttcgccgccatcgccgttaattcccctcagcccccaccgccaacaccagtacattcttcctcttcttcccaccgccatcacacgaaattggaagtgccacgcttcgacggccacgatcccctcggggcattccagagaacgaacggctcaccgtcgcatccttctacatggaaggacccgcgttatcctggtatcagtggatgtgtcgcaacgggttctttccgtcctggccagcgatgctacaggccctag

SEQ ID NO: 73588 - DNA, 1015 bp, Glycine max
  Peptide Sequence Number=SeqID_165273
tgatggagttatagacataaaacaatatttttacgcaggaaatgaccgaattgccccccttccttctctttataacgaaacgcagactccttgtgcagttcctatcccattctccgtcggagagagagagagagaaaatgttggggatcttcagcagttcagtggtgtcgccgccggaggagctggtggccgctggcagcagaacgccgtcgccgaagacgacggcggggaagctgctgaaccggttcgtggagagcaaggcgtcggcggtgtcgctgcagtggaaaatggcagatcatttgctgttaaggatgagatattctgcttgtttgagggggctctagacaatttgggcagcctgagacaacagtatggactggccaagtcagccaatgaagtgattttggtgattgaggcttacaaagctttacgtgatcgagcaccctaccctgccaatcgtgttgtatgccatctcagtgggagctttgctttcatagtgtttgacaagtccacttctaccctttttgtggcttctgatcaagctggcaaggttcctctctattggggaatcacagctgatggttacgtagcatttgctgatgatgcagatttgcttaaaggttcttgtggaaagtcgcttgcttctttccctcaaggatgtttctactctacagcagttggaggattgagatgctatgaaaatccaaagaataagattactgcagtccctgctgaggaagaggaaatctggggtgcatttttcaagaatagagaatcagtgatcagtccccacagtaatggaaggttaatgtcagttaagactgcattaggtacaaaggaaaagtgtaaggtaaccttagagcttaagattttagaattgaacatccgttatgtaactaggattgccagttgcaacaatttcactgaggcatgcatgaggggtcatgtaaataatgttaatgatgactatgacaagagtgcgactggtggaagagtttattatggtgttcattag

SEQ ID NO: 73589 - DNA, 1269 bp, Glycine max
  Peptide Sequence Number=SeqID_165274
atgccagtgttggagactttaaggagagtgaagcgtttaaggttgtttgaaccgtccgttggcgttgctggatttattctagtatctacctttgttatatgcagctttttctacttggactacagtgaactcgcagggaaattcgggttctcgggtcaatcagagaggtttacttggtcgcatgagaaaagaggttcagtagagaaacgtgtgcatagagttgaatttcttggagaaaagggaggtggtggtggtgggtgtgatttgtttgaaggtaactgggtttgggatgaaagttaccctttgtatcagtcaaaagattgcagcttccttgatggaggatttcggtgttctgagaatggaagacctgatttgttctacacaaagtggaggtggcaacccaaagcttgcaacttgcccagtcgaagtaaacctaaaattgaacttctcaataagcacagattcaatgcaacaataatgttggaaacgctgcggaacaaacgcctagtgtttgctggggactcaattggtagaaaccaatgggagtcactattatgcatgctctcttctggagttccaaacaaggaatcaatctatgaagtgaatggtagcccaattacaaagcacaaggggttcttggtattcagattcaaggattataactgtacagtggaatactacagagctccatttcttgtattgcaaagcaggcctcctcctagaactgatagaaagattaggacaaccctgaaattggatcaaatggattggtactctttgaaatggagagatgcagatgtcctagttcttaacacgggacactggtggaattatgagaaaaccataagagggggttgttatttccaagaaggtgcggaagttaagttggaaatgatggtagaagaagcatataagagaggtggagattggagaaaaggcggaaactgtaatttggaaacactgccagagcttggttcctcattggtgcctaatgataactggtcacaattcaaaatagccaattctgtgctattagcacacacaaacaccagtgaagttttgaaattcaagatattgaatgtaactcagatgacatctcagagaaaagatggtcattcatccatctattatctcggtcctaatgcgggccctgcacctccccatcgccaagattgcagccactggtgtctccctggtgtaccagatacttggaatgagctactttacgcattgctcctaaaacatgaaacttctcatacatggaactag

SEQ ID NO: 73590 - DNA, 1575 bp, Glycine max
  Peptide Sequence Number=SeqID_165275
atggcatcggttatggtgaatcgaggtggttccaggatcatcaagtcagtgtctgcagctcttggtacgaggtttttcgcaaaggttgcaactgggactgacatagtctctgccgcacccaatgcttctctccagaaagctcgtacctgggacgagggtcttgcttccaagttctccaccactcctctcaaagacatcttcaaggacaagaaagttgtcatctttgggctcccaggtgcatacacaggagtttgttcaaacaaacatgttcctccttacaaggagaatattgataagtttaaggctaaggggatagattctgttatttgtgtggctattaatgatccatatactatgaatgcgtgggctgagaagcttcaagccaaagatgctattgagttttatggggactttgacgggagctttcacaaaagtttggaattagttactgatctctctggtgcattgcttggaactcgatcagaaagatggtcagcatacgtggtagatggaaaggttaaggctcttaatgttgaagaagctccatctgatgttaaggagcctagagagagagagagagagaggagtgctgaagacaggagccaaaaaggtggattaaaggacaagacaagaatgataggttgcgctatggagtcatgcatgaatcccagccacgaagccatgacacccggtttggtgaagcgactcaccaagtcattgtctgcaactcttgggttcagatcttcttcctctgtcgccaaggttacaactggaactgaccttctctcgattgcacataatgtttctcttcagaaagctctcacgtgggacgaaggcgttgcttctatgccattctcattttcaaaccatttttatccttttggctcagttactataactaatgtcctctccccacgatgtttcagtacaagaaagtggtcatatttggaatcccggtactttcacactccgcaatcgtatcacgaccacaatgcggatgcattcacaggggtttgttcagaagaacatgttccaacttacatggataatattgataagtttaaggctaagggaatccatgccgttattcgtgtctcgattaatgatccatttactatgaatgagtgggcagagaagcttcaaggcaaagatgctgacttgctttcttctaatattttgaaactgaacccgaacactgaaatggtgagtgataacaatgataatagtggtgttgttagcaatgacggcggtaaagatactgttatgacaatgacggtgatagtggaagtgatatttgtagtagtggcgattggtggtggtggtgatggtagtaacaatgttaatggtaatggtggtaatagcaatattagtggtgttgataacgatggtgttgatagtaacaatagtggtggtggtggtaataataacaataacactgaccgtgacaataatggtgatagtagtggtgatgataacaatactaataatgctagtgatattggtgactacaatgatgacaatgaaagtgttagtggtggcattaagtggaatgatattggtggtggtaacatgtag

SEQ ID NO: 73591 - DNA, 759 bp, Glycine max
  Peptide Sequence Number=SeqID_165276
atggcttttagctctggttgttctaccggcaaggtcacacataattatgagatttgcattagtagtgtacctgactttgctttcaatttgggctctaccaagaaatgcctggacggactgggttcagatggtgcgcctgcacttgttcaattgagaacaccaccacctgcaatgatggggcttcctaatcttccagtatctttaacaggttatgcatatacaatcatgaagttaggtccattaacctttaccaggaaaggcctatctgtagcaagcactattgcatgtttgacttttacagtgtttcaaagtgcaagtctctgtctcacaactacaagccctgaacaactagcatttgcattgcgatggtttatgctcccactgaaatacataggtgtttctgtgtcagaaattgtgcttacacttttactgtcattgaggtttatcagtcttgtttttgatgaggttcggaacattgctttggggattgtatctcgtaggctaaattggaagcagctgactgttatggagacaattgatattttctttaactacttccgtcgcatcttcaaaaatattttcagccatgcagagcaaatttctcaggctatgatagtcagaggttttaaaggggactgtggcactcataaaatttactttttgtcagaatcatcttttgggatggtagatattatatgcttgctgtgcttgacacttttaataggagctgctctcctgtctgagtactaccttgtctaa

SEQ ID NO: 73592 - DNA, 894 bp, Glycine max
  Peptide Sequence Number=SeqID_165277
atgtggacaagcgagtgctccatgttccgcaggctcctctgcacctctcttccccgtctttcaaaaccccaatcttcaagctccttaaccattctcaactcctcactcacccaaaaacaaaaacaaaagcccttatctccccaaaccatcaaatccttctcctcttccaaaatgggggacgcgcgaagacccttattcgtcccaatccccactttggaaaaagcagaacgctccgacctcctccgcgccctagaagcttccatgggctcccctttcagctccgagcctctctctccaaaccctaaccctctaatcatcgtcatcagcggccccagcggcgtcggcaaggacaccctcatcgcgcgcctccgcgactcccgccgcgccctccacttcgttgtcaccgccaccacgcgcccccgccgccccgccgaggtcgacgggaaggactacatcttcgtctccaaggaggagtttctcgggatggtggagcgggaggagctgctggagtacgcgctggtctacggtgactacaagggcgtgccgaagcagcagattcgggagtgtctcgcgcaaggctgcgacgtcgttttgagggttgatattcagggggctgccacgttgaagaaggcgctcgggaagtcggcggtgtttgtatttgtggcggcggagagcgagatggcgttggtggagaggctggtggaccggaagacggagaccgtggagtcgttgctggtgaggattggtactgccagggaggagatgaagcatgtcaagaattttgattatgttgtggtcaatgcgaaagggaagcttgataatgcggtcaagttgatggagtctattattgatgccgagaaagctagggtttctcagaggactcctcacttataa

SEQ ID NO: 73593 - DNA, 2151 bp, Glycine max
  Peptide Sequence Number=SeqID_165278
atgttgttagtcttcatttctgcgagtctcagactcaaactcaaaatcttgcctcgatccttacccttttctctttcagttgagcttccatcaccaaacccaattctaagatcaaaatgggtttccttttccagttccaccaatgcctctccacacgtgcaagacccacaacacttcattggcattttctgcaatgcgaggcttcaccagaaccactacgagtgcgagcttgcattggtttccgcgctcaaatattgttcttcctcctctcagggtcgccaacttcattctctggtattgaaactcggactccattccaacaccttcattcaaaacagcttgatcaacatgtacgcaaaacgcggttcaattaaagatgcccaattgctgtttgatgcttgtcccacgttgaaccctatttcctgtaacattatggtttgtgggtatgccaaagctggtcaattggacaatgcccgcaaactgtttgacataatgcctgacaaaggttgtgtctcctacaccaccatgataatgggtctcgtccaaaatgaatgctttcgagaagctctagaggttttcaaggacatgaggtctgatggggtggtccctaatgacttgactctggtaaatgtgatatatgcttgctcacattttggtgaaattttgaactgtcgaatgattcatgcgattgctattaagttgtttgttgaggggttggttcttgtttcgacaaatttgatgcgtgcgtactgtctttgttcgggtgtaggggaagcaagaaggttgtttgacaggatgcctgaagtgaatttggtctcttggaatgtaatgttaaacggatatgcaaaggctggccttgttgacatggccagggagttgtttgagagagttcctgataaggatgtgatttcttggggaacaatgattgatggttatatcctaatgaatcgtttacatgaagctttggtgatgtatcgtgcaatgctacgaagtgggcttgcacttaatgaaatcctagttgtgaatttggtttcagcatgtggtcgtctgaatgcaattggtgatggttggcaattgcatggaatggttgttaagaaaggctttgactgttacaattttatacagactactatcatccatttttatgcagcttgtgggatgatggaccttgcttgtttgcaatttgaagtgggcgcaaaggatcacctagagtcgtggaatgctcttgtttctggattcataaaaaatagaatggtggaccaggcaaggaaaatctttgatgacatgcctgaaagagatgtgttttcatggagtaccatgatttctggctacgcacaaactgaccagtccagaatcgctcttgaactcttccataaaatggtagccagtgggatcaaaccaaatgaagttacgatggtgagtgtattctctgcaattgccacattaggcacattgaaggagggaagatgggctcatgaatacatatgtaatgaatccatcccattgaatgacaatttacgtgcagctctaattgatatgtatgcaaagtgtgggagcatcaacagtgccttgcaatttttcaatcagattcgagacaaaaccttttctgtgtccccatggaatgcaattatatgtgggttagcctcgcatggacatgcaagtatgtgcctagatgttttctctgatatgcagaggtataatatcaaaccaaatccaattacatttataggagtccttagtgcttgttgtcatgctgggttggtggagcctgggcgaagaatatttagaatcatgaagagtgcatataatgtcgaaccagatatcaagcattatggctgtatggttgatcttttgggcagagctgggctattagaagaagctgaggaaatgataaggagcatgccaatgaaggctgacattgtgatatggggaactttattagcagcatgtagaactcatggagatgtcaatataggagagagggctgcagagagtttggcagggttggcaccatcacacggtggaggtaaagttctcctatcaaacatatacgcagatgcaggaaggtgggaggatgtatcactggttagaagagccattcagaatcagagaatggagagaatgcctgggtgcagtggtgttataaggtag

SEQ ID NO: 73594 - DNA, 393 bp, Glycine max
  Peptide Sequence Number=SeqID_165279
atgtcggagagaaagggtagacatggtttggagaattgcgaggtcgaccttgccaaatcgtgtgtccacggactccgcaccacagtcctcctcattgagaccgtcgccggcagctctgactctgttgaaggtgtccaccgcgctctcgacgtcgaagattgtgaggctgccgcgcgcgcgctgaagggagggtggtgcaggattgtcgccggcaccgaacgacgaagaggacaagagggacacggtggtggacacgttatgtgtatgcatacccatggtactccctcgcacatctcaaaaaaatcctatatcgaacgcaccaccttatcttcgcacgatgagagacatcgggtcctttcccatgctagcctgcgtttgaaatggatagagtga

SEQ ID NO: 73595 - DNA, 126 bp, Glycine max
  Peptide Sequence Number=SeqID_165280
atgacaaaggtggtggtggtgacaaaggcaaggtgttgtggtggttgtgacaatgacaataataatggtgatagtaattgtagtggaatggtggtggtggaagctagagtgtgctggcaactatga

SEQ ID NO: 73596 - DNA, 309 bp, Glycine max
  Peptide Sequence Number=SeqID_165281
atgatagtagacacattaccagtgttctactatgaaaagatggtgggctacacaccttcaagctttgctgatttagttttcgcttacgaaaagatcgaagtgggtatgaaaagaggcaaatttaatcatcctgcttggacgagtgagaaaactggggcaaatgaagagggtgagaatgaagaagaaacccatgctgcgactgccattcctatacgaccaagtttcccaccaatccaacaatgtcattactcagccaataacaacccttctccttacctgccacccatttatccacaaggccatccctaa

SEQ ID NO: 73597 - DNA, 381 bp, Glycine max
  Peptide Sequence Number=SeqID_165282
atgtcatggatgaatatcaaaggcgctttccccttcagcccgaaacagcacttcatgcagcacatttctatccacatcgaaggattaagggctaagcggtggaggtattggtggctggcagtaacatggtctatatggaagctcaaaaacagaattttgtttgcaaatgcagaatttgatactaatcggctttttgaagatgctatctttataatttggacttggcttagacaatttgagaaggacttcacagtccactataatcagtggtcaaatagaatcccaactaaagggaatttacggagaagacagctggagaaaggctttgcccagccctacaactattggtctagtaatttatcaacaacatttttttattag

SEQ ID NO: 73598 - DNA, 201 bp, Glycine max
  Peptide Sequence Number=SeqID_165283
atggagaattggcgaacagcgctatgcaataacttccccggggctccagtactcgaaggtggaggagcacatgaaaagtgcttggcaataacattcatggggctacgaaaaaagtggagaatggagaattggcgaacagcgctacgcaataagtttgtggggctccagactcgaaggtggaggatgcatgaacagcgctag

SEQ ID NO: 73599 - DNA, 462 bp, Glycine max
  Peptide Sequence Number=SeqID_165284
atggcgcctactaggcaccctctggacccagataagtccaacagggccctggggtttccgacgctgattataggtctctgccagtcctacggagttcccgtcacccccagtaaggccgcagacgcaccgccaccacctcgacaggccgatcgagctgggtcactgggtgtggagcgttatctacaacatttggttcgccagcaggcagcctaccaccgtgggcaggtgcagatacatgagtgtctctaccgattcagccttagtcagcaagggcaaggtttcgccccttttgtatgccttaccccagagcagtttggggctgaggtcgcatggcctagagactggcccgatgcccaggcaagggaggagcctgcaggatccctcggtgaggcggatgaatcccatatggatgaagatatgactgacctgctcagtttcttgggagggaggggagccacgtga

SEQ ID NO: 73600 - DNA, 375 bp, Glycine max
  Peptide Sequence Number=SeqID_165285
atggtggactacacaccttcaagctttgatgatatggtcttcaccgacgaaatgatcaaaggtgaggatgaagtagaagcccatgctgtgactgccattccaatacagccaagtttcccaccaacccaacaatgtcattactcagccaataacaaaccttctccttacccaccgcccaccccggggcgttccattgagcattgtagggctctgaagcgtaaggtgcaaggtctaattgatatgggctggctgaaatttgaggagaatcgcgtgattttcaactttcaccggaagtgggtgcaagccattggtcagtttgctcaagcgacctatgctcctgagtttgggacttccaagaccgttggtgggggtgcc

SEQ ID NO: 73601 - DNA, 737 bp, Glycine max
  Peptide Sequence Number=SeqID_165286
atggaagacgcacccgtgagccccgcgtcgccctcccgccgaaggacttggcttttggtgaaagcgttctatgcaaatttatacagttcagaggaccatccaccaaagcagtctaaagtcagaggtcatttggtgaaaattcaagctgagagtctcaacacattactggagacacttgtggtattagcagagggggagaccttacccgcatactccagatactgcaggttgcctataggctacaaagagatagaggttgccttatgcatacctggacgagggttcatcatgaactctgagggccatcctgggaagattctaaggaaggatctgactacactagctcaggtgtggagggtcctctcatactccaagttggcccccacatcacacacttctgacttgacagtggatagagctaggctgatctttggcctagtctctcgcatggatatgaacataggagcactgatctctggccagatgacctctatagcccagtctagcacttctagacttgagttccctgctctgatcaccgcattatgtagagacagaggggttgtctctgatagcctcacttttgagcgcctgagcccgatcattaacttggcctacatcaagaagaactgttggaaccccgaggatctaacagtttctatccaaggggttaggagggcgagggctaggccaactgagctcccttccacttctgcggctcctactctagcatccac

SEQ ID NO: 73602 - DNA, 2778 bp, Glycine max
  Peptide Sequence Number=SeqID_165287
atggccataacgacttgtaaaaacatgaaaaaaagcattcgcgcgttcgcttcactcgccctcgtactggcggcgttcagccagtcggcctttgcagtcgtctatccgctgcctccagcgaatagccgcctgattggcgaaaatattgaaatcaccgtgccagacgacagcaaactgccgctggaagcgtttgcggcgcagtaccagatgggcctcagcaacatgctggaagccaatccgggcgtggacgtttacctgccgaaagcaggcactaaaatggtgatcccgcagcagctgattctgcctgacgcaccgcgtgaaggcatcgtgatcaacagcgccgagatgcgtctgtattactacccgaaaggcaccaaaactgtcgtggtgctgccgatcggtatcggcgagctgggtaaagatacgccggttaactggaccaccgcggttgagcgcaagaagaatggcccaacctggacgccaaccaaagcgatgcacgcagagtacgcggcgcgcggcgagagcatcccggctgtgttcccggcaggtccggataacccgatgggcctgtacgcgctgtacattggccgtctgtatgcgattcacggcaccaacgccaactttggtatcggcctgcgcgtgagccacggctgcgtgcgtctgcgtgcggacgacatcaaatggctgttcgacaacgtgccagtgggtacgcgcgtccagttcattgaccagccggtgaaagccaccgttgagccagacggttcgcgctacatcgaggttcacaacccgctgtcgaccaccgaagagcagtttaactcacgtgaactggtaccaatcagcctgacgtccgccgtgaccaaagtggtggccgatgccagcaccaatcaggatgccgtgaacaatgccatccaggcacgtaccggtatgccgaccaaaatcaacggtcagccgggtgaagcccagcctgagccggtgatggtgcaggagtcttctgacgcgatgccgaaagaagagccgatgacgccgcagggtgccaccgccgtcgcgccacaggccgatgcgcagcagcccgctgaagctgctccggttgagcaggccgcgccggcacagcctgccagcaacggcaacagcctccgcagggctggcttttttattgcccgatcgccgggatcattgtgcggttgtgtcgcggtgcagttgcgcgctcaatcgtgcggccggcgtaacgccagccagcccgccaccagggtaaacaccagcaccaccagcactaacagcaggaaaccgtgcggattgttcgccagcggaatgccgcccacgttcatgccaaaaaaaccggctacgatattgatgggcagcgccagcacggtgattgaggcgggcagcgatctcctcctgcagcaggcgaatgcgctccatcaggctggcaagatcgttaagcgctacgctgaactcctcggtgaaaatccgcagctcactgagcggttcccggttgagccagtttggcggccggttaagcaggcgaaacagcgcggccggctccggcgccagcagccgctggacgcgcagcagcatgcggcgcagatggcccagctcgctgcggttggctttgatcgccgcgctcagcagcccctcttctatcgcatccaccgcctggctggagcgccgcaccacctgctccagctgcgcttcctgttcgccgagcagccacagcagcatcgcatccggcgcgctgaagcacagccgatcaatctgctgatgcatacgttcaatcatgccaaccgggcgatagcgcgcgctgaccatcacctgcggccggcaccagatccacaacgtcgcattttgtgtgttgcgctcctctttactaaaggtgacgtcattcagcaccgccagcagcgcatcgttttgctgcgccagccggcccgcgctggcatcatcattctgtcatacaaaacccgtatcacactgcagttaacgggtgccattcgtgcatcgttaattcaccccggggggtgtgttatggctgaaaacagtttccctgcatcatcgtccgaccgcggacggcccaatctgcacccgcgcagcggtcgcgcgtcgcgcgtgctgtttctgctgctgctggtggccgggctggtgttcaccggtatcaatctgttcaacgacgtggaagagaccggcgcggtcgtcaccagctatacgccgttcctgctgctcggcgtggcgctgctgattgcgctcggcttcgagtttgttaacggctttcacgataccgccaacgccgtcgccacggtgatctacactcactcgctgtcgccgggcgtggcggtggtgtggtccggcttgtgtaatttccttggcgtactgctctccagcggcgtggtggcgtttggcattatttcgctgctgccggtggagctgattctgcaggcgggcagcggtcacggtttcgccatggtgtatgcgctgctgtgctcggcgattgtctggaaccttggcacctggtatttcggcctgccctcttcctcttcgcacacgctgatcggctcgattatcggcgtaggcgtggcgaatgcgctgctgcacggccgcagcggcaccagcggcgtcgactgggatcaggccatcaaggtcggttacgccctgctgctgtcgccggtgattggcttcatctgcgccgccgtgctgctgctggccatgaaggcattggtacgcaatcgccagctgtatcaggcgccggaggcaatcagccgccgccagcgtggattcgtggcctgctga

SEQ ID NO: 73603 - DNA, 117 bp, Glycine max
  Peptide Sequence Number=SeqID_165288
atggccgacacaataggagaccaagtccaaagccaaagtaggacgcacctagttgctcatgatcctgggaatttaaataaaacaagcgcaagctcggaaggtagaaaaataccttag

SEQ ID NO: 73604 - DNA, 345 bp, Glycine max
  Peptide Sequence Number=SeqID_165289
atgacaaaagacaaggttgatacctcaaagccctacattagggcaatgaggggcaccgtgcatgagcctcaagcgaacctaggtgcagatcaaaataccctcaccttcagagggctaaacgccctcgccttcaaagggctgcacgccctcgcctttagagggctacacgccctcgccttcagaggactacacgtcctcgcctttagaggactacatgtccttgccttgagagggctgcacgccctcgcctttagaggactacacgtcctcaccttcagaggactaaacatcctcgccttcaaaggactacacgtcctccccttcagaggaggtgggatcctctag

SEQ ID NO: 73605 - DNA, 351 bp, Glycine max
  Peptide Sequence Number=SeqID_165290
atggaactcgatcttagatgggaggcgttaaatggcaatttctacaacgtgctcttgggcaccacgttcaggctcgagccgttgtcgatgagtactttggccataacatgttccatgcatttgactgacacatgtaaagccctgttatgtcctctcccctcggcagggatttcctcttcagcgaagaggaactcgccggcctcctcgagtgatacctctttcttgccgcagccctctcttccctcggcaaaatccttcatcggaacatcctcgccgactagggggtgcgaacatgcgaacgctacgggttatgccgctcagcccagtgatattggtcactttggccgatag

SEQ ID NO: 73606 - DNA, 318 bp, Glycine max
  Peptide Sequence Number=SeqID_165291
atgaccaaacttggtctctgcttgtcatcgggcccgccgcctctggatgacaaaagggtgcggataaccgtaagaatgaccaaacttggtctctgcttgtcatcgggcccgccgcctctggatgacaaaagggtgcgaataaccataagggtgcgaataaccataaggtatctccgcgtatcatgggggcgaatgaccaaacttggtctcttgctgtcatcgggcctcttgagtcatggcaacaaaaggcggtatggtcgacaaaagcgaggctcttgctcctacgtatcctccaatgaggaattcagacctacgtag

SEQ ID NO: 73607 - DNA, 147 bp, Glycine max
  Peptide Sequence Number=SeqID_165292
atgaaggtaatgcttcttagtccaatagctcttaaggtggttggctcctttcttcttgactcaaattcttcaagggatggcaccaatcctccttccaattccctatatggcaacccacaaacaaggaaacaaagagacaagcaataa

SEQ ID NO: 73608 - DNA, 207 bp, Glycine max
  Peptide Sequence Number=SeqID_165293
atgaagccaaggcactgccaatttgggactgtgatcaatctctacatcgttcctcgttcggtgttcttcgtgcgattgccggggtcccccttgttgttttgtgaatattcatcttctccatctatcatcatcaacctcaatttctttgtaaagttcaatcttaaaccaatcactaagtgttgtaaacttgtctttgaaaagatttaa

SEQ ID NO: 73609 - DNA, 531 bp, Glycine max
  Peptide Sequence Number=SeqID_165294
atgacccaaaagctggtagcccgcggacacaccttacggttatccgcacctcgtcattcagtgaccccaagtgtgattggtgagcagaggccaatgtggtcatctgcgccctttccggagatgtcagcatcttccggtggagactttttcaagtctaacaagttatctagaactacgaagaggcggcgggcccgatcacatgcggagacaaattatggtcattccgcacaccttttgccattcagacacagtcgtgtccgatggcacgcagagacaaataatggtcattctgcacccttttgtcatccagaggcggcgggcccgatgacatgcggagacaaattatggtcattccgcacacctttttccattcagacacagtcgtgtccgatggcacgtagagacaaattatggtcattctacacccttttgtcatccagaggcggcgggcccgatgacatgcggagacaaattatggtcattccgcacaccttttgccattcagacacagtcgtgtccgatggcacatag

SEQ ID NO: 73610 - DNA, 674 bp, Glycine max
  Peptide Sequence Number=SeqID_165295
cggggatcactttgtcattttgttcttctgctatcttcgccttccctttagcgtttgcgggttgtgtcggcaagtcaggaggtgcgaacacgcgaccgctgcgggtcacgccgctcagccccgtgatattggttaccttggccgacaatgagatgatgtcagtggcttcttccttcctttcgcttggaggcgcatacctccacgaaactgcgtggctgttttggtatggaaacggaataggtctaactaccgaggggtatcagggcgtttggggagttgcgtctctgggcctcgtagataaaccttcagggggtcttcacatccttcaaaggcttggacctgcgcggcctacccgactcgacagcattaaccgctccccctccatgattggaaagcgggccaggcactgttcggtggagtggcccggggttttcccatggtatgcacaggatggcaagaggtcttcgtacgtcattgggatcggggtgaatgttgtcctcgggggaaagttccttatcgcgttggaaccggcgccaaagtgggcattgccggccgggcgagttggggttggagccatagcttggggggtcttcctctggatgggcgtaggcgccctagtttgtacgggtgctgagttggaggagtccccagcgcgagctgagaagctcgagtga

SEQ ID NO: 73611 - DNA, 1214 bp, Glycine max
  Peptide Sequence Number=SeqID_165296
atggctacctcaccaaaagaaacttccgcttctggttcacccgctgtacgatcatctccgcaccaggaacaaccagaattcaacgtccaacccatacaaataattcctggtcaagcttctgtccctgagaaactggttcccagaagacaacagggagtgaagattgctgaaaaccctagccttgcaacaagtcctagggaagtagacacggagatggacaagaaaatccgcgaaaaatgttccaacatcttccaccccaatgtttctgtgcctgatgttgagaaagatgttccaacatcttccgctccaaatgctgaagtcctcccttcacccagtgaagaggaatcatcagaggaagaagatcaagccacagaggagacccctgcaccaagggcaccagaacctgcaccaagggcaccagaacctgcaccaagggcaccagaacctgctccaggtgacctcattgacctggaagaagtagaatctgatgaggaacccattgtcaacaggttggcacctggcattgcagaaaggttgcaaagcagaaaaggaaaaacccccgtcaagaggtctggacgaatcaagactatggcacagaagaagagcacaccaatcactcctaccacatccagatggagcaaagttgcaatcccttccaagaagaggaaagaaatttcttcatctgattctgatgatgatgtcgaactagatgtctcgacatcaaagagggccaagaaatcagggaaaaaggtgcctgaaaatgtccctgatgctccattggacaacatttcattccactccattggcaatgttgaaaggtggaaatatgtatatcaacgcaggattgctttagaaagagaactgggaagaaatgccttggattgcaaggagaccatggaactcatcaaggctgctggactgctgaaaacagtcaccaagttgggagattgttatgaaagcctagtcagggaatttattgtcaacattccctctgacataacaaacagaaagagtgatgagtatcaaaaagtatttgtcagaggaaagtgtattagattctcccctgctgtgatcaacaagtacctgggcagacctactgaaggaatggtggatattgatgtttctgagcatcagattgccaaggaaatcactgccaaacgagtccagcattggccaaagaaagggaagctttctgcagggaagctgagtgtgaa

SEQ ID NO: 73612 - DNA, 189 bp, Glycine max
  Peptide Sequence Number=SeqID_165297
atggcttcacaagaagctttaagacaagctttttggatactattcggatatgtatccggaaatatgtatctggaggtatccaaggagtatcggtatttgacacaggctccagttgttttactaaggatactgtcaacaggatgcatgcttgttgaaatctttctttacaaggtcattcatgaatcatga

SEQ ID NO: 73613 - DNA, 549 bp, Glycine max
  Peptide Sequence Number=SeqID_165298
atgaggggcatcgtgcatgagcctcagggtggacccttgggtactagtaccctcaccttcagaggcctacacaccctcgacttcagagggctacacgccctcgccttcagaggactacacgtcctcgccttcagaggactacaggtcctggcctttagaggactacacgtcctcaccttaagagggctaagtaccctcaccttcagagggcaacacgccctcgccttcagaggactacacgtcctcaccttaagagggctatgtaccctcaccttcagagggctacacgccctcgccttcagaggactacacgtcctcaccttcagagggctacacgccctcgccttcagaggactacacgtcctcgccttcagagggctgcatgccctcgctttcagagggctacatgcccttaccttcagaggactacacgtcctcgccttcagaaggctacacgccctcgccttcagagggttacatgctctcaccttcagagggctacacgccctcaccttcagaggactacacgtcctcaccatcagagggtag

SEQ ID NO: 73614 - DNA, 204 bp, Glycine max
  Peptide Sequence Number=SeqID_165299
atggttatcaaatcgggtgattgggtttggattcacttgcggaagaataggtttacttccaaaaggaaatctaaacttcaaaaaagtacctttgacatcaattcaagggcgaattcttcccaagaaggagggtatgatagaggactatccaaggaggaagagttatgcttaggtgggcttaacatggatggaccaatcacttga

SEQ ID NO: 73615 - DNA, 420 bp, Glycine max
  Peptide Sequence Number=SeqID_165300
atggctggtacattcttccttttgaaacagcaaaatagtttagagattttgagcgaggaggaaactgttggtcatgtcatgttctcttgcacaagaactaggagtctttggtgggaggctttgagatgggttgatagagtgggccctttccccactgatcctaaagatcacttcatacaattctcaagctggagtagcaaaagatatatagacaatagatgggcagtgctttggatagctttatccatgactatttggaagcataaaaattcaatggtttttaataaccagattttcaactccgaaaaagtcatggatgaagctttattccatacatgggcatggttaaaatgtatggacaaagacttccatattcattttaatcaatggtccactagcttgagggaggagttgtcttag

SEQ ID NO: 73616 - DNA, 87 bp, Glycine max
  Peptide Sequence Number=SeqID_165301
atgtcgatgacggaaggaaatctggttcagagagatttgggatttgggaaagattgtcgtggcaaaggctacggtgggaaaccataa

SEQ ID NO: 73617 - DNA, 534 bp, Glycine max
  Peptide Sequence Number=SeqID_165302
atggttgtgaggaacatgtttggtttgcccctagttgaaggtcttgccaaccagtctagggactcactaagtgcaaatcttgggtttgacgagcctttggagaaacgaccagagaattgtccgtccagggtttttggagggattcaccagcaagcttggtgtgtgcaatgcgtgtgtcgtgctcttgcatacatacatggtgcttttgcatacgtgttactcgtgaggtggcacatactggagacttggtgtcgtgctcttgcatacatgacacttgtgaagtggcatgtactagagattggcatgtactggagacatggtgctcttgcatatgtgtcgcttgtgaagtttcatgtattggagacatggtgctcttgcatacatgtcccctatgaggtggcacgtactagagacttgattctagaaggaaggctcaccaagcacgttccttgggttttaagagcctgtgtagctatgaccatggatgcacctgtcttgacgacacaagaaaattatgaaaaggaagggatgtag

SEQ ID NO: 73618 - DNA, 732 bp, Glycine max
  Peptide Sequence Number=SeqID_165303
atgttgtggaagcttgggaggattgatggggacccagtgttgagagaaacgaggatatgggctacgtgggagtacgtgagctcagttggaggtgggcaacaggggatggtggagtggtacctggagatatgtcgcgggggtcaggagaccttggggacgtcaggtggggtgctattgcccaaaaccaagcttgaccaatcccgacccaacccgggcatagtcggtcagcttaaaaacgaagtcaggaaactaagggagcctctgagggatgggtcactggtaatcgattaccagatcgtgatggcggcacagctaatccgtgatcgagtagagatggagtgcctagagggagcttgggagaccctcgaaggcaacacgaggtgccgatttcggggcaccattcgattcacggccacttctttggtgcatccagatgaacctgcacggacgcttcagcgcacggtggagtggatactacccacgcctacaccctatcgtctagtggagcccgtccaagtgatcgaggtaacgtcatccgaggaagaccctgaggaggatcccgaggatctacctcctgagcttgttgtggatgctcttgactttctagagggcgatgaggacccacttcttgaggtggattctcccgaggaagtcatgtcggcatctgaggcagactctacggaggatagtggcccgggggagatggcgatcagcggaggctcttcatcatag

SEQ ID NO: 73619 - DNA, 615 bp, Glycine max
  Peptide Sequence Number=SeqID_165304
atgagttgctcacgtgatgcgatatctgaagcaacttcttctcgattatgtcccttatgcaccctttgttgtatgcaatgccatcaaaggcatgtttacaagttgatcattgctccactcagcagagtctataagtcatggtgctgcattgaccctatggtgctcttaatggagagatcgttgattgtggctttgagcttaataatgcttttgccacgtccatggtggagagataatcgatggtggctcaaaccgaccggatcgcctgggctacctcccggttcagaccagcccaatcctcgcagcacactgtcaccttcacctgttttgaagagtgggagagcaaaaagggcagatgaaggtccaaaggcatatcgagtggagaggcacaacaattgctcacgaatcgtgtcaaagacgacatcaagttcaggtgtgagatcgacaaaagataagcttgaacttgcggctaaaggttgggagcaagagaaaattagaaaacacaacacaaggaagcatcaacttgctactaacaagcgtaaatcatggtgggaacatccttttcttgggtgttcaactgatcaacatgatcttggccttggaaccataacttga

SEQ ID NO: 73620 - DNA, 426 bp, Glycine max
  Peptide Sequence Number=SeqID_165305
atgggagggcttgttgaatactatgttgtgccagcaaatggattatttgtattaccagactcattgccatatacagagtatgcaattctaggatgtgttgtttttactgcttacggtgctacggctcatgtagctcaagtgtgtcctagtgattctgttgctgttattggaactagaggtggcagtgacatgtttagtgagaaagatgggtttccccggaagccattcctaaatggatggaaaggtgaaaatggattctatgcagtgagtttcaccaaacagggtttcaccaaacatggccttcttggtgcatctattgatgcaaagaggattgatgaagacattgaacatagctggaaagctgagtccaaccatgttatggaatttccttgtccactttctaaaatcattgacctttatatatag

SEQ ID NO: 73621 - DNA, 309 bp, Glycine max
  Peptide Sequence Number=SeqID_165306
atggacccagagaagtccaacagggtcttggggtttccagctctaattacgggcctttgtcagttctacggagtgccagtcgcccacagcaaggtcatcaggccccctactaaccgagctttcatcaagaagtactgtgcccccaggcaggcgcaggatgagacaccacagcatcctggggatggccggcagggggcaacagacgcaccgtcgccatctccaaagccccttagctcatctacaaaagctggagtgttgcctatgacccgtggtcaaccagaaggcgaccaagtccaaagccaaaggtag

SEQ ID NO: 73622 - DNA, 128 bp, Glycine max
  Peptide Sequence Number=SeqID_165307
atgagagataatgatttggttaccaatcataagatcagaggcactagagtcaaggattcaaggtttagtagtaggggactaagagacaaaggctataggattaccatactaagccatagtggtaacag

SEQ ID NO: 73623 - DNA, 396 bp, Glycine max
  Peptide Sequence Number=SeqID_165308
atggacatcattgaagatttagagattcctttaattttgggaagaccgttcatgttgactgcggaatgtgtagtagacatgggaaggaaaaagatggaaatgggatttgaagatcaaaagatcaactttgatctttttgaagaagataaaccagcaacgaatcagaatgtctgcctacaagtgaagaagttccactcgctaagcgcatcaatcttatgcgctaagcgagcattgcttgcgctgagcgcacaacccttgtctttcaagctgattgggcacgctaagcgagccctatgtgagctaagcccaattcgattcgatctgaattgggctaagcgagcattcactcgtttagcaaacaatagttgcttgctaagcacagacaacctgcgctaa

SEQ ID NO: 73624 - DNA, 697 bp, Glycine max
  Peptide Sequence Number=SeqID_165309
gttggtgatgaggatggacatgaacattggagcattaatttcaggacaaatctcactcattgctcagtccaactcctctaggttgggatttcctgccttgatcacagctctctgtaaggcaaaaggagtcatttcttattccctctcttatgaatcactgagcccaaccattaatttggcatatatcatgaaaaattgttggaacctggatgaaacttcggtctactttccaaggactcgcaaggctagggccagagcagctgagatcccttcctcatccactcctcaggaccttctttcaggagctcagccttatcctattggagagggtgaggcctccgtagcccaggagcctcagccacatcaggatgagtcttccttgtcttcagagtcagagaccgtaccaccagagccattcatctatgaggcagatccaggcaccacactagaggagactcaagaggctgctacaccaaagattaccccacaacaagcaacagaaccttccataccggttctggatttgtcttcaccacaactatcccaggagccatctacacctatcttgggcttgtcatcccccactacttcaccagcaggcaccccagtgcttcacctaacagatgaagaggaggataccatggaccaggaccaactaaaagaccagcggcatgatttctatgctcctgtcttttga

SEQ ID NO: 73625 - DNA, 1161 bp, Glycine max
  Peptide Sequence Number=SeqID_165310
atgacattcccttctaccttgaagcggacaagaaaagccacacgcctaagatcattggcgactagaccagttggggaagagagacccctagtccatatggatcttgcaatggggaaagccgacggtccccacagaaagaagttaagaacatatttggggatcgtctctcgcgataaggtagatgtgacatacgagaattggaaacaagtctctactacccagaaggacttgatatgggaggatattcaagtatttaacttaaatgttgcatccgacaaggacggtgtcgatgatactatttgtgaaaagtacgacattagccaggaaaagtggacccgattttatcaaagccgtagagacccttcgtggaaggatgagcaaaaaaaggcacaggccattcagaaacaaaacactgcccctcacgttttgtctcgtgggggttatgagcttcttgaaaagaaggtgatggatgagaagaaaaagaaacaattgaaggaagatgctcaatccagaagcactgacaccgtgattgatcctccatctcccatcagacgacatgtgaagtggaagatgacccgcaccaagaaaactggtcaaatgacgtctgaggcagcaaaagaaattgctaacaagatttcgttgggggagcaagcctcacagggagccggtgccattgggcgactagaacaccctggtcgtgtgtgtgctgctggagccggtgtaatgatcaaacaatactttggactggctccaaggacttcttgcacttcttcttccatgactctcgaagaccttgagcaactgacgcaaaagattagggaccaactggaggaatcaatcacaaaaaaagtgactcgacaactaatgttgtcctttagccaaatgcagtctcagtttcaatcgcaaatgcaatcacagggactcacattgcctcctgagccagaggtgggtcctttagctgctcatgtcagcacaaaggagagctgtgttgatccctcagggaattacccagacatggatgactcagagaaatacgggtttgctttgaaaggacttgacgatactccacaaagtaaatccaagactgctgctaggtggattgttgttaaatataatagacaaaaaggaagcactgagtgtgggtattacgtcatgcactag

SEQ ID NO: 73626 - DNA, 422 bp, Glycine max
  Peptide Sequence Number=SeqID_165311
ccttcccggtagtaggatcaacatgcaccactggtctctcagcactaggtggtctagtggacaatgatcgtagacgtgaggctttgcgtgtccgtttcacggcagacagcgaagccgatgcgtccgaaggaggagaaggaggaggaggaggaggaggaggaggagtggaggcagtcaatgtatgcttgatggaatataaatactggaaagatattgagctggtagacgaggaagaagcacagattggtgttgatcgttctagtgcaacctctaataaatctaagatttataaggaggaagcacgaaatgcaacacagaagcataaaccaaagagggtagagagtgtcaatgctgatgcagaagccttgggtgatgactggaaaattcagattgctctatgcattctgaagctgaaccactag

SEQ ID NO: 73627 - DNA, 225 bp, Glycine max
  Peptide Sequence Number=SeqID_165312
atgaaaacacaactttctattaaagatgagcgagacccagtcgagctatgcagccatagaacgcagtcatcagaaggacatacatgtggatgttgtacaacaaatgaatgggtacccagtacacgacggagcatcacagtagactgggtttgtgggaaggtggacacgacggtgagcgtgagcgtcacagcagtctgggttcgtgttttggcggacacagggtag

SEQ ID NO: 73628 - DNA, 246 bp, Glycine max
  Peptide Sequence Number=SeqID_165313
atggagagaacgaggaagaggcagcccatgatgaagccaatggcggagcccaccacgccgagccttagggccctgaggttgatgtgggctcggaaggccttgtcaacgtccttgctgttgagcagattcagggctagcttcatcccctgcgccaccagtgacgataaaaggaagaagctaaacaacactactacgaagacaaggagcttcttcgctacgtcgatattggcgtcgcaagaagagtga

SEQ ID NO: 73629 - DNA, 819 bp, Glycine max
  Peptide Sequence Number=SeqID_165314
atgccatatccactttgtataactaggactgatagcatcacatataagatgtgttctaatgtcatccaaagattgtcatcgaccattcaaacatttaacagatggacagaagtatactccaccaatgtctggtgcattttctttcgcaaattgcaagaaatcttcaaccccattctcatactcgtcacatatgcgaggtcttttcatccaacttcgatccatctttggtgtactgtcatacgagcatctcgctttggtctccaagtaatggaggtggacaatacagacgatcacccaactggacctcctcttgaattagttgcctgtaataatgctgcacctgcaggaagtgtggacaatacggttgaaaatgattttcaggatcatcaattgatggctgacttattaagtgataatggtgaactgaagactgagcaaatttctatgcaagaatctgtattccatggtacttgcaatgcctctgcagcttcgcagggacactcaatttgccaggaaagatccaattccaaagatgtacccacgggattaggtttacaacatgccgaaaagggacaatggagtagaagtgaaaccaaaagaagccatatcattggcaagaagaaaaacagaaggattgaagttgtacataattgcttcattcctcagcaaccacaaggacatcgaagagacaatgaagaccccgtggatactctagacaaggcatatgcatctaaaactaattcttctagattagctcctcgtgcattcacagggaaagggatggataattttcctatcccccctaagaatagaaaatga

SEQ ID NO: 73630 - DNA, 348 bp, Glycine max
  Peptide Sequence Number=SeqID_165315
atgccgatgttggatcaatttcatttgtgcattcatgattccattgaaaacattgtcgatgtcaaagctggcgataaatatggatatcgtgcaattgttgccttattaggtatgtgtgaagattcatggtctttggtgcacaaccatttgcttaaagaactttccaaatggtctgatgagtatatcaacctccttggtggcatagacagatttgaggaattaaagaggtccctacttgttgatggattatccatggaatttgccatggataagtggatgaatataatcgacatagaatacgtcattgcatcaaggtataatgtcatccttgtatctttgtctctctaa

SEQ ID NO: 73631 - DNA, 1186 bp, Glycine max
  Peptide Sequence Number=SeqID_165316
atgcatgaaaaaggtgtgcaacattggcctatagtggaggttttccaaacaaagcctctctcgtcgtgttcgtacaaccctgcaattccaagcttcttcctcctccatctatctgtgttctctatcacagcgctgttgccatcctcagtttccattgccgccgttcaagtcgtctccaccatcgacgtgccatttccgctgttgaggcagggttataggaaaaaccctggggtgagaacatttgcacgtaggcaactggaagctatccctattgctgagaatgttcatcacgtggatgacgcagttgacgaggtccacaaacaacctcaagaagcagccattgatgataaagttgttgatgcccaaggttttctaggcgggccacatgacacattagttctgactgcctatgttgatcatgctgcagtcattgtttggaatgaagaggaacgtcctgaattgaagttatcctcccatggaaggaaggttcagaaattcggcagggctactgtagagattgaaggcttagttgctgccattggattaagtcctttgattgcatgtgccttccatagcttcgagactcttcatgttgatgaagcggtgttgctgttagtcgaattacttaaagtgagtgcagatgaagcaagagctaagacaatacaatgtcatgaggcatatgttcgactatcatggcttgcaacacacatgcatgtggtgttcttggacacttttcgagacctcgaccaaagtggaagctacgcatggggaactgcagccctaatgcatatgtacggcaatttgaatgatgcatctaaaagcagcgacaaacaacttctcgaatatatcatactattacagtgttggatttatgagcattttccatttgttgttgaggctattactgttgaagattatcatgaaaggaaaccatgtgcttgttgctggacctctgggaaggcattaccagtgtcgacgtatcggaagcgtctagatagattgacgtctgatggtgtttgctggatgccttacgatattcctcagtactcggtggatgcaacaactgtggaggaagcacctgcagatgcaccttctcatgtagagcagcctcgacatgcagtggatgcttgccaagaaatagctgaaaggttaaaacgattgttgaacttgaggataatgacagaag

SEQ ID NO: 73632 - DNA, 133 bp, Glycine max
  Peptide Sequence Number=SeqID_165317
gtgcgagttgagccaaccggctgtgcttctcccaaaagagaagggaaaaattgttttagttgatgagcttgaagataatccttcttgtaacagttgctacttgggacacgaagcttctctctttagcttttga

SEQ ID NO: 73633 - DNA, 291 bp, Glycine max
  Peptide Sequence Number=SeqID_165318
atgaaattgaaagacaaatcgagaacatgttacagaaaggcattatccgcccaatttcgcaaactgccctccggcgtgggcgcaaaaaggcctcttgtgcgggccaagggtgcgtcttccatcgtaggaaaatgcgtggagtcaccaccaatgtatattcgaggaaaacgtcgaaaaacccaaaaagacgatggtctgcatattttgaaaatgagggttcagaagttgtttaagcacgagaaagtcgacaagggtgtttccctcgctcctacgtatcctcaattgcgatga

SEQ ID NO: 73634 - DNA, 1383 bp, Glycine max
  Peptide Sequence Number=SeqID_165319
atggataaacaaacactcaaatctataggttgtctcaaatttgtacattggaagcaaacagatgcacatgacttttcaacatttgccattgggcgaccagagcaccctagccgtgttcgtgctgttggagccggtgtcaccataaagcaatactttggatcggcttcacgaatgtcccgcagttcttcctccatgcctcctgaagacctagaacagctgacccaacaaatcagagaccaactggaggagtcaatcacagaaaaagtgactcgaaagatgatggaatctttcagccagatgcagtcccagtttcattctcagatgcaatcacagggacttgcactacctccagagccagaggttggtccctcaggtcctcgtgtcagcacaaaggagagttgtgttgctccctcagggaacgatccagggacgagtgactcagacaaatgcgggctatatattgaagaaaatccttcccgcctggttgccctaggaagactttatgagggatccacaatagttcacaacatccctttgttgcatggccaagtcaaggttggtgttgaggaggttaaagatgcagaggctctcgttcctgtacccattgtcgaggttaccttagtggggcagacacttaacaccttccttgcttggtcaacacatcttgtgaagcgtttatcagaacatgcaactgtgtctccagcaaaacctccaaaaagcccggatgaagaggttgatgatcccctgtacctgatgacattgaccatcccacaactgtttttgaagccgctccaggttatgtgggatgctaccatattcagggtgtttaatcaaaacttcccattgtatataaagcatgaagatctctctgaaattgcacacggtggtcaatgtcttagcatatctgttatacagttgtggattctccatctgactgagacaagtgtgcgagcggggaattctgatgtgtatggactcctcgagccacagtccattcagagatctgggcaatcacaatttgaatccgaaagttacatcaagagttggatacagagttcaaaacgagatatttaccttggagcctacctgaatggcggacactggcaaatggtcgtcattctgcctaaggaaaacctagttgtctggttttgttctttacataacaggccagacaactaccttaagggaataattaacagacaaaaaggaatcacagaatgtggctactacgtgatgcactggatgtccacgataatcttaggatctttcaggaataattgggagacgtattttaatgaagttagaccattggaagcagagagtttcaaggcgcttcgcatccagtgggcacagtattatctaaaagttagaaatcaaacatag

SEQ ID NO: 73635 - DNA, 383 bp, Glycine max
  Peptide Sequence Number=SeqID_165320
atggaagcttggggaagtttggttgattgtccttctgaggaagagttcgatgtgtgccttaagaagtatgctttaaaccaaattgacattgagtatgagcatgtgagttatgctggtattgacagttctcattgtggatgtgtaatgagagctactcatggtcttccttgtgaatgcaagatagttagatatgttgtgggtagcatacctctagaacttgatgtatgtggcaaagttactctaaagagtaaacttcgggaaattgtctaccctaaccaaaactctatgtgtgctcctccagaaaaggtcaaaacaaaaggtgcttacaagaaaccgatgacaaagcatcaaagatcaacaaagtgtgatccatcttactggga

SEQ ID NO: 73636 - DNA, 273 bp, Glycine max
  Peptide Sequence Number=SeqID_165321
atgtggaggacgagtggaattggttacaagatgggtcaggcgcatacccaacttcttcggcatacaaggcaatatatgcatagaggttcagtgtgtttgaggtgttatcaatggttaaacttgtccactgtgctacatgaatcaaccgctgttaatttcaggaatcatttggggacccttagtgataaggaagaatataagcttcacataatggtcgtggctaaagcacaaggaacgaaggttctcgtacatattcgtgcagtgtatatctaa

SEQ ID NO: 73637 - DNA, 453 bp, Glycine max
  Peptide Sequence Number=SeqID_165322
atggtggaaccatcgaagaagcgaaagggggttgcgacttcatccgtagtctccggaacacgaagccacggaacatccaaggcgcagacatctcaaattgctccctttatatcatctcctacgttgatttcctcagaagaacaacgtacccggtacaattctcttttctcttctcgttccattatagaccctaagttcgtagacttagctttctttgatgatgaatttatctccatgaaacttcccttttaccctgaattggttaaatttttttattcaaacttggaaattcaagaagattccttgattttcgaagtctatgggattattatggtcatagaccagtcccttttctttgatctcactcaattgtcaagtgatggcgtaccatttgagggttcacttgatgatgagttgaagtttaatttctctgtgtctgatgcccgccggatg

SEQ ID NO: 73638 - DNA, 111 bp, Glycine max
  Peptide Sequence Number=SeqID_165323
atggaagttggaagttggaaatggaagttgaaagttgaaaatggaagttggaggttggaagttgggaggggaagtggttgtcatcatcaaaaagggggagaatgtaaataa

SEQ ID NO: 73639 - DNA, 399 bp, Glycine max
  Peptide Sequence Number=SeqID_165324
atggccctgcaaactggccgccaaattgactgggcccatcttgttcacttccgtatgcataaggcattacgggcaaatgcatctctcccttatccccacctagttactctgattcagcaacacttcgacattcctcttgctaatgaaccttttgtcaaggttaaatgttcatttgccattggggccactgcagttgcatcctttgggtataggaaagatctagacggtcaatgggttcgtaaacaggatctcccgactaatgctcttgacaaacgcattccatctccaccaccaagagacccatcctcttcattactgaatgatgcccttagtgagcttcggtatcttcatgcctttgtcagagaaaggtttgactcaatggattcacacatcacgtga

SEQ ID NO: 73640 - DNA, 2670 bp, Glycine max
  Peptide Sequence Number=SeqID_165325
atggctatgcaatcatcctcatcttcctttagttacagattcagcaacgatgtgttcctcagcttccgaggggaagatactcgtcacagttttaccggcaatctctataaagctctctctgacagaggaattcacaccttcatcgatgacaagaagctccctagaggagaccaaatcagctcagcacttgagaaggcaattgaagagtccagaatattcatcatcgtgctctctgaaaactatgcatcgtcctccttctgcttaaacgaacttggttacatccttaagtttattaaggggaagggcctattggttttgcctgttttttataaggttgatccttctgatgtgagaaaccatgcaggtagttttggagagtcattggctcatcatgaaaagaagttcaacgctgataaggagactttcaagtgtaacctggtgaagctggagacatggaagatggctcttcaccaagtggctaacttgtctgcgattaagacagtcactaacgtggctgacagtatccttgcgatgactgccacaaaaatctgggaagaatacgaatataagtttattcagaggattgttgagttggtctctaagaagattaatcgtgttcctttacatgttgcggattatccagttggactagagtcacgaatgcaagaagtaaaagcacttctggatgttggatctgatgatgttgtccatatgctggggatacatgggctgggtggagtaggtaaaaccacacttgctgctgcagtttataattccattgctgaccattttgaagctttgtgtttccttgaaaacgtgagagaaacttcaaaaaaacatgggatacaacatctccaaagcaaccttctttctgaaacagttggagagcataagttaataggtgtgaaacaaggaatttccataatacagcataggcttcagcaacagaagattcttttgattctagatgatgttgacaaaagggagcagctacaggcgcttgctggaagacctgatttgtttggtcttggcagtagagtcatcatcacgactcgggacaaacaattgctagcatgtcacggtgttgaacgaacatatgaggtgaatgaattgaatgaggaacatgctcttgaattacttagttggaaagctttcaagttggaaaaagttgatccattttacaaggatgttctgaatcgagcagcaacttatgcttcgggccttccattagctttagaagtaataggttccaacttatatggaagaaatatagaacaatggatatctgctttagatcgatacaaaagaatccctaataaagagatccaagagatacttaaagtgagttatgatgctttggaagaagatgagcaaagtgtttttcttgacattgcttgttgtttcaaaaaatatggtttggtagaggttgaagatatacttcatgctcatcatgggcattgcatgaaacatcatattggagtgttggttgaaaaatctctcataaagattagttgtgatggtaacgtaacactacatgacttgatagaggacatgggtaaagaaattgtcaggcaagaatcagtcaaagaacctgggaaacgtagcagattatggtttccaaaggatatagttcaagttttagaagaaaataagggaactagtcagattgaaataatttgtatggatttccccatatttcaagaaatacaaatagaatgggatgggtatgccttcaagaagatgaaaaaactcaaaacccttaatatcagaaatggtcatttctccaaaggtcccaaacatcttcctaatacattgagagttttggaatggaagagatatcctacacaaaattttccatatgatttttatccgaagaaacttgctatatgcaagttgccttacagcggacttaagagttttcccgccatgaagttgacctctcttgagcaattcaaacttcggtattgtcacagtcttgagagttttccagaaatattaggaaggatggaaagtataaaagaacttgatttgaaagaaactcctgtaaaaaaatttccactttcatttggaaaccttacccggcttcaaaaattacaactgtctttgaccggtgttaatggaattcccctttccagccttggcatgatgccagatctggtctctattataggttggagatgggaattgagtccattccctgaagatgatgacggtgcagaaaaagtgagctcaaccttgtcttcaaacattcaatatcttcagttcagatgctgcaacctaacagatgatttttttcgaatagttctcccatggtttgctaatgtgaagaacttagacctaccaggaaattcttttacagttattcccgaatgcatcaaggaatgccactttttaactaggcttaatttgaattattgtgagtttcttcgagaaattagagggattcctccaaacttgaaatatttctctgcaatagaatgtcgatctttgacttcttcatgtagaagcaagttactgaatcaggatctgcatgagggtggtagtaccttcttttatttgccaggagccaatattccagagtggtttgagttccaaacatcagaattgccaatatctttctggtttcgtaacaaattgccggccatagctatttgtcttgttatggaacag

SEQ ID NO: 73641 - DNA, 1674 bp, Glycine max
  Peptide Sequence Number=SeqID_165326
atggctatgcaatcatcctcatcttcctttagttacagattcagcaacgatttgttcctcagcttccgaggggaagatactcgttgcagttttaccggcaatctctataaagctctctctgacaggggaattcacaccttcatggatgacaagaagatccctagaggggaccaaatcacctcaggacttgagaaggcaattgaagagtccagaatattcatcatcgtgctctctgaaaactatgcatcgtcctccttctgcttaaacgaacttgattacatccttaagtttattaagggaaagggcctattggttttgccagttttttataaggttgatccttctgatgtgagaaaccacacagcggaccccacgggttcgggccccgttgccatgcctaacgctgataaggagactttcaagtgtaacctggtgaagctggagacatggaagatggccctgcaccaagtggctaacttgtctgcgattaagacagttactaacgtggctgacagtattcttgtattgactgccacaaaaatctgggaagaatacgaatataagtttattcagaggattgttgagttggtctctaagaagattaatcgtgctcctttacatgttgcggattatccagttggacttgagtcacgtatgcaagaagtaaaagaacttctggatgttggatctgatgatgtcatccacatgctggggatccatgggcttggtggagtaggtaaaacgacacttgctgccgcagtttataattccattgtcgaccattttgaagctttgtgtttccttgaaaacgtgagagaaacctcaaaaatcatggattacaacatctccaaagaaacattctttctgaaacagctggagaggataaagcctgggaaacgtagtaggttatggctccttacagatatagttcaagttttagaagagaacaaggggactagtcagattgaaatcatatgcatgaatttctcctcattcgaagaagtagaaatagtgtggggtggagatgccctcaagaagatgaaaaatctcaaaacacttattatcagaagtggatatttctccaaaggtgtgggatgggaagggtgtctattccgtaaagaggatgatggtgcagagaatgtgagctcaaccacatcttcaaaagttcaatatcttgatctcagaaactgcaacctgtcagatgaattttttccaatagctctcccatgctttgctaatcatcttcgagaaattagagggattcctccaaacttgaaacatttctttgcaagagaatgcctatccttgacttcctcatgtagaagcatgttactcaatcaggaactgcatgaggctggaagaacctgctatttgctgccaagagccaagattccagagtggtttgagttccaaacatcggaatttccaatttctttctggtttcataataaactcccagccattgctatttgtcatgttattgaacaggtcgctgagttttcctcatcaagaggttggacatctagacccagcattataaccaacatgatcatcaatggtaatgcaaatttgttttactctatggacttgggaagtgattgttcagttctttttgatccgcaggatgataaagtaacagataatttagatgaagcacttttagaaaatgaatga

SEQ ID NO: 73642 - DNA, 258 bp, Glycine max
  Peptide Sequence Number=SeqID_165327
atggcagtggaatggagaaggaagagagagaggagatgccacttcaaggagaagatgagtctagaagaagctcaccaccataggaggtcatggataagcgggctcatacttagcccacgagcccgaaatctatcctatgagaaacctagggccttctcttgcatctctagtccaatcttctttgagtcttctatgcaatgcccttgcgggataggattgcatcaagaaatatatatgtctaggaatggagtgcagtaa

SEQ ID NO: 73643 - DNA, 507 bp, Glycine max
  Peptide Sequence Number=SeqID_165328
atggagaagctagaaacatggaagatggctttgaaccaagtggctaatttttctggttaccatcatttcaaacatagggaagaatacaaatatgagtttattcaaaggattattgagttggtctctaaggagattaatcgtgctcctttacatgttgcggattatccagttggactagagtcacaaatgcaagaagttaaagagcttctggatgttggatctgatgatgtcgtccacatgctagggatacatgggctgggtggagtaggcctaggatcttattcatcaatagattccattgcttcttggaagatgaatggcagcggaatagaaaaggaaaagagagagaggagacgccacttcaaggagaagatgagtctagaagaagctcaccaccataggaggccatggataagagcttggaggaagaaagagattaatgaagggagaggaagagaagagcacaaaattttttgctctacaagagctctgaaatctgaagtttaa

SEQ ID NO: 73644 - DNA, 432 bp, Glycine max
  Peptide Sequence Number=SeqID_165329
atgatgggagatgcatcaaattttattcatatttctctaaaaaatagtgaacatgtgacctatggacacaacagcaaaggttttgatgatgccaaagtattacctatagatggttcttattatcaaaaatggggagaatgtgaatgtatatcatgcagaagcaagcttcatgatgaatcaagattgattcaaagaagttttgatgataacaaaggtgatgacaaaaagctcaaagatcaagaacaacttcatgataacaaagatgatgatctcaagaatcaaagaatgagttcaagatgttcaagattgaatcaagaacatttcaaggttcaagaggaaattcaatttcaagaatcaagaatcaagattcaaggttcaagcttcaaagaatcaagatcaagatgcaagactcaagattcaagaatcaagtga

SEQ ID NO: 73645 - DNA, 408 bp, Glycine max
  Peptide Sequence Number=SeqID_165330
atgagcgtccacgtggcccaggtgattgctgacgccatctacttgtttgcaggtatgccacccaccaggcaccctctggacccggataagtctaacagggccctagggtttccgacgttgattatgggcctctgccaatcattcgaggttcccgtcacccccagtaaggtgatccgacagccgatcacccgggccttcatcgagaagtactgtacgcctaggcaggcgcagggtgatgcacatcaggccacagacgctcagccaccacctcatcaggccgatcccgctggatcactaggcatggagcattatctacagcacttggttcgccagcaggcggccaaccaccgggggcagatgcagatacatgagtgtctctaccggtttagcctcagtcagctggggtag

SEQ ID NO: 73646 - DNA, 162 bp, Glycine max
  Peptide Sequence Number=SeqID_165331
atgactcagctgcttgacggaatcttgatagacatgccatacgcaaatttgatgatttgtttgagaaaattaagaagtgctataaaaatgaagcatagtgagtgtgaaagagatgggaacttggaagctgaggagaatcggaagaactctaggaatttttaa

SEQ ID NO: 73647 - DNA, 144 bp, Glycine max
  Peptide Sequence Number=SeqID_165332
atggggaaagtttggattttgatggtgtttatgttggtgcgtatggttagcaatgttgaaggggcaaggaagcacccatcatcagcgaagaggatccacactctgttctctgtggaatgtcagaactatttcgactggcaaacg

SEQ ID NO: 73648 - DNA, 1164 bp, Glycine max
  Peptide Sequence Number=SeqID_165333
atgttgtattacaacagcaagtggaagataccacgacaagacgattttttgggttactccttcactggaacaaacccaataagatttcaaatacctttaggatatagcatcgaaaaactcaaggatgtcattaaacaagttgcacctataggagtttcctcttatgaaattctcgaatcacaactagtatatgatgaattcggttataacaatcttgtatttcaatggaagggatttttagtttcaggaaagtatgttgcgttgcaaatttgtgatgacaaagatgttgaaactatgatcgaaagttttcaccgacaagatcaaatgtcagttctggaattgtacatagaaaagaatgtggctggtggttctatgtttcattatgcaaattctcttacatcatgtggaaataatttatctaataatgaggcggaaccgccaagaaatgtaagcaatttacatggtgatgaagatgatgatgatgaggattatcttgtgtctaactcatacgttgaagagtctttagatgaagatgatagtgttgacgatatatctgatatagacgatgaagtcaccaacatgattcaaccaataagaattgttcacccagcagaaggtgtagaaaaaattcaaaatctattttggaatgatgctttgcattataacaatatcaactggagtcatcctgatcaggaggacatttgcgggttggagatgccatcgagttttaatgttggacaacaattatatgttggcatagattttaatagtaaagatgcggtaaaaaatgctctgaaacaatatgttatgaaggtgcatcaaagttttaaagttgttgaaagcaaatcaaacaagtatatcgtttgttgctcgaataaaagcgaagagtgtccttgccctttttatacgagggaaattttatctaaaaaaacttattcatggaatgaagcggcaattcctccttctgatgatgcaaggacacttatccctgacccaactacaattcgtgcgaaaggtcggccaaaatcaacaaggataaggaatgagatggattggctcgaaccatctgagcaccgacaaaaatgtagtagatgtggagcagaagggcacaacaggcgtcgatgcccaatgcaatatgatcgtgggagttgttcatttaattga

SEQ ID NO: 73649 - DNA, 915 bp, Glycine max
  Peptide Sequence Number=SeqID_165334
atggcgagaccaaggtggtgtaggctgcagtctagggcgcacagaggagcaggttgtcctaaacgaaagaagacacacattcatctcttcctcgtggctgttacgctttggctgatagcgagaaggtttccttctattcttcatcttcttttcttcaattctctcaaacttgcgtggtgcgcggtggtgccactcatgtgtttccaagttgttgagtggcaccaacccgatagagttttgagacaatttggattgaaacaaccaattctaggatgtccttcacaatccctgaatttgcatggcataacgctgaaaggcaaacaagatgaaaattgggggcaactattcgccccaatgatcagtcaatggaacaatcgagttgattttagggtcaacggttatcctcgacaagagggcctattgagctttaactccgactacatggctaaagttgcggagacattacagtacatggtgtctcctcaagggaggaatacgtggacagttgatgatcttgtgccttatgtggagaaaataacgattctatcggaagaacaagagagaatcgttgagcctgtgtcacatggtccagcaacagagcatcaatttccagcacaacagtttcacattctccactcaagtgttgaaactcaaggcataggcagacgaagggagcaacatgatgccccaattccaacacctaatgtcccattaggtatgcaatggaatgtacccagagcaatacctgatatgggtgacttattaggtgttgatttgcgtcaccaattttctgctgaggctgaccaagtagaagtagggagacattggggcagaagaaatcctgataggcaagcacgaagatgggatcgaccatgtggcacatcctcacgtcatcacggacaacataatgaatga

SEQ ID NO: 73650 - DNA, 406 bp, Glycine max
  Peptide Sequence Number=SeqID_165335
atgactagaggcaatccaggtgacttacaaccctttgatcctgaaatagatagggcatttcatagattagttaggcatagtgtgcatcttgattaccctgaacattttgtaccttttgagcatcctgagcattttgttattggtgagtctgagcattctgtggttggtaattttgaacatcttgattttgagcattataattttgaacattttgattttgaacattctgagtttgaatattctgaaaatatggctcaacctccacctcgtgaaaggactctaagggaaatggctgcacctgatttcacttatgaaagcttgtgcattcaataccctgatgaggatgtcccatatgttcttaaaactagactgatacacttgttgtccaagtttcatggttttgcag

SEQ ID NO: 73651 - DNA, 369 bp, Glycine max
  Peptide Sequence Number=SeqID_165336
atggtggcccatgtgatgttagggcacgactatgagcccagaatgggcttgggaaagaataatgatggcatggccagcttagtggacatcaaggaaaaccgcaagaagtttgggctaggctataagcccacgcgaactgatgtgagaagaagcatcgtagaaaggaggaataggggcacgagcccgcaactaaggccacaagcgaggaaggaccctccttgtcatatcagtaaaagcttcgtgagtgcaggcttgagacataaagagcaagtcaccatgatacacgacaaagcccctcaagaacgttcagactgggtgcggccatgccttcctgattttcaattgggaaacgggcaagccgtggaatga

SEQ ID NO: 73652 - DNA, 537 bp, Glycine max
  Peptide Sequence Number=SeqID_165337
atgatggatatccctggtgggggaaataaagtggctgatcaccataggggaggggggagagttgcttgtgcacgacagggtgacctcgacacttattgcctagttttcctaagtgagagtgtcatgtggacacactcaggctatttcctgatgaatggcttcaacaatgaagaagatgccaagagagtgcttttagatgattctttcattcctgaacgatggagaagcttcaatggacttgaggaagagggatttgttgtcagaaacctctttgatgaagtaggactcatacatagctttctattcaacatggttatgcccatacttgggtcaatagactacgtcagtgcgttcaaggataggttcaaccccaaggtaaagaagaaccatgtcccttatggtatccttttcaatcaaatcatgagggatgttggtgttgatgtgtttggtatggcaccatctggaggggcaacacaacataaggagataacctttgtgaagatggagattactgataatttccaagaatatgcttag

SEQ ID NO: 73653 - DNA, 312 bp, Glycine max
  Peptide Sequence Number=SeqID_165338
atgatgaacatagatcgtaagcctatccttgaagaagtggtgctagagtttgtcatagctcactccgaggataagcaaagaagagctaagcttgaagagcttgagcgaatccagatagttgatgaagatatggagcctaaagaatgtgagcattatgaagaagccttactccactttgtcattgaagcatccttgaaggaagttgaggatgacattgttgaaatagaccctaaagttacactagttcaacaaaggccagtgtctaataaacaagctattaatgttgttctatgtgaagaaatggatgcatga

SEQ ID NO: 73654 - DNA, 168 bp, Glycine max
  Peptide Sequence Number=SeqID_165339
atgacttgctctccgtggcctatgtttgtggactatgtgtgtcaaacatgggtgattctgcacaaagaaaaatttgtgaaagcacggaccaacaaagtgatgcatctaggaaacaccactactaacagggttgagagtgctcatcggtcattaaagagactcctataa

SEQ ID NO: 73655 - DNA, 1491 bp, Glycine max
  Peptide Sequence Number=SeqID_165340
atgggagggctaaagattgtggcagtagggactaccagcaacaatgtatcatcaaagagaaaaactctagatgaggctccactttcatcaagcgagtcggagactcagcatgaccacagatcaacctccacttcctatgcttccatggacccggcaactggtgttaagcagctcaattcggctagcaagaatcaaaaagttagcaaaagatcatccccagatgaaattaaggttgggtttaacccaaacactttagaaactcaatccaatataattgggtcgagttgggattgtgctagagctgctgaagaaggccctagggttctcatgaacctcagggtagatttccgagcccgtgggccaagggtaccctacaaattaagggtacaagttaaggtattgggtggtccgggtggagaaggaggagtctttgaagatgaagattttgtggcattagtgtttgatgatgaacgaacgaaaggagagggtatgataacattgtcaacccctgtgaaggcgcgtgttgttgaggatcctcagacagctgtagaggacttgaacgaaaagcagcaacaaccacctattgaagaaggtgttactgatgttgagggtttttcaggcggaccccatgactcatcagttctgagagatttcgaaaatcacattgctttgagagtgtggaatggaaagctgaagctatcttcccatggaaggaacatggctaagtttgggaggtctgctccagagattgaaggccatgtggcagccagtggactaagtcctttgatcacatgttccctagatacaaacgatcgaggactaatgtctgcttttgtggaacgctggcataaggaaactagtagtttccatttgcccgtcggagaagcgactatcaccttggatgacgtcgcgccgttgctacatttgccgatcttaggggcgtttcatagctttgagcaaattcatgtcgacgacagtgtcaatatgttggtggaatcattcaaggtcagtgctgcagaggggagagctgagacgattcaatgccatggctcctatgttcgactatcatggcttgccacacacttgcacgtggtattcttggaagcattgtgtgacttgacgcaaagtgggacttatgcttgggacactgctactcttgtgcatatgtatgataattcaaatgaggcgtcaaaaagcatgaggaggcagcttgcaggatatatcactctattacaggcactgcctgtgtcgatgtatcgcatgcgtctagatagactgacccctgacattgtatgctggattccgtatggtgaccaccgttcatttagagaatttgaggtcatctccttgtttttcggccatctcagatggggtcccttgatgatcattcaccgaccagagagggttgtacgaaagtttgggtacatccagactattcctccacatcttactgtgccttcaatttctgttgaagaaatggatgctagatga

SEQ ID NO: 73656 - DNA, 369 bp, Glycine max
  Peptide Sequence Number=SeqID_165341
atggggccaaaacaagttccgaggggctttatgggcagcaacagtgaactcaagcttcgaagggataaaagggacaagtcgagggtggaaagtatgatattagaggacaagttgaaggcttgtcaaaggtcgaagaggagcttgaccgaacagctgagtaggacagaagagaatatatggacaatcgttgatcagtataaagggaagttgaaccaagctgttagccatgagcaaaggctagaggacgagcatgcaaaagtatcggctctgcaagcagaaagggaagcaagggaaagagtgatagaatcattgcatggagaagctatgaaatggatggataagttcgctttcactctgaatgggagttaa

SEQ ID NO: 73657 - DNA, 321 bp, Glycine max
  Peptide Sequence Number=SeqID_165342
atgtcatatatttccattgaaccaaagttagatgggattaattgctctttgtccgctccagaagttgaacaacctccaactaattttgaaagtactccgactcctaatgttgaaagtgctctagctccaacttcaactaccactcaaagtgtttcaactcctagtgttgtcattatttataattattgtagggaacaagcttcataccttgatagaggactatccaaggaggaagagcttggcttaagtgggcacaacatggatggaccaatcactagagcaaggagtaagagatttcaagaaaagcttgcaagagactaa

SEQ ID NO: 73658 - DNA, 376 bp, Glycine max
  Peptide Sequence Number=SeqID_165343
atgactggcgaggggattagtccttacatttgggctatcctcttgaaatgttgcattggggttgtaccatcaagggaagggagactggtagatcttctcggggttcactatagccatctggttggtgatcaaggatggcttctttgctggaaaattccttctcggattggtgtttgcgctggggttggtgttgccgacgggacgagattgtgcgggaaacgagttttatgggggaggcctttgtggttgagtgggaaatctttgttggacggacgttggattgagaggggccatgtgggagctgaagttacagcatgggtgtctccctctttcttcttggctccacccactctgaacctcctattgctttgcggaa

SEQ ID NO: 73659 - DNA, 213 bp, Glycine max
  Peptide Sequence Number=SeqID_165344
atggccatagtagcatggcctggagataggcccaattttcaggcaggggcaggacccacagggacccccggagacgaggatagagctcaggaggatgatgacatggctgatgggttcagactttcaacattgaaaggatttagtgaaattaaggagaagaaggagaaagaagaagaaaaacgaggccgaggcgcttctgaatcgcaatcgtga

SEQ ID NO: 73660 - DNA, 753 bp, Glycine max
  Peptide Sequence Number=SeqID_165345
atgtcgtcgccggacattgtctcgatattggataactcgaaggagctcgatcgggttaggaaagaacaggaggatattctgtcggagatcaacaagcttcacaagaagcttcaagcaactcctgaagtggttgagaagcctggggataactcattggcaaggctgaaatttttgtatactcaagcaaaagaactttcagaaagtgaagcaagtatttccaacttactgataaaccaaattgatgccctactgcctacgggtccacaagggcaaacacgaagaagaataggaaaagctgacagtacttgtgttacagaaggtaatgagcagaaaaggaaacgagtgaagactgagtcagatatttcaaggctaactcctagtatgcgaggtcaacttgaggcttgtgccaatcttaaaggtgaacaggtagcagctagggtcacaccacgaaatgccgataaggatgaatggtttgtcgtaaaagtgattcattttgataaggaatcaaaggaatttgaagtactagatgaggaaccaggtgatgatgaagaaagcagtggccaaagacaatacaagcttcccatggcaaatatcattccttttcccaagagtaatgatccttctagcgctcaagatttccctcctggaagacatgttttggcggtctatccaggaactactgcactttataaagcaacagttgttcaaggccatcgcagagtaataattctctcattttccttagtagagtga

SEQ ID NO: 73661 - DNA, 174 bp, Glycine max
  Peptide Sequence Number=SeqID_165346
atggatgggcgactccgcatcttaggccaagattgttgcagatcttgtgttgtgcggaatggagaaggagaaagacgaatggagacaccacttcaattagaagatgagtctagaagaagatcaccaccatgggaagccatggataagagcttgaaggtagaagaagatgaatga

SEQ ID NO: 73662 - DNA, 363 bp, Glycine max
  Peptide Sequence Number=SeqID_165347
atgctgacatctccgagaaaggtgcaggtgacgatgttagtcactgcatgctatcgggctttgagtcttacgatagtagaaggtggggtggtcgacaaaagtggggcttttgctcctacgtatcctcaatttgagatgaggaactcagacctacgtagttcttgcgaaagcggtgtgagactaaaagagtctctatcggaagatgttgacatctcaggaaagggtgcagatgaccacattggtgcggataaccgtaaggtgtctccgcatgatatcggactctcgggtcgctggatagcaaagggtgtgtgcgggttaccgtcgggtgtctctgcatgccaccagactcttgggtcacggtaa

SEQ ID NO: 73663 - DNA, 354 bp, Glycine max
  Peptide Sequence Number=SeqID_165348
atgaggattgcagagaatcaatttatgttaggaaggtttacaacacgaagaggaacttaccttgacaatgtcgacgcgaggacgcagcaacaccaccgtcaacacccacagaagacgaacgaagcacgcaattggaaggtcacgaagaagaccagcgaaggtgacaaagaagacgcaaaagaagctttttcgagaggaagaagaaggattcgaagaaggatgcgaaggtcaccaatgaaggtcacgaagaagcagcaatggcaaggaagaagaggaatggcaaggaagaggaagaagcaacataaatggcgaagaagaagaaatggcggaaatgaaccgctttttttaaattaa

SEQ ID NO: 73664 - DNA, 942 bp, Glycine max
  Peptide Sequence Number=SeqID_165349
atggcgacgatgatgtggtccttggagaggagtgattgggactcggtggagaccagatctgatgatgctgaagttgaactcgctcttagagtcttggaagggtgttttttgcttcaccctcaaagtactgctctcgcccatcaacacaacgctattcaagttttaatgaatatattatccactcgtggagtgcttgagcaaggtgcatgcttagatgctctaatctcattgattgtggattcatcatccaatcaaatggatgtactgattgatgttcctcttgatgcttatgagatagtttgtctaagggttggggtcgctgttcacaaccttgggcagttttaccttggacaacggaagttggaagaagctccatatgttgcggtttccagaagtggtcaagaaaatctccttcaggctcccttattgtctagatcaaatagcatggaggcttccttggcaaaggatacttcctctaatgatgtgaaaaatggtcaagggttcaaaggccatagcatgcttgctcctttcacagctgggtggcagactactaatttgcattctctggtcatagaaaagtcagagggaagctatgtatatgacattaacgggaagaaatatcttgatgcacttgctggtctatgggccacttctttaggcagtaagaatgaatgcaatttctactttaaggttgttatatacaggctacatgtcttcaaggatgcagagtggactgatttgtggggaacattgatcatcaattgcagtggccaaaagcagagagtatccatggctagagctgtctactccaattctcatgtgtacatctttgatgatcccctaagtgctctcgatgcgcatgtggctagacaggttacctttatgccaactaacttctctatagcttctgttatttctatattagcactcaatgagatataa

SEQ ID NO: 73665 - DNA, 111 bp, Glycine max
  Peptide Sequence Number=SeqID_165350
atgcagtgcgatagggtccttgtagcctgttgttgcgagggagccggtggcgaagcgggaggtgcagcggtcgctgtggtatcccaggatggtgttagtatagagcaataa

SEQ ID NO: 73666 - DNA, 849 bp, Glycine max
  Peptide Sequence Number=SeqID_165351
atgaaaagagaaaaacatgtctcctatagtagtcataactcttgcaagagcctaagtgaagaacttcgtgactattatgaaggaaggcataggtcacatcttagacctcactcccataggagagaaaatgaaagaaagcctcaagaggttaacattaaactcccatacttccatgggaaggacaatgtagaggctaattttgattgggaaataagggtagagcaacaacttaaaaggaagtctacttcaaaatcttatggctctcactcttatccaaagaatgaccaaggtcaaggaatcttaggggtgagaccttataagcccaaagatgataaggggaagacaatagaaaagcaaccccttaaggctagtatgcaagagaagactagctccatgaagtgctttaaatgtcttggaagaggacacattacttctcaatgccccaccaagaaaacaatgattatgaggggccaagacatttatagtagccaagatgaggctactacttcaccttcctctagtaaaagtgaagaagcaaaagtggaagaatctagtgaagagatctacccccaagaagaaggacaacctttaatggttaagaaggagtgtaaggagacacttgttagcattgccacatctcttaggcttgagtttattcctcaagtaaaggagttgttggatgatggggttcccatgaaccctaagagaataaaggtcattcctgagtggcccgctccaccaagtgttgaggaaaaaagcccagagtttcaagaacctcgggatttgaggtcaaatccttttcaagggggagggaatgatgcaatcctaccccgcaagggcattggatag

SEQ ID NO: 73667 - DNA, 180 bp, Glycine max
  Peptide Sequence Number=SeqID_165352
atggagcttacatcatgtgcggaagggagaaggaagagagagaggagacgccacttcaaggagaagatgagtctagaagaagctcaccaccataggaggccatggataagagcttggaggaagaaggagatgaatgaagggagaggaagagaagagcacgaaattttgtgctctaaatga

SEQ ID NO: 73668 - DNA, 327 bp, Glycine max
  Peptide Sequence Number=SeqID_165353
atgctgataaggagcaatctattaaagcacaggctgaggttgctgccaagtccttggatgacaacattattaatgagatcattattgatctcactaacactggtgacatggactagaccccaaccgcattcaaagttgctcaagctgatgaggccctcattcaaccaaaagaacccacgtccaagcgttgatgttgctcctacacctcctattgttgcccttactatcgtccaaccaccaccacctgccattgaaccatccctctcgtcctctattcctagcttcgttgaacaaacatctccaccattacctcaagttcaagtgtga

SEQ ID NO: 73669 - DNA, 432 bp, Glycine max
  Peptide Sequence Number=SeqID_165354
atggcagtgcagttgattcatgatcacgttgtgatggagtgcctagagggcgtttgggagaccctcgaaggcaatgagaggtgccgattccgtggcacaattcgactcactgctacttcactagtacatccggagcaacccgcacgcatacttcagcagcctgtggagtggatactacctatacctactccatatcgactagttgagccggttcaagtgatagaggtgtcatcctctgaagaggatcttgaagaggacccagaggagttacctcctgaacctactgtggatgcccctgacttcccaaaggatgatgaggacccactccctgatgttgattctcctaaggatattatgtcagtatctgaggcagactctacagaggagagtggccctggagggacagcgaatagtgacgactcttcatcatag

SEQ ID NO: 73670 - DNA, 231 bp, Glycine max
  Peptide Sequence Number=SeqID_165355
atggcttgtatatcgtcatcatcttccatggtgaatagttcatacttacgtgccaacaagttgagcttgttatgttttacctatgacgatccttcacatgtcagagctagaacctttgtctttgagtggtctgttcaagaggtactaggaacttcattcaagttgtcgtatttgacgcctttgaatagtggtggcttgtatgtgaaatatccttcttccatatctatttga

SEQ ID NO: 73671 - DNA, 540 bp, Glycine max
  Peptide Sequence Number=SeqID_165356
atggattctaggaaaagaaaggcaccctctacacctacccaagtcagatttgacagatccatattcacttcccaagaggcttgggaaagatacacagatgttattgtgcctatgaagcttttgcctgagaggaacgtggttgtttataccacagagtttgatgaattcttagatgagctggctagacgccactgggatgaggaattgactgatttcattgacgtcagcatcgatgttgccattgtgaaggagttttacgccaacctctatgaccctgaggacaaatcacctaagcaggtgagggtgagaggtcatttgattaagtttgatgaggacactcttaacacatttttgaagacccttgttattgtggaagagggggaatcactctgtgcttattccagatttgcactccggaggcctgatcctcaggagttagctgctaagctctgtatcccagggaggggattcaagcttaatgtcgatggatacccagtaaagattctgaggaagaacatgactgcactaactcagacatag

SEQ ID NO: 73672 - DNA, 411 bp, Glycine max
  Peptide Sequence Number=SeqID_165357
atgccgaggcgctgcggaatcgcgactgtcatcaatctctacgttgttccttgttcgttattcttcgtgcaaccattgtggatgtaccctccactagaactgatccacaagagatgtaccccttcttgttctcagtcaacaacccaagtagatgtacgctctacttgtaccacaaaggatgtactctccaatgtgttaagacaaagttctcaggcagttaaacctttgaaactttgtgagtggggatacaaaagaattctcaggcgggagaagggagacacaaaagaattcaggcagttagtcgtttgttcttctgaaaaagggagaagagagacacaaaaagaattcaggcggttagtccttggcgaattctttttggcaaagggagaagggaatgaaaaagatgaataa

SEQ ID NO: 73673 - DNA, 1026 bp, Glycine max
  Peptide Sequence Number=SeqID_165358
atgcttgatgcatggttcacagacgagaataagaagaacaacttcaagataatatacacaacgaagaatgtgagaatacccaagtttctagacttggagtggttttctcagcaagggtttaacttccctaatctgctcgaagcacagggtctacctaagcttgtgcaaatgaaaggaactttctacccggagttggtgaaaattttctatacttgtgcccgcgccgatatggaagaaatggttatcgatgatacagtttggaaggtggtagccggactggacatgggtggagtctgcaagtttgaagaatctgttgatggttacaataagatgcagacttacagagctatgctccttgacccagcaaggaatctgaggaatcacttaagtgtaggtggtttaactgctagagacagaatgctcgtgtaccttataacagacattctcacaccgaggtccaacaaccacgcacaggtgactaacaatgatttacagatcgtgtatggtctaaaatcaggtattcaaatgaattgggtactccttattgaagacatcatgttgaaaagttgtcggttagtggactataagtttctgtatgctgtgctagcctctagattcattcattatttcaatgtcgatgtttctaatgagattgtagactttaccaaagcatccaatgagataaccaaaaggcatatcaagaatcttgggatgaggtttgttgaatacaaatggatcatggctggagagtcaccaacaacaaacatggaccagatggaagaagaagctgaagatgaagctcagcaagagcttatgcaccaatggagtcctttagagtctctcatgattcaaaagatggatgccatgcttcatctccatcaagagcactcagtagatgttcacaacaccttagaaaacataaccactaggctagagaacatagaaactaggctaacccttagtaacctaaactggatgagaatgaagcgtagttatgttcttgtgcttggttttgctgtctgttga

SEQ ID NO: 73674 - DNA, 879 bp, Glycine max
  Peptide Sequence Number=SeqID_165359
atggcctcaaagaagagacgtgcttcatcctctagacctcacgagccctatgacacatccagatttgtgtctgaggtcgcatgggagagaaatatggagatagcttactcccattatgacgagttcctccaagagctggagaggcgccagtggcacaggaacttgacaaggcaaatggagaatcacattgaccttgccttggggaagatgatcaaattcgacgccgcaacactaaatgccttcttggagacctcggtggtactagagcctggggagagggcgaggatggtgtatggccttgttatgaagatggatatggatttgggctcgatcatcttaggtcagatctcccagatggcccagtccaacgcctctaggttgggcttccctgctcttatcacagccctatgcatagccaaagaggttgtgtctaattcacttaccttcgaggccccttcagacgcttcagctttagcttcagttccagctctcacaccagcaccagcccctccactttcagcaccgactctagctccagctggcccttctatgtatagcactgatgccattgtgctgatgctgcagagccttctccaagcctttggctgcatagaggacttcatggcacaggtggcttggcccggagtcccacctttctttttgggggcaggtgaggctcttgtggcccaggagccatacatacaggttcctgaagatcctgaagacactctagttgaagcagctgcggatgataccccagaagcaaaggcggaagctgaggagacacttgtagatacaccgatggaggcggctgaggagggaggcacaacagaggcaggcattgacgaggactatgtagtatatgtcactgcggcatag

SEQ ID NO: 73675 - DNA, 612 bp, Glycine max
  Peptide Sequence Number=SeqID_165360
atgtgggatacattacaagtaacccatgaaggcacaactaatgtcaagagatctagaataaacattctcacacatgaatatgaactgtttagaatgaatcaatatgacaccatacaagatatgcaaaagagatttactcatatagttaatcatcttgcatcgttgggaaaaatatttcctaatgaagatctcattaacaaaagattcaataaatttcaaagaaacaaaggaaatcaaaggatatcaaacatcaatccaaagaagaaaggagaagattcctccttagccccaaaatgctatgaatgcgatcaacctgggcacaggagattcaattgtcctatctttaaaagaagaatggaaaaatccgacaagaggaatttcaaagaaaagaaagcatacatcacttgggaagataataacatggattcttcaagtgattcagaaaatgaaatcataaatatgggtctcatggtgaaagactatgaaagcgaagaagagataatgtcttctaactatgacttatctatttcttttgatgaacttcaagatgcattgaatgatttgtataaagaatctatcaaactttccaaattagtttcatattctaagtaa

SEQ ID NO: 73676 - DNA, 153 bp, Glycine max
  Peptide Sequence Number=SeqID_165361
atgactgtgagagcattagcatcaaggccgcgcgctaagtgcgagattagtgcgctaagcacaacaggtgtcttcagccaggctcaacgcacgattggcgctaagctcgaaggtggcgctaagcgcaacattgcgaatttagagcctatttaa

SEQ ID NO: 73677 - DNA, 405 bp, Glycine max
  Peptide Sequence Number=SeqID_165362
atgcattatatcattgttcgtattttgcttcctcggtcttcaaaccttgcccaagcctctgaagaggatttgattctgatgtgggcttttcaaactagtcgtcagatcgactgggcccatttagttcggtaccgaatgcataaggcattacgggccaatgcacctctgccttatcttcaccttgttactctttttcttcatcatttcaattttcctttggattatgaaccatttgtcaaggtcaaaaggtctttctcaattggtgctggtgtggttacctcctttggttatcgaaaggatgttgatggtcaatggtactcacaaagctttgcgacctttgagattttatgggtgagcgcttcaatgccatggacaccaggattactaggcttgcagatgatatga

SEQ ID NO: 73678 - DNA, 717 bp, Glycine max
  Peptide Sequence Number=SeqID_165363
atgaatggccttgagaaagagaatatccatcttcttgagaatctttctaatatcaaagaggaagttgctaactgtgtggagtttgctagagtattatcgtcaggagttgacatctttgtcaattactccttctccaactctcataaagttctagcatctactgttggtgtcacccgtttctggtatgcctgtatcgctggtttttactttgaggagaggctttgtctactgaagaatcttgcagaggcaagcaggaagccatatgtagcaattattggaggtggtaatctctatgataaagcagcttcctttcagtttttagcttccagatgtcaatggtttgtatttgtgggaatgatgccatttcaagtaatgcatgcattaggagtatctgttcctcgtaatttagtggaccataaggcatttaatgaagctctagatacatgtccaaaccctgatttcaataaacctgagcatagatggaggatgctgcagagatctttaatcgaagcagtggtggatcttctagcacctaatgggaagactattgacattgaccagatctttctgcaatccgatgtagaagccgtggcaataagaatgaaagaacaatttttgacatatggcaagggtaagcttgatatggagcatggccaaagtgagtggcttgaggaaaacccatttggacttgatcagattgggaaaggcatgttttag

SEQ ID NO: 73679 - DNA, 321 bp, Glycine max
  Peptide Sequence Number=SeqID_165364
atgaagaacaatggaaaaccttcacggattcgcacacggaaacgtctccgaagcgttacagaagcacctcggcttggattttcttcacggaaacaattttttcacccaaaacaactgaaatgcatagccagggggattgaggatatttggaacagccccctttcgcttatttataggaaaaagggggaggaggttgccacccaactcgcccaggcgagcagggaattttacggaagcattacggaagcttcggaagctccgaaaacccttttccatcaaaacgtggaggatcttgataagttcacccctccccttttctaa

SEQ ID NO: 73680 - DNA, 135 bp, Glycine max
  Peptide Sequence Number=SeqID_165365
atgtgggaggaagcatatggaaagttgcatgaggttggtgatgtagaagatgtggatttttacaagcgtggaaatttcctataccatataagattaaaggaaacggatacaagatgcggggtatttatcaggtag

SEQ ID NO: 73681 - DNA, 60 bp, Glycine max
  Peptide Sequence Number=SeqID_165366
gagtgcaaaaggctaagtatggggggtttcgatgtgccatcatttccttctattttctaa

SEQ ID NO: 73682 - DNA, 666 bp, Glycine max
  Peptide Sequence Number=SeqID_165367
atggaaaagtgcaaagaagcatcaacaccaatgacaacatccatttatcttgatttggaagttaaatcagtcgatgaatcaaagtatagagagctattcaaggttttctacacttgtgcacttgctgaccttcaaggtaacctcttctctactattaatggagtagatatggtcattgatgttattgtgtggaaaaaagtagccagtctgggcatgggtggagttcgcaagttcaatgaaacacttgatgggtacaacaagatgcaaacctataagggaatgcttcttgaccctgctaggaacttgaggaatcacttaagagttggtggattgactgcagaggacaaaattttagtttacctcattacctacattctcataccgaggtcaagcaatcatgctcaggtaacagatgataatctacatatagtttatgatctaaaatcaggtatcaagattaactgggtactgctgattgaagacattatgttgaagagtcctcaccttgtggattatgaatttctttatgttgttatttcctcaagattcattgactacttcaatcttgatgtctctaatgagattgtggactttaccaaagcctctagcgagattaccgaaaggaatctcaagaagcttggaatgaggattgttgatcatgaatag

SEQ ID NO: 73683 - DNA, 690 bp, Glycine max
  Peptide Sequence Number=SeqID_165368
atgggtctaaacaaatcactttcaaagagggtgcatctcttaaatgacctctattgtttgagggagaacatttttcattttgtcaaaaacaaatggaaatctttatttagtcaattgatcctggtgcatggtgaattggtgcctaaagaattggttgaaatgaaagatgatgagaaaagaaaagtgcaagatgatcaaaaagctaaaaacattttaacttctggtttatcttctaatgatttttttttatcaagaaatcacagtcttgtatttgaatatgaagctttccaaatgaagaatggagaaaccatttcagaacttcaaacaagattcacccatattgtgaatcaccttcttggtcttggaaaaaagtttgaagaaaagaaaagaaaaggagttatactcaaggtcaaatatttaaaggaagattacaaagaaagctctagtgatgacaaagatgtagagaatttaagcttaatggtaaagaagtttggaaaatttctcaaaagaaccaaagacaaaaaaatctctaaactttcaaagaagatagaaagtaacaacaccttcacgtgcttcgaatgtgagaagcaaggtcacatcaaatttgaatgtcctatctaccctaaaaaacaacttcctggtaagaaaggaaagaaggatagaaaacagaaaaaggccttcattgcgtag

SEQ ID NO: 73684 - DNA, 231 bp, Glycine max
  Peptide Sequence Number=SeqID_165369
atggataaatttaagattataatagcacaaagtgctgcactcgctttgaccatagttaacttttgtaatccttcggacttactaggtgttggttcaatactaagctttggagctagaagtgatgcaatcctccctaggaagggaccaatcactagacccatgagcaagaggttccaagaggattgggctagagctgttgaagaaggccctagggttctcatgaaccttagg

SEQ ID NO: 73685 - DNA, 219 bp, Glycine max
  Peptide Sequence Number=SeqID_165370
atggcagcggaatggagaaggaagagagagaggagatgccacttcaaggagaagatgagtctagaagaagctcaccaccataggaggccatggataagagcttggaggaagaaggagatgaatgaagggagagggagagaagagcacgaaattttcccactaatccaagatcaattccaagattctccactaagtgtgcttaggtgtcatgaggcatga

SEQ ID NO: 73686 - DNA, 93 bp, Glycine max
  Peptide Sequence Number=SeqID_165371
atggggggtgcagtgacaatgatggatatccctggtgggggaatagagtggttagaaagttttaagcatctctggagtgaaggggtgacttaa

SEQ ID NO: 73687 - DNA, 229 bp, Glycine max
  Peptide Sequence Number=SeqID_165372
atgcaacatggacagacagatattctcatagctaggttccctgaccctaactatgatgtcaaaatggtaaattttatattaactcccctcacctatcgtgagctccccgtcgattcctctttgcgtcacttagaggtccctctctcattcgcgcttgtcgatccaacgcaagtctctattacgccaaaacgaaaggaatttaatatgaatttcaacaacaaggtcaaag

SEQ ID NO: 73688 - DNA, 807 bp, Glycine max
  Peptide Sequence Number=SeqID_165373
atgagtcatcattcatctagtgttaatggcaaggaaaaactagaaagaaaagaaaaaggaaaagagagggtaaaaataaatcaagatgagagggaacaaataagggaagaagaaagaaggaaaatactaaaagaattaagaaaagaaaaacatgcctcctatagtagtcataactcttgcaagagcctaagtgaggaacttcgtgactattatgaaggaaggcataggttacatcttagacctcactcccatatgagagaaaaggaaagaaagcctcaagaggctaacattaacctcccatacttccatgggaaggataatgtagaggctaacttagattgggaaataagggtagagaaacaacttaaaaggaagtctacttcaaaatcttatggctctcactcttatccaaagaaaaaccaaggtcaaggcatcttaggggtgacaccttcgaagcccaaagatgataaggggaagacaatagaaaggcaacctcttaaggctagtatgcaagagaatactagatttataaagtgcttcaaatgtcttggaagaggacacattaattctcaatgccccaccaagaaaaccatgattatgaggggccaagacatttatagtagccaagatgaagctactacttttccttcctctagtgaaagtgaagaagcaaaagaggaagaatctagtgaagagatctacccacaagaagaaggacaacctttaatggttaaggaggagtgtaaggaggcaagtgtctcctccaagaggttagctaagaaggaaaggaaaggcattttgaaataa

SEQ ID NO: 73689 - DNA, 653 bp, Glycine max
  Peptide Sequence Number=SeqID_165374
atgttgagaaacatttgaaggttcatcaaactactataaagaagggaagacggatcaacacttacatttatgatagaacaatgttgattagcatcatgaagaagttcataattggaagagacttgactaggcctgagtggaaaacaagcaagtttagaacttcacaggaggggagaaaagtacagaatatggctttggatagtcgattttggaagaaagtaaccatgtgcctcaaagttgctactcatcttatggtagtccttcgattgttggattcagggattttctctatggaagagccaaaggacactagaaaagttatgcaacctggagaatggtgggagatgtttggtgatggaactctagagttgaggaggtttgctatccgtattgagtatgataatgaatggataactaaagagggatataatgatgaggatgagcaacctccaggtgaaggtgatggtgccaatgttgaattagtgggagatgttggaggaagttcaaatgatccagttgtagaagcttttggtctagataatttaattttggtggaacctaatgatgatgcacatttgaggaagaccttgatgatgatggagatgatgatgaaactgatgatattcatggagatgatcctattagaggattaa

SEQ ID NO: 73690 - DNA, 372 bp, Glycine max
  Peptide Sequence Number=SeqID_165375
atgcctaagcactacacagcaccaccaacaatggaaacgcaaacgacggggagggagaagagggcttacctcgacaatgccgacgagctgaagaagaagacaccacgggacgacgctgcaatgctgaagaacgaaaaggaagcagaagaagaagggagctgcgatgctgaagaagaagtgttgggtgcaccagcatcagccttgggtgcacctagcatcagccttgcttgtttcagctatgttacggattctgaggattgtggacgatcctttaaggaatttatcttaaagtccctttgcgatcaacatggtgatatggcgaatattctaagggatacttgccacactccatggataagtttaacatcttga

SEQ ID NO: 73691 - DNA, 618 bp, Glycine max
  Peptide Sequence Number=SeqID_165376
atgccgatggattgctacgaaggcaactgtgaagttcatatctacagcgaagtacaggcagcgtctggatcgactcaagattcttgttggatgccttttagggagcatcgagtcattcgggagtttgatatgatttcatgcttttccggtcagctctgttgggggcccgttgccgtcagacaccgactagagagggtcatgcgccagttcggatacgtccagagtattcctgcaaggcctgttgattcatgggtgtcatttgaagaaatagacgacggaaggatgcactactcagaccatcttgcgccagcaggtgagatatgtcttgtgccaagtcagtgtgcgcccgagtacatggattggttcttcgtcatttctcatccactcacgatcacggcacaaccatcagatctgccgcaagatccacctgcgacgcatgatgcctcatttatagagccatatatccctcaggtcccagagctagtagcaacatcgattcatgcccgttctaatgtggacgagcctagacatgcagtggaggcttgccatgcgattcctgaaaggttggagcgtcatttcaacctaaggatagtcacgccaggcacaaagacacatgag

SEQ ID NO: 73692 - DNA, 432 bp, Glycine max
  Peptide Sequence Number=SeqID_165377
atgcactactcagaccatcttgcgccagcaggtgagatatgtcttgtgccaagtcagtgtgcgcccgagtacatggattggttcttcgtcatttctcatccactcacgatcacggcacaaccatcagatctgccgcaagatccacctgcgacgcatgatgcctcatttatagagccatatatccctcaggtcccagagctagtagcaacatcgattcatgcccgttctaatgtggacgagcctagacatgcagtggaggcttgccatgcgattcctgaaaggttggagcgtcatttcaacctaaggatagtcacgccaggcacaaagacacatgaggtcatggaacaatgcctcaggattgtcaggggtgtcacagaagaccgcattgtgtatgtgaggtctcgtcgtaggtggcgcacggatcaattatag

SEQ ID NO: 73693 - DNA, 1038 bp, Glycine max
  Peptide Sequence Number=SeqID_165378
atgggtgagagcaagaaacgaaagagacacagaaacaaacgtggtggtaaggaggagcaaccgatgcgagcaaggttgtctggtgggcatttcaggatgattaatgaaaagctctacacttgcactggggaggaggcgctagattatttcaaggaagaaccttcgctatttgatgtgactccccttgactcctcatctgttgacgtcgccatcttctgtctttcattgatgggaaccaactaccaaagttacctcgaagaatcgtacagactgctcaagccaggtggctggcttttgatagcagaagtaaagagcaggtttgatccaaatactggaggagcagaccctaaaaagttctcaaatgctatttccgagctaggtttcagctctgtaaaacagtgcttcgtcgtattttcttcgttttcttacgattggttagcttcagtgaaggtgaagatgtcggtgttcattgttgcggtggttggttcgtcgttggcgacatacgagatggacgaagatcaatggatgtatgacactataatgtctgaagaagttgatatgaatgatcaaaatgaacaagaatgtgatgtgtttgacagccgagatgatgtattgcattgggctcgatccgttgctcatgaaaacagatttgtgacggtcattataaggtctgacacaaacactggagtgacgagtataggtgtaggaagaaagaatttgttagaagagatactgggactaggaaatgtgggtgtcccttcaagcttcatggcaaaccaatggttggaggataagggtgaacgtcttaataatgtgatatgggctttagaacggtttcgagatatatttttaagacgtgatgccctccctggacttattgtgactgacagagacctagcattgatgaattatgtcatggatacttggggaagtctggttgattgtccttcggagcagcagtttgatgaatgcctgaagaagtttgaaatggcttgttcaccttggccaatgtttgttgactatgtcaacgaaacatga

SEQ ID NO: 73694 - DNA, 1020 bp, Glycine max
  Peptide Sequence Number=SeqID_165379
atggaggccatgaaggagcaaatgacgacaatgatggaggtgatgatggatatgacgaagataatggaggttaacattgttgcagctgctactgctagtaccgttactgagagagacccaactcacccgctcatttttaatcaagaaagtcacctagtgacggatgtggaaggtcaaggaggtgtgatgagggtagctgcatatgggcctcagtacacacatagccataatagatatacttttccaccatatggtctgcctcctaactatacaccacccatggctgtaccggtgcctgtcaagaacgttactaatcctatccctgtttgtactaagaatcatccaactcaaccaaatcagaatcaagcctataactttaatgccagggaggaggcacgagaagctcccgtagaccacactgtaattggtttcgggccccatccaggatatactactgaaggacatgtattttctggcgtccttgtgctgaacgctcctggagcctctcaatatcgcccattatcacaagccttgcattttgtgaggggagaagggcctccctcagtatttgagaagaaaaagattgagcatatggaggagaggctacgcgccatcaaaggggggggggagttatggttttgccgacatgtcagggctatgtttcgtacccgatgtgactattcccctgaagttcaaggggaaaagattgaagttggtttgaagaaggggaagtttgattatgctgcttccacgaattttggtagtaggaggcctgagatgaatggagtcaagaagaaagagggaaaagaccatgtcgtggatacatttcccacatggccaaacttcccgcaaaccccttataaccccatgtatcagtatcctccacaccaataccactactcggccaatatcagccctcccccccctgctcaatacccctttaaccaagagcacccaatcaaccacagagaccacccgaaaatcacccacaaaatccatcccctatacaacctagactaa

SEQ ID NO: 73695 - DNA, 492 bp, Glycine max
  Peptide Sequence Number=SeqID_165380
atggatgatgagatagtgaagcctcagccacagcaatggcatccagctataaagacatttaagaagcgctcctgggaggatgggtacattgcacatgctccaaagaaactcacctgtaagagagctaggaagaccactgcaagagaagggtctagcatagctttgcttgtagaaattgaatttgatggacaccactttcgtacagagattgctagaaggtgctggacacaacttgcagagcccatgcctaaatatgaccctgagattgtcatggaattttatgtaaatgcttggcctacggaggaaggtgttgtggataagcgctccaaagtgcagggccaatggattccttatgacatagatgccatcaaccaatttttagggaatccattgatcctagaagagggggaacaacgtgaatatattgcgaggagaagtcagactacaagttttgatgaagatcctatggacatgattttgtatggagcatga

SEQ ID NO: 73696 - DNA, 144 bp, Glycine max
  Peptide Sequence Number=SeqID_165381
gaaaaactctatcagtggatcttgaggcaacaagagggtggatcaagagttgcaactgttgatatactcaactacattcagagggagacaaaaagcgggtggggaattatagctgtggaagttagtgagaagaaggctagttaa

SEQ ID NO: 73697 - DNA, 360 bp, Glycine max
  Peptide Sequence Number=SeqID_165382
atgggcaaatttactaatgacggagggggtctgttcttgggtgtaacccgccattgccactggtggcaaaggtggagagaggctggtatcgttactggtagtggcgatataggtggagagaggctgttgcatgatactcaacgtatgaagttgcagatgctctccttgttcatgatgagactaaacataaggtctgaaatagggttcaaagctagctgtagatgttcacaggttgcgcatgctctccttgttcatgatgagactaaacataagagcacttgcaatgatattgaatacttgcaaaatttcatactgaaagagagtaagaaactgaagagaggaagaaagactttcgtttga

SEQ ID NO: 73698 - DNA, 327 bp, Glycine max
  Peptide Sequence Number=SeqID_165383
atggaggtcatgatgagcatggaaaagataatggacgtcaatgtggctgtcattgccgctacatgcactattgctgaggtggagccaacccccccatttggcctcaaccaaataaatcatccgacctcggatagggtaggtcaaggaagcaaagagttggtaggtacgagcggcccccattatgttcaaattcaaaacaagcatgctttctcgccatatggcttgcctcccaactatgcaccacctaatggaaagtccgagactactttagtctcacttccatcatctagagactacttgagtctcacttccatcatccagagatga

SEQ ID NO: 73699 - DNA, 711 bp, Glycine max
  Peptide Sequence Number=SeqID_165384
gattcaaccattagtccaaaaaaagtcgttgaacctgttgatggggtcaaagatgttgttgtgcatgacctcttgcgtgaattgattaagtgtctgattgacatttataacaaccctgttcagtttgtgtgggatggtagtaaatttgggattccaaatgtagagtcaaccttgttcttaacatatgttgatgtcaacgaaataacaacaggggacaaatggttgaacatagccatacttcagttatggaccattgcatttaaggcattaaagacgactcacgacgacaaacttcctcaaagtacaccccagtggattgaagttaagagtcacgttcaacgagaaggctacgagtgtgggtattatgtgatgcactggatgtggaacataattggcgcagggttgaagactgattggagtctatggttcggtgatgccacgccacatgacacgaaaacgatgacaacattacgtcaaaaatgggcaaaatatttttttaaagttagaaactcccaatctggtcccaactcttggcaactcttcctcttccaaatagcattggatggtaaaaactcatcatcactgaacttgaaggagacagagctgaggctcaacctccctggttgcgagtctccagagagaaaatcaggttctgcactatgtcttcaatctaacttttgtaaagtatttgacccaagtttgatagtttaa

SEQ ID NO: 73700 - DNA, 573 bp, Glycine max
  Peptide Sequence Number=SeqID_165385
atggaaaattcagagaaggtggtcgctgtgatcatggtgggtggacccacaaaagggaccagatttcgacctctttccttcaatattcccaaaccgcttttccctttggctggccagccaatggttcaccatcctatttctgcttgtaaaaagatacccaatttggctcaaatatttcttcttggattctatgaggagcgagaatttgctctatatgtctcttcaatctcaaatgagctgaaattaccagtaagctttccactaccatcaatgcttgatgcccataaaagatatggcgggatggggacaatgttggtaatcaaggtttcagctgaatctgctaaccagtttggggagttggtttctgatccaaccactaatgagttgctgcattatactgagaaacctgagacatttgtcagtgatttgataaactgcggtgtctatgttttcacccctgatatttttactgccatccacgatgtgtatattaatcaagaaggcagaggttggtctctttcaatcacatttgaaaaagctcagataacaaaaggcttgtgttacatgaattga

SEQ ID NO: 73701 - DNA, 426 bp, Glycine max
  Peptide Sequence Number=SeqID_165386
aacgttcactcccggaaccttcttccggagaggaacgttaacttatatatcactgagtatgatgagttccgtcgggaacttgagaggaggcggtggcataaagccttgaccaggcagcctgatgatcgcattgacatggcctgggtcaaggaattttatgccaatttatatgacccagaggaaaaatcaccctggcaggttagggtgagaggaaggttgattaaatttgatggggagatgctgaatgccttcttggagacccccgtggttttggagccaggggagcaatacaccacctactccaggagcaccctggaagctcctgaggaaggacctcaccactctggtgtagacctggagtgtcctctcctactccaacctcgccctcacctctcacacgtccaatctgaacatggacagggcgag

SEQ ID NO: 73702 - DNA, 1974 bp, Glycine max
  Peptide Sequence Number=SeqID_165387
atgcaggcatcaacttttggtgttgaagaagctacttttggggttcaaagtcgtagggggttggtgggttttcgagagttcagaaatgggagtgttctgagacccagaagagtgtgcatggctaataataacattgatctttgtgggttaaggcttggttctgtcactatggaaactgaactaactaatgctagagttggttttggtggcatttttgggccctccgttaagcccagatcagtgagggttatggcttctggtttgtatgctgttgctggtggctttgatttgtttggtttattggctattgtgaatttttctggactgcatttgccaatgatgtatggaaaaattgaagatgttgttccagctactcctcagggcaaatcttctggagatgttctaccatatgttggtgttgcttgcctcggagccattttatttggctatcatctcggggtggtaaatggcgcccttaataccttgctaaggatcttgcaatcactgaaaatactgttctacaaggcaactaaaactgtagatataagaagatgcaatttcttgtttaatacactcataaagggcaaattttcagtatgcatgtctgtccatgttaatggctggattgtcagcacattacttgctggtgccactgttggttcatttactggtggatcattggctgaccaatttggaagaactaggacttttcaattagcctcaatccctctagcaattggagcatttcttggtgctacagcacagagtgttcagccaatgatcattggtcgcttacttgctggtataggcattggtgttacatctgctatagtaccactatacatatctgagatttcaccaactgaaattcgtggtgcgctcggatctgttaatcaactttttatatgcattgggattcttctggcactggtggctgggctgcctctggcagggaaccctatatggtggcggtcaatgtttggcattgcagtagttccatctgttctgttagcactcggaatggcaatttctccagaaagtccgcgctggcttgttcagcaaggtaaaatctctgaagctgaaaaggctattaaaacactctatggacaagaaagagttgctgcagttatgcatgacttaacaacagcaagtcaaggttcatcagaacctgaagcagggtggtttgatctgtttagtagtcgatattggaaagttgtcagtgttggggcagcacttttcttgttccagcagttggctggaataaatgctgtagtttattattcaacttctgtgttccgtagtgctggaattgcttctgatgttgcagcaagtgccttggttggtgcatcaaatgtttttggaacttgtattgcttcctccttaatggacaaacaaggaaggaaaagtctccttatcacaagctttagtgggatgtttttacttatcagtgttttggtgattgattgcaatttgcaaatatcatttctactgaagccagtaaatgataaaaatgtggcaatgcaatacatttttgagaaaagtctaaacaagggattgaactttattccgttcttgaaggaaggaaaggctgcttctatgttgcttctttctctgtcttttacatggaaggttcttgcaccatactctggcacccttgctgttctagggactgttctctatgtcctatccttctctcttggtgctggtcctgtgcctgcccttcttctaccagagatatttgcttctagaattagagcaaaagcagtttctttgtcattaggcacacattggatctccaactttgtcattggcctctacttcttgagcgttgtaaacaagtttggtatcagctccgtgtacttggggttctcagctgtctgtgttcttgctgttttgtacatagctggtaatgttgtggaaacaaagggtcgatcattggaggaaatagaacgtgctctcagtgcttcagcatga

SEQ ID NO: 73703 - DNA, 171 bp, Glycine max
  Peptide Sequence Number=SeqID_165388
atggagaggtgtcatatttcaaattctcaagttcccatcgtaaatataacctcgtatcattgtctagacatgaatgatgatgtccttgaggattctggtgctgcaaacttgtctccttgtcaacaaggtagggtgaatatcagaatatcaaaagcttgctatgccacttaa

SEQ ID NO: 73704 - DNA, 366 bp, Glycine max
  Peptide Sequence Number=SeqID_165389
atgcataaggcattacgtttaaatgcacctctcccttatccccacctagttactctgattctgcaacaattcagcattcctcttcctaatgaaccttttgtcaaggttaaatgttcatttgccattggagccactgcagttgaatcctttgggtataggaaagatctagacggtcaatgggttcgtaaacaggatctcccaactaatgctcggaacgaatgcattccatctccaccaccaagagatccatcctcttcgttactgaatgatgtccttagtgagcttcaggatcttcatgcctttgtcggagaaaggttaccatgttccttagcatttcagacttcttggctttggttatttgtttag

SEQ ID NO: 73705 - DNA, 103 bp, Glycine max
  Peptide Sequence Number=SeqID_165390
atgcctgaagtatcccatcaagagggtgaaatgccaaacctgagatacatagggaaaaagtcagtacacccttcatctggtgggaatgttatggacaaaagtg

SEQ ID NO: 73706 - DNA, 246 bp, Glycine max
  Peptide Sequence Number=SeqID_165391
atgccacatgcctacaccaaaattgtgatgtgttgtcatgttccaccgttgaggtccttgcatgatgccgtcgaggttggcctcgccttcgccctcaccctcacccgcactaaacgtcaatggtcaccctcatcctctacctctccattctcgaacaagatgtcatctagtgaaacaccaacatcccaagaaacatttactcaaaattcaaggcgtaacattagagggaagacagacatagcttga

SEQ ID NO: 73707 - DNA, 276 bp, Glycine max
  Peptide Sequence Number=SeqID_165392
atggaggattcaccaacattcttaaccaatgaggaggtgggtgcattacgcaaaaaccttgcaaatatgaccatccaaccactttcaaatgatattggtcctttaattttggatgatgatgatgttgctgaagcacaagacactcacatggaaaacatgaatttaaatgagagcaatgttgattatgaagttacaatgggagattcttctgagttctataatgaagaaggagttcctaaaaatgacaatgacttagtttatgtcccttggacataa

SEQ ID NO: 73708 - DNA, 368 bp, Glycine max
  Peptide Sequence Number=SeqID_165393
gtcgactctagaggatccccttgagaagatggttctaggtggtaacgtggaaagcttggcaactgagaaagaagggcttgttgaggctggaggagtccgagttgcaggataccaaggagagggagaccagcatgaccttaacttgggtctcttcgatcctttcaaggatgtgaaggatggtgtcctgcatgatgaggaggagggtgcttgtgcgcacatgtcactcgtcatgggtggcatgtactggagtcaccaagtcataatgctagaagaagggcgaaccttaggttttaagagcctcgaagctgaagtagaacttcaggtgggttcgttcatgggattgctttgtcatccaactcttgtagccg

SEQ ID NO: 73709 - DNA, 369 bp, Glycine max
  Peptide Sequence Number=SeqID_165394
atgacaagccaaaagaaccaggttagcgccactgacgacatgtcactatcagcgaggaggaagtttagcgcgatctgtcgcagcgcggtagcacttagtgatttttttggcatcgtcacacttctttatgaaggagaggagtgtggtgttggagggggagtaaggcgcaggggagcagatctagatgacgctagattgggagtcgcgggtgaggttcatggagtcgaagttgtcaatggcgcagccagtggtttgaaggagcatggtgatgagcttgccggaggaggggagggtgcagaggttggactaagagaggaactggaggaggacgtccgagggcggccgaggaaaggcagtcatcggtggtga

SEQ ID NO: 73710 - DNA, 1152 bp, Glycine max
  Peptide Sequence Number=SeqID_165395
atggctggtcctagggttgcccatgctaccttgaaaggtctgagtgtggttaaggacatcataattggaataacacttggtttagctgctggtgtggttggagtcattgtctcaggggctgaagctaggccaagagcattctttgtgtttggagattcacttgttgatagtggaaataacaattacttggctaccacggcacgtgccgatgctcctccttatgggattgattaccctccaagtcatagaccaactggtcgtttctccaatggctacaacattcctgatcttatcagtcagcgacttggtgctgagtctacattgccatacttgagtccagaattaagtggaaataagctccttgttggtgccaatttcgcttcagctggaattggaatacttaatgacactggaattcagtttgtaaatgtaatcagaatgtatagacagctacattattttaaagagtaccaaaaccgagttagagctttaattggagcttcacaggctaagagcttagtgaataaagcactagtgctcatcactgtaggtggcaatgattttgtgaacaactacttcttggtgcccaactcagcaaggtcccaacagtacccactacctgcatatgtcaagtatctcatctctgagtaccaaaagcttttgaagaaattgtatgatttgggagcacgcagagttcttgtgacaggcacaggacccttgggttgtgttccatcagaattggcccaacgtggtagaaatggacaatgtgctcctgaattacaacaagctgcaacattgtttaacccacaactcgaaaaaatgttactacgactcaacaggaaaattggaaaggacatttttattgctgcaaacacaggaaaaacgcacaacgacttcgtttctaacccccaacaatttgggttttttacatcacaagtagcttgttgtgggcaaggaccttacaatggacttgggctatgcacagcactctccaacctttgcaccaacagagagcagtatgcattttgggatgcattccatccatctgaaaaggccaataggcttattgtggaggaaattatgtcaggttctaaagcctacatgaacccaatgaaccttagcaccatcctagccttggacgcaaacacatga

SEQ ID NO: 73711 - DNA, 246 bp, Glycine max
  Peptide Sequence Number=SeqID_165396
atggcggtgatggatctcagctttggagatcccttgtatcgaaagtcttcctggcgaagagccatgcaagaagatatgcaatccttgcatgagaataacacctatgaattggtggagtggagaatagtcatgcaagaagagatggaatccttgcatgagaataacacctatgaattggtggagtggagaagagtcatgcaagaagagaagcaatccttgcatgatgaccaaagcacattgacataa

SEQ ID NO: 73712 - DNA, 321 bp, Glycine max
  Peptide Sequence Number=SeqID_165397
atgtggactgttgaagtcactcaatccatgcttgctgccccctatccactgaaacttcctacttctgtcgcgccgcatgttgatgcctgcggccaacatatgacaattctaagaagatttggctctcctctgcaatggaatgtcatagtcctcgacactggcattggtgacaaatatattgttcaaccttggtaccaatttctcgcgaacaacgatttgagccatggagatgaagttgcattttactacagacgttatgataaaatttgggagattgtcatcagaagacaaaaagactgggaagatagtgctaccgactaa

SEQ ID NO: 73713 - DNA, 777 bp, Glycine max
  Peptide Sequence Number=SeqID_165398
atgaacaggaaacatatcatgcaccaaaaacaacatgctcaggctcagccccctctacatgcaactgtggatcctacttcacaatatacaaaagatcataaggatctaaattctgaatcaacacaaggattcgattcaatttcttttgtaggagatgaacattgtcaatccccagctaataaccctacaattaacacagaagctgatagtaaaaattatcaacaaaacatacacacatataacatgatgtttgcctttacttctgctggtattaagctagacaaattaattaatcattcaagaggatctcctacaattaaaattcaaggccaaccatgtcaccagataggcagcctattaccaatgcctggaaaagaacctaaatttgcacaattatatatctttgacacagataatgaagtgcaaaatagaattaatgccatgagccagcatgttgaaattaaagcacacattgtttcaaatttaagtcaaatgctggatgaacacaatgcgcatgctaaaagcttcaggatggcaagagatagattggcagatagtgaagtgcataatttcaggctgaaattgatcgctaatcgtcaaaaagatggtcgtacatataatgtaccaactgtttcagaagttgatgcacttattgcaggtttacagtaccctccactatttccttacggtgaagatggatatagagctgacatacttcatcgtgctacatcaggcggcaaaaaaggaaagagaaatcgtctcacaatgagggagtga

SEQ ID NO: 73714 - DNA, 512 bp, Glycine max
  Peptide Sequence Number=SeqID_165399
atggatttgtggaaggccgttgagaaggcaaagaagctcagaggcttcatcgctgagaagagatcactgttatttacgattgagtttatggattatcgttttgacgcattttggtgtgtttcgtgtgcagatggcactctgctggaacctttgacaagggcacaaacactggtggacccttcggacatcgctattaggcttttggagccactcaaggcggagttccctattttgagctacgccgatttctacccgttggctggcgttgttgccgttgaggtcacgggtggacctgaagttccattccaccctggaagagagagttttacgggattatctacgaggtattatgttccaagacattactactctattgctttctgttgttgtaggtattatattccaagacattactacgttctgcttcactggtcggaaatcgtgccacttgaggaagtttttcagactctgaggtgtgattcaaatggactcacaatagcatctgcagaaag

SEQ ID NO: 73715 - DNA, 3280 bp, Glycine max
  Peptide Sequence Number=SeqID_165400
atggcgtcccccagtgtgcggcttagccatagtgttaggtcaccatcgtcccttttgccgttgctggctttaaatgggagtgatgattttcctttcctgagagcggtatcagtttccttgaacaacgtgtctaagaagctgttcgacattgactcaaacgtatttcgtcgcttcaaggaccatttcttcaaggtcctgactactgacatagtggctaatggcttgtcactgatgtttaaccaggacagagagccccgcttcccattcttctggcagtttgaccataccaggttgacgtcgtttgacgaggatctgttgacccttgtggagagggtcaataaagcgatattggagcaactgtcggccttgctggatgcgcggaccattttttctcttccttcaatggacgatccttttgttgccttagatggttggacttgctggtggggctgtgcaccgtatgctgccatccctcctattggagaagggggtcaacctgttgttggtgttactgaggagcgagatgatggcactgcggtgtcatgccgtaagaaatcgagggccccttttagccttcgtgccctaagacaggcttcaaggttgacactcgattcgggtatcctttcgagtttgcaagatctacctccggctccatcaatcttcatggcttctactcctgctattgttgttgttgtcgctcctactgttgaagttagtgcgctagccgcttcggctggttctgttatgtctccttcatccaccgtcgctccacctttgttgagtgctggtgtagtgacaatgagtgctcttgtgatgccgcctcctccttcttcagcttcaccggttcctccttctgctgtgttggtgtcggtgtcaacttctacctcttctcacccccgtgtttctttggaccacatctacacctccagcggtcttcctccaatgaagtttggcaatcttggaagagaatgggcaaaggcactaagaggcgctaaggtcaatgcttgtacagtctggagaacggagcaccctaaggtagttaatgccattgtcaccttcaatgaagctgtgaagtcaaaccaacaactgtcttccaaggttggcagtgcccttgccaaggtggagaacactgcggcgaagaaggatgagcttgccaaggtggtggtggacctcgaggtccgattgaaggaatcagagtccaggctagaggagtccatgctatgggtatccaaggagagagaggtcaacaaggagcttgaagaggagctgttgatgtacaagaaagaggccatggagcaacatgaaaaggattttcacaaagccattagtgttctgcttgatgaggaagatattgttgctgaggaggaggctggcgaggagcaggaggttgaggagcaaggaaatgatgccaatttcccaaggggtgaacttaccaagggcatgccttgggtttttataggagtgcgcaccaacggtgcaccttgggcttttgtaccaagggcggaccttgggtttctttaccaagggaggaccttgggctcaccaagggcggaccttgggattaaggagctttggactagggacgcgttcatcttgggttttggcgaggctcaccaacgatggaccttagactcaccaagggagaaccttgggtttgatgagcctttggagaagaaagactcaccaagggcaaaccttagggcggacaatgggtttgatgagcctatggaaaaaagccatactcaccaagggcaaaccttcgatttaacgagcctttggagaagcgagactcaccaaggatggatctttgatttacgagcctttggagaagcgagactcaccaagggtggaccttgggtttggcaagtctttggagaaggagactcaccaagggcggtggaccttaggtttgaagagcctttggagaagcgagactcaccaagggtagactttgggtttgatgagcctttggagaagcgagactcagcaagggtggaccttgggtttgatgagcctttggagaagcaagactcaccaaaggcagaccttgggttcgacgagtctgtggagttgggaccagggatgcgcctatgggtagcattcaatgttcttggaattgctttaccatctaattcctgtaatcggtatgctccgttgtctaggcttgatacgactctgaatgggccttcccagttgcatccaagctttcctgctcagggatcttttctggctttacctcggactcgccatacgagtctccttatcaacggttccccgacttcaatggggatcatggcatttgtgccatataccctctgcctaaccattggtctgaggatgttcgatagaggtaacaaggccatagttgcatataaggtgtttccaggtgaacttctccacctaattggttgtaatttctcatactggtcttgccttgatccacttgggccaatgagagctcatgttgtgaagattgtcaggagggccgaaatgcaccactttggttgcaagggagcatcccccggtagggagaccatagataccttcatgaagctctctaatggcatgatctgcttgctggctattcaggcatttcactataacttcctcagtgtttatggtggaagtttggagggtctcctagatgatagtcttgaggtgcccggtctttttgctattggccagcttggagagcaagtatgctttggtgttgctcttcctgggtatgtagtacatctcaaagcatttaaagttgtcaataagagttatagcaatgtggtagtacttgagtatcattgtttccttggtctggtatctgttggcaacttgtccctggacaagctgcaagctttgaagttgagcttgagggcttgctctagaatgacattgtcaggaacttcgaggataattcttgcctcgcttccctttatgctggatgcaccatcaacgtataggctcaaccgggttgagctaacggcttcgtcaactattgagagatataggaggaggggtacccctggcctaggtccactcaggactggtgttgtagccatggtcatcttgaaggcttgttcgcagcttctagacttcctggatgttggtaggactgtgcatctccaatatgactgtgcatttgtcagggttggcttctattccccgatgaaagctggagttgctgcacatgatgtccaacgttatgtcaaggaatcagatcgggctgcacaatgcacaaggcaagataaaatgtcaaatgaagaattgaagctgcaggatccacgat

SEQ ID NO: 73716 - DNA, 1596 bp, Glycine max
  Peptide Sequence Number=SeqID_165401
atggctagtaaggttcttgctaagttgtgtacattgcttgggtttgggtccaagctacagcttgatgagttcttcaataggcttcgggcctctatcagaagtgtcatctattgccacccactgtggggtgaggcttggcaagctccctggtgggaggataaggtggggaacttcatccttagatgtggtgtgaagacaatgattcctagctcgttgagcgttttcctaccaatgaaagcaaagaaagaggttgacatcgcctctagtctctactatttctcttgcgaagccaatgagtggatcggcgtgagtttggatgatgtcagtggagctaccctcgttgatgaggaccttggacaccatgaagttagccattacgatggagacaacgataaggttgtcctagttgatagggttgatacctttgaagtctctatcattgatgtcgatgttccggatggcatggaggttacacttatgggactggctggactgcccttcgtaagagaatccccctgcaatggtgttgattacacctctgatttgttgggcgggcttgttttcccattcttacggaggttgtcgctcacatctttgatggtggtgtctttgtcttccttgatcttctgctttgtctcttctttttctgccatcgcggtttttatggtgatcctcttggtgtccttcgggtctcactcctattgcatgacttatttggtcctttttaaccctggccttggtagaagcggcaaaggtagttttattggtacctccgcattgaaagcctcctcgaggattgtagtgcgattgattgtcagggtcggtcttgttacctccttctctcttgtcgtgcttttgtcccgcttgtcggaccttgttcttgagcctggacatctcttccatctggatgtagcctttggctcattcgtgcaactcgtccatgctactagggcgcctgatgtcatacaatgtgactgggtggttgcatattatgcattgaagcgctcgacaagagtgtcaaagctgtcgatggaccttggaggaagtccaccataccaggttaatgtcgcccctttgagggatgttgggaagacacgacacaggattgcatcgtcattgggtgtcaacttccatgatgcaatcgacaaaggggtgtcgacgagtaggccaccctgcaggacagtgtatgtgagagagacttggatcatcttaagtgttaactatgtgttggggctttttgagctcttcctcatagcgtcactccatctccgcaatgtagttttagagttgttggagagtatcaatatccatcatggttacgagaggaggattggagccttcgaaagggatctcgagtctaaggccaaactgagtgctaaccatggagtgggcactaaatgtacttaccgaaatccaaagttgtcccacgtcaaggtggacgtgaacaaggagagtatgagtgagtatgaaaagagtgagatggaacctggtacttatagagcggagaggaagttgcgggcccttgtttataggggttgttatggtgacataatagcccttgcaaataattatcggcttgtagataatagccggtaa

SEQ ID NO: 73717 - DNA, 381 bp, Glycine max
  Peptide Sequence Number=SeqID_165402
atgcccatgatccgtgaggacatcttgattgtaatcaagctgccaactgcaccaaccccgtgtttaattaaagaatgtcccattggatgtatgtctgggagtgggaatgaatcaaattcatcaaataccaatataggcacatccataggtgcagcaagcagaagtaaaaatgctccaagaaataggattgatattgggtggaaacatgggacaaatgttttagggaatggtaaaaaagttaagtgcaactattgctcaaagatcaacaatgggggaatttttagattcaagcatcatcttgctgggactagatgggattctgaaccttgtgcttcacttcctgaagaagttaagatgctcatgatgaaagttattgcagag

SEQ ID NO: 73718 - DNA, 453 bp, Glycine max
  Peptide Sequence Number=SeqID_165403
atgattatgaggggccaagacatttatagtaaccaagatgaggctactacttcaccttcctctagtgaaagtgaagaagcaaaaggggaaggatctagcaaagaaatctaccccaagaataaaaacaaccttgaatggttaaggaggagtgtaaagaggaataatcaacatgaaaataaaggaaaaggtatgttttattccattactttccttaactttttaactagtgatcaaggggttcccacggaccctaagagaataaaggtcattcctgagtggcccactccaccaattgttgaggaaagaatccccgagtttcaagaacctttggatttgaggtcaaatccttttcaagaggagggaatgatgcaatcatacccccaagggcattggatagaagactccaagaagattgggccaaagagacaagagaaggcccaaggattctcatga

SEQ ID NO: 73719 - DNA, 825 bp, Glycine max
  Peptide Sequence Number=SeqID_165404
atgacaagggccatgttatgccgcatggatctttacggtgttggtggtttgacaacggtggggtgcacgaatctcgctgccacaatcttaggtttggatgtcggtgttggtggacaacaaaagggggacgaggtggccagtgtgacgcaaatcgataatgccaatgcttggaattcaacattatgcatgcagtctggaggggttggcatgggggaggggtggcccgacggttctagatttgggctggggttgggaacaccgagtccaggcctagaattcagtcagtccaccaacaaaccaaagcccgaacaagaaaaacaaagcaagaaacaaaaatccaacaagggttttaggaggaaacaagagaaacagagtgttagtgaggaactgttctgttccgaagtgattcattccactgctatgaagtttcttcaatctctcattgctcaatcccgttatgcagcgcgtgccgggtcactgaatcgggtctcggggctccgattcttctccgtttccacggaagagtattccaagagaaactatgcaaacaacgttgccgagtacaacactgttttgggttctctcactgcacaaagaaggaatttcttgctgagggatgtgtacgatgatatgatgcttgatggggtgaagcctacgcgtgacactttccattcccttgctgttggaaccatgaaagcagctagaatgcaagatgctttctacttcgcggaccaaatgaaaatcatgggtttgcttcctgatttagcttgtataactttctgttgtggggatgtttggaatgatgctagtgataaagatcattga

SEQ ID NO: 73720 - DNA, 1056 bp, Glycine max
  Peptide Sequence Number=SeqID_165405
atgtcgtacgactacctcttcaagtacatcatcatcggtgacacaggtgtagggaaatcgtgcctgctcctgcagttcaccgataagaggttccaaccggttcatgatctcaccattggtgtcgagtttggtgctcgcatggtcaccatcgattctcgacccattaagcttcagatatgggatacagctgggcaagagtcttttagatccatcactaggtcttactacagaggagcagcaggagcacttctagtttatgacattacaaggagagacacatttaatcatttagcaagttggctggaagatgcccggcagcatgccaatcctaacatgaccatcatgctcatagggaacaagtgtgatctgtctcatcgacgcgcagtgagcaaagaggagggagagcaatttgcaaaggaaaatggacttctgttcttggaggcttctgctaggacagctcaaaatgtagaagaggcttttataagaactgctggcaagattcttcagaatatccaggaaggtgtgtttgatgtgtccaatgagttggctatggacgtccccaaggtcaaccaggtgccagagatggaactgtttcagccagagttagtcaattggagagttagtattgtggctagggagagtcctgaatctcttgaatatctagggaaattgtgcattctttctgttcatcaacaacaatatgttcttagtgcgctcaacccgaaccagtttctatcaactgagcagtattttggggttagaagagtacctgaggagatgaaactatcatggattgttgcatttgcatttgagaagaaagctctcaaatggtgggtttcttgcagtactcaggaaataccaactagaagctttgtcttcaagattcagaaactgaggagcaagaatgtagatgcagagatgaaattcaagagaaaatccaagaatcaatggagcggaaggcacaaggtgatgacaaaaggcagcaagaaaacaaacaaagatgaagaatgggagagaagagaatcagcggctcaaggaagagaaacgaggaaataa

SEQ ID NO: 73721 - DNA, 744 bp, Glycine max
  Peptide Sequence Number=SeqID_165406
atgacactcagaagaggtgtagcttttgaagacaggcccaacaacttagccagaggtgcgatgtggcccaaaagggaatggaagttgatttgggccagagtggggtttgggtcatcgggtgggtcgggtggttgctctcggttgaagcacaaacctctgtctcgtcgggaggccatttccgccgatgaaaggcaattgagaagaataaggttaagggatagcaattttaagggcgtggggagcaacgacgggcttggagtggagcatctaggagtttcttttcttgtaagcgcgccaaccccgccgcctgagccatcgttaagggttggagagcttggacttcccggcgtatctgtggggacaatctcgagacgaagcaacacaagagaaagagagatggcaagccaacaatacgattcgcaaggtcctcaaactcagagaggggcaaacagagattgcagggcttggataaaatctgaccaagatgtcaattggtcgttgctagtcctccactggaatcatgctaaacgtcaggcgttcatgctccagtgtcgcatgatattcgaagaactgattgatcttaaagatccaaccaagcgggagaagtcacaaaagagggaatggcggatgaagatgaagggagatggtgagcttcgtgatagcgtcctccagaagattggagttggctttggatctcgtggactctgccatggatatctttcaatgaaagcaccaaaacgctaa

SEQ ID NO: 73722 - DNA, 201 bp, Glycine max
  Peptide Sequence Number=SeqID_165407
atgcatggtattattcatgaagtgacactttcatatgctcctcaatctaatggtattgtggaaagaaagaatcataccttgcttgatatggtgattgctatgcttatgatcttaaaacttatggtgaggccatggggtctattgaggccatggggtctattgaggcacctttttggaaagaagctaataatgatgaaatga

SEQ ID NO: 73723 - DNA, 1143 bp, Glycine max
  Peptide Sequence Number=SeqID_165408
atggctgttttcaccaccaccaccagtatcattgtgattgtcgccatgactatgatcattatcattaacatgatctccattgacggtggtggttacaatgagagtgacagagatcatggtggtagcaatgatgatggtcatgacgacaattatggtgatagtagttgttatgagaaaagagaaggcggggcagaaagtagaggaggaactgctggcggaggaactacagatggagggaagaatggcaaagcatctagagtggcccgagccctagccctttgtggccttgggaagacaatggaaggatctattggattccgcgactccaacgttagagtgttagaaatgacccccttggcgtcgcaaagggatgcgattaagccaataaatcagtcgggcacagtccacgttcagatcagaggtgggggaggtaggttgaaatataacaagacactcgacgtctgcgcaagggtggtaggtgtgcataaactgagagaaagtggtcaggcgctccccctccagaatgatgattggtgtctccatgaaggcattcaatgtcacagcgtcgaaattgatgagcttctcgcagactttgcactgcttcggggagccatccttaagataataaatctgctcagaaaattcgccgtactgggtgggggaaagctccatgttccgcttcggaagaatgttccagaggtgaacgttgttcgggtaatggtgccaggcgacctctatgacaaagcgagtggaggtgaagacaaactcaagacaaaacctggaaaacatgaacactacatgaaaaacatgaaacctagatttgctaagtgcgacatgctggcttatcgagttcatcacaacaaacccagaaactcatacaaaagcccagaacgtatgaacttgttaagcgcgcagttcagggttagcgagttcataaaaaatttccagaaatgcaaactttacccaaaacatatgaacttgctaagccataggtgcaggcttagcgagctcggcaaaaatttccagaaacagatgcaacatagacacatagataggtgtggtacaaaagtggatgcacaagaaggtagaaggaggttggaggcagcactagagtggaagatgggaagacttcgaactgggtag

SEQ ID NO: 73724 - DNA, 348 bp, Glycine max
  Peptide Sequence Number=SeqID_165409
atggcaagttatcttgtagtatctgctgggcttcttaggatttttggccgtaatgttgctgagcttccacttgttgccacaagcagagcacatcaaggaaaaggttattttgaagtgttgttctcttgcatagagaggttgctatcttctctaaacgtggaaaagttggtgcttcctgcagccagggatgctgagtcaatttggactatgaaattaggcttccgaaagatgagtgaagatcagatattagcgaccataggtttgattccatattgcaagactggaaagttggtagctgttaattatgtgcaatggcacaagttctgtgaagaaaaaaggccaacttaa

SEQ ID NO: 73725 - DNA, 459 bp, Glycine max
  Peptide Sequence Number=SeqID_165410
atgaaacgctctgaatttgagttccccgcaactgtttttcccagtgcggtctccgacgacgtcgttttattcggcaaactcataacgcgccgaaccggagaaccgggtccagcgccgtgtgagaagagcgaaaaccgggttctgttgagatccgagtcttcttcgggtgggaccaacgggtttgtggcgtggctacggtcgccgtccgggagggaaagccggtaccggaaaagcgagagttgccggagccgttataagatggtgctgaagtttccactgcaaatggaactgagtgacattaagatgaggcaggaacggagggagccgatgccgcagccgccacctccgccgcgtgttacggcgaaggacgacggagagagttgctgggaactggtccggccgttgaggcgccggggagcgcttaagaacgccttgttcggatgccttcccattgtttag

SEQ ID NO: 73726 - DNA, 871 bp, Glycine max
  Peptide Sequence Number=SeqID_165411
atgacgatgataatgatatcgagaatagatgatgttgatggtgatgatactcaggttgatcaccaaaggggggcgggagttgcctatgcacgacggggttacctcgacacttgctgcctaattttcctaagtgagagtgttgcatggacacgcttaggctatttcctgatgaatgataccacattgcatttaagagttgagggccttttcggtgactctataggtcatcccattgatgagttttatgatctgactagaggtcaaaacaatgcctttcaacctgctcctgagcctcattctaggagaagaattgaaaccctaagtaagagggagcatcgcgaaatcattactagaggtaatgatagtaagttgaataaaggatgtccatattccctcttcgatagggattctattattgaatacatagaagcgtttctagctaacttggacaagataaaaaatccctctggtgcgggagaaacttctacgatgactaggaattctttaaagaggaacaaaaatgttaaggacgaacatgctttcgctgttgtattaagtacaatgtcagaacgcaaggtcttgggtatcaaatttactcttgattctggtgctattggcttgttgcttaaggaatcttgtgatattaatgttgtaggggctcacaaaggtggaaatattgacaatattggtgaagaaaggtctaatcttacccctaatgcttgggcatttgaaattgcttttgaactcggatcgttctcagatgtttatgaagatttcaacaacgaatataaagaatcttatttcattcttaagactttggatgaacaaggaatagtggatgattgtcatgaggcggatgttgagagggagg

SEQ ID NO: 73727 - DNA, 979 bp, Glycine max
  Peptide Sequence Number=SeqID_165412
atggcaatggcccagctccctcaggacctcatagaagaaattttgtcatggcttcccgtcaaatctcttatgcgtttcagggatctcccaggcatcgccccatgctctatatgtagtttacttgagaacccatcatccactgttgacaatggttgccaccagctagacaacagatacttatttataggttcctgcaatgggttggtttgcttgattaatttggttgctagaggtgaattcagtgaataccggtgtgggtttggttatgatgatcggagtgacacttacaaggtggtgttagtcctttcgaatattaagtcacaaaatcgggaggtgagagttcaccgcttaggtgacactcattggagaaaggttttaacttgtccggcattccccattttgggagaaaaatgtggacaacctgtgagtggcactgttaactggttcgcaattcgcaagttgggttttgattatgaatgggaaactgtcaccgtcgatcaattagtaattttttcatatgatctaaacaaggagacattcaaatatttgctgatgccgaatggtctttctgaagttccccgtggccctgaacttggggtattgaagggctgcttgtgtctttctcatgttcaccggagaacccatttcgttgtttggctaatgagggaatttggagttgaaaattcttggactcaattgttgaatgtaactcttgagcttcttcaagcccctctgccctgtgtaatactgaagcttctgtgcatctctgaaaatggtaacatcaagggtgatattggggctgtggaaagtttggctttctgctctatacatgctttactcgagaatccatcgtctactgttgatgctttgtctgccattacccctgtagaagcaaagcttcatgatgaatcaagattgattcaaagatgttttgatgataacaaagatgatcacaaaggtgatgacaaaaacctcaaag

SEQ ID NO: 73728 - DNA, 375 bp, Glycine max
  Peptide Sequence Number=SeqID_165413
atgcaagggttacgtggctccagacagataaaaggacaacttagagtttccaacacaggaaaggatttgaacttgtcagcactttatcagaaggctatgtcagtgatgaaaaacaagtatcaagttctcaaaaagcttatgagaaggtgcactaggtcaaatttaagaaagaggattatgtatttgcccggtttggattcatctatagaagaaaaagaactcgccttggttggatcacctgaaggatctacatacatctccaagttcttttttttggttaaaattttactactcaaattattagcattgtcacccaaatctttgatagattcaacaacaacaaaaggagtacgtgatgtccagaaaaatgcttga

SEQ ID NO: 73729 - DNA, 78 bp, Glycine max
  Peptide Sequence Number=SeqID_165414
atggagctttttgtgtttgcaaagaatggaaagggaaagacagaagagagtgaaagtgagggaaaaaatataagatga

SEQ ID NO: 73730 - DNA, 225 bp, Glycine max
  Peptide Sequence Number=SeqID_165415
atgttgtggccattcaaagttgttgccggtattaatgacaaaccaatgattattgtcaagtacaaagggcaggagaagcacctttgtgttgaggaagtatcatctatgcaaaaacctaccgctgctgctattgcatatggccttgtcaagaggactaattgcgttggagagcaaaacattttcatctttgaccttggtggtggtacttctcacgatcaaggataa

SEQ ID NO: 73731 - DNA, 324 bp, Glycine max
  Peptide Sequence Number=SeqID_165416
atggctaccccaaccagctctccttctcttcctcctcctcctactggtgttgcatcacagtttccatctatcttgaagcgcacaagaaatgccacacggctaagatcattggcaactagactagttggggtagagagaccgttggtccatgtcgatcctgcgactgggaaggccgacgatccccacaataagaagttaagaacatatttggggatcgtcactcgttataaggtcaatgtcacatacaagaattggaagcaagtccctgctgctcaaaaggatttgatatgggaggatattcaggatgtgcgaaaaaaggcatag

SEQ ID NO: 73732 - DNA, 1587 bp, Glycine max
  Peptide Sequence Number=SeqID_165417
atggctccagccttggaagaaggaggagaaagagaaactagtgtggcacagaacaactccttgaacagtgttgtcaatgatgccacacacagatccaaagtcactgttattggaagtggcaactggggcagtgttgcagctaagctcattgcctccaataccctcaggcttagctccttccacgatgaagtgaggatgtgggtatatgaggagacactactaagtggtgagaagctcacagatgtcatcaatcgaaccaatgaaaatgtcaaatatctccctggaatcaagcttggcaaaaatgttgttgcagatccagaccttgaaagtgccgtgaaggattccaacatgttagtgtttgtgactccacatcaatttatggaaggaatatgcaaaaggcttgttgggaaaataagggaagatgctgaagctatttcccttgttaaagggatggaggtcaaaatggaaggcccatgcatgatctctagtctcatttctcagcaactgggaatcaactgttctgttttaatgggtgccaacatagcaaatgagatagctgtggagaagtttagtgaagcaactgttggatacaggctcaatagagaagttgctgagagatgggttcagttgttttatacacactatttcattgtgacagctgttcaggatgttgaaggagtcgaactgtgtggaactttgaaaaatgttgtggccatagcggcaggttttgtggatggcctggagatgggaaataatacaaaagctgcaatcatgagacttggtcttagagaaatgaaggcattttcaaagttgttgtttccatctgttaaggacagcaccttttttgagagctgtggtgtagctgaccttatcacaacatgcttgggtggaagaaataggaaagttgctgaggcttatgcaaggaatggagggaagaggtcttttgatgagcttgaagcagaaatgctacaaggccagaaattgcaggcacttataaaagcagaaaataggaagggtgtctcaactgcgagtgaggtttatgaggttctaagccatcgtgggtggctagagttgttccctctcttctcaacagtgcatgagataagcactggcctacttccaccatcggccatagttgaatacagtgagaagctacccagggtttgtcacaaggaaatttcttctagcaccccaaaaattacttcctacacctttctagaacgttgtctttaccttctggattggccaatccggaatgtaaaaggtgtaaccaatccagcatgtaattggccaatcgggaagcctaaaacaggtgcagcaagcaattgccttataacaattgaggaagtatgtgaagctttgggcatagtgttgggctttgttagtttctgttattttctttctcttaatctagatgggctattgattcatgcacctcccaagttgcttctaacacctctgttttggcttttggaatggtcaattcaaaatgtaaacttacattacaaaatacatcccttttttggctttagaatgaccaatttggaaggaagcaacttggaggtgcaggaagtaacaaccatctag

SEQ ID NO: 73733 - DNA, 366 bp, Glycine max
  Peptide Sequence Number=SeqID_165418
atgcataaggcattacgggtaaatgcacctctcccttatccccacctagttactctgattctgcagcacttcagcattcctcttgctaatgaaccttttgtcaaggttaaatgttcatttgccattggagccactgcagttgaatcctttgggtataggaaagatctagacggtcaatgggttcgtaaacaggatctcccaactaatgctccgaacgaatgcattccatctccaccaccaagagatccatcctcttcgttactgaatgatgtccttagtgagctttgggatcttcatgcctttgtcggagaaaggttaccatgttccttagcatttcagacttcttggctttggttatttgtttag

SEQ ID NO: 73734 - DNA, 1239 bp, Glycine max
  Peptide Sequence Number=SeqID_165419
atggcaatggcccagctccctcaggacctcatagaagaaattttgtcatggcttcccgtcaaatctcttatgcgtttcagggacctcccaggcatcgccccatgctctatatgtagtttacctgagaacccatcatccactgttgacaatggttgccaccagctagacaacagatacttatttataggttcctgcaatgggttggtttgcttgattaatttggttgctagaggtgaattcagtgaatactggtgtgggtttggttatgatgatcggagtgacacttacaaggtggtgttagtcctttcgaatattaagtcacaaaatcgggaggtgagagttcaccgcttaggtgacactcattggagaaaggttttaacttgtccggcattccccatttcgggagaaaaatgtggacaacctgtgagtggcattgttaactggttcgcaattcgcaagttgggttttgattatgaatgggaaactgtcaccgtcgatcaattagtaattttttcatatgatctaaacaaggagatattcaaatatttgctgatgccgaatggtctttctcaagttccccgtggccctgaacttggggtattgaagggctgcttgtgtctttctcatgttcaccggagaacccatttcgttgtttggctaatgagggaatttggagttgaaaattcttggactcaattgttgaatgtaactcttgagcttcttcaagcccctctgccctgtgtaatactgaagcttctgtgcatctctgaaaatgacatgaatgatgatgtccttgaggattctggtgctgcaaacttgtctccttgtcaacatggtaacatcaaggatgatattggggctgtggaaagtttagctttctgctctatacatgctttactcgagaatccatcatctactgttgatgctttgtctgccattacccctgtagaagcaaagcttcatgatgaatcgagatttattcaaagatgttttgatgataacaaagatgatcacaaaggtgatgacaaaaacctcaaagggtacatctacttgggtttgattgagaacaagagagggtacatctcttatggatcagttctagtggagggtacatccactaggttgttcaaagagaacaagggagggtacatcccttgtggatctttgtttgtaaaaggattttttacaaggttgaaaagaaatctcaaggaccgcaggtcgcttggggactggatgtag

SEQ ID NO: 73735 - DNA, 699 bp, Glycine max
  Peptide Sequence Number=SeqID_165420
atgcgtgagtttcttctgcgcatcaaatgcatagtcgatgcacttggatcgtgtagagatcctgttcttatgcatgaacaccttgatgcgattcttaaaggcctaccagaggagtacagtccagtgaactcaatgattgaaagtaagtttgagccacttttgattggagaagtagaggcattgctgcacacacatgaggcacgcatgaaaaagtttcagaagcactttgctgattcaccatcgattaatgttgctcaagtggctacagtcatggaggcagtgattctaaccgcggtagtggctacaggcgcagaggcaatggctttggccgtgctggaggtcatcgtggtggcagtagaggccacagtcgttatgcaaatttttagtgccaagtttgcttttaatttggtcatacagcaacgcaattcttcaaacacctttgattcagaacagaatcagggaactaattttcacaaagactcccaacctagtgcaatgatggttaattctgaaagtcaagatcctaactctactacttggatacttgattcgggtgcatcgttccacgtaattgaagagtctcaaaacatccagcagcatggtccatttgagggaccaaatcaaatatacataggttctgatggcctctacatatttccacatcttgcactcaaagattctgcctcagtcacctgctga

SEQ ID NO: 73736 - DNA, 444 bp, Glycine max
  Peptide Sequence Number=SeqID_165421
atggagattccgcagaagacaactcagtcttggattatgagatccattcttaatcaaagagttcatattaataatatgcagagtgatttgggccagaaggataggagaaaattcggtatgaagacactgtatctgaagatgcgatgtgaaggctcgaatgaggtaaagcatcatcctcaggaatggaatgaagagctaaaatggattattaggcacggtaaaggaaagggacataaggcctatattctgaagctggcggtgactgaaactgtctatgacatctggaaataccacaatttacccttgattcaatcttctctttcaccgttgacttttcaactctcccactctcatcctaaccaccacgatatcaccacaaatcatagtgaaacccaccacgtcgctacaaacaaccacgacgctgccgcgcacaaccacgattga

SEQ ID NO: 73737 - DNA, 345 bp, Glycine max
  Peptide Sequence Number=SeqID_165422
atggatatcgacaatctaatgaactacccaggtgaaaatgaagcatgttcggaggttcagagtttagaagatattgtgggtactatcattgagaacaatgcagaggatgacggcgaagatgatacggtgtctttggagcctgttacgcaaaaggaagcacttatggcgtcgaacactcttcacaactttatgatacaatacaaaaatacaacacttgagctattggatgcaataagaaaagttagagatgagctccaaatagacttgaactttaaagagacacaagtatcattcatgggagacaatctagatcgagtaagatggatccagtattatgatgtttaa

SEQ ID NO: 73738 - DNA, 148 bp, Glycine max
  Peptide Sequence Number=SeqID_165423
gaaaagagaaagctacgatgcgaaggtgaatgagttcgagatcatcgtttttctgagacgggttttgtgggctgcgggaaaaagaaagggttttggagaggagaaggggaaaaacgaaaatgaggccaaaaagaggcacctgacttaa

SEQ ID NO: 73739 - DNA, 654 bp, Glycine max
  Peptide Sequence Number=SeqID_165424
atggtttgcaccaatcaagcggatatgaccggaagattacttgccggatcattgacctttgaatgtcacatcatgcactacttgattttgcgaatcctccttccccaatcatctaatcttgctcaggtctctaaggaagacctgatagttatgtgggttttcttaaccggtcgtcaaattgactgggtccaccttgtcagatatcgcatgcataaggcattgcgatcaaatgctcctcttccttatccccatttgattattctattcttgcatcatttcgatgtccctcttgactctgagccatttgttcaagtcatgagatcattttctattggggtgggggtagttacttccttcggataccgcaaagagcgtgatggctcatgggtgaagaaggacgctcctgcacaggcagcagaggaccgctctccatcaccacctcctcaaagagatgactcttcatcccttatgcaaatcgttcttgacagactggatggactatacatcttcgttggtgagcgttttgactccttggacagccgcattgatgccattgatgcacggtttgcaggaatggatacacgcatcactcaacttgaggaggacatgagttttatttgtcagtgcttcaatcttccactaccgtctttatag

SEQ ID NO: 73740 - DNA, 339 bp, Glycine max
  Peptide Sequence Number=SeqID_165425
atggccactacagctgtcgaaatcaaaggctttgagaaaccaatgtcctctggattaaaaaatatggaacctcaagatcctttagaagaaattaacttggggactgaagaaaatcaaaagcctacatatgttcgcaaactagtagacaccaggcttcgagaaaatattgtttttctcttacaagaggaaaaaaccaatgaagcaagcaccaaggagattttctacttatgtcatggaggtcatcaaagtagagataaaaaggctattgaagaccaatttcatttaaactacaagtacccgagggcattgggaacatatgaatggatggtgagttcttag

SEQ ID NO: 73741 - DNA, 264 bp, Glycine max
  Peptide Sequence Number=SeqID_165426
atgaagaaaccaactcgcttgggcgagctcattgcttcaaaactaagtttcaactcgcctgggcgagctgcttttgccccaagtgcccattttcctataaataggcgtgctagggaggctgaggggaggttccaaggttcagaaggtgagggaattgagagaagagagaaagaagaagagaaaacgaggttgaggcgctatcgaatcgcgaccgcgatcattccctacatcgttccttgttcaatgttcttcgtgcgaccgtca

SEQ ID NO: 73742 - DNA, 54 bp, Glycine max
  Peptide Sequence Number=SeqID_165427
aagttgaaataaatggagtggatcaattgaggttgagtgacattggtgttgatc

SEQ ID NO: 73743 - DNA, 372 bp, Glycine max
  Peptide Sequence Number=SeqID_165428
atggacacccgtctccgagtgattggtgatcccatgaatggagttcaacgggattcacctagtgagtgtggtggtggggccgccactgtgagatatgggctaatctctaagggacactcacgaaacaagatacaagcgcaaggccgtgtgactgatgctttggagatgatggtgcgcataacgcacagaggtgcttgcggttgcggctgtgaagccaacactggagatggagcagggatcatggtggctctacctcaccagttttacgagtggccgtcagatttggaggatgtctatccaagatggactgcaaactctcactacaccttggtaccaattctggagggacaacaacttgatgactcaagatga

SEQ ID NO: 73744 - DNA, 336 bp, Glycine max
  Peptide Sequence Number=SeqID_165429
atgacacaggggcttggtgttgtttggaacaaggaagaaggctttgttgaagatgattttgttgtggactttctaggagagaatgctctcttagcaagcattgctgaaaatgagaagcaaactgaaatggctgctagggtttcaacatggaaacaaagaattgagaacaacttggaagaacaggaatcacatccaccatttgatatccaagactatggtgagagagttcttcacaagttcttcgtgctttcccttgaagcaagcagtagtggtgtcctatccttttctaatttggtgaagggtcaagcatgcacttacgcatttcagcttttataa

SEQ ID NO: 73745 - DNA, 645 bp, Glycine max
  Peptide Sequence Number=SeqID_165430
atgtacgaagaaagtagttgctatgatgatcccaatgcaatggtttcacaatcagagggagttatgtctgccacacagacccacaaccacaaccacaacaacaacaccgcctttgcctactcttattccagtggagaagatgctgcaaatgcaaatgctaacgctgcaatagcaatggaaatcattgcagaacaccctcaacaaaatcaatacaattatagcaacaccccacttgagaatcatcaccaacttccttatcccacaccaacagtaccagatctccttaaccttctccacttcccaaaccctattccaggagataatagcacaaacgtctcctctgtctcctatgacccttacttgcatctcaacctgcagcagcaacaacaacaacctaccctcagagacttgcttccacacatgccggctctaagtaatgatttccccttcgctggccacgccgtcgaaggagaaggcattcaaggctttggaaatggagtggtggacttcactcaagatgttgggaaaaagagaggtggaaaaaggaccaagcagttcactagcaccatcactgagaaacaaaggagagtggatttgagcagtaaatttgatgctttgaaagaactcatcccaaacccctccaag

SEQ ID NO: 73746 - DNA, 739 bp, Glycine max
  Peptide Sequence Number=SeqID_165431
tgtggataccgtagcgacgaggcgggtcgttacagcggatgattgggctactcctcctccttatattaacttgggtgctaccaagaggataactttgggtcatgaagatgaaggtcactttgccttcctttctatgaaggatggggtttcttctctatggggtaaggacttcattccccgtgcttttattccttcttccatgctcagccaatcgaactacgacatgctaagggaagcaaccctccgaacctctatggactccattggacaagttgagtgtgccaaagctgagcaagccttgcttaaagtcaccaaggccaatgaaactctgtttcaatcggccaaggattcttggaaatatctcaaagatatgaagactaagttaaaggaggtagtgtctcgagaagaggccttaaagaccaagttggctacagtcaagaattttgccaagactcttcatgaagagatcgagcgcctcaacaaggagtttgatcttttcaaggctcttggaatcgccttgttggataagttggataagtgctctgctgcttatattagagatggcctcaaatcctattcccagcttgatctccctcactccgtttttggttctgaaagtgtagccttcgattgccatgggaaaggaccatatgttggagtgtctgatggtagaattctcaagtggcaagagacaaagagagagtggattgactttgcagttacctcgccacacaggtaa

SEQ ID NO: 73747 - DNA, 297 bp, Glycine max
  Peptide Sequence Number=SeqID_165432
atgctgccaaatcatgtttccaatgtccttgttggtgacattgtccctgttggtggtgtggctcaccttgacactggtgtttccgcctctattggtggcatcatcactactaaagtagggcttcgcccttactctaccattcgtccaaatcccagggaggataaggctgagttccttctatccaatcctccttataatgtcatagccccacatctttttattcctcctcctcttcctagaaaacttagtaaggaaaagagggagtaccctcccataacccttccgggttcatcctag

SEQ ID NO: 73748 - DNA, 639 bp, Glycine max
  Peptide Sequence Number=SeqID_165433
atggatttcccagtagaagctttggcgagggtggcattgggctggagtcaattccaagagggactagatgcaagattggaggcaagattctcccatcaagattcatgcatggataagctgcaacagatggtggataggttggtgtctacattgtctggaaaaggttcaagaacaggagacccaagggttgagacagggggaggagatgaaggggagtttggagggaatgtacaaactgaatctgggaaagcattaaaggaaacaaatgaagaattcaagactgccttgattgagaggctccaactagtcatgatgagtgattcttttgaatctcttctaaccttgaaacaagagcagacattggctaaatttgacacccaatttgaaaggctagcaagagcggtgaaggggggaagattagtatttgatgggaatatccaatgggttgagggaaaagagtcaaaattgcataagaggaagagtcttttggagatgatgaataaagcactcaccatggaggagaaaaatatatcaacggccagatgtaacaacattcttggaagcaatcttgagagaagggcaaacaactgtgctcatagttttacaggcacaagaacgtccagggaatgccaaccataa

SEQ ID NO: 73749 - DNA, 402 bp, Glycine max
  Peptide Sequence Number=SeqID_165434
atggaagcggaatggagaaagaagagagagaatagacaccacttcaaggagaagatgagtctagaagaagctcaccaccataggaggctatggataagagcttggaggaagaaggagatgaatgaagggagagaaagagaagagcacgaaattttgtgctctaaaagagttttgaaatctaaaataattggacctaaccttggtccatgggctcagaaatctatcctgaggttcatgaaaaccctaagaccttcttcagtagctctagcccaatcctcttggagcctcttgctcatggctctagtgactggtcccttcctagggaggattgcatcagagcaacatccttgggaatgttttaacttgttgagtacacaactacctcctaatgagttgaagtaa

SEQ ID NO: 73750 - DNA, 183 bp, Glycine max
  Peptide Sequence Number=SeqID_165435
atggtaaacgcgagggttgttgtcaaccacaagggtcgtggtcaaccatatggtggagtgtccttacagaataggacaagcttgaatgcttcttataggggagaacacacagttgatgacaaacttgttgcagccatggatgagatcaactttgttaagggaagagacaattatgataattag

SEQ ID NO: 73751 - DNA, 798 bp, Glycine max
  Peptide Sequence Number=SeqID_165436
atggcacgttttccaaacaagatcaagagcattgatggctcaaaagaaactcttaaacttagtgtgaggatcagtgatctatggtttattggcacgcctaacaaatctgagcaagctgagatggtgtttgtggaccccgatatttattatttattgttcaggccattgtgttgtaactttaatgcaattcagggtgatgagatccacgctgtttgtaaacaagaccaactgaaggttactgttgtaagggagtgtgttctagaggacattccttttagaaaatacaggtttgctggatttgcggatgttgtggctggccagtttgaacctaggctattggttgatgttattggtgttgtggaggaggttgtctttcggcaagtttcaggaaaaggtagatgggtagtctttaaactaaaggacttgagccagcaattgctatcttgcactttgtgggatgattattgcttgcagtttttaaagttcttagatgattacaaaggtgatggcccaattacagttctattgacccatggtagaataaaggaagctcagggcttgcatagttgggcattgaggcccaatcaggttttaaatcccatggtgaagggagtacacagctttcaggatgatgatgttgatttgaatgtttcacctcaagcacttgataagctgttgggttatgaacttgctttcaagataaaggtgcaacccaagttcaggaattttgctgttttgaagtgttcagctgactcaagcttaataaatgatgtgatggatatgctggttaatgctgag

SEQ ID NO: 73752 - DNA, 276 bp, Glycine max
  Peptide Sequence Number=SeqID_165437
atgaagacaaaagctcgcagcagaatcactgacaatatagtaagcgaaactaagcaagaggctccataccaagatgatgagcttgtagggcttcaaaaagtgttggaagttgaccctgatgtcattaatgaatcttttgcagatgttgatggaggtggagaagagatagatgcagatttacttaaacaactagacttggttgaaccagacgaggatgaatgcatattaagtgaaaatgagattgagagtgactttgatgatgtagatacttcttag

SEQ ID NO: 73753 - DNA, 75 bp, Glycine max
  Peptide Sequence Number=SeqID_165438
atgaagaaaaagtgtcccaagtatgccgtatggcgtgtgaagaaagggttgcctgtggagccgaccaccaagtga

SEQ ID NO: 73754 - DNA, 630 bp, Glycine max
  Peptide Sequence Number=SeqID_165439
atggatatgggcttaatgagcagaaaccagtttggcccattaggggataatgggaaccctaatagagaaaacgaaggtcccataaggaagaaggcgatttggttgagaaaggtcattaaatcaattgttcgtgaccactgtcagattccgctgcgtgttaaccaaactctatggattcagaacaaagtagggagttgctacgtgcacccagcattattgctggggcacccagcaaacagtgaagtggcgaaactgcccttcagcaattattcttccggaagaaggttctcccagaaaagttccggaaataattttttcggaaagtttccggaagaatcttcttccggaagaataatttgtgtcttccggaagtactcacagacaacttccggaagaacgtcatccggaatgtttccggaagaatcttcttccggaagaattccattgtcttccggaagaagcttcttccggaagcacagaaggaggaaggtccggaatgaccacttccggaagaaggtcttccggaagttacgaaggccaattccggaagaagtgcttccggaagaccttcttccggaattggccttcaccacttccggaagaccttcttccgtaatgttaaattattag

SEQ ID NO: 73755 - DNA, 261 bp, Glycine max
  Peptide Sequence Number=SeqID_165440
atggagcggcggtgcaagtaccgaatctccctggtatttcctcccatcgagtttttcccaacactagtagattcaagatctccaacaaaacaattaacaaaaaacataaagttagtactcgagatatcggagcatcttgaagccgaggcgagtcaagagaaaggtctcagaggcaacctcacggccgagggaagacctagtggtggtggcggtggcggtggtggtggtggaggcagtgtcaacagagacggagggcaatga

SEQ ID NO: 73756 - DNA, 240 bp, Glycine max
  Peptide Sequence Number=SeqID_165441
atggccctttgctcagtgaacatgcacaactcatccttcttccaggttcttcctcgtgctcagccgaggagtgttgcgcttagcggattgctcgctcagccgacaggtattatgttccaagacattactactctattgcctgatcctaagcatttaaggacacaacagacaacaaatttgttcattgagcggtattatgttccaggacattactacgttctcatgtcatacactttgtag

SEQ ID NO: 73757 - DNA, 438 bp, Glycine max
  Peptide Sequence Number=SeqID_165442
atgcttcaccttcagcaccagatgattctcttacacccgagtacccaccaaatcccaaattgtgaacatattgttgatcaaaggactttcattcatgcatataaaggagagtttcaaccaacatatgggtgttctaatatcatatcaaatatcattagggcaaaatgtgatgaaccagctgcaagctggttgaaggtgtcagttgaccatcacgataggtggtttggagagtttaagttcttgtttcctattttatgcagaaagagtataggtggcacccacaagaagagtgagccattagagttgtttttgagacaaaagtcaaaggagtttcaaagaccaccaactgcttgggaggtgatggagaaaactacgaaattgaagtcgggaaaatggatcaatgtcaagtcccacgaatttgtttggcagatattataa

SEQ ID NO: 73758 - DNA, 1870 bp, Glycine max
  Peptide Sequence Number=SeqID_165443
tccgggcagtatcacgttggatggcaagccggtacgcggaccgggcgcagagcgcggcgtggtctttcagaacgaagggctactaccgtggcgtaacgtcatcgataacgtggcgttcggcctgcagctggcgggcatggcaaaagctgaacggcacgcgatcgcccgccgtctgatccgtaaggtcgggctcgagggcgcagaaaagcgttttatctggcagctctctgggggtcagcgtcagcgcgtggggattgcccgtgcgctggccgctgatccgcagctgctgctgttagatgagccgttcggtgcgctggatgccttcacgcgcgagcagatgcagacgctgctgctgacgttatggcgcgataccggcaagcagattctgctgatcacccatgacatcgaagaagccgtctttctcgccagcgaactggtgctgctgtcgccgggtccgggtcgcgtggtggagcggctgaagctcgactttggtcagcgcttcgccgcgggcgagccgtgccgcagcatcaaatccgatccggcatttatcgaacgaccgccggacgtcccgcgttcgtcgcctgcgctggccgttttcccgccagctgtcgctgagcctgctgagcgtagccgtgctgctgctgctgtggtggggcgtgaccgcgctggggctgattgcgcccttgttcctgccgccaccacagcagggctttatggatgccacgctatggcagcaccttggtgccagcctgacgcgcatgctggtggcgctgttctttgccgcgctgatcggcattccgattttactgatttatctggcaattttcgctccggtgactttgtccaccctggccggcgtgaagaatacgcagcaggtgcggatccgtgccgctcaggcgctgggggcgacgcgcgggcagctgctgcgttttgtcattctgcccggagcgttgccggagattctcaccggcctgcgcatcggtcttggcgtgggctggtccacgctggtggcggccgaactgattgccgcgacgcgcgggctgggctttatggtgcagtcggctggggagtttctcgccaccgatgtggtgctggcgggcatcgcgcgccgactgacgccctggaatggagaacagcaatgaacgaacgagtgaattttaccgcgctgggtccgtatatcggggcgcaggtcagcgatgtcgatctcagccatccgctgagtgacgcgcagtttgagcagctttatcacggtctgttgcgtcaccaggtgctgtttctgcgcgatcagcgcattacgccggagcagcagcgcgcgctggcgatccgcttcggcgatctgcacattcatccggtttatccgcatgctgaaggcgtggaagagattatcgtgctggatacgcatcaggataatccgccggacaacgataactggcataccgacgtcacctttattcagacgccgccggcgatcgccattctggcctcaaagctgctgccggagagcggtggcgatacgctgtggaccagcgggattgccgcttacgaggcgctgtcagagccgttcaaacagctgctgagtggcctgcaggcggagcacgactttaagaaatcgttccaggagtataagtaccgtaagacggaagaggagcatcagcgctggcagcaggccgtggcgaagcatccgccggtgcagcatccggtgatccgcacccatccggttttaccaccagctgctgggcgtaagcgagaaggagagcgaggcgctgctgggctatctccgaatgacgtggcaatctgggataaccgcgtgacgcttcattatgccaacgcggattattatccggcgcggcgcgtgatgcatcgcgcgacg

SEQ ID NO: 73759 - DNA, 405 bp, Glycine max
  Peptide Sequence Number=SeqID_165444
atgcaggcaagagttaaatgggtggaagggttaacgtttttgggagaatcggcctccggtcatcaggtattaatggacggcaattccggtgataaagcgcccagcccgatggagatggtgttgatggctgcgggcggctgcagcgcgattgacgtggtgtcgattctgcaaaaggggcgcaacgatgtcgccgattgtgaagtcaaactgacctcggaacgccgcgaagaagcgccacgcatttttacgcatatcaatctgcattttattgtcagcggcaaagcgctgagcgataaagcggtggcgcgcgcggtggatctgtccgcggagaagtactgctcggtcgcgatcatgctgggcaagggcgtcgagataacgcacagctacgaagtggtggagctgtaa

SEQ ID NO: 73760 - DNA, 564 bp, Glycine max
  Peptide Sequence Number=SeqID_165445
atgggtgatcaagaagagacacaggaacagatgaaagccaacatgtcggctttgaaagagcaaatggcttccatgatgaaggccatgttaggaatgagacaactcatggaaaaaaacgtggccaccgctgccactgttagttcggctgccaaagcagacccaactctcctagctaccgcacaccatcctcccccaaacacggtaggacgagaaaggagcacgctggggcacagcagcaaccctcatttgggatacaaccgggtggcttatgcttatgggttaccgcctaattacacgccgccagtcatgcatgacgatgtgggtcatgtctcttcccccatccttgaaggggagtctcctcgacatcccaacgaggtccacgaagatcatcgagagtatgcccaaggggatgtcgatttctaccccccgatccccgtcgaggggccggcacccaacacattgcctcagcacaacctcactcatgcatacgcatacacatgcatattttgtgatgacaggagcagaatcgtcttaggcagtggtcaaatgtcgggatggggctaa

SEQ ID NO: 73761 - DNA, 312 bp, Glycine max
  Peptide Sequence Number=SeqID_165446
atgaagttagcatctgttgaattctcagactatgcccttgtttggtggaataaaaatcaaagagagatgatgagagaggaagggcaggagatagatacatggattgagatgagaaggcagaaccatgcgatagaaactccagaggctatcctagggaagtctgactatggaggagtactacaaagagatggagatgacactagagtatgtggattggatgacttgctgcataaggcagtccgtgttgaacaacagataaagaggaaaattgcagcaagaaggaattcatccaacactttcaaccagaactag

SEQ ID NO: 73762 - DNA, 303 bp, Glycine max
  Peptide Sequence Number=SeqID_165447
atgtacacacaaagtttcacaattccacaatttcctaaaataggcctaactcacaaaaacagtccccagtggagtcgccaactgtcgcaacctacccttttgcgggcgagcagggtgaggctcaagggtgcgtcttccaatggaggaaaatgcgcggagtcgccaccaacatttagttgtggaaaacgtcggaaaaaccgaaggaaaacggtcatgaagaatattccagattcgggagttgtatttacatttgaggaaggtattaacacctctcacatttgtcccaaaggacaacagccttaa

SEQ ID NO: 73763 - DNA, 300 bp, Glycine max
  Peptide Sequence Number=SeqID_165448
atgttggtgcgcatgatccgcactcgtctttttgtagcggcacgggtgaaatcttgccccggtatgcatagtagatgcgtgatagtctccctctctggatgtactcgcacagttggttgccctccaatatcaaggggtggcccaggaactgataaaggaaactactggccccttaaccgggagcgcaagtctcgtacactgaaaatgaggacgcgtaaccctctaaaggcgagggcgtgcagccctctgcaggcgaggatgtgcagtcctctgatggcgaggacatatagtcctctaaag

SEQ ID NO: 73764 - DNA, 924 bp, Glycine max
  Peptide Sequence Number=SeqID_165449
atggttgcgctactcgctacattggtcgccttattctctgccagccaggatattgtcattgatgcataccgccgtgaaacgctcagcgatgaagagctgggattaggcaacagcctgtatgtgaatgcttaccgtatcgccggtctggtccctggctcacttgccctcatactggccgaccatatggcctggccacaggtctttctgatcgtaggcttatttatgctgcctggcatagggtttacgctgtgggcaaaagaacctgtcattaccagcgtccccaagactttgctggcatctgtggttgagcctttcaaggaatttatgcagcgcagcggctggcaacatgcgctgtgggtattgctgtttatcttgctgtataaattgggagatagcatggccacggccctggctaccccgttttatattgatatgggctttagcaaaacagatatcggtgccattgccaaaggtagcggcctcgtcatgcaaattgcaggtgcgtttattggtggcttgtggatgctaaaactcggcattaatcgtggtttatgggtatttggcgtggtgcaagccttatccattctcggcttcgcatggttggcaacgagtggtcctttcacagacattggcgcaactgaacgtggcatgctagcgattgtgattggctttgaagcctttggggttggcctgggcaccgctgcctatgtggcctatatggccagggaaaccaatcctgcttacactgcgacacaactcgcattgtttaccagtttgtcggccgtccctcgttcggtgtttaatgcactcactggcggcatggtagaagcgttaggctggcaacagtttttttatgtgtgtactttactggcgattccggggatgttgctgttgtttaaggtggcgccttggcgggaaaaatag

SEQ ID NO: 73765 - DNA, 315 bp, Glycine max
  Peptide Sequence Number=SeqID_165450
atggtggaatacaacggtaataaaggggatcagtgcccactgcatccaggggagtttcatgatgtagaaacgtgcccagtatccaaggagttgttgcagggattgatagatgggggtcgaattgaaattggccgtgtaaggagggaggaaggagaggtgttcatgcagtcaagtgacagcaacctgggtaagcctaaacctttggaaattcattttaccagagatgttaccactcaagtacctcgaggtttccaacccgctgtggtgaggacaccatcaccattcccttataaaagtgacaaggaggtgccatag

SEQ ID NO: 73766 - DNA, 801 bp, Glycine max
  Peptide Sequence Number=SeqID_165451
atggaggacactgtctttgagaaatacgacataaggaaaaataggcccagttttgccagactcgcagagacccttcttgggaggtatcagaagctcctggctgagaagaccaagaagaagctggaggaagctgcacagtcaggaagcgttgatggcatcatcgaccctccatcccccgtcagacgccacgtgaagtggaagatggcccgcaccaagaaaacaagggagatgatgactgaggccgcaaaggaaatcactgagaagatcgattcctttgaggagcaggtgacacagggatccttggtcccccatggacgtcaggatgttctcaccactgctattggacgtccagagcaccctggacgtgtccgtgctgctggagccgcaactgacccagcaaatcagggaccagctagaggagtccatcacagaaaaagtgacgtggcagctcatggcatccttcagccagatgcaccagattcagtccttgttgcaatctcagggacttacactgcctcccgagcctctggaaacgatcccgagatgggtgactcagataggtgcggcttgtacattgaagcagatcctgcccgcctggttaccctggggggagtttatgagggatccactgttgttcataacactcctttgttgcctggccaagtaaaggtgggtgtggaggaggttacagatgtagatgcttcagttcctgtacccactgatgaggtttccttagtgggacaggcacttcacaccttccttgcttggccgatacatctggttaagtctttatcacagtag

SEQ ID NO: 73767 - DNA, 1113 bp, Glycine max
  Peptide Sequence Number=SeqID_165452
gtaggatttaggccgtgcggtcgccagcccggtgcggccccacatcttggtcaggcgataaaacagcaggcggatattgaaatcgctgatgctgtagccaacaaacagcacggagttacccataacatcatgggtcagtttgatatccagcggcgagtcaaaatagagccgctcgaagtaactgctctcatccagcacgatggaggtatcatcgtcaaaatcgccatgaagtttaataatatggcgcttatcttcggtcagcgacaccagatcggcggcattagcgaccttgctatacggcacattgtgcgcttcatgcgccatctccagccagcggtcgtaattggtggtatagatgcgcgagaaattgccctgggtgatcatggtgtggatttcagagctgcgcacgtcgatgtccggacggtgccactcgcgatccatccagctgcgcagcgggccgagcgagcctttgcgctgtttgtaatactccgccagcgacaaatgggtgccgtaggtattgaagatcttcggatcgtagcccagctcattagccagatgtgcaatcagctcgtgccactccggcagtccgagattgcttttcagaaaggtggcaaagcgatccagcgccaggcggcgcatcgagatttcgtttttcagttcgcccatttcagcgaatgtctggtagccgaggacggttttggcggtcacgcccgggctgtccagcccattcaccagtttggtaaagcgttccgcgttcagccggctccagaagatgcgcgtcagtccggcgggcaggccattgagcccatccagatacagaccggctttagtcagtttgtcacgaaccagctccacctcattttcggtctgaatctcttcaatacggcgcgcaatgggcaccacttcgacacccaccggctcaaggatgtccaacctggtgacgcgtatccggctgcggttccggctgttattgtccggcacgctgtcgccgcgccgcgtggtcattctactctgcggcgacgtcactggcgaggaacaatcgggtcgcgctgcgcgcgccttcgccggtatagcgcatcgcttatcgctggcggcgttaaatattgcgcctga

SEQ ID NO: 73768 - DNA, 225 bp, Glycine max
  Peptide Sequence Number=SeqID_165453
atgccgattgttgtgttagttaaggagaagcaccccttgggcagtagtgaatttaccatccttgggcagaggaagatacaaaccaagctgcttaagttttcgagagacttggacagtagtgaatttaccatccttatccagtgcattggctatcatcagtcatcaagcaaagagcagaaagagatcaaatgcaaggcaaccaagtggtactcactgctcatatag

SEQ ID NO: 73769 - DNA, 862 bp, Glycine max
  Peptide Sequence Number=SeqID_165454
atgccgctgatcatcgccggcgccagtaccgaagacatccgccgccgcgtctccgccgcgctggacaaggtcggtttgctggataaagcgaagaacttcccgattcaactgtccggcggtgagcagcagcgcgtgggcatcgcccgtgcggtggtgaacaagccggcggtgttgctggcggatgaaccgaccggcaacctggacgacgccctgtcggaaggcattctgcgcctggccgcatgcaagggggcgctcaccatggccaataacgcaaaaaccgccaagagcaaggcgctgcgcggcggctggcgcgagcagtggcgttacgcctggatgaacgccattaaagacatgctgcgccagccgttggcgacgctgttgacggtgatggtgatcgccatctccctgacgctgccgagcgtgtgctacatcgtgtggaaaaacgtcagcaccgcggccagccagtggtacccgacgccgcagctgacggtctacctggataaatcgctcgacgacgacgcggcgctgaaagtgctcgacgccatcaaggcggaagccggcgtggagaaggtgaattacctgtcgcgtgaagaagcgcgcggcgagttccgcaactggtcgggctttggcggcgcgttggacatgctggaagagaacccgttgccggcggtggcgatcgttacgccgaagatgagcttccagagttcggataccctcaacaccctgcgcgatcgcgtggcggcgtgcgcatggatgacagctggtttgccgcctggcggcgctgaccgggttggcgggccagatcgcggcgatcatcggcgtgctgatgatcgtggcggtgttcctggtgatcggcaacagc

SEQ ID NO: 73770 - DNA, 700 bp, Glycine max
  Peptide Sequence Number=SeqID_165455
atgttgataatcattgaccaatataaagagaaggtgaacctagctgctagtcatgggcatatgctggaagatgaacaggcaaaggtgttagccttgcgggttgaaagggaagcgagagaaggggtgatagagttattgcataaagaagccatgaaatggatggatagatttgctctcactctgaatgagagtccagagcttccaaggttgttagctagagccaaggcggtggctaacacatactctactcctgataaagttcacagtcttttcaattactgccaacacatgaatgaacatgctttaggacacccttaccaaacacgtgccaaggctaggatcatgagtgagatagaagaagttcaagaacagatgaaggctgacatggaggccatgaaagaccaaatgaccaccatgatggaggccatgatgagtatgagaaaaatgatggaggtcaacacggctgcagtcgctgccacaagtgccgccactaagggaggcaaagcattgggaagtacagacggcccccattttgtgcaggtccagagcaagcatcccctcccaccatatggcttgccttccaattatacactacccaatgttgaacacgcgcccgatgagaatgtccacaattctactcccatacccattgagatccaacaaccccagtttggtcatgcacacgtccctcaacccatag

SEQ ID NO: 73771 - DNA, 168 bp, Glycine max
  Peptide Sequence Number=SeqID_165456
atgggaagatgctcaggaaatgggttttcaaaccttaccttacttcaacttcccaaacaccacgaatatgaaaaaagccaagagtttcaagaacctcgggatttgaggtcaaatccttttcaagggggagggaatgatgcaatcctaccccgcaagggtattggatag

SEQ ID NO: 73772 - DNA, 177 bp, Glycine max
  Peptide Sequence Number=SeqID_165457
atggcgagtccgatgacatgcaggggtggcaggcggagatacccaagtggttatccatacaaacacacttctgttaatcctgacccacgaagtcaggtggcatgcgggggtaccttatggttatctgcaccttttgtcaaccagagacaagcgagcccgttgacacgcagagactaa

SEQ ID NO: 73773 - DNA, 569 bp, Glycine max
  Peptide Sequence Number=SeqID_165458
atggctacctcaccaaaagaaacttcagctcctggttcaccctctgcaccatcaaaccaggaacgacctgaattcaatatccaacccatacagatgattcctggtcaagcccctgttcctgaaaaactggttcccaaacgacaacagggtgtgaagatttctgaaaaccctagccttgcaacaagtcctagggaagtagacccggagatggataagaagatccgcagtattgtgagtagcattttgaaagatgcctctgttcctgatgctgagaaagatgttccaacatcttccaccccagatgttgctgttcctgatgctgagaaagatgttccaacatcttccaccccaaatactgaagtcctctcttcacccagcaaagaggaatcaacagaggaagatgatcaagccacaaaggagacccctgcaccaagggcaccagaacctgctccaggtgacctcattgatctagaggaggtagcatctgatgaagaacccattgccaacaagttggcacctggcattgcagaaagactacaaagccgaaagggaaaaacccccattaagag

SEQ ID NO: 73774 - DNA, 726 bp, Glycine max
  Peptide Sequence Number=SeqID_165459
atgcgtagatcttctgtaggtgaattggttccattggatttagaaattgaagccacctttagaagaaacaacgcagaaaggaaaagaaagcttttgcacaacataacagtagcatcaatccttgaagaggctcacttttatgagtcatcatcttctaattcacctacatccaaggaatctcaaacaacagaatttgaagccgaagtcatggctgaagagcaacctcgacgagtgaccttggaagattactcaagtacttcagtgccacaatatttctcaagtgctacatggccaaagtcaaagcaattactcgacacttctgcaggaggaaaaattaagttgaaaacacctgaagaagccatggttacaggttgcacactttgtggtggagcttatgggtcaggcctgtgtattcccactgaagaaacatctcatgaagttaattacatgggaaaccagcctagacaaaattttaatgcagatggattttttggatttcaacatggccaaccttaccagcagcataatcaatggagaaatcgccctggtaatcagttcaataaagaccagagtgtggaagcaatgacttccaagattattttgatgatgccaaagaatcaagagtcaagcaaaatccaaagattcaagaatcaagtttcaagattcaagaataatcaagatcaagattcaagaatcaagagaagactcaatcaagataagtactaa

SEQ ID NO: 73775 - DNA, 522 bp, Glycine max
  Peptide Sequence Number=SeqID_165460
atggggtggttggagtaccaaggaaatgtttggaagcaaaagcaagagtcttggcaggcagcgattgacgcttttctcgcctttcatgaccgcaaggaaagcccggttgtcgctatcgtagccgatctatatgacaccttcgaccgaagatgtgaaaagaatagtgcaaggatggtttgctgtactccggccctctacgtatggggttgcattaattacaatcccatcctcgccataagacaactgggctaccccatgagaggggcaccattagaggaagacctcacacctattattgcacgaggtttcaatagcaccaacgcagaggcacttcagaaggtccgcaaggcatgggagatggtgcaaaagaaggacaaggaactcagaggtagtagcaacgggcccatcggtggctaccataggtggttgaaagcctacacgcaaggtctggattggctcccgaatttgagaaccactaagggggtggaagttgaagctctggaagaggacgaagaggtttag

SEQ ID NO: 73776 - DNA, 459 bp, Glycine max
  Peptide Sequence Number=SeqID_165461
atgcgtgctagagctagagtaatgggtgaaatacatgaggtacaagagcggatgaaggccgacatggaggccatgaaaaagcaaatggccataatgatggaggccatcatgagtatgaagaagataacggaggtcaatgcggctgcagttgccgctaccaacgtcattgttgaggttgatccgactcccccatctggcctcaaccaaataaatcatccaaccttggatatggtaggtcagggaggaaaaaagttaggaagtatgggtggccccctttttgtgcaaattcagaacaagcatgccttcccaccatatggcttgcctcccaactatacaccacccgatgttgcacacactcccgatgagaatgtcaataactccactcacatactcattgagagccagaacctcaatttgattatgcacgtggtctctcaacccatgggagaagacacatga

SEQ ID NO: 73777 - DNA, 840 bp, Glycine max
  Peptide Sequence Number=SeqID_165462
atggtttcccttgaacctattgagggcaacctcagatctagcgacccaccttcaagtcctagaatatctttctcagcagagttcttagatgagaacaacttcatctccatcagtccaaatgccgagtatgagagagatcaagagaaggaacgtgagagagcaaggaatgctgctgagtttgagttcctttcaaacaacacgagcagcaacaacacagtgttaactgctgacgagcttttctttgaagggaagctcctacccttttggcagatgcagcatctagagaagctcagcaagatcaacctcaaaaccaaagagggagaggaagaggagttagaagaggaagtaatagtggtgagcaacaataacaaagaggatagtaatagtaatagtaatagtagagtaaattggtttgtggatgatgacccatctccaaggccaccaaagtgcactgttctatggaaagagttgttgaggttgaagaagcaacgtgcttcttctttgtcaccctcttcttcttcctcatcttcttcctcttctgcaagctcacttggtgatgtggctgccaaagaagggaaagaagggtcaaggagtagtaacaaagagcagcatgtgaagagggtaaagaaagggttggagagagcaaggtcagctactattagaattagaccaatgattaacgtgccaatttgcacacaggtcaaaagcagtgccttgcctcctcttttcccactcaagaaaggaaaattagagaggagcaatgtcccagatagtcagatgctgagtgagttcctcaacgtgcgagtcccacatgggcacctgtcagccgcatacatctga

SEQ ID NO: 73778 - DNA, 1533 bp, Glycine max
  Peptide Sequence Number=SeqID_165463
atgtccctctccttcttcctcctcctcctcttcttccctttctctctctcccaaacaccccccagaggcttactcatcaactgcggggcccactccgctgcccaattcgataaccgcacgtggctccccgactcgggcttcatctcttcgggctcccccaaaaccgtcaccacccctgttcttttcccaactctgcacaccctccgctccttccctcgccaggtcaagaagcactgctacaatattcccgtgtaccgcggcgcaaagtacctcgttcggaccacctacttttacgccggagtcaacggcgctgaccacccctcgccgccggtcttcgaccagatcctcgacgggaccctctggagcgtcgtcaacaccacccgggattactccgatggaaactcttctttctacgaagggcttttcttggctcagggcaagatcatgagcttgtgcatcggttccaatacttacaccgattctgatccctttatttctgctctggagttcttgattctcgagggttctctttacaacacctcggatttcactaaatatggacttgccttggttgcacgacacagttttggatactccggaccacccattcggtatcctgatgatctgtttgaccgtgtctgggagccttttgggcagagtaattctacccaagcaagcactgataatgtttctgtttctggtttttggaatcttccacctgcaaaaatatttgagacacgtataggatctgatcaattggaaaccttgcaactgagatggcccacagcatcacttcctagttcaaattccaaatactactacatcgctctatacttcgctgatgacactgctggatcaagaatttttaacataagtgtgaatggtataacttattaccataatttgaatgtgatcccatcaggtgttgttgtatttgccagccagtggcctctttctggtcctacaacaataactttgacccctgctgctagttcttccttgggccccttaatcaatgctggtgaagtttttgatgtgctgccacttggaggaagaactttaacccgagatgttattgctttggaaaaggtaaaacagagcctccgaaatcctccacttgattggaatggtgatccttgtatgcctcggcagtactcatggactggcatctcatgttctgaaggaccacgtatccgtgtagtgactttaaacttgacaagtatggatctttctggatctttatcaccttttgttgccaatatgacagctctgactaacatctggcttgggaataacagtttatcagggcagattcctgacctcagttcactaaagattttagagacattgcacttggaagacaatcaattcagtggagagattccctcatccttaggggacatcagcagcttgcaagaagtgtttttacaaaataacaatttgactggtcaaattccagcaaatctcattggaaaaccaggactagatatcagaacttctggaaataatttcttatctcctccagcatcttga

SEQ ID NO: 73779 - DNA, 954 bp, Glycine max
  Peptide Sequence Number=SeqID_165464
atgtcttttgtgcggaattatcaagcagaagattgtagtttacatagtggttactggtccacctttgatggaaacaactttggcaacagcaataggaaaagaagcaggaacaattattataacaggaactgtaacatttacaatgacaaccggacaaaatttggggaccatggttgcaactttaatttttacacagctgatcatgctaattatgttagatatgatgctgttccatcatctttgaaaaggagaaaatattcagtgcctgcttggcaagaaagccagcaatactatgttccacccatggtccatgacaatatcccttcatcctataatttccaaggtcctcctacaagatctgatggtgatgcctctacatcagctagctgcaagcgtgattgctctatttttgaagatgataagcctgtcttcatgtctagggacgaaattgatagacactctccatcaagaaaagatggtattgatgtacatcatgagacacacttgcggtactcctattgtgccttccttcagaatcttggaatgcgtcttgagctgcctcaaaacatcattgggacagctatggttctgtgccaccgtttctttgttcgacaatcacatgcttgccatgatagatttttgattgctactgctgctctttttcttactgcaaagtcagaggaagctccacgtcctttgaataacatattgagaacatccagtgaaattttacataaacaagattttgctttgttgtcctaccggtttcctgttgattggtttgaacagtatcgggagcgggtgcttgaggctgaacaactgatacttactactctaaattttgaactcaatgtgcaacatccatatgtacctcttacatctgttcttaacaaattaggtctatcaaagactgttttggtgaatctggcattaaacttggtcagtgaagggtga

SEQ ID NO: 73780 - DNA, 507 bp, Glycine max
  Peptide Sequence Number=SeqID_165465
atgtcatcatctgcattattaaattcccacaggctcgccccagagaaccctcttcccgcagcatatgaagatagctgggaagctctcaaatggcacggtgatttcaacaggttttacatcgggggtgacactgcaggcgccaatattgcacacaatgcagttcttcgcgcgggtgttgagagtgagagtgtgagtttacttgggggtatggaaataacgggtgcggttcttgcttttccgttgttctggagttcagaaccggtcgaggggtttgaagagagttcagccatgcaagtggcattgatcaatcctttggcttctggggcgcctagcttggcctctcttgggtgccacaaggtgttgatttttgtggcggggaaggatgatcttagggacagagggatttggtactgtgatgctgttaaggagagtgggtgggaagggggtggaactgcttctagtggagggagaggaacattgctttcagatctaccatcctcaaactga

SEQ ID NO: 73781 - DNA, 48 bp, Glycine max
  Peptide Sequence Number=SeqID_165466
atggagagagaagagagtaagcgagggaagaaagctttaaccatttaa

SEQ ID NO: 73782 - DNA, 375 bp, Glycine max
  Peptide Sequence Number=SeqID_165467
atgaaggagatgcaaacattgaacttgttggcattaaagaacaacaacagaagcagaaacaggaagaggaacctttggaagtgcaaagcttatccatttgtcgtcaacgctacctcaaacctcaatttccttgcttttggtatcaatgctgagaacaaccagaggaacttccttgcaggcgagaaagacaatgtggtaaggcagatagaaagacaagtgcaggagcttgcgttccctgggtctgcacaagatgttgagaggctattaaagaagcagagggaatcctactttgttgatgctcagcctcagcagaaggaggaggggagtaagggaagaaagggtccttttccttcaatcttaggtgctctctactga

SEQ ID NO: 73783 - DNA, 708 bp, Glycine max
  Peptide Sequence Number=SeqID_165468
atgattgaagagttgatcagcaaagggcagcagcttgatgcggttcactttacctatgaagtgggtctggtggaaaagttccctcctgttcccttgttgaagtcttttctcaaggatgctaagaaagttgcggcttctattttggaagatcctaataatgcaggccgagctgcgattttttttcctatggtgaatgaaatttggcagtacctagctgcaaggaaagagcagtctgcactcagggctgtgattaaatgcattgaagaatacaaacttgaggatgagttccctccagaaaatctgaagaagcgacttgaccagttagagaaggtgaagaccgagaaaaggaaaccagtggcagttcctgccaataagagaactagagcaagcaacggcaatggaggtccaatgccaccagccaaagctgggcgtttgactaatgcgtatgtatcatctttccctgctgctcctacatttgtcaggtctccatcacacgggcaatacccagctgctcttccaccatacccttccccaccccacatgtacggcagcagaagtcccccagcaaatccttatgctgcttattcacccgagccggcaccagctattgcagggtcttacccggcagctcccatgaactatcctcatgcatatggcggctatggaaatgttttggctcccacttatcagcaggcttactaccgatag

SEQ ID NO: 73784 - DNA, 843 bp, Glycine max
  Peptide Sequence Number=SeqID_165469
atggtcggcggcaaccatcccaagtcttcccatcacaagaaacctcccccctccgcctcccaccgcaaatcccgctgggaacccaactcctcctcctccgccaaatccccagccgatcccaagtcatccaccgccccttcccccaaacccaaccccaactccaaccctaaccctagccccaaacacctccccttccccttccccttcccggaccccgcccctgcccctctgggtactccccctcctcccgcctatggcttccacatgctcgaacgccgcaccatcgtcctcgccgacggcagtgtccgctcctacttcgccctcccttccgattaccaagacttcgcccctcgccctctcgacctccctccccgcttccccccgcccctcagccccggtcgcttccgcctccccgactactcacacgccgccgccgccgccgccgccaagcgaaagtacggcgacgataacggcggtcccagggatgacctcgcgaggcagagggagcagcttctccgtaacgccaatggcctttccagggagcaattctccgcgggccccagtgagttgaggccctcgaagcactccaggctcgatgggtcgaattctactaggcactcgcaggtggatcaggacgcgttgaagaaagccttttgtaactttgcgaagctcattagtgagaatgcctcgcagaagaggacttacttggaagatgggaagcagggacgccttcattgtcttgtttgcggcactggcactggcagtttatttatcgataactttaaaagcaagcttcaggcaagatgcaccaaaaaattagatgaacaagaacaagaaggatag

SEQ ID NO: 73785 - DNA, 1848 bp, Glycine max
  Peptide Sequence Number=SeqID_165470
atggatgcaaccacgaaggttacactgttctcaatcctcatgctcttttggagccatgcagaatgcaaccatcttcttcacccactagaccctctaaccccttctgagctcaaccttgttcgaaccattgtccaaaacttttatccaacctctcaaaacctcaccttccactacgtaggcttggacgaacccaacaagcccgaaatcctcaaatggctatcctcaaacaactcaaaaatcaaacccaaaccacgaccacctcgccgagcctttgccgtagtccggttccaaaaacagtcccacgagatcacagtggacctgtccacgcattccatcgtctcaaccaaagactgcgaaggaaatggcaaccctatgctcacctttggcgaacaagccgtggcgtcgcagctaccattcagctacgaaccgtttaaagagtctttgaagaaaaggggtctcaacacgtcacaggttgtttgtgcttgtttcactattggttggttcggagaaggcaagaccaaaaggaacgtcaaggttaagtgttattacgcaaatgacactgccaatttgtatgccaggccattggaaggtgtggctgcggtggttgatttggacgacatgaaaattgttggctacaatgatagatatgtggttccggttccaaaggcagagggcactgaatacagagcttctaagctgaaaccaccgtttggtccaaagcataagggaatagctgtcacgcaagacggtggacctggtttcaccaaagacggccattcggtaagacatcgtcgggtactgtataaaggattcataccagagctatttgtaccataccaagacccaactgaggaatggtattacacaacatactttgattctggtgaatatggttttggacagtctatgtcttcactgcagcctctcaacgattgccctcccaatgctgcattcatagatgcatactatgctggatcagatggtaccccggtaaaaatagctaatgccttttgtatatttgaaaagtatgctggtgatatcatgtggcgtcacacagagatttcaattccaaatgaagtgataactgaggccagatctgatgtaagcctagtagtgagaatagtttcaactgtgggaaactacgactatgtcatagattgggaatttaagccaaatggctgcatcaaaatcggggcagggacatacaccaacacagaccaaataaaagaggatatttacggcacactaatagcagataataccattggtatataccatgaccacttcttcacctattatcttgaccttgacattgatggtgaagccaactcctttgtgaagtccaatttggagacagtgagagtgaaagatgacaccacacccaggaaaagttattggacggttgtaagtgaaacggctaaaactgaagctgatgcaaaaatcaacctagggtccaagccttcagagctactagtggtaaatcctaataaaaagactaaacaaggaaataaaattgggtaccgtttgcttccaggtccagtggcacacccacttttgcttaatgatgactatccacaaatcagagctgccttcaccaattacaatgtatgggtcacaccatacaacaaatctgagaaatgggtaggagggtcatacgtcgatcgtagcagaggcgatgataccattgctatttggagtctcagggatagggaaattgagaacaaagacatagtattgtggtacacaatgggatttcatcatgttccttcccaagaagactatccaattatgccaacgttgagtggtgggtttgagctgaggccaaccaatttcttcgagagaaacccg

SEQ ID NO: 73786 - DNA, 813 bp, Glycine max
  Peptide Sequence Number=SeqID_165471
atggtgatgattctgagggtacctgtcatttttgccgatgatgtgcctgtggtgcctgcggtaccacaggctgagcctgctgtagctggcgatgaacccatggtagatgttgacgcacaggacactaatgcagagactgacgcacaagataccgatgcagaggatgctgcagatgaggctgagggatttcctagtggactcagggacccatcagtgcttacggagtatgctgagcatgttgtagccagtgtatggtctggacaggaacaacctgagttgaagttatcctccaatgggaggaaggtgcataaattaggcaggcctcttcctgcaattgaggagatggttgctgggacaagattaagtcctctgatcgcgtgttcaatagacaccggcgatcagagaagtatatcctcgtttgtcgagaggtggcaccaggagacgagtactttccatcttccagtgggggaggtatccatcacgctggacgacatcgcgtctcttcttcatctgccgatcgttggcgacttccacgccttccagcctctgcacatcaacgaggcggtgctgatgttggttgagttactgatggtctcaccagaggtagccatggccgagataggacactgttgtggaccatacgtacgcttacattggctacgagacgtataccagcgcagatgtcagacccaacactggacagctgcagctcgtgcttatcatctgcatcttctggattgcactctttttgctaataagagtgcaacccgtgttcatgttgtacacttagacgccttgcgtgacctcacttag

SEQ ID NO: 73787 - DNA, 4659 bp, Glycine max
  Peptide Sequence Number=SeqID_165472
atggacaggattagagaagccagaagaagcactatggccgcaaatggattaaccagacgaagacacaggactaacaacagtcttagagactcaccagaggaagatggagccatggagctgcaagaaccatccaggttgcgagatcgaggaggtagtgggaaaaaggatcgagatcgtgaaagggagagggaaagggagagagatcgattgggtcgaagcaagaagagaagaggagataggttgatgcatagcagcagagaagatggcggagaagacacttctgaagagagtatcaacgatgaggacgacgacgacgatgaagacggtggcggcggcggcagcggcagcggtagcgcttcagtgagaatgcttccgctgaacccctcttcgctctccaaccagcatcatcggaagagcttccctccggcgaaagttttaagaccaacgccgccgacgacgtggaaggccgccgatgagatgatcggagtatccgtccctaggaaagcacgctcggcctctacgaagaggtcgcacgaatgctgggcttcgagcggtggcggtatcgtggcggaacaaaatcaccgacagccgtcgacctccccggtgagggcggctgcgccggcctcgccttcgtcgtcgaacgcctctgttaggaagaagataaagcagaatggcggagccaagtttcgaccacccaaaacgacgacgtcgtcgtcgtccaagccgtcgtcttcagcgcaggacgagatcgaaatagagatcgcggaagtgttgtacggcatgatgagacaacctcaaggaccgtcgaaacaagaaatcatcgccaacgattccaccaagttcgattcccgagaatctaataaatcttccaccgatgccaagtcaccgatctcaaacccacaaaattcaagctcttccgccacacccatgtccgctgttgctccgaagaggaaaagaccgcgaccggtaaagcacgaggatgagaatccggcgagtttgatcgttcggagcagtcccatttcgtcaacgacgaaggccgagagcgatcagccttcaaagatggagacttgttcttccaatttggataagaacaacgtggggtctgtttccgagaatctggcgcattctcagacagttcaaattatgccggagccggtgaagccggagaacaacgagtttaagccggcggcgacggaggaagcggagaagcagaaagatgtggggttgagtgaggtggtggtgtctcctcagttgcccaagaaggaatctcctgtgcgacaagtagcagatgatgaccgtgaagatgtgaaagcgactaaagcgaatcactcaatatccgagagtgataatcagcgagaagagaagttccagatagatctgatggcgccacctcctccatcgagatcttctccggaaagggatgtggagaataataataatatggtgattgacgcagaaaaggaagtgaagcctatgacgaaggaggacgagaaagtgctcagaatgaacaaggaagtagcaatggttatagaaatggagaaagtgaaagcaaaagcggaagaaactgattcgcagaaaccaagttttgtgcagaaagaaagaggaattgacttgcagcttgatttggagaaagttgatagggtagatactagtggcaatgttggtagtatggttaacaagaagcagcaacatcagaacgttcagaggcagcaaacgaactcagagaaaaatgttcaatccaattctttgcctctaccattgtctgttcctagctggcctggcgggcttcctcccatgggatatatgacacctctgcaaggagttgtatccatggatgggactcctgtgacatctgcagcaataccgcctccccatcttctttttaaccagcctcggccgaaaaggtgtgcaacccactgctacattgctcgcaatatattgtgtcaccagcaaattgcgaggatgaattcattctggccagcagcagcaggttctgcatcactatacggggctaagcccagcaatcttaatgttgtaccctccacagagttgcatgggaatgttcccggcagggctgcaaactcttctcaggacaaagggcatggtattgccatgtttccaggacatattgggaaggacaaagcctctcagcctgccattgtggataattcatcaagaaaacaaattttgcttcagcaagctttacccccaggagcagcacctagtaatatcttgcatggccctgcattcatattcccgctgaatcagcagcaagcagctgctgcggcatctgttcggcctagatctgtgaagtctttgccagtttctagtaatggagcaccctccagtgtctccaattcagccccgtcgaatgcttctggcacaggcactgtggcggtggcagcggctgcagctgccgctgccccaacgatgagcttcagctatccaaatatgcctggcaatgaaactccgtacttggccattttgcagaataatgcttactcatttccaataccagcacatgttggtggtccacctggctaccgtggaaccccccatgcccaggcttttccattcttcaatggctccttctattcttctcaaatgctgcatccttcacagattcagcagcagcaacttcctgctcagtcacagcagcagaatcaacagggccatcaaaatacaagtatgtctagtggatcctcctcttctcagaagcagcatgctcaaaatcaacaacaaaagcctaataataatgctactggatccaatgggggtgcaagtttgcaaggctttcctgtcaccaaaaccccaccatcacagccactgcagttgcaacagcaacaaccgcagcagaggcagaatcatcacacttctcatccagctcgccaggttgagtctgagatgggtggtgaagacagtccatctactgctgatagtcgtctcgcccgtgccaccatgaatatttatggccaaaatttcacaatgcctatgcagtcgccaaactttgctctgatgacacctgcctcaattggtgcaggaggctccaatggcagtcacagtgaaaagaagcaaccccagcagcaccctggtccaaaggctggaggtgaaacagctcctgcatttgccatgtcatttgcatccatgaatggagctactggcgcctctggccttgacctctcatctattgcacagaacaaccattcaatcatgcagagtaatcataactatcatataatggcagcacaagctgccagtgctcagttgaagaagagttatcatgccgccgaggaagggaaaagtgtagttaatccttctaatctagacgaagatagaaaagcaatatctgctggaaaaattccggcaacaatggggcaatccattgcattcggaaggccagatgtatctgatccctcattagcgtcgttatcgggcggcaacaatgtgattgatacctcgggccgtaatctaaaccttggttctgcttcttctcgtgcttctgcttctgttatgcctgctgccatcagcactaatgcagccagttctcagcaacaaatgcagcgaaatcagcagcagcaaattcttcagcatcagaagcagaatcaatttgcagctgcagcagccgccgcggcggcccgcaacaagaccccatcaacaagcaatggcagtgtttactctgataacctcccttctacatcttcaatggctaataagtttcccagtgctgtatccgcattccctcaaaaccttgtacagagcagtaacaccgttgctcagtcaccttctcagtggaagaactctttaagggcaacaaccacttcacagtcgcccccatccatggcttcaacaacaccatcctcatcggtcaaaagtcacccacagcagcaggctcgttcccagcaacctcacacccaaatatctttcgcaacaaatccaaaatcatccgcagcacaagttcaacctgcaagttccacccagtccccatctcccccagtcatggttggctcaccaacaacttcatcaatatcaaaaaatactggtagcccaaggacaacttcagcctcaacaaccaacaataagataagccaaagttcttctttatcctctcagcaagccaagaactcttctgctgtgccggcgcgcaaatcgtcacctgttggcagcaggaatgtgccgtcaatacttaatgttcctcagctaactcccccttccagcactgggagtaaatcccaactgccacagcagcaacagaagcagcagcagcaaataccaaagcaagcattaccacaggcccagcttttcttctctaatccttacatgcatccgcaatccaacagttccacatccaccaccacagttccaagtggttattaccttcaacatcaacaccaccaccaacaacatcaacagcggcgtggccctgagcagatgcagcggccaggctcttccggcacttccccggccgtgaacaatgtgaaaggcagcagtgccttacctacgcagggtcttttgcatccggcacaggttgctgcaatgcaaccctctgggagccaccctcagtttgttcctactggcttttcttatgcttcttatcatgttcattctgtgccctcagttcaagtgaagccagcggagcagaaacaacctgcgggtgagtag

SEQ ID NO: 73788 - DNA, 84 bp, Glycine max
  Peptide Sequence Number=SeqID_165473
atggcggaaatcaaccaaggtaagaggatgaccggtcacgattggccgcgtattgtttgtctcctacttgcagggacagcataa

SEQ ID NO: 73789 - DNA, 306 bp, Glycine max
  Peptide Sequence Number=SeqID_165474
atggattacctcctatggatgctctggagcatggagtgcaacatctgtggagtaaaaataaaatctgttagacctacagagagaggagctggaagtggaatctgtgaaggtgctggaggaatcactgggatctctgtggaggaagtgactcaggctctccaaggatctcgagtcagactgaactcccctagccttacacaaagctgtaatcaaggttgggaatccaagtctggatgtgtcatgctgagcagtgagggaggtctggtgggagatgaggtaccccacgttcatgtcccatcttcataa

SEQ ID NO: 73790 - DNA, 225 bp, Glycine max
  Peptide Sequence Number=SeqID_165475
atgtcagtgaaaaacctcgttgggcgcctaggagtacatgacaagacaaaccatacactagcaagtcaattagggtcacagtgttttgcgagaatgctccaaccatatgggatcaacataggcttaaaggagcactcaaaccgggtgacccccaaggcctacactacgaaaagtccatcagggcctctccttcctgattcaggtccaacccagaaaacactttag

SEQ ID NO: 73791 - DNA, 1017 bp, Glycine max
  Peptide Sequence Number=SeqID_165476
atggagcatgaccgccgcattatcgcggaaaaagtgctgggcaccggcgagaaaccggcctggcacttcacaccggacgtcactgccggcttcacgccgcagcagagctatctgcagcagcacagccagcaggaactgaatgcgcaggccaaagccctactgaccgccgccggttacggcccggctaaaccgctgcacctgacgctgctgtataacacctctgaaagtcaccagaagattgcgattgcggagtggaaaacctatatcgacagccgcaacagcggtaatttcgatgtgatccgcgcttcctgggtgggcgattacaatgagccatcgaccttcctcagcctgctgaccgccagccacagcggcaatatttcccgcttcagtaacgcggaatatgatgcggtgttgagtaaggccagcaatgaaaccagcgtggcggcgcgcaatgccgattacaacaaagccgagcagatcatcgctgaccaggtgccgattgcgccgatctaccagtacaccaacgggcggctgatcaagccgtggggcggtgaacgacccggcgagtacgtgaacgtcattgaaggaaaagcgctgcaggtgtcggatgcgattgtcgcctgccagttcgacggcaagggtggcgttatcgccattgaagataaagatgtcatcaactgcgagcgtcactgctggctacacctgaactatacccagcggcaaagcgccgactggttgcagcacacgccgctgatccccgatgcggtgcgggatgcgctggccggcgacagcatgcgaccgcgcgtgacgcgtctcggtgacggctttatgatcgtgctgcgcagcgtgaatcataacgccgattcgcgcccggaccagctggtcgcgatgcgggtatttatcaatgacaagctgattgtttctacccgccgtcgcaaagtgtatgccatcgatgaagtgctgaccgatctgcaaaacggcaacggcccggtggacggcggcagctggctggtggac

SEQ ID NO: 73792 - DNA, 291 bp, Glycine max
  Peptide Sequence Number=SeqID_165477
atgaacttaatcgttattatcaaaaaagaaaaaaaacacgctttacggcgcccttaccaattccgtgctagagctagagtaatgggtgaagtagagaaggtgcaagagcagatgaaggccgacatggaggccatgaaagagcaaatggccacaatgatggaggccataataagcatgaaaaagataagggaagtcgatatggttgcagttgccgctaccaacgccgttgctaaggtgaacccgatgcccccatctggcctcaaccaaatgaatcaaccaacctcaaatatg

SEQ ID NO: 73793 - DNA, 264 bp, Glycine max
  Peptide Sequence Number=SeqID_165478
atgaccatccagaatatgcaatttcagcaagagacaagagcctccattcagagtctgtcaaatcagatgggacagatggctactcagttgaaccaagctcagtcccaaaattctgacaaattgccttcacaaattgtgtctggcaaccaaattcaagtgcctccatcagtagcagcacttgcacctaaacctgtcaagcttccttctacacctgagaaagaggatgagatagtcactgatcgaggccgtacccaaatcaaataa

SEQ ID NO: 73794 - DNA, 852 bp, Glycine max
  Peptide Sequence Number=SeqID_165479
atggaaccaattgcatccctttcccagtattatgaccagcccccaaggtgcttcacattcgaggacttccagctagtgccgactgtgaaagagtttgaagaaatcctgggatgcccactgggaggaaggaagccatatcttttctctaggaatggggtagtcggagtaccaaggaagtgtttggagaaagggcaaaggccttggcaaatcaaggcgaatgggctttcttttattgacatcttggcgcttttgatctttggagttgtcctctttccgaatatggaagggttagtggacctagcagcgattgacgctttcctcgcctttcatcatggcaaggaaagcccggtcgtcgccattttggccatgtatgacacgttcgaccgggatgtgaaaagagcagcgcaagaattgtttgttgtgcactggctctctatgtgtggctggtttcacaccttttttctccaagaaggtaggcccgtctatccgctacaaggtcaccgctcgattctatcctcatgcgaaggatgtccaaatgttcccttgatgggaacaaggggttgtattaattataatcccgtcctcgccataagaccgcttggctaccccatgagaggagtgccatcaggcgaaagcatcacgcctttcatcgcacggggtttcagtgaccacaacgcgagggacagagagcttaggggaagcagtaatgggatcatcggcggctatcataagtggctaagagtccggacacaaggattggattggctcccaaatctaaagactgtgagagacaatgaggttaaagcttcggaagaaagtgatgaggtacaagccctaaaggccagagcttga

SEQ ID NO: 73795 - DNA, 923 bp, Glycine max
  Peptide Sequence Number=SeqID_165480
atccttattggggtactgagacatcttacacaaaaacctggcatgaaaatggctatcttgaaattgcagtgaaatttcacacgcatttttcatcaggagatcgtcgcatgcatttacgctttacaaccgactcacaagccgccccggtgctggatgtcgacattaagcagctggtcattgccggatgggttggccgcgaccaggcggcggtgctgcaccatatcagggagctggaggcgctgggcgtgcccgcacctggtgcagtcccgctgttttatcgcgtagccacccagcagctggcgcagcacagcccgctggaagtggtgggcgagcaaacctccggcgaagccgagccgtttgtgtttttccatcgcggcgaatactgggtgtcgctgatttccgatcacaccgaccgtcacctggaaaccttcagcgtggcactgtcgaagcaggcctgcgttaagccggtcgccggtcatgcgtggcgtatggcagaggttgagccgcactgggatcggctggagctgcgcgcgtggatcaaagtcaatcggcgactgggtgacttatcagcagggcacgctcgactctctgctcacgccgagggatctgctggcgcgctacttcggcgatcgcccggtcagcgaaggctttgcgatgtcatgcggcacgttgagcgcgatcggcggcatccgtccggccagcgagttccgcatggcgctgcacgatccgctgctgaatcgcacgctggaacaccactatgtcaccggcgcgctgccggtgattgcctgaggaggcgcgcgagccagcaactgcgcgccggagatctcaccgcaagcgccgcgacgcaacaggcactacgcgccgctgagcagccatcgggcgaaggcgcacgcgtgtttacgcgaacctacgccgaccgcgcc

SEQ ID NO: 73796 - DNA, 1299 bp, Glycine max
  Peptide Sequence Number=SeqID_165481
atgtctgacaagataacccgcgcggccgctgtgcccgatattgagcagcagaccgtaaaacgcgtcatctggcgcattctgccgttcctgatcgtctgctatctgatcgccattatcgatcgcggcaacatcggcatggcgtccctgcaaatgaatgaagatctcgggctgagcaaagcggtgtttggcctggcaagcagcctgttttttgttggctattttctgtttgaggtgccaagcaacctcgcgatgcagaagattggcgccaaaatctggatttcgcgcatcatgcagtgcggaaatgctgtacgtgctgcgctttctgttgggcgccgccgaagccggcttctttccgggcgtgatcctttatctgacttactggattccggcgaaatatcgcgcgcgcgtgattgcgactttatggtagcgatcccggcagccaactttattggctcgccgatctcgggcgcaatcctgacgatggacggctggttcggcctgcgcggctggcactggctgtttatcatcgaagggttcccggcgattgtgctgggtgtgctggctttcttcctgctcagcaaccgtccggaaaatgcccactggctgaccagcgaacagcgcaactggctgagcggcaaactggctgaagagaatgcccagcgcaaagcgattggtcatatcaccctgtggcagctgctgcgccacaagcatatctgggtgatggcgctgatttacgccggcgcgtcggcagcgggttcgacgctgagcgtctggtcaccgcagctgctgaaatcatttggcctggataacttcaccaccggtttgatgaatgcgatcccgtacggtctggcatcgattctgatgattgtctggggccgcagctctgaccgcagcggtgagcgtcgctggcacaccgcgctgacactgttcctgattgccggtggactgctggcggcgttcctgaccgatacgctggcgggcagcgtggtgattctgtcactggtgctgattggtgcttattcgatgaaagggccgttctgggcgctggcctcgggctggatgtcctcaaccaccgcagcggccggtctggctgctatcggcgcgatggccaacctgattggtggcgggctgatggtgaacgtttacggcatcattaatgagaaaaccggcagccatgcgatggcgatgattcctctggcgctgctgtgcgcggcgggcgggattgcggtattgctgatgggacgcagcaaaaagctgcacgttgaagcggaacagccggtggccagcaccgggaaataa

SEQ ID NO: 73797 - DNA, 561 bp, Glycine max
  Peptide Sequence Number=SeqID_165482
atgggagagagaatttgggcaccttggttcataaagtttattcaatcccgtggttatttcaatatctacacaaatcttctgcatgagagagcactaagcgtttctcacagggatgctggagtaaactacgggaaaactgctggacctgattctaaattactagaggaaaaagaagtacatcctggaaaggttgtcactaacctggaagaacttggatcgttgcttcactctctgcagaaacagagtagtgtcttcttagtaaatctttttggggatcctctagagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatag

SEQ ID NO: 73798 - DNA, 171 bp, Glycine max
  Peptide Sequence Number=SeqID_165483
atgacggagataaagtctcaagaggccaccatggcaaggtatttgcatggtctcaatagggagatccaagacattgtagagttgcaccactatgcctctctgaaggatctcattcatcaagctatcaaggtggaacaacaagtaaagaggaagcaaacatgcaagagatag

SEQ ID NO: 73799 - DNA, 126 bp, Glycine max
  Peptide Sequence Number=SeqID_165484
atgaaaggtaaaggtgatgcaatcctccctaggaaaggaccagttaccagagccatgagcaagaggctccaagaggattgggctagagctgataaagaaggccttagggttctcatgaaccttagg

SEQ ID NO: 73800 - DNA, 366 bp, Glycine max
  Peptide Sequence Number=SeqID_165485
atggcaagacacaaggtcacacgcacacacacacacacacactcacgcaggcacaagggggaggaggggcttggtcggtttgttggtgatttggaggggagggacgaatcaaagcgacaagggctgaatctcagtggatcgtgcagcaaggccactctgccacttacatacccgtcgcgtattaagtcgtctgcaaaggattctacccgccgctcgatggaattgcgcttcaaggcgtctcgtagggctaatccgcctcacgagggtcaccaacggcacgtgcctttggggggccgaggcccctactgctggtcggcaaacggacggcgggcgcacgcgtcgcttctagcccggattctgacttag

SEQ ID NO: 73801 - DNA, 198 bp, Glycine max
  Peptide Sequence Number=SeqID_165486
atgcccttttgcgggcgagcgaaggcgaggctcacgggtgcgctttccgaaggaggaaagatccacggagtcaccaccaacgtttatttgtggaaaacgtcgggaaaaaccgaaggaaaccggtcgacaatagcggggcttttgctcctacttaccctttatcgaagaggaaatcagacctacgtagttctttcttaa

SEQ ID NO: 73802 - DNA, 180 bp, Glycine max
  Peptide Sequence Number=SeqID_165487
atggataagagcttgaaggtaggagaagatgagaggagggggatgatgcaatcctaccccccaagggcattggatagaagactccgagaatattgggccaaaaatgcaaaagaaggccctagggttctcatgagccttagggtagggtaccctagaaatataggatttttcagcctttga

SEQ ID NO: 73803 - DNA, 165 bp, Glycine max
  Peptide Sequence Number=SeqID_165488
atgtcgctgcatgttctttatctttatgcgttttctggatttcccccagggatttcccgtctgctgtatctctcgttacgatctttcaatgaaatgaacgggcaggatcatcttgagctaccttctggggtgaggaccaaatgtggacagcagaaaccaatcaag

SEQ ID NO: 73804 - DNA, 70 bp, Glycine max
  Peptide Sequence Number=SeqID_165489
atggcaagattggtgcaatgtgtgaaactgggcaaagagctggagggcatggattttccgccttaccctg

SEQ ID NO: 73805 - DNA, 1161 bp, Glycine max
  Peptide Sequence Number=SeqID_165490
atggaccaggatcgctgggagttggctggcgaagtcagggagctgcgtggcccattgcagaaactcaaattgcgcatggcgcatacggattaccagcacgtagagattgaaggtggtcaagtggggaccactttcaagaatcgcggtatggagggcagcctggaagcgacccatgtaccatgggcaggtgttaacggtgtggttggttaccagttccagaacaccaagttccaggcgttgggcgaagaggcctttgtacctagcgtggtgacacagacccaagcgctgtacctgtatgaagagttaccgattgataaacacaagattactttcggtggccgcgtgggggaaacaacagtgaattccagcgctgatgctatctttacgcaagcctttaataaccgctttaatccgaatagcctggctttaggcgggttgtacaccattaatgatacgtggagtgcaaccgctaacttatcccataacgagcgtgcacctagctattttgagttatatgccaatggtgagcatgtggccaccggccagtttgaagtcggtaacgctaatctgaataaagaaatctcgaatgggttggatgcgcaattgaagtggaaagaaaatgggcacagtattactttgggggcgtatgccacacgcttccagaattttattggcctgtttaactccggtgcaacagatccaggcaccgggctggccattgcgaatttcgctgcagtgccagcgttgtttaaaggtttggagctcgaaggcaagtttgccctgaatgacgagtggacattaaaaatgcgtggtgattacgtgcatgccaaggatacacgcaataaccagtatttgccgcgaatctcgcctttgcgtctcggtggcggcctggactaccgcttgggtaactggaatgcgcgcgtcgatgtattgcatgcgttcaagcaaaatgatgtggcagaaaatgagctgaaaaccaatggctataccaacttaagtgcattggtcgcgtataagcttccggtcaaatatcatgtggaattgtttgccaaggcaaataacctgcttaatgacgagatacgcgagcacgcgtcttttctcaaggatatttcaccggcaggtgcacggtctgttctggtgggtgccagggccgatttttaa

SEQ ID NO: 73806 - DNA, 273 bp, Glycine max
  Peptide Sequence Number=SeqID_165491
atgtctatcgaccgagactgcaaaaaagtctcacctttgctatctagagacaatcgagtccaatacaatgcagagacacctcatggttatccacacctttgtcatccagagacagcaagtccgatgacatgcggagacacctcacggttatccgtaccttgtcatccagaggcactgaatctgatgacaagcaaagacacctcctgtttatctgcaccttttatcatccagaggcaagtgagccatgatcgaggccatacacgaatcaaataa

SEQ ID NO: 73807 - DNA, 285 bp, Glycine max
  Peptide Sequence Number=SeqID_165492
atggcgatacaagtggaggaaagtaaagctgatcagaaggtggagggattgaaacaacagctggctgatgaattggcactagaaccggttgatgatttagttgaacttgaagaaatttttgaggaagcagaagatgaaaagaagaaagaggctactcttactgaatgcaaggaggtaccttatccatttgtaccctcctggaaagataaagagcgacatttggccagatttcttgatatcttcaagaaactggaaattactttgccatttggagaagcactttag

SEQ ID NO: 73808 - DNA, 234 bp, Glycine max
  Peptide Sequence Number=SeqID_165493
atgaagtctgacatggaagccatgaaagagcaaatgaccacaatgatggaagccatgatgagtatgagaaggatggtggaggtcaatgcagatgcagtttatgttgcaagtaccgccacagaattggacccgactcacccgcgtggcttcaatcatgtaaatcatccagcctcggatatggtaggtcagggaggcgaatcattgggaagtgtaggtggcccccattttgtgcag

SEQ ID NO: 73809 - DNA, 432 bp, Glycine max
  Peptide Sequence Number=SeqID_165494
atgacgattgagggaggcaaaattttggagtgtattaggagaagaagagaggaagtatattttgtgtcgactactttggtgaaaagcatagggagaggaccgaaagggttacactataatactaacaaattgtttggtgggatccccgggtaccgagctcgaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagctgaatggcgaatggcgcctgatgcggtattttctccttacgcatctgtgcggtatttcacaccgcatatggtgcactctcagtacaatctgctctga

SEQ ID NO: 73810 - DNA, 276 bp, Glycine max
  Peptide Sequence Number=SeqID_165495
atgggtgcaaatgatatcatcattgataaacagaagggtctgctggctgctgaagaaaagattgatccaccactagagagggtggatctgggatggtggcctcggatgatgcatcctatacctgctgaggtacctaagcactgggacccccaccttctcttgagagaaggcaaggttcctggccaggataccttctctaaaaactactccactaacataatggatcctaaaggggctacaacctgcaagctctgcattaactttatctatccttga

SEQ ID NO: 73811 - DNA, 432 bp, Glycine max
  Peptide Sequence Number=SeqID_165496
atggcagcgcaattaaaacatgaccgagtggagatggagtgcctagagggagtttgggagaccctcgaaggcaatgcgaggtgccgattccgtggcacgattcgactcatgactacttcattggtacatccaaaggaacccgcacgcacgcttcagcgaactgtggagtggatactacctacacctactccatatcgactagtggagccggtccaagtgatagaggtgttgtcatctgaagaagaccctgaggaggacccagaggagttacctcccgagcctgttgtggatgctcttgactttccagagggtgatgaggacccactacctgatgtggattctctagagaacgtcatgtcagcatctaaggcagactctacggaggagagcggccctagagggatagtgactagtggagactcttcatcatag

SEQ ID NO: 73812 - DNA, 463 bp, Glycine max
  Peptide Sequence Number=SeqID_165497
ggtacatctacttgggttgttgtaattgagaacaagagagggtacatctcttgtggatcagttctagtggagggtacatccactaggttgttgaaagagaacaagggaggcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccacccc

SEQ ID NO: 73813 - DNA, 165 bp, Glycine max
  Peptide Sequence Number=SeqID_165498
atgaggatgcgtagccctctaaaggctagggcgtgcagtcctctacaagcgaggatgtgcagccctctgaatgcgaggacatatagtcctctaaaggtgataggtactagtacccaagggtccacctttatgagaaagcaagagatcgactcattgagagggccg

SEQ ID NO: 73814 - DNA, 417 bp, Glycine max
  Peptide Sequence Number=SeqID_165499
atgaggggggcactgtcagaggaaggcctcacaccttttattgcacgaggtttcagtatccccaacacgggggtgcttcaaggagtccgcaaggcatgggaaatggtgcaaaagaaggacaaagaacttagggggagtagcaataggaccatcagcggctaccataggtggttgaaagcctacgcacaagccgctaagggggaggaggttgaagccccggaagaaagcgaagaggtgcaagccctcaaagtggagcttgagaaagcccaagcgatcaaggaaaagttcaaatcaacaaccattaggatccaaagggagaatgccaaactgagagacgtcaacatagccaccaccaacgccttggagcaagagaccaaaagggcctgcaaggaagaacacggtcggaacaagttctga

SEQ ID NO: 73815 - DNA, 171 bp, Glycine max
  Peptide Sequence Number=SeqID_165500
atggtaaacaatcctagtgagttcacatacataggaaggttgaaatatccagaagaaaaaggtgaaagggaattggaaggaggattggtgccatcccttgaagaatttgagtcaagaagcaaggggccaaccaccttaagagctattggactaagaagcactccaaattga

SEQ ID NO: 73816 - DNA, 552 bp, Glycine max
  Peptide Sequence Number=SeqID_165501
atggggtgcatgttggggcagcaagacgattccgaaaagagagaacgggttgtctattacttgagcaaaaagttcattgcttgcgagatgaactactctctactgatggatccagtcaagtacatttttaagaaactcgctcttataggacgaatcgatggagacatcatggccttgttcggggagaaggtgaaggatgaggacagggataagtggatcgtgtggttcgacggcgcgtccaacgccttaggccatggggttggggtggctttggtctctcctgacaaccaatttgctaaagttgatgtctcgctaagcgagctctatgcgcttagcgagtttcatccgctaagtgaggcatcaacacgcttagcggataggaggaatctagaagggaatcagtcacgcaggcatgcgctcaatgcatcatcagcttgctcaccgagtcatttgtcaccttccaggcttagcgcgagtttggcgttgagcgaaaattcacttactctcgctaagcgcgagaatggcactaagcgcgatgtggggatcctctag

SEQ ID NO: 73817 - DNA, 631 bp, Glycine max
  Peptide Sequence Number=SeqID_165502
ttctgaggatcatccaccaaagcaatctagagtcagaggtcatttggtgaagattgatgctaacagtctcaacacattcttggagacacctgcggtattagctgaaggggagaccttatccgcttactccagatattgcaggttgcctacagactacagagagatagaggctgccgtgtggagtgtcctttcatactccaacttggcccccacatcacacacttctgacttgacagtggatagagctaggctgatctttggcctagtctctcgcttggatatgaacataggtgcattgatctctggccagatgacctctatagcccagtctaacacttctagacttaggttccctaccctaatcaccgcattatgtagagccagaggggttgtctctgatagcctcacttttgagcgcctgagcccggtcatcaacttgacctacatcaagaagaactattggaaccccgaggatctaacagtttctatccgaggggctaggagggtgagggcaaggccagttgagcttccttttacttctgcagctcctacttcggcatccacttctgtcccagttcagatagattctcaatgctttgaagccatgcttcagagcattcatcagggatag

SEQ ID NO: 73818 - DNA, 522 bp, Glycine max
  Peptide Sequence Number=SeqID_165503
atggacaaattgcttttcttaggaacacatattcgttaccacaaaaaggataatgatatcccttcaacacaacataggtcatcgaaaggatctcgaagacccaccaacgcacgaaagccgggatctttcagaaaatggattcctattcgaagggtgcataaccgcatggataagctcacactaacccgtcaatttgggatccaattcggttccttaggaggtatcgggaaggaattttggaatagtggcagtaagggtgacttatctgtcaacttttccactattacacccaaaaaaccaaactctgctttacgtaaagttgccagagtacgcttaacctctggatttgaaattactgcttatatacccggtattggccataatttacaagaacattctgtagtcttagtaagaggggggagggttaaagatttacccggtgtgagatatcacattgttcgaggaaccctagatgctgtcggagtaaaggatcgtcaacaagggcgttctagtgcgttgtag

SEQ ID NO: 73819 - DNA, 285 bp, Glycine max
  Peptide Sequence Number=SeqID_165504
ggtttaagaaatagaagaaaacgatggcacatcagaggcatcacagtagcgggcaacagacgcaccaccacagcctccagaatccatctcacctcatctacaaaggctagagcattgcctacgacccgtggccgaccaacaggcacccaaccaccggaacagcatttcgaggccatcaaaggatggttattcctcagacagagacatgggcagctgagggatgatgaatttccgcacttccttggaggaggcggagccatacaaccgggatcaccaaacttgtga

SEQ ID NO: 73820 - DNA, 258 bp, Glycine max
  Peptide Sequence Number=SeqID_165505
atgttggcgactcattctgggtatcaatcaatggccaagaagctagcgttgaattgcttcttcacctcttcttttatcttcagggacatctcgggcttcatcctcctcaacttttgctttaccggggaacactcgggatttagaggaccaagtgaagatttcttggtagtctttgaacagagctaccaattcatcttggacgttcgtggacatgcctatgccaaccttgacctcctttctttctttgccaacacctaa

SEQ ID NO: 73821 - DNA, 390 bp, Glycine max
  Peptide Sequence Number=SeqID_165506
atggacgtgtggggtgctaataccttccccatgcgtaaatacaactcccgaacctttcacttaaaagttcgtagatcgcgtcttttccggtttttccgacgtttttctcaaataaacgttggtggcgactccgcgcgtattcctttcatggaacacgcatcccgcgagtcacgcgtcgccctcccgccgaagggtaggttgcgacaaccagtgcatgagagagaagcagatcctcctacacacattatggagatgctagaagaccctaccatgccagtcctgagattgtcatccactcctctagctaccccagttttacatctgacagatgaggaggatatgcaggaccaggacacacagggcacacaagaccactcacaggaattctaa

SEQ ID NO: 73822 - DNA, 708 bp, Glycine max
  Peptide Sequence Number=SeqID_165507
atggcatccaggaaaagaaaaagcaccacttacaagcctcaagctcacccgaaagaccagagccctaagcaagtgagggtaagaggacatttaatcaagattgatgctaacagcctgaataccttcttagagaccccagtagttttggagaagggtgagacactgcctacctattccagatttacaaggatgaggattgatcctcaagagttttctggtcatctttgcatccctggtaggggttttgttctgaatgcagagggcaatccttggaagcttctgaggaaagatctcaccactcttgcacagacatggagtgtcctctcctacagcaacctgactcccacttccccacctctgatcttaatatggacaaagccagccctaatctcaggtcagatttctaccattgcccagagtaactcctctaggctcgaattcacaaccttgatcactgctctatgtggagctagaggagttacctctaacagtctgacctatgagagcctgatcctggccattaacttggcttacattaagaaaaattgttggaatgtggatgatctgacaattaacttcagaggggctaggaaggtaagggctcgaccagcagatattccttcttctttcgcaccaccaactcctcccacttctaccactcctacactagctgctcccacttctaccactcctacaccagctgcctag

SEQ ID NO: 73823 - DNA, 246 bp, Glycine max
  Peptide Sequence Number=SeqID_165508
atgtccaaccataagagtactgagttagccctaaaaaaccttgagattcatgtgggtcaactggccaagcagttagctgagaagtcatccaacaactttggggaaaataatgagaagaatcccaaagaagagtgtaaagtttttgtaacaagaagcaggaaacttgtggtggctgaggatgatgatgttgttgctttgaaggagcaagttgctttgaaggacactactgttaaaaagaagaataag

SEQ ID NO: 73824 - DNA, 966 bp, Glycine max
  Peptide Sequence Number=SeqID_165509
atggtcatctacccttttgtcgaagactcaatgtctttcgaccgagactattacagtctcttttcctttgtcatccagacacaattgagtctgatggcacgcagaggcaaatatggtcatctgcccttttttcggagactcaatgtttttcgatcaagactattacagtctcctttgccatccatagacaatcaagtccgatggcacgcagagacaaatatggtcatctacccttttgctagagacttaatgtctttcaaccgagactattacagtctcctttttcgtctgaagacaatcaagtctgatggcacgcagagacaaatatgttcatccgcccttttgttggagactcaatgtcttttgaccgagactattacagtctactttgtcgtccagagacaatcaagtccaatggcacgcagagacaaatatggtcatctgcctctttggtcagagactcaatgtctttcgaccaagactatcacagtctcctttgccatccaaagacaatcaagttcgatggcacgtagagacaaatatggtcatctgcccttttatcagagactcaatgtctttcaaccgagactattgcagtctccctttaccatccagagacaattgagtccgatggcatgcagagaccatcatggtccttcgcttttgttgtttcccgagactattttagtctcctttaccatccagagacaatcgagtccgatgattatttcaatcctctttgtcttccagagacaagcaagtccattggcatgcagagactatcaatgtcttctgctctttatctttttcaatgtctaccagagtcctttgtcgagacttcgatgtctcccttactttgtaagacttcaaggtcttttcttgatatacctgatgcctctcatgctctttcttttgacaggtttcgctgatcgagctagtggtcggttggctggcgcgatcgcttga

SEQ ID NO: 73825 - DNA, 252 bp, Glycine max
  Peptide Sequence Number=SeqID_165510
atgttggcgacgcattatgggtatcgagcgactgccaagaagccggcatcaaattgctttttcacctcttcttttatctttaaggacatctcgggtttcatccttcatagtttttgtttcaccggggaacaaccaggattcaaaggcaacctatgctgcacaatgtcggggttcaagccaggcatatcttggtatgaccaagtgatcaaggtcgtacccgaatcaaataaacatgaaaaatgcagtatctag

SEQ ID NO: 73826 - DNA, 117 bp, Glycine max
  Peptide Sequence Number=SeqID_165511
atgccctctatggaaatggctctgaagaagctcccggcgaagaggtctaggaagggcatcactgaagagggttccaatgtggtcccgcaagctgacacagacttcaacagacactga

SEQ ID NO: 73827 - DNA, 282 bp, Glycine max
  Peptide Sequence Number=SeqID_165512
atggagactcctcatgcctttgtcaaccagaggcaagtgagtcctttggtcgagactactttagtctcaccttcgtcatcgagagacggcaagttcaatgacatgcggagacccatcatggtcatccgctggcttcatcaaccagaggcaagcgagcccattgatcgagactactttagtctcaccttcatcatccagagacaacaagccgatgacacacggagaccaatcatggtcatctgccacctttgtcaaccagaggcaaacgagctagttgattga

SEQ ID NO: 73828 - DNA, 755 bp, Glycine max
  Peptide Sequence Number=SeqID_165513
atgccgatctccccctgcgaaagtatcggttggtatgtgccgtcacgacatagctctggttacgggcctctatcagtcctgcagggtgcccggatcacgcccgcaggacacccagtggacccaaagaagtccaacagggtcctggggtttccagctctaattacaagcctctgtcagttctacggagtgcccgtcacccccagcaaggtcatcaggcctcctactaaccgagctttcatcaagaagtattgtgcccccatgcaggcagaggacaacaaatgcacagccgccacctccagaccccctcagctcatccacaaaaaggtccgtgaccgacaagtcatcatgcgtcctgctcaagacgttaaagaagcgatactaggaggcaacctaacacaagagcctgaaagaccatctcttctaactcataatgcattgggcatcatggttcatttacagtcattaccatggtgccccatgcatgcatttaagaaggaagccaatgagttggccaaacatacttccaagtacaaagaattaaaggtcaaaaagcatgagtacaaagagcctaatgtggctacccaggatgtaccaacggttgattggggatacgagagtggagtcgatgggtttctattgaaatgtgtaaatatgactgctgctctacgggttatgagagaagtacatgaggggatatgcggctcccaaagattagggccaaagattttgcctagaatattagctgattgtgtgaa

SEQ ID NO: 73829 - DNA, 955 bp, Glycine max
  Peptide Sequence Number=SeqID_165514
atggaccatgtcgcactaagcgcgttcatccctgctgatgaacaaaagctaagcgccaatatgcttctgttagtcagtcctttgaataaggctaaacgcagctgctgcgctaagcccttgttgtgtgttgagaaggttgagctaagcgtgccctgcggcgctaagctcaactctctcactgtttttgagttcacttctcctaaggcctgggaaaggtatactaacattattgttcctaggaagctgctgctagagagaaatgtggtaatctacgacattgaatttcatgaattcaaggaagaattggagagaagaagatgggatgaagaattgaccagctttgaggaaggtagcattgatgttgccatagtaaaagaattctatgctaacctctatgatccagaggacaaatcaacaatgcaggtgagggtcagagagttggctgctaagctctgcatcccagggaggggatttgagcttaatgttgatggtcaacctctaaagatcctcaagaagaacatgaccacacttgctcatacttggagtgttctttcttactccaacttgatccccacctcccacacttctgacatcccactagaccggaccaagttgatttatggcattattatgaagatggacatgaatctgagctacctcatctcccaccagatttctatcattgcccaacatgactcctctaggctaggatttccagccttaatcacaactttgtgtaaatctagaggggtcactattcgattgctggcaagtgcaccagatcgtgcaaacacacttgctcatcctgaaggtgaagacggtgcgcttggcaagttggctttcgctcaacacctctatacaactcatccttcttctagaattgtccatgcacttagccatcagatggggtgcttagcggatgatgcacttagccagaagatgagtggcttcgcga

SEQ ID NO: 73830 - DNA, 195 bp, Glycine max
  Peptide Sequence Number=SeqID_165515
atggtgtgcaaaggttggagttttgatggagcttcaatggtgaggaagaagaaaggaatagcaacaaatttccaggatgtcacacttagtgagcggatctcgcgcttagcatgcagcctagatattgatgctctactagattcttctgcctcgctaagcacgctgaagctgcgcttagcgatggatgcacgctga

SEQ ID NO: 73831 - DNA, 312 bp, Glycine max
  Peptide Sequence Number=SeqID_165516
atggtcgagggtgggtggatatataaagagaggccttttcttttttctcacaactctttctttctttctttctttctttctttctttttttctcctagagctccttcttcctcttctccttcttcctcaactcttccttctcagggagccctttcaagcttggagcttgagctcttcatggttgatgattacatttcctttctccttttgagcttcaatggaaggaaatcccttggatggagcttaggatcctgttattctattttcttcttcgaaaaacctagctcattcttgttggtaatggaaggttga

SEQ ID NO: 73832 - DNA, 162 bp, Glycine max
  Peptide Sequence Number=SeqID_165517
atgtgttggtggggattgggcgggaggttgtttgcatttggagcacatgaggatcctgcaacaaccttctcatcatcatcgttgtcctcatcccggctgcaaatccttccttcttctgaaactggcttaggcattcgattaccaaatgagacaattgattaa

SEQ ID NO: 73833 - DNA, 363 bp, Glycine max
  Peptide Sequence Number=SeqID_165518
atgggagcctctggtaatcgattaccagcctgtgtaatcgattacacagaggaatgggtcactgatgaacctgcacggacgcttcagcgcactgtggagtggatactacccacgcctacaccatatcgtctagtggagcccgctcaagtgatcgaggtaacgtcatccgaggaagaccctgaggaggacctggaggagctacctcctgagcctgctgtggatgcccttgactttctagagggtgatgaggatccacttcttgaggtggattctcccgaggaagtcatgtcggcatctgaggcagactctacggaggatagcggcccaagggagatggcgatcagcggaggctcttcatcctag

SEQ ID NO: 73834 - DNA, 369 bp, Glycine max
  Peptide Sequence Number=SeqID_165519
atgaattctttcatactgcaaggtgcaaaagtgcaaaggaaatacggaaaatgcttgaagtcagtcatgaaggcacaatggataacttgggaaccaaagataacagtgatcaaggaatccaaggacttgacatcaatgtcgatggaagctctctttggaaaattgcttgcatatgaacacgagttgattcaacaatctcgtgcagaagaaacagaaaagaaaagaaaaggaattgcactcaaagaaaactcttcaaaggaagattacaaagaaaattctagtgatggtgaagatgcagagaattttagcttaatggtagagaagtttggaaaatttctcaaaaagtcctacaaagaagatagaaaataa

SEQ ID NO: 73835 - DNA, 267 bp, Glycine max
  Peptide Sequence Number=SeqID_165520
atggaggccatgaaagagaaaatgattacaatgatggaagccatgatgagtatgagaaaaatgatggaggttaacatggctacaatcgttgctgcaagtactgccactaaggtggacccgactcacccatctggcctcaatcatattaagcattccttcccaccatatggcttgcctcccaaccatacgccacccaatgttgcacacactacggatgagattgtcgataactctgctcccatacctattgagagccaacatccctaa

SEQ ID NO: 73836 - DNA, 1062 bp, Glycine max
  Peptide Sequence Number=SeqID_165521
atgattagaaccagaggattgtgtcaggctttagttgttgttgaggatgttgagcatgaggatcatgctgttgacaaggttcatgaggagcctaaggagacagttacggatcatgtaggtattgatataaagggtttttcaggcgggccctatgatacatcagtgttggcgtcatacgttgatcatgtgacaaccaaagtttgggcaggagaggaacgtactgagttgaagttaggcctctcatgggaggaaggtgatagaggaattttatctacttttgtggagaggtggcacaaggaaactagtagtttccatctaccgatagaagagctgactataaccctcgatgatgtgttatccttattacatctgcccattacaggtgtcttccatacctttgatgctattgatgtagaggaagttgttgacttcaaatgtgacgcaagacagtggatcatagcagctcaagcatatttattgcttctagtaggttgcacactctttgctaacaagagtgccacacacatcagtgtggcattcttggacgcatttcatgacctcaaccaatatggaggctattcatggggagcggtttccttggtccatatgtatgagaatatgaatgttgcatccaagcatacaacaaaacatcttgcaggatatatcactatattacaaatctatggacatttccctaaaattgtgtccattattgctgatgaggattaccatgagaggaaaccacatgcttgttgctggaagtctgggaaggcattaccagtgacgacctatcataagcgcttggataggttgacactagatgctgtgtgttggatatcatatggtgaccatcgtgcattcagagaatttgagctcgtttcattattttctgaacatatcagatgggtcagtgtcgtaggcccttgccaaaagatagcagaaagtttggaacacatgatcaacataaggatagtcactgctggaactgatgcatacactttcactgagcactgtctaagactagccaggagtgtcactgaccaaggaaatgtttatgtttga

SEQ ID NO: 73837 - DNA, 1243 bp, Glycine max
  Peptide Sequence Number=SeqID_165522
atgccggcaatcgaagacgaagagctgcttacctcaacaatgtcgacatggagggagaacaccaccctcaaaatgcctgggctactcaacaccaatgagcaccacgatcgtagaacacagactcccggtgcggaggaagaagacgacgctcacggcgggaacgcggcgcggaggaccgagggatccaattccagcttcctctttcccatggaattgaaaaagggcaagcttgccaggttctacacggatggtaaaaagcataagcaatcgttttggggagcaagagcaactgagcctccagcacttaaacctagcaatttgctaccactagggaaaaatagaattgctgaaacatttagaattggaggatcgaaggtgttcccggaggaccatgagccgtggcgtaaaagaatacttgacccgggtagcgatattgtgttgaaatggaaccgggtcttcatagtttcatgcctggtggctctttttgttgatccattgtacttttatttgcctagtgtaatagaaaacacagggacggcatatgtggcaccaagctcacgggtatttggcaggggtgaacttgtcatggacccaaagaagattgcaaggagatatataagatctgatttcttcattgattttattgccacactccctctacctcagcttttcttcttggcttccgcttctaacaaccctcctccgccgccgccggtgaccactgaagttgcggtgcataatgagacaccggtgaatgtagatgctgctacattggttgagcttgtgatcaaagtccatcgtcttcactatctcctcacaaatccacaaattcctccgcgatatgcttctttggcagatcgcaatactggaaatgtctcttctgagtttttgctttgggaacaacaggctcaacttctgtcgtggcttcaatccacgatttcaggtgaagttctccctcatctcatcgtctcaactgagcatgttgataacattcttgatggactacccgatgagtttgagtctctggtcacgctcatcagttgtagatttgagtctctcacaattgatgaagtcgaaactctccttgctcctaatgttgctcaggctaacactgattcaacctactacaactacaatggaggtaatcgtttccctaacaatggtcgtggaggtggtcacaatttctctcccggtggccgcggtgatagtcgtggctatggtgatggctgtgggggttgtggtg

SEQ ID NO: 73838 - DNA, 2454 bp, Glycine max
  Peptide Sequence Number=SeqID_165523
atgtcgaaatcttctccctgcacctactgcggcgaagcctccttcatccatgatgatatttccagtgagttaatctgctcctcgtgcggcggcgtccagcagttcgaccaattcgatggtcctcaaggaaccttcatccatattgcgcctagcagcgacgtgagaagcatgatatccaccatcaccgagggcgagttcggacaaggcgagtggtttaaagtgctcattggtgcatgcatttatgtcgttatgcgaaaagaggatcgacctttgcctatggcggaagtcgcctccacgatagggattgatgtttacgaaatcagtagaatgattttacgcgttgttgattttttgaatctgaggcctgattttcctgagtttgatatagttcatttgttggaacgaatgattaggaattgtagcggttgtgcctctgctgagaggaatttgattgagaggatgaggaagcaggggatgtttttgattcagtgtgcggtgaagtggtatctgagcatcgagtggaggccggtgccgttggtggtggcggtgttggtttttatggtggagttgaatggggttggggtggggatggaagaattagctaaagaggttcatgctagggtttcaacttgtagggctaggtataaggagttacttgagactcttgtgaagggtgcacaggtgttgccttgggggaaggatgttactgtgaagaacattattaagaatgcgctggttgggattcagtatatggagaggaatgctatgttgaagcatggggagaagagggaggagggtcttgatcaggctacggtggatttgaaggatgtggttgttgaatgcttgagaaatgatggtgaatttgaatacggggttgatggcatgtctaaaaggaaggattcacggtattttatgttggagagtaatgctggtagagtgggtggtggggattcagagaggcagcaaatttcgcttgaatgcttgtcagtgttgtataagaagtttttggatgaaaataattgtgcagagtctctgagagggagtgggaaggggaaatctgaaatgagcaagaagcttctgcttaaatatttactggagaaggatgttgaagtggataccatgtcgccatcgtttgtcaatggtcaattgaaatgtaaaatgaggcgggagaggatcaatgcttctatggtgcggataaaaagaattatgcatcagtcaaatgctgatctagctgatgctgagattcctggcactttagatggctcttatcctgaaagtagaaggaagaaaagaaaaggaatggtagttgatgatgttgattgggaagacttaattattgaaacccttgttcttcatcaagcattatgtgagaagtttcaaatatactatccattgacattcttgtcccaacttcttggtgccaagaaaaagaatcttgttgggttctccatagcaacatctcaatttcgtgtagcacgagtagattctatacgcggggatccatctggaaaaattggaagggctttcaaggaagagatccacaaaaaattgagaagtgttcctgattctaagcctaaaaagaagagaggtggttttcctctttggaagaagaaggaaaggtatgcaataacagacatgaggaagttagccaataggatgcaatttggagtcccagaagagagttcattaggtaaagagaaaaaagagtgtaggaatcaaactaatgtcgatgctattatgttggaaattgatggaactcctaacaaatcaaaactaggggctaatgcaatattgggagtttcgttgagtgtatgtagagctggtgcaggggcaaagggactgcccttgtacaggcacatccaggagatttcaataacaaaagaacttgttatgccagttccagctttcaatgttataaatgggggcaatcatgttgggaataatatggctatgcaagagactttagaatcagatcagttcccactgttgaatgaccctaacaaagcatgcatctacgtgatcaagtctgggaacctcctttacaacaaagagaagaacaagatgaaagactgcaaaaacacaagtggtgaggatgtctccttcacctctaggatctcacaatcactcacaaactcatctcaagctctcataacagcttccgcttcgaactcgcatctttgcagatcttcacatagcaaaatctctcagaactctctggaacttggacctttctctctcttgaacttcctaaacattcaaaagcttcaagccaaggccagactctcgtgcatgcagaggcttcttcaagaaaaatgccaaactccctttgcaaatctgatttcaagcttaaataggtggccttctgaagcggtgtgcttgatgacctggagcggtgcgctcagcgaacctgacagctcatcttcttctggattcttcctcgcgcttagccactga

SEQ ID NO: 73839 - DNA, 1143 bp, Glycine max
  Peptide Sequence Number=SeqID_165524
atggatggcaaatccaagcgggagatacactacacaatcagcttacaatggatgaggaagatagcagttgaggggattcaagatcaggctttcgaggagctgtggaaattgaaggagctgcccattttgtacaaacatggaagaggaggcaggacatatgttcttccactgcagaaaagtcatacctatctggtgggaaacactatcctgggtgaagaattctacagctctgtcggtactagggctaatagatggaagtgttggtggctggcagtgacttggacaatttggcagcaaaggaacaagatgatattctcaaatgaatcttttgacaacaacaaagttatggaagacgcaacttttctgttgtggacatggttgaggtacttggagaaagatttttctatgcacttcaatcaatggactagtaatcttagagcaaaatatggacaagatgcatgtaatgttggagatgaaggaggatttgctcccagtgttcaagataacagggaggggtttgttttactcgtggatgccattgagaaggctggttatactggcaagattaaaattggtatggatgttgcagcttcagagttttacactaaggatgggaagtatgatttgaacttcatgaaacagccaaatgatggagctcatgttcactctactcagagtcttggtcaactatataaaaattatgttaaagaatttcccattgtgtcaattaaggatccgtttgatcaagatgattggggttcatgggcttcattgcttgcttcagttgatattcaacttgtagatgatttgttagttacaaatcctaagagaatagctgaggccatcaaaaagaaagcttgcaatggtttgcttctaaaggttaaccagattggtacagtgaccgaatctattcaggctgcacttgactcaaaggctgcaggttggggtgtagtggttagtcatcggagtggcgagactgaggataacttcattgctgatctctctgttggcttggccagtggacagacaaagactggtgctccttgccgaagtgagcgattggcaaagtataatcagcttcttcggattgaagaggaacttggaagtgtgcaatatgctggtgaaactttcagatcaccttag

SEQ ID NO: 73840 - DNA, 906 bp, Glycine max
  Peptide Sequence Number=SeqID_165525
atgattgcaaaactgaaaggatgttttgaagagttgatttgtgggaatttggcatgttgctggattctgatgtcactgattttgagcaattattcaatgaatatagagaaatatgatagtggtcaattgttgtcagacactattcaacctgctgatgttggccttaaagaagaaattgcagacgatgatcgagggcatggattttttggcgctaatgcacttagtagattagctcgatgggctcaaccaataacttatgtagacattcatgaatgtgatagttttacggtgagcttcaccatttattacacaccagtgacaccactactgcctctgcactgctgcaagcttcatgtctatgctcgtgtatgtttattgaagtatgtttcattcttgtcttctgagtactggtatcagatgtgtatattttgtttccctacttcttcagttattcctctccatgaccatcctgggatgactgtatttagcaaacttctctatggctctttacatgtgaaagcttatgactgggttgagcctccctgcatcatagaaagcaaagaaccaggatatgctcaagtaagactagcaaagttagcagttgataaggtcttgaatgcaccgtgtgatacatcagttttatatcccaaacacggtggaaatctgcactgtttcacagcagtgacaccttgtgccatgctagacattctcacacctccttacagagaagaggaaggaaggaggtgtacatactatcatgattatccttattcagcattctcagttgcaaatgcacctatatgtgacggggaagaggaggaatatgcatggctcacagagttagaatcacctagtgatctttatatgcgccagggggtatatgctggtccagctattcagctttag

SEQ ID NO: 73841 - DNA, 186 bp, Glycine max
  Peptide Sequence Number=SeqID_165526
atggtgaatatcgacactaaagtggaatttgggacaaaagcacaaactgagcagaacaaccctacccaacttacattgtgttgtagtaagcttagcaatgccactattactagtgtggctatgaaccttaccagaatagcgaggttgtctaatgattcactaagtcatccttactcgaaaacatag

SEQ ID NO: 73842 - DNA, 279 bp, Glycine max
  Peptide Sequence Number=SeqID_165527
ggatcgtgcctgcaagacacccagtggacccgaagaagtccaacatggtcttggagttgtcaagctctaattacgggtctctgtcagttctacggagtgtctgtcacctccaacaaggtcatcaggccccctactaaccgagctttcatcaagaagtactgcgtccccaggcaggtgcaggacaaaacaccacagcagcctagggatggccggcagcgggcaacagacgcaccgccatcacctctagagttcacctcagctcatccagaaaaaggttag

SEQ ID NO: 73843 - DNA, 432 bp, Glycine max
  Peptide Sequence Number=SeqID_165528
atggtagcgcagttaatccatgatcgcgtggtgatggagtgcctagagggagtttgggagaccctcgaaggcaacgagaggtgccgattccatggcacaattcgactcactgctacttcattagtgcatcctgaggaacccgcacgcacacttcagcagcctgtggagtggatactacctacacctactccatatcgactagttgagccggttcaagtgatagaggtgtcatcctctgaagaagatcttgaagaggacccagaggagttacctcctaaacctgctgtggatgctcctgacttcccagaggatgatgaggacccactcactgatgttgattctccagaggatgttatgtcagcatctgaggcagactctacggaggagagtggccctggagggacagcgaatagtgacgactcttcagcatag

SEQ ID NO: 73844 - DNA, 147 bp, Glycine max
  Peptide Sequence Number=SeqID_165529
atggaggcttcaatcccttctcctctctctaacgcttggaaatcctatcagaacaatgagaggaaaagcttgaggaatcttaggaaactttttgagatgccgctatcgcttttagaatatacatgggttcttaaaggatcaaattga

SEQ ID NO: 73845 - DNA, 159 bp, Glycine max
  Peptide Sequence Number=SeqID_165530
atgttctataaatcttctcattaccccgaccttcacttcgcaattagggttctctggtcctcccgcccccggtgctggcattctcaagccagtgaaatcggtgcgagtgtcttcgcctctgagagagatactatgagatctcaagcctcggaggcgtag

SEQ ID NO: 73846 - DNA, 105 bp, Glycine max
  Peptide Sequence Number=SeqID_165531
atggctgcaccgtttttctcaacgccctttcagccttatgtttatcagaaaaagatatctaatagccggatcaaactggaccaggcaagctgggctagagcttga

SEQ ID NO: 73847 - DNA, 816 bp, Glycine max
  Peptide Sequence Number=SeqID_165532
atgatccattcatcatggcagtgcaagctagacaggtgttttatgtccaagatccatgactcaagatggtcagtggttctacaagggagaacaacttgtatcgatgacctgattgatggttcaacacttgatgtcaacgagatgtcggctttctgtgaacaaatgcctttcataaatggggaagatcaggaggatgatgtacatgcaaatcgtaatgatcatgatgaaggtttatgggagaatattcgtatactcatggcaacacccaaaaggtcccctccacatccttcagaggctatgtctaggaagactagacaatcgtccaggctgagaaggttgattgtccgaagtttggatcagccacagccaatgattaacgtcaatcctaccactgggagaggatcaggcccccataaagaaaagttccatagttatttaggggttctagcgcgagaaaaaattcctattctccactccaattggaatgatgtaccagaatctttaaagaacctaggaaattttgacatccttgaaggtgacaatgctaaaaagaaggtgatgtcaacggtcgctactagatggaggaaatttaagtcctccttaacgacaaaatatgtttatgttgacaatgacgatcaacagaaagatgatccttttgttaagtatgttattgatgcagcaacatgggcagaatttgctaaaagccaccaaacccctaactggcagacatgtgaagtggaagatggcccacacaaagcgatatgggcagatgacctctacaacagcccaagaaatatcagacaacattgtgagtaa

SEQ ID NO: 73848 - DNA, 93 bp, Glycine max
  Peptide Sequence Number=SeqID_165533
atggcatttggtggacctgtagctcgcccaagcgagttgagacttagccatgaagtaattggctcgcccaggtgggccagaggctctggctag

SEQ ID NO: 73849 - DNA, 565 bp, Glycine max
  Peptide Sequence Number=SeqID_165534
atggagaggagtatgattgatgctgccagtggtggagctcttggtgatatgacccctgctgaggctaggaatttgattaagaagatggcttccaactcccaacaatttagtgcaagaaatgatgctattgttcttagaggagtccatgaggtggccttggattcatcttcatctactgaaaataaaaagcttgaaggaaaacttgatgccttggtcaacctagtaactcagcttgccatgaatcagaaatctacacctgctgtaacagtcagtggtctatgttcttctgcagatcaccattcagatctttgtccttctttgcagcaatctgaagtcaatgagcaacctgaagcttatgctacaaacattaataatagacttcctcagcagcaaaaccaacaacagcagaatcattatgacctttcaagcaatagatacaatccgggttggaggaatcatccaaatctgagatggacaagtcctccccaacaacaacaatctatacctcctttccagggcgctgctggtcctagcaagccatatgttcctcctccaatgcagcaat

SEQ ID NO: 73850 - DNA, 534 bp, Glycine max
  Peptide Sequence Number=SeqID_165535
atgggagaagcccgtgaagagccctgggatcacgctttgggcgattttgaactataccctacatatgccgttgagggaccagcgtttggtggcattcctcagcccaatgtcgtgggagcccctcaacaccacccgctgcaacctttgcatttctcaatagggagactacctccgaccatggaagaaagagacaagtttgatctcatagaggaaaggctgaaggtcattgaggggatcggtgattatccacttgccgacatggcagagctatgcttagtgcccaatgtcatcatccctaccaatattccccgcatcaaccaaattactcagccaacgtcggaaaccctcccaattcggcacctgtgtccaataaagattgcccactcaaccacaaaggcctcccccacaaaattcgtttcccacacagtctcaacccaccagaaactccaatcccaacacaaacacaaacccgaggaggaatttcccggaaagaaagcccttggagttcactctgataccaatgccttatgttga

SEQ ID NO: 73851 - DNA, 534 bp, Glycine max
  Peptide Sequence Number=SeqID_165536
atgacgttgctacttagcaacattccactcggcgaccgcaatgccgatctccccctgcggaaacatcagttggatcacacccgcaagacacccagtggacctggagaagtccaacagggccctggggtttccagctctagttacgggcctctgtcagtcctacagggtgcccgttccccccagcaaggtcacgccatcctaggggtagcgcctacaagacacctagtggacccgaaggagcccaacagggccctggggtttccagctctggttacgggtctctgccagacctacagggctcctgtccccccagcaagttcatcccatcgtgacatagggaccgcgcctgcaagacaccctgtggacctgaagaagtccaacagggtcctagggtttctagctctgattacgggcctttttcagttctacgaagcgcccgtcgcccccaacaaggtcattaggccccccattaaccgagctttcatcaagaagtactgcgcccccaggcaggcgcagggcgagacaccacaatag

SEQ ID NO: 73852 - DNA, 501 bp, Glycine max
  Peptide Sequence Number=SeqID_165537
atgcttcaaagcatacatcaggggcagattatattactacaaagcctacagttggtagcgcctccagactccatcccaatggtagagcaatttattgaatgggtagcctggccagggactcagcctcctcttcatagggaacacgaagaccctgctactcaggtaccccatcagtcggaggatgagtcatcagattcttccactcctgagcccttgatcaggaaaaggagggtagttgtaacccatgaagctgcatccacctttgaaaagtctcttgaagcttctccagagcttccggcactagtggcagataccacttctccacagcaggcagcagaaccttccacgcctaaggatcaaaccactccagtcctgtctccgaacacctctcctgtagctactcctgtacttcatttgttggaagaggaggagggtcagacctggaccagttgtcccacctggacctcaaggtttttcaatgctgacttagtgcttttatga

SEQ ID NO: 73853 - DNA, 471 bp, Glycine max
  Peptide Sequence Number=SeqID_165538
atgtcattgcctagcgctgttcatgtgtcctccattatcaagcgcagagcctctgcaaaaaaagaaggagtagagacgagagtcgtcgtcacggaaagggcaggacggacggaatcaatgtcttatcttttctttcctcttatctccgatgagagaaaatccaagccgagacgcttccgtaacgtttccgtgagcctcgccttcgctcgcccagtggagtcgccaactgtcacaacgtgcccttttgcgggcgagcgaaggcgagggtcacgggtgcactttccagaggaggaaaggtgcgcagagtcgccaccaacatttatttgtggaaaacgtcggaaaaaccgaaggaaaccggtcaaaatgaaaattctaagttcgggagttgtatttacgtttgaggaaggtcgacaaaagcggggcttttgctcctacgtactctccatcgaagaggaaatcagacctacgtag

SEQ ID NO: 73854 - DNA, 786 bp, Glycine max
  Peptide Sequence Number=SeqID_165539
atgtgcccggtggtcggttttggcccgtggctaggtcttggcaagccgttggttgaaattttgccccccggtcaacttcgtggtttttgcccgttgttggcttggctagggtcggcggtgctgggttatggccccgtgctaagtttcggattggttggccccctcctcccccccgtgatcagttttgttgccaggattttgccaactttggcttgcgccccgttggctaagtctgtgcctcgggtggtgggatcatcatgtcataacatggcaagacacaaggtcacacgcacacacacacacacacactcacgcaggcacaagggggaggagggggcttggtcgtccgtccgcccgggcacacacctagttagcaccaggcaggcaaaacgagagagagccgacgaacggggagggacgaatcaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattgtgcgaatcaacggttcctctcgtactag

SEQ ID NO: 73855 - DNA, 435 bp, Glycine max
  Peptide Sequence Number=SeqID_165540
ggacaccatgatttattaatctgcgaagtgatctccgtcacaggtatttattcggagcaaagtgcgtcggctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttggtcgggaaacctgtcgtgccagctgcattaatgaatcggccaacgcgcggggagaggcgtgttgcgtattgtgcgctagcggagtgtatactgtcttactatgttggcactgatgatggtgtcagtgaagtgcttcttgtggcacgagaatactag

SEQ ID NO: 73856 - DNA, 177 bp, Glycine max
  Peptide Sequence Number=SeqID_165541
atggaaaaatctgacaagaggaatttcaaagaaaagaaaacatacattacttgggaagataatgacatggattcttcaagtgattcagaaaatgaaatcataaatctgggtctcatggcgaaagatgactatgaaagaagagaaaagataaaaatcaatgttttacaaaatgcttaa

SEQ ID NO: 73857 - DNA, 309 bp, Glycine max
  Peptide Sequence Number=SeqID_165542
atgttcaagatagaatcaagaacacttcaaggttcaagaggaaagttgaagaacacttcaagattcaagaggaaagttgaattcaagaatcaagaatcaagaatcaagattcaaggatcaagcttcaagaatcaagatcaggattcaagactcaagattcaagaatcaagagaagacttaatcaagataagtatgaaaaggatttttcaaaaagtgagtagcacatggatttttctcaaaacatgtttaccaaagagtttttactctctggtaatcgattaccagattattgtaatcgattaccagtag

SEQ ID NO: 73858 - DNA, 330 bp, Glycine max
  Peptide Sequence Number=SeqID_165543
atggaagagaattccgaatcagctttgtctacgaacaaggaagctataagtaatgcaactaggaatctcatggagagttcgatcctggctcaggatgaacgctggcggcatgccttacacatgcaagtcggacgggaagtggtgtttccagtggcggacggctggtccgagaggatgatcagccacactgggactgagacacggcccagactcctacggaggcagcagtggggaattttccgcaatgggcgaaagcctgacggagcaatgccgcgtgaaggtagaaggcctacgggtcatgaacttcttttcccggagaagaagcaatga

SEQ ID NO: 73859 - DNA, 470 bp, Glycine max
  Peptide Sequence Number=SeqID_165544
gttgcccgaagggctatctgatccgatcaactgcgtaagccgtagcgcgctagcgcgcgtactcttcctctatgagcgagactccatccaaatctgccactcgttgggcgacgccctcttttctatgaacaccccaccactgaatgatgaactttgccagtcttcgcctccgacccgaccaggagagaacacagagtcaagccaagcccttacccgccagaatggaattcatatctccttcgtctgccaaccccaaaacgcaagaatcaaggggagcggaaagaagcactggctaagactttcaaggagatggggcatacagggcaactctcgggcattgattgaggaagtagcccaaccttttttcatctacgcaaagaggaattacttcttattttattcgaccggaaatggtgcatctagatcgattcctaaggctggtaatgccgaatcaaggataaggcaataca

SEQ ID NO: 73860 - DNA, 465 bp, Glycine max
  Peptide Sequence Number=SeqID_165545
atggcatcaagaaaaagggcaagaaccgatgacattccttcatcatccaacccagctcctccgacaccagccatggaactagatgtccaacactcacatactgggcaattgacgatcatgtataaccagcaggagttggctcacaataggccaatcatatctatggagcattttcttgaaaaagtggcctggcctgaagctcagcttccattggagaaattccatgaggttgttcctcctgagcccgcaccagcaaggactgagccgataccagctgaaccacaacctccagtagtggatgcacctccttctcttgagcttgaaatattatctcctccaccagctccagctccacctttgataatcatctctgatttatcatctgatgaagatgctgcccctcttgattcaccatcttgcaacatagatgatggttctgacttttctgattggatgaactgctga

SEQ ID NO: 73861 - DNA, 213 bp, Glycine max
  Peptide Sequence Number=SeqID_165546
atggtgtattatgtagatgatgtagttaatgaaggatggagtgttgttgtacacataaagccaagagatttatatgacatgggagaagaagtagaagaaaatgcatatgaaaatgagccataccaagagcaacaacttgaacaattttctaggcttgatgatcaatatgtacaattggctacaaaccatctaaatgatgatatagttgattga

SEQ ID NO: 73862 - DNA, 309 bp, Glycine max
  Peptide Sequence Number=SeqID_165547
atggcgaggacgtgtagtcctctaaaggtgaggacgtgtagtcctctgaaggtgagggcatgtagccctacaaaggtgaaggcacatgaccctttgacggcgaggacgtgtagtcctctgaagttgaaggtgagggcgtgtagccctctcaaggcgaggacttatagtcctctggaggtgagggcgtgcagccctctggtggtgaggacgtgtagtcctctcaaggcgaggacgtgtagtcctctcaaggcgaggacgtgtagtcctctgacggtgagggtaactagtacccaaggtgagggcgtgtag

SEQ ID NO: 73863 - DNA, 195 bp, Glycine max
  Peptide Sequence Number=SeqID_165548
atgctttcttttgactttcggcatgtcacggaacttcatgaattgcctaacgatgggtgccaagcattggaccttaaaacggttttgtcataccctaatttcgttcggggaccattgtttggtggcgtgcgactttcgtttgaccacttcgaggtactttgcacccattgttgcacaatacgtgaagtttcgtaa

SEQ ID NO: 73864 - DNA, 288 bp, Glycine max
  Peptide Sequence Number=SeqID_165549
atgccatttactgtttacagggatcgcgcccgcaagacacccagtggactcgaagaagtccaacaaggccctagggttctagctctgattacgggcctctgttggttctacggagtgaccaccactccgatctccccctgccgaagtgtcagctactctgattacgagcctccgtcaattctacggagtgctcgtcgcccccagcagggtcatcaggcccctattaacagggctttcatcgagaagtattgtgccccctggcaggcgcagggcgaggcatcacagtag

SEQ ID NO: 73865 - DNA, 461 bp, Glycine max
  Peptide Sequence Number=SeqID_165550
accccgtagaaagatcaaaggatcttcttgagatccttttttctgcgcgtaatctgctgcttgcaaacaaaaaaaccaccgctaccagcggtggtttgtttgccggatcaagagctaccaactctttttccgaaggccaccacttcaagaactctgtagcaccgcctacatacctcgctctgctaatcctgttaccagtggctgctgccagtggcgataagtcgtgtcttaccggcgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagtga

SEQ ID NO: 73866 - DNA, 285 bp, Glycine max
  Peptide Sequence Number=SeqID_165551
atgaaggtagatgacagagagaaggaagacatacaagatgaggacgtgatagttgaagaaatagcacgagagccaattaagacaaagagccaacttatacaagaagctaaacaagcaattatacgtgagaagttgtatcctcacaaaccaacaaagcaagacaaggaacggtttttgatgatgccaaagtataataaaacaagattgcttcaagaaatattcaaggttaagcaaacagagattgcttcaagattaattcaaggtcaagcgaacaagatcaagtaa

SEQ ID NO: 73867 - DNA, 533 bp, Glycine max
  Peptide Sequence Number=SeqID_165552
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccaggttaggccaccacttcaagaactctgtagcaccgcctacatacctcgctctgctaatcctgttaccagtggctgctgccagtggcgataagtcgtgtcttaccggcgccacgcttcccgaagggagaaaggcggacaggtatccggtaagcggcagggtcggaacaggagagcgcacgagggagcttccagggggaaacgcctggggggcggagcctatggaaaacgccagcaacgcggcctttttacggttcctggccttttgctggccttttgctcacat

SEQ ID NO: 73868 - DNA, 150 bp, Glycine max
  Peptide Sequence Number=SeqID_165553
atgtcattatcacttgaggacaagttaattatgcaagttttggaaaagcgagcatccgctaagcgcaacactcctgagctaagcgcgaggaagaatccagaagaagatgagttgtacaagttcgctaagcacaccgcttcatctctctaa

SEQ ID NO: 73869 - DNA, 414 bp, Glycine max
  Peptide Sequence Number=SeqID_165554
atgggagtagtagatgcactagtggctcgctcggcaggtaacaagttgatgagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 73870 - DNA, 1132 bp, Glycine max
  Peptide Sequence Number=SeqID_165555
atggctggcaacactggccggccgaatggcagcagtgccacagtgcaacagtgctggcgtttcgcattgagcacagcgacgagtgtgcgtttctacatgtggctgcagtggctggcggcagagcaattcgccgcctgctggcagctgtgtcagcagcagcagatggcgatcgggctgtatcgcgacttggcggtgggcgtggcggcggatatggacgaaagcgcggcgcacggtgcctatgtgcactatccggtggatgatttgctggcgattctggcactggagagccagcgccatcgttgcatggtgattggcgaggatctgggcaccgtgccggaagccatcgttgataaactgcgcgacgccggtgtgtactcctacaaagtgctctactttgagcaggaatcgcagcgccacttccgcgcgccagcgacgtggccgcgtcaggcgatggccgttaccaccacccatgatatgccgacgctgcgcggctggtggcaaagtgacgatttgcggctgggcagtgcgctggggctgtaccccgatcgggcgattctcgctggcctgtatcgcgatcggcgcctggctaaacaggcgttgctgcgtacgctgttgcgcagcggtgatctgccgccgcgccgccgcttccggcgggccagcgtgcgcatgagtcatcagcttagtcaggcgatccatcgctatctggcccgcagccagtgtgcgctgctcggtttgcagccggaagagtggctggatatggcactgccggtcaacgtgccgggcaccgtcgatcagtatcccaactggcgacgtaaactcagcgtaacgctggaagcgatagcggaggatgacagaatcgatgcgttgctgacggcggtggggcaactcagcactgtcggggcagtttcaccccttgcctttaacactgctgataaaggtttgccgcgccgatgtcgatcccagacgctccgcttcatccagcagcttcagcgctttatcgatattgccctgttgcaccgcctgacgaatgctctgattgaaatagctttccgtctcatttaccagtggtgccggttcaggcgctggcgcgcgcgccgtcgtggcggccatggccggccgggtgctgccaacg

SEQ ID NO: 73871 - DNA, 1091 bp, Glycine max
  Peptide Sequence Number=SeqID_165556
atgaaaaccggcgcacgcgttctggccctttccgcccttacggccgtactgttttcggcttcggccgtggccaaaattgaagaaggtaaactggtcatctggatcaacggtgataagggctataacggcctcgccgaggtaggcaaaaaattcaagcaggacaccggtatcagcgtaacggttgaacatcctgacaaaatggaagagaaatacccgcaggttgccgccaccggtgacggtccggacattatcttctgggcgcacgatcgctttggcggctatgcccagtcagggctgctggccgaagtcacgccggatcaaaacttccagcaaaaactgtttccgtttacctgggatgcggtgcgcttcaacggcaagctgattggctatccggtgtctgtggagtcgctgtcgctgatttacaacaaagatctgctgcccaccccaccgaaaagctgggaagagatggcggcgctggataagcagctgcgcgccaaaggcaagagcgccatcatgtttaacctgcaggaaccctatttcacctggccgctgctggccgccggtggcgcctatgctttcaaaaagaccgatagcggctatgacgtgaaagataccggcgtcgacaacgccggcgcgaaagcaggcatgcagttcctcgtcgatcaggtgaaagccaaaatccttaatgccgatactgactattcgattgccgaagcggccttcaataaaggacaaaccgcgatgaccatcaacggtccgtgggcgtggagcaatatcgataaaagcggcatcaactacggcgttacgctgttaccgacgctgaacggcaagccgaccaaaacctttgtcggcgtactgagcgcgggcatcaacgcggccagtcctaataaagagctggccaaagagtttctggaaaattacctgctgactgacgccggtctcaacgcggttaacaaggacaagccgctgggcgcggtcaccctgaagtcattccagcaaacgctggagaaagacgcgcgcatcgccgccaccatgagcaatgcgcgtaatggcgacatcatgcctaacatcccgcagatggcggccttctg

SEQ ID NO: 73872 - DNA, 498 bp, Glycine max
  Peptide Sequence Number=SeqID_165557
atggtggcgaataactggctaggcatgccgtgctggcagccgccgtttggcgagattgttgcgctcgatatgcacaccggtgatgtgaaatggcgtcgaccggtcggcgcgtcgcagcagtacggcttcttcatgccggaaagctggggctcgccaaccattggcggtccggcagtcaccgccggcggcgtgatctttatcggtgcctcaatggatgccaaagtacgcgcctattcactggatagcggcgaagagctgtggtccgatcaggttgaagcgcccgcagttgccaacccctcggtgtatgaatacaaaggccggcagtatgttgcctttgtcgccggaggtggtggtttacgcactgccggaataatacagcgcagtcagcaaacacagtggggccacagcgctccacttttttatgcctgcataaaaacggcggccattggccgccaaaacctcaacaggtggttgccgttgaggaagcagtggtactga

SEQ ID NO: 73873 - DNA, 528 bp, Glycine max
  Peptide Sequence Number=SeqID_165558
atggcacgcaaagacaaattatggtcattctgcacccttttgtcatccagaggcggcgggcccgatgacatgcggagacaaaatttggtcattccgcacccctttgccattaagacacagtcgtgtccgatggcgcgcagagacaaaatttggtcattctgcaccctttgtcatccagaggcggcgggcccgatgacatgcggagacaaaatttggtcattccgcacccctttgccattcagacacagtccgtgtccgatggcacgcagagacaaaatttggtcattctgcacccttttgtcatccagaggcggcgggcccgatgacatgcggagacaaaatttggtcattccgcacccctttgccattcagacacagtcgtgtccgatggcacgcagagacaaaatttggtcattctgcacccttttgtcatccagaggcggcgggcccgatgacatgcggagacaaaatttggtcattccgcacccctttgccatacacagtctgtcatggcagctgaccttttga

SEQ ID NO: 73874 - DNA, 297 bp, Glycine max
  Peptide Sequence Number=SeqID_165559
atgttggtgcgcacgatccgcatttgtctctttgcagtggcacaggtgaaatcttgccccggtatgcatagtagctacgtgatagcctccctctctggttgtattcgcacagttggccccctccaatatcaggggatgtggagccctctgaaagcgaggacgcgtagccctttgaaggcgagggcgtgcagcactctaaagttgaggacatgtcgccttttgaaggcgaggacgtgtagtcctctaaaggtgaggacgtgtagccctttgaaggcgaggacgtgtagtcctctaaag

SEQ ID NO: 73875 - DNA, 991 bp, Glycine max
  Peptide Sequence Number=SeqID_165560
ttcgactcagttcagagtagggaaagcctctgatcttcttgttcttgaaagaaaacactctcaacactcaacagaaattctggctaatccttggtggaccggtcatcaggtggggttgggtgtaggggtagaccctgcagcaaccaattcaccttcttccaacctaaacaaacgccacatggacctttccatcaacgaaagaagccttgttagagaaagacaagaggaagaagaagaagaagaagatgaaagagacaacggtgatgaacccaaagagggtgcagttgaggctggaacacgcaggccaagagggagaccccctggttccaaaaacaagcccaaaccccccatcttcgtcaccagggacagcccaaactccctcagaagccatgtcatggaggttgccggcggggccgacgtggcggaaagcgtggcccagtttgcacggaggcgccagcgtggggtgtgtgtcctcagtgggagcggttccgtggccaacgttactctccggcaaccttcggcaccgggagcggttgtggcacttcatggaaggtttgaaattctgtccctaaccggagcgtttctgcctggtcctgccccgccaggagctacaggacttactgtgtatctcgctggagggcagggccaggtagtgggagggagcgtcgtgggctcccttgtggcagctggaccagtcatggtgattgctgccacttttgctaatgctacctatgagaggttgccccttgaggaggaggaagacgacggtggtggtagcgtgcaaggagggagtaccctaggaggatctcctcatggaattggtagtagcggcggcggtggcggtagtggtggtggccacttaccaggtgggattcctggtccttcttctttgcctttgtataatctcccaccaaatcttcttcccaatggaggccaagtggggcatgaggcttttgcttgggctcatggccatggaaggccaccttactga

SEQ ID NO: 73876 - DNA, 528 bp, Glycine max
  Peptide Sequence Number=SeqID_165561
atggctgacacgatccatggtgaagaattaattgaaggagaagaaatattggtgaagaagaagatcaagttttcgcatgcatcctgcgcgcgacgtcgcgaagctcagaactcgaaggacctcgaagctgacatcccctgtgccggatcaatgttttcgcatgcatcctgcgcgcgacgtcgcgaagctcagaactcgaaggacctcgaagctgacatcccctatgccggatcaatgttgttgtatgagaagcagagggtaacgaggaaggtgaagtggttcgatgaccagaagggagtgggtcgtgtctacgatgtcagcactggaaaatccttttacggccccggcggcccctacgccatgttcgccggcaaagacaccagcagagccctggcgaagatgagcaagaacaacgacgacatctccccctccctcgttgacctctctaacaaggagatcggcgttctcaacgactgggagaacaaattccaagctaagtaccctgtggttgctcgtgttctcaattaa

SEQ ID NO: 73877 - DNA, 1167 bp, Glycine max
  Peptide Sequence Number=SeqID_165562
atgaagtctgaaaagaacaaagaaactacaggcgtgacaaaagaagggtcaagacccccaacaaatgaagaagcaccttcaaatgtaaccaaacagagggttgaagctgcaaagcagtatatcgaaaatcattataagaagcagatgcaaagcctgcaggagaggaaggaaagacgtaatatgctagaaaagaagttggctgatgctgaagtctctgaggaagaacaacacaacttgcttcagcatttggagaaaaaggagagggaaatcatgcgccttcagagacataagatgggggctgatgactttgagcccctgactatgattgggaagggtgcatttggagagttttggcccctggaacgagctaactccaagcctgaattggagcctggtcagataacttccagatcacgatcttggttgtggaattgcaagatcaatgatcctgaagagcctctcctttctgggctgaggtgggtttctgggtcagcctggactgacccagtggaggaactcgacttgctcagcttgctggagagagctgctagcttttatccttcggcgttgtgttggaacccagctttgacagctgccatggcaacggttgtgttcattcttgattactttgctgtggtcatcaccattcaggttgttgttgccattgcttttggcatcagggctgttagaatctgccgggagaaggccactggccatgtttatgctatgaagaagcttaagaaatcagagatgctacgaagaggccaggttgaacatgtcaaagctgagagaaatctacttgctgaagttgacagcaattgcattgttaaactttattgttcctttcaagatgaggagtatttatatctcataatggagtatctacctggtggagatatgatgacattgctgatgcggaaggatatactcacagaagatgaggccagagatatcaagcctgacaacttgctgctagatagaaatggccacatgaaattatcagattttggattatgtaaaccgctagactgcagtaaccttcaagaaaaggacttctctgttggaatgaacagaagtggagccctccaaagtgatgggcgtcctgtggctcctaaacgaacccaacaggaacaactgcagcattggcagaaaaatcgacgaatgctt

SEQ ID NO: 73878 - DNA, 261 bp, Glycine max
  Peptide Sequence Number=SeqID_165563
atggaacaggattactatagtgagcttatgagattgatgttagaggcgataaaaaatgccatacccaaagcagccatgtcagcaatagatttctactgctcggttgataaaattaaaggagtagatgggaaggatcgtgtggtattgacatttgatgggaaatatttgccacattcagaacagaaatctgagcacatggtttcaagaacaaggccactgggaaaacaaaaaacattggaagagaaaaataaaagtgtttaa

SEQ ID NO: 73879 - DNA, 207 bp, Glycine max
  Peptide Sequence Number=SeqID_165564
atgttggaggaagtgcctgcaaaaaggactcagacgattaagtcagtcaagcccaaggtgttttgtgcatctatgtatggagtgattgaaaacggagctagtggtcaccaagctttgagttcattacgagtgatagagtcttatgtgtcatccgaccacgatggggaccttggtcttatgatcacatgccgagttcataggctgtaa

SEQ ID NO: 73880 - DNA, 508 bp, Glycine max
  Peptide Sequence Number=SeqID_165565
atgggtttaaatgctggaaacaaccttttcgtatgttgggtgcccagaggctcttcgctatgcgaaagtatgagagagggatattgtacgcagccttacccttgcatatgcaaagaggctgtttccggattcgaacccatgaccaacaaaggatgcagtgagaatgatatcatctacataaagaaggatgtaggccgtgtcattgccattgtgcaacaacaacagtgggctgttccaccttgggctgcaccgtggcaaccatgggccacgccaccatgtccgtacccaactacgccaaattggcaacatcagtccactcctcgccagcaaggaattcttggaccaaagcctccacaagctcatatggcagccacatcagcaaataatgctcaaccatcatatgcatcaaccgacattcaagctgcgatgcatactctttctatggctcctcccgatgatcagtggtacatggataccggggccacctctcacatgactgcaaatggag

SEQ ID NO: 73881 - DNA, 1809 bp, Glycine max
  Peptide Sequence Number=SeqID_165566
atggtcgcagaagcttggattgtaaagatgggtaaccaggtaagttccaatctcaagcatgcccttcttcttgaaaccttgacaaagagaaaaccgaaccacaagaggtcagatactaaagaaaccataggtattctttcttttgaggtagcaaatgtgatgtcaaaaactgtgcacctccacaggtcactgtcagagtctgagatctcaaagctgaggaatgagatcttggactcagagggtgttaggaatttggtgtcctctgatgaggattatctccttgagctggctctggcagagaagcttgaggagttgaatagggttgctagtgttgtctctaggttggggaagaagtgctctgagcctgccttgcaagggtttgagcatgtgtatggggacattgttggtggggttatagatgtcaaggaattggggttccttgttaagcatatggagggaatggtgaggaaaatggataggtatgttactgttactaggaacttgtacagtgagatggtggtgttgaatgagttggagcaagcagtgaagaagtttcagcataatcagcatgaggagagtaggagggcttttgagcagaagctcatatggcagaagcaagatgtgaggcatcttaaggatgtttccctttggaatcagaactttgataaggttgttgagttgttggctaggacagtttgtaccatttatgccaggatttctgtgatctttggagaatctgctttgaggaataatgcccttggacctggtgttggtggaggctcgccaggtacgcaaaatgaatcggggtttgtgtcgggccatgttaatgctcacacaagttcggagaggttgaagcgcaatcagagcaagggaaatggattccatccgggttcggttggaagaatggctgtggcggagagaaggggagctactagtaggcctcagattgatttgaggagaggcgagttggtgcctattcgacttgaagattttggttttccatgtggaacaagtgcgggaagacttttcatggaatgcctaagtttgagtagctcagtttcaaaatttgatgatgctgatgatgtcaatagggaggaccatcatagtagctgttgcagtgttgggatagggaataatagcatgaagatggagcacgcgtgccattctggtattctaagtcatagccgaagtggcgttcctttcaccggagatcttagacaagccaaatctggtgtacaaagttgctcaacattaggtcccaaaagtaggttagctgtttatgctcctccttccacacttggaggctgtgctctagcattgcactatgccaatgtcataattgtcattgagaagctgcttcgctacccgcatttagttggcgaggaagcgagggatgatctatatcagatgctaccgatgagcttaaggttatctctcaaggccaaactgaagtcctatgtcaagagtttggccatatatgatgctcctcttgcccatgactggaaggagaatcttgatgggatactcaagtggctcgccccacttgggcataacatgatcagatggcaaagtgagcgtaattttgagcaacaccaaattgttagccggacaaatgttctgctacttcagactttatactttgctgacagggaaaagaccgaggaatcaatctgtgaacttcttgttgggttgaattacatatgccggtatgagcatcaacaaaatgctctactggattgtgcaagcagtttcgattttgaagattgtgtggagtggcaattgcaatgtggagattcttttctcaattga

SEQ ID NO: 73882 - DNA, 131 bp, Glycine max
  Peptide Sequence Number=SeqID_165567
atgcatgcagcggagaaaaatggaggtttccttagaggaggaggttctggaagcttatattgggatgaagatgcttcggagttgttcccaaagggagtgagatatgagagagatgtgaggggctgtatcag

SEQ ID NO: 73883 - DNA, 306 bp, Glycine max
  Peptide Sequence Number=SeqID_165568
atggaggttggtggaagccctccacgcgcctactactaccagctctgtagcaaccactttcatgctcctactaccccgaccccagccaactcctactataccgacagcaccactagcgcttgcactccaactcgtactactagggctgctactccagctcctctatcttccagcctcactacaacagagttggtgttggacagcgacgagggttgggactggctactaatatggctagccggaggtgtgctatctctactcccagctccagtaactactattatatgggtgatgaactactactaa

SEQ ID NO: 73884 - DNA, 462 bp, Glycine max
  Peptide Sequence Number=SeqID_165569
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggaattcgatccggttctcctgtagctggttccggaggatccagctacaggagaaccgggaacggagagcttcccccgccccccttttttttccgcccgactctttgctcttaa

SEQ ID NO: 73885 - DNA, 1971 bp, Glycine max
  Peptide Sequence Number=SeqID_165570
atggggggcagtgcgacagagaaacagcgtgaaacgggcactgcgtcttcgcaagacataaaaaaagccccggcaaaacgccggggcctggggatcaaccaaggccagcgcgtttttcatcgcctccaccatttcgccatccacgcaataatggctaaattcgtcaaactcgttatcggagcacatggtgacgcccgccttgcggtaacgcatggtcgacggcaccaggtgaccggaagaactgtgcagttcatgcaggccaatatcgacaaacttgtgcagattgctgaggcgcacgccggcacccgccatgattaccgggccctgactggcctggcgcaaatcgcgcagcaacggcaggcccagttcggcgctctgctgctggccggaggtcagaatgcgcgccacgcccagctcgctcagttgctccaacgccaccatcgggttctggcacatatcgaacgcgcgatggaacgtcaccgccatgccctcgcacagcctcatcacttcgcgcatgcgcggcagatcgatgtgcccttcttcgtccagcatgccaaccactacgccggggaaccccatctcgcggatctggcggagatcctgtttgatcacctcgaaatccaccgcgccgtagcagaaatcgccaccgcgagggcgaacgatcggatgcaccgggatcgaaacccgctcgcgcgccagacgcagcgtgccatagctcggcgtcaatcccccctcgctctggctggcgcacaactcaatgcgatcggcgcccgcccgttcggccgctcatgcataggcataaaccggctcagggttgtaactatggcattcaattttgatcaatgggtagaccgcagtcacagtgacagcgttaagtgggataaatatcgcggcagcgacatcatcccgctttgggtcgccgacagcgatttcacctcaccgccggcggtgatcgaagccttgcagcggcgcgtggcgcacggcgtattcggctacactcacccatcccctgatcttattgaggtttttacccgccgcatggtagagcgctacggctggcacatcaagcctgaatggatcattttcctgcctgggctggtgtgcggcctgaatttgtgcgtgcgcgcctgcaccgaagaacaccagagcacgctggccccctctcccatttatccgccgtttcgcaaagcggccaaattcgccgggcgcgagcacctcgcggtgccgctgaaggcgaccggtcaacgctgggtgctggatttttcctcgctgcatgatcggctgagtggcaacgagaaactcctgttgctgtgcaacccgcagaaccccggtggcaccgtttatcgccgggatgagctgttgcagcaccatcagttcgctcgcgaacacgatttaatcgtctgttccgatgagatccactgcgaactgctgcttgagcccggcgtgcggcatatccctttcgccaccctgaatgacgacgcggcccaacgcagcgtgacgctgatgtcgccgtcaaaaacgtttaatctcgccggactgggcgcttcactggcgatcgttcccaacgaagcgttgcgacaaaagctgaaacgcgcgcgcagcggtattgtcccggaggtcaatctgttggcgctggtggcggcgcaggcggcttatcaatacgggcaaccctggctggatgagcagttgatttatctgcgcgccaatcgcgatcggctgataaagcgtatcaacgccatgccgggtttgacgttgctgcctgtcgaggccacttacctggcctggatagactgcagcgcgttgccggtggataacccgcatcagttcttcgaacgtgcgggcgttgggctaagcgccggtttggatttcggcgatcggcgctttgtgcggcttaactttggttgccgatgggccctgctcgatgaagcgctcgatcgcatggcgcgagcctgtgcggcactgcctggctaa

SEQ ID NO: 73886 - DNA, 1122 bp, Glycine max
  Peptide Sequence Number=SeqID_165571
aaactgacggcggcgcagaccgccaacgataaagcgcgccagcgttatgagcaggacaaacaagcggccgccgctgagctggcgcaacagaaggcggaagccgccaaggcgacgggagaacttcagcagcagctggcactgcggcagaaagagctggatgaacaacgccaacaggccgagcggcaagagaaaagcctgaaaacggcgctggaacagcaaaaggccgaagccgccaaggcgacgggcgaacttcagcaacagctggcgcagctacaggaaaaaaacaagacgcaaaccgagcaggcgaaggcattggcgcagcggctggcaacggcggtggcggaaagcgaaaaatcaacgctgcaactggcgaaaacgacggagcaggtgaaaaaaaacgcattggcgctagcggacgccaaccaaacgcagcaggcattgcgtgaggagctggatgggctgcgctctcgcgccaaatggctgccggatgcacaggcgctcgagaaaaagccggcgcaacagagctatgctgccggtgtcgctttggggcgcgatattcaaacgatgctggcggagcgtaaaaattggggcatcaatcccgataaaaccgtgctgctggcgggcgtgatcgataccttcaacggccattaccagctaagcgatgcgcagttgacccgtgcgctggcggagtcggaaaaagcggtgaacgacgcccggaaccaggcagcgaaggtgcaaaccagcaagggcgaggcgttcgtcaccgagtttaaaaagaaaaagggcacgcagaagtcgccttccggtttctggtatcgcatcgattatgcgggtgatgaagccattaaggaaaacgcgcgggtggacatcgtggtgaaggaaagtttaaccgacggcagcgtgattcaggatatggatcgcagtgggaaggtgatgtcacagccgctctctgcctatccgccgttgttccgcgaggcgatcggccatctgaaaaatcatggttcgctgacgatggtggtgccgccggcgttggcgtacggtgaaacgggctatgcgccgcagatcccgccgaacgcgaccatggtgtatgagctgcggattgtcgatgtcaacaacgggtaa

SEQ ID NO: 73887 - DNA, 519 bp, Glycine max
  Peptide Sequence Number=SeqID_165572
atggtggtgacggttaaaaagctcgtagttggaccttgggttgggtcgatcggtccgcctccggtgtgcaccggtcggctcgtcccttctgccggcgatgcgctcctgtccttaactggccgggtcgtgcctccgcatgggataacaccacaggattctgatcctattgtgttggccttcgggatcggagtaatgattaacagggacagtcgggggcattcgtatttcatagtcagaggtgaaattcttggatttatgaaagacgaacaactgcgaaagcatttgccaaggatgttttcattaatcaagaacgaaagttggggctcgaagacgatcagataccgtcctagtctcaccataaacgatgccgaccagggatcagcggatgttgcttttaggactccgctggcaccttatgagaaatcaaagtctttgggttccggggggagtatggtcgcaaggctgaaacttaaaggaattgacggaagggcaccaccaggagtggagcctgcggcttaa

SEQ ID NO: 73888 - DNA, 567 bp, Glycine max
  Peptide Sequence Number=SeqID_165573
gattcctttgaggagcaagccacacagggatccttcgtcccccatggatgtcaggatgttctcgccgctactattagatgtccagagcaccctggacgtgtctgtgctgctggagccggtgtcaccatcaagcaatactttggctcatctccatggacgtcccgcagtgcttcctccctgcctcctgacgaattgcagcagctgacccagcaaatcagggaccaactagaggagtccatcacagagaaagtgacgaggcaggtcatggcatccttcagccacatgcagtcccagcttcagtcgcagatgcaatctcaggaccttgcagtgcctcctgagcctctggggagttgtgttgatccctcaggaaacgatcctgaaacgggtgactctgacagtaaaggtgagtgtggaggaggttacgcatgcagatgctccaattcttgtaccactgatgaggtagttgtgtctccggcaaaaccacctccaaagcccgattcagaggttgatgatccactttatctgatgacattgaccatcccagagcttttcttgaggccttatcag

SEQ ID NO: 73889 - DNA, 954 bp, Glycine max
  Peptide Sequence Number=SeqID_165574
atggctaagttcgacccagatgtagtcctagagtttaacgccaatgcttggcccacggaggagggcgtgcgggacatgcggtcatgggtaaggggccagtggattccttttgatgcagacgccctcagccagttcctgggagacccgctagtgttagaggagggccaagagtgcgagtatagtcagagaaggaatcgggccaatggatttgacgaggaggccattgcccaactgttaagcatatcgggtcaggattttgcccgaaccactgccaggagacaggtgcggatcatgcgcaccagcatgaccaccttgactcagatgtggatgacgttgctgctcagcaacgtcctgcctagcgatcataactccgacctccctctaccaaagtgtcagctggtgtatgccatcctgacacggatgagcgtccatgtggctcagttgatcgctgacgccatttatttatttgtaggtatgccacctaccaggcaccctctagacccatataagtctaacagggccctggggtttccagcgttgatcacgggcctctgccagtcaaacggggttcccgtcacacctagtaaggtgattcgaccgccgatcacccgggccttcattgagaagtattgcacacctagacaggcgcagggtgatgcaccgccaccacctcatcaggctgatccagctgggtcatttggtatggagcaggggcaggtgcagacccatgagtgtctctaccatctcagcctcagtctgcagagccagcgtttcgctccttttccgtgccctactccagatcagtttagggctgaggtcacatggcccggagattggcccgaggaccagacagaggaggcacctgtagaggctcccggcgatccagaggatgcccgcatggatgaagagatgaccgatttactcggcttcttgggaggaagcagagccacgtga

SEQ ID NO: 73890 - DNA, 1159 bp, Glycine max
  Peptide Sequence Number=SeqID_165575
atggctacctcaccaaaagaaacttcatctcctggttcaccctctgtaccatcatcgccatcagccaccaaagcaccatcaaaccaggaacaacctgaattcaatatccaacccatacaaatgattcctggtcaagcccttattcctgagaaactggtccccaaaagacaacagggagtgaagatttctgaaaaccctagccttgcaacaagtcctagggaagtagacacggagatggataagaagatccgcagtattgtgagtagcattctgaaaaatgcttctgtccctgatgctgataaagatgttccaacatcttccaccccaaatgctgaagtcctctcttcatccagtaaagaggaatcaacagaggaagaggatcaagccacagaggagacccctgcaccaagggcaccagaacctgctccaggtgacctcattgacctagaagaagtagaatctgatgaggaacccattgccaacaagttggcacctggcattgcagaaagattacaaagcagaaagggaaaaacccccattactagaaattcctcatctgattctgatgatgatgtcgaactagatgttcccgacatcaagagggccaagaaatcagggaaaaaggtgcctggaaatgtccctgatgcaccattggacaacatttcattccactccattggcaatgttgaaaggtggaaatttgtatatcaacgcagacttgccttagaaagagaactgggaagagatgccttggattgcaaggagatcatggacctcatcaaggctgctggactgctgaaaactgtcaccaagttgggagattgctatgaaagtctagtcagggaattcattgtcaacattccctctgacataacaaacagaaagagtgatgagtatcagaaagtgtttgtcagaggaaaatgtgttagattctcccctgctgtaatcaacaaatacccgggcagaccaactgaaggagtggtggatattgctgtttctgagcatcaaattgccaaggaaatcactgccaaacaagtccagcattggccaaagaaagggaagctttctgcagggaagctaagtgtgaagtatgcaatcctgcataggattggcactgcaaactgggtacccaccaatcatacttccactattgccacag

SEQ ID NO: 73891 - DNA, 534 bp, Glycine max
  Peptide Sequence Number=SeqID_165576
atgggtgatggtttgatgatacaagagggaagttcagtaaaagcaacaggaagaattgctcagatacctgtaagtatttccgtttccagagttggatcggcggctcaaacaggacttattaaagccatgaaacaagtagctggtaaattaaaattggaattagcacaattcgcagaattagaagcttttgcccaattcgcttctgatctcgataaagctactcaaaatcaattagcaagaggtcaacgattgcgcgagttgcttaaacaatcccaatcagctcctcttaccgtggaagaacagataataactatttatactggaacgaatggttatcttgattcattagaaattggacaggtaaggaaatttcttgttgagttacgtgcttacttaaacacgaataaacctcaattcaaagaaatcatatcttctaccaagacattcactggggaagcagaagtccttttgaaggaagctattcaagaacagatggaactctttttactacaggaacaggtagaaaaaaattga

SEQ ID NO: 73892 - DNA, 182 bp, Glycine max
  Peptide Sequence Number=SeqID_165577
atgggtatctccgcatgtcattggacttcacgggtcacgatagcaaaaggtggggcagtcgacaaaagtgaggcttttgctcctacgtatcctccatttgtgatgaggaactcagacctacgtgtggataaccgtaaggtgtctccacatgctatcggactcttgggtcatgatagcaaaag

SEQ ID NO: 73893 - DNA, 315 bp, Glycine max
  Peptide Sequence Number=SeqID_165578
atggggcaaaatacaccaaatgattatgatgatggatggctcaaattctcacaaagtgtaataaaagcaaagaaggagataggaaaagaagaactccctaagttatggtggaggaagagtagggttgtcgcaacctacccttcggcgggagggcgacgcgtgactcgcgggatgcgtgttccacgaaaggaatgcgcgcagagtcgccaccaacgtttatttgaggaaaacgtcggaaaaaccggaaaagacgcgatctacgaacttttaagtgaaaggttcgggagttgtatttacgcacggggaaggtgttag

SEQ ID NO: 73894 - DNA, 351 bp, Glycine max
  Peptide Sequence Number=SeqID_165579
atgccaatctccccctgcaaaaggatcgcacccacaaagacacccagtggacctgaagaagtccaacagggccctgaggtttccagctctggttacgggcctctgtcggccctacagggcgcccgttccccccagcaaggatcgtgcccgcaaaacactgtggacccggagaagtccaacggggtcttggggttgccagctctgattacgggcctctgtcgattctacggggtgcctgtcgcccccagcaaggtcatcaggccccctattaaccaggctttcatcaagaagtactgcgcccccaggcaggcgcagggcgaaacaccacagcagcattgggatggccggtag

SEQ ID NO: 73895 - DNA, 351 bp, Glycine max
  Peptide Sequence Number=SeqID_165580
atgggtttgtatgtagttggtgaccaatgtactcaactagtggcattgggaaaagtgtatgacagttcgtccaccatacacaacgtcccttatgcggatgatgtggttagggtgagctttttcaaagtttaccacggtgacactcagctcccattttcgacatctgagcttcaatttgtgagccagggcgttggcacatttgtgggctggccgacacatcttgtgaaacttgtgtctactgaggattcacacaagcatttgcctaaaccggttgcatctagtgaaatggacaatgtcgtggctgcagttgatccattaggagaattggtgacaaacttgtatgatgtttag

SEQ ID NO: 73896 - DNA, 776 bp, Glycine max
  Peptide Sequence Number=SeqID_165581
ttggaacctcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgataacaacatatgactggaagaaattggggggaaaattacccaacaaaaatatagctagactccatagtaaggcatggacgcttgaactggattgttatcagaagcactatatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacggaacggggcggagatttcctggaagatgccaggaagatacttaacagggaa

SEQ ID NO: 73897 - DNA, 354 bp, Glycine max
  Peptide Sequence Number=SeqID_165582
atggtgtttttgaggtgctccagtggcttctgttttctatccagctgtccctcctgttcagctactgacgggggtgggtgcgtaacggcaaaaagcacccgccggacatcagcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaa

SEQ ID NO: 73898 - DNA, 582 bp, Glycine max
  Peptide Sequence Number=SeqID_165583
atgctgaccaaccttatggaggggagcatagatgtggctctcgtgaaggaattttatgcgtatctttatgacctggaggataagtctccgaagcagggcaaggttggtttatggattagtgatgaagatggacatgaagaagaactactagaacttggacgaccccacggtcagctttctaggacccgcaaggccagggctagaggatctgaaggtccatcttctgctgctctccaaccttctattgtaccagctcctattccttcaacaccaccagttccagctaatttcggtccctccgctcagagcatagacctcatgatggcgatgctacagagcattcaccagggtcaaatcctggtgatgcagagtttacataatttgggtggcctggtggcctggccaggagtccagccttcttctcatggtggaggtgaggccttcgcagctcaagagcctcagccagatccagagattacccctcctgcccaggaggatgattcagaggccactcccccagagtcatttgtaccagagactgatccagaggccgatccagttattatggaggccagcccatag

SEQ ID NO: 73899 - DNA, 297 bp, Glycine max
  Peptide Sequence Number=SeqID_165584
atgaagcatttaatgcttttcgcaaacttgccaaagttattcaaaattgtagaagcaagcttcatgatgaatgaagatgattcaaagagttttgatgataacaaagatgatgacaaaaagctcaaaaaatcaaagaatgagttcaagattgaatcaagaacacttcaaggttcaagaggaaatttgatttcaagaatcaataatcaagtttcaagattcaagttccaagaatcaagatcaagattcaagactaaagattcaagaatcaagagaagactcaatcaagataagtattaa

SEQ ID NO: 73900 - DNA, 963 bp, Glycine max
  Peptide Sequence Number=SeqID_165585
atgggtcagctccagcgacaagtgtttcgcaaagcttacggtaaaatctgggacctagccatggtagaagtctccacggaggccattgcatccctcgcccagtattatgatcagccgttgaggtgcttcacctttggggacttccagctatcacccatggtggaagaatttgaagagatcctaggatgccctctagggggaaggaaaccatacctcttctcaggattctatccctctttagctagaatttctaagatagtccaaatctcggtgcaagaattagaccacagaaagcaagtcgaaaatggggtggttggaataccgagaaaatgtttggaggcaaaagcaagaatcttggcaggtagaggcgaatgggccccgttcatagacatccttgtgcttttgatcttcggaggagtcctctttccaaatgtggatgggttggtggacctggcagcgatcgacgattttctcgcctatcatgaccgcaaggaaagcccggttgtcgctatactagccgatctacatgacaccttcgaccgaagatgtgagaagagcagtacaaggattgtttgctgtacttcggccctctatgtatggttggtttcacacctttttcgccaagaggtgagccatgcttgcccgctagaaagccaccgttcatgcacagagaaaagaggggcgaattgggaccgactcttagcaagcaaagaaggagcgtctgtcaactggttccctcgatggaaagaaggaagaatcgggattcttacttcgtgtggaggatttccaaattttcccttgatgggaacaaggggttgcatcagttacaatcccgttctggctataagacaacttggctatcatatgagaggggcaccactagaggaagagctcgcacctattattgcacgaggtttcaataagaccaatgtggaggcacttcagaaggtccgcaaggcgtga

SEQ ID NO: 73901 - DNA, 339 bp, Glycine max
  Peptide Sequence Number=SeqID_165586
atgggtgttagacaaccagtgattaaagttccacaagctgttgaaagtgatcatgtagatcaagttgtttgtgaggaacaacatgatgatattgaacaaactggtgaagaaccagttgaacaagttcctcagcaagatgaccaaacaacattaagaagatctactagaataaaaatgacagcaattcctagtgattatccatcggatgtagatgggtcttcaaaacaaagaaagactcagaaggcaacattgagagacataaggcaagacttgttgctaaaggattcactcaaagagaaaggaatcgattacagagagacctttttcccctgtatctaa

SEQ ID NO: 73902 - DNA, 117 bp, Glycine max
  Peptide Sequence Number=SeqID_165587
atggcctcgatcaaatttggcgacgttgtcggggagcagtgtccaaagtgctttgcgacggatttagcgaccacttttactgacctgggaaacagagcagtagtgcaaatccattag

SEQ ID NO: 73903 - DNA, 360 bp, Glycine max
  Peptide Sequence Number=SeqID_165588
atgaaaactaaaatacctgaatatcctgtaaatcatgaagattttgatgatatcaagaagaatttgcttgagaaagagggagatgtaaatcatgcaagctttgatggtgtcgagaagaaatcacatgtttgtcatcatcaaaaagggggagaatgtgaatattttgatgatatcaagaagaatttgcttgagaaagagggagatgtaaatcatgcaagctttgatggtgtcgagaagaaatcacatgtttgtcatcatcaaaagggggagaatgtgaatgtatgtatacatgatttagatgatgtcaaagaagaatctaacaaggttgcttcaaatgataagcatttgcttcaagaataa

SEQ ID NO: 73904 - DNA, 630 bp, Glycine max
  Peptide Sequence Number=SeqID_165589
atggaaaatagtaacacaaataataatggagctttaaagtacaacacaaagattattattattcaagtccgggtagagatgagtgcttctagtcctagtcaagctaaaaaacaagatgatgataccaaacctttatggacctatgttacaaagataaaaagtgtaggtgatggtggaaattatgagataaaatgtaatatttgtgattttaccttcaatgggtcttacactagagtgagggcacacttgttgaaggtgactggaaaggtagttagagtttgtcaaaaggtaacaattgacagacttatagatttgaagaagatagacaatgaggcaacattaaaggtggagaagtcaaaaacaaaatctgtatcattgcctctggtttctactcaacaccaaatggatacaaacactcttggtgttgatccaaaaaagagaaagacatcaactgcagaaaatgcctttaatttgcaagctagagagacacttgatcatgaaattgctaggatgttttactcttcggggctgccttttcatttagcaagaaatcctcattataggaaggcatttgcctatgccgccaacaatcagatcagtggttaccaacctccaggttataataattaa

SEQ ID NO: 73905 - DNA, 270 bp, Glycine max
  Peptide Sequence Number=SeqID_165590
atgtgtgttcaggaagaagaaaggcttgtaatggagatgggtgagagtgcattactgacaactacttgtgggaagaacaaagcaactaagtctcaagctaatcagaaggggaaggttagtgttaatattaatacctggtggattgattctggatctactatccatattgcaaattctttacagggtatgcaaaacctaaggaaaccagtaggaagtgagcaaaacattttattaggcaataagctaggctcacctgtagaggctatttga

SEQ ID NO: 73906 - DNA, 280 bp, Glycine max
  Peptide Sequence Number=SeqID_165591
atgaccaagagcaagggcaaggatccacttgaaggacttggaggacctattgatgaggacatgaccaagagcaagggcaaggatccacttgaaggacttggaggacctatgacaagggctagagcaaggaaagccaaggaagctcttcaacaagtgctgtccatactatttgaatacaagcccaagtttcaaggagaaaagtccaaggttggcccaattggcaacctaggcatcagccttttgggagaccaaatggtggctgacttgttggctgttgggg

SEQ ID NO: 73907 - DNA, 372 bp, Glycine max
  Peptide Sequence Number=SeqID_165592
atggcacatcagtggtctaaatggcttgtcccccattgggatattccctacaagggcgattgcttatgccttggtaaccacatcattgtaccagccatgaaccccaccaaaaatgttcatgatgagaaggcatcccaaattgcaatgttagtgaggagggatggcaatagagttcctaaacgtgtaagtgagtgggtggctacaattggaacctggggtatggaggtgaggaccaggatgatgcaagctccattggagcttgtaggcctaggatcttcttcatcaatggattcctttgcttcttggaagatgaatggcagcggaatggagaaagggagagagagaggagacgccacttcaaggggaagatga

SEQ ID NO: 73908 - DNA, 231 bp, Glycine max
  Peptide Sequence Number=SeqID_165593
atggcagcagaatggagaaggaagagagagaggagacgccacttcaaggagaagatgactctagaagaagctcaccaccataggaggccatggataagagcttggaggaagaaggagatgaatgaagggagaggaagagaagagcacgaaattttgtgctctaaaagagctctgaaatctgaacccactaatccaagatcaattccaagattctccactaagtgtgcttag

SEQ ID NO: 73909 - DNA, 303 bp, Glycine max
  Peptide Sequence Number=SeqID_165594
atggcatcagcaaatgcaatcgacctcaatcttctgaagtttgagacagaagaggatttgaatcaggtcctatcagaaggtccctatttcattttccaaaggcctctcttgctgaaagttatgcacgctttctttgactttgggaatgaggaactcagcaaaattcctcctcagaaaaaaggaaagaaagctcaaatccagcagacacagagaactgaggagaggcagtttgactcaaagaaaggaaagcttcaaaaatctagcatccatgtcggggagggtccttcccgtcctaagctataa

SEQ ID NO: 73910 - DNA, 406 bp, Glycine max
  Peptide Sequence Number=SeqID_165595
atggcatcctctgatcaacaaaagaataccaatttagaggggtcttcaactggaatgttcaagcctacgggtgataatgtagatgtcttttggaattggaacagcttaaaggataaaaataacaggaagagtgtgacatgtgatttttgtcaaaacacgtctactggaggaatttgtagagccaaaagacatcaacttcaaataaaagttgaaactgcaacatacatggaggcaatgcaagaagaagacgacgaagaggaagatgggatccaagagattacaagacttaaaagtggaaaaagacctccaacaacatcaaatgaagccttctcatctacttccaagaagaggaccacaaacaaaaaaggccctcttgattttttgttctccaaacaacttgaagaaa

SEQ ID NO: 73911 - DNA, 681 bp, Glycine max
  Peptide Sequence Number=SeqID_165596
atggcaaatgtaagagcaatcaaggtgatgttaaggagctttaagttggtatcgggattaaagataaacttttccaaaagcagtttttgggcaattgggatgactgagcaatggatgaacaatgcagctccaaagattgtggtggataggttggtgaggctgcagcggtggttcttgtggggaggacactcggatcagaaaaagattacgtgggtgaattgggggttcagtctgtctacaaaaggaaaaaggtggcttaggcatcaaggatttgatgaaattcaactatgcactgcttggaaaatggtgttggaatttgtttcatcaccaaggagaattatggccacaagttttggaatccaaatatggagggtggaggaatttggatgtgacaagaaggacatacagagagtccctctggtgttgttctgggaagacgggtggaaggatgatgggggtgaaatggacatgactgcaaaatttatggaggatatagaaggtctgatcatacaactgcagcgacaagacacctggaattgggagggagattcaagcaggggatatacagtgggaaatgcttacatgttgcttgatagggattcgacaaatgaaaatcaggttggagtgtttactgcactatggaagttaaaaatcccaagtaaagcctcattctttgcttga

SEQ ID NO: 73912 - DNA, 132 bp, Glycine max
  Peptide Sequence Number=SeqID_165597
atagcaaaagaaagtttttacggaaaaccactcgggtatctccgcatgtcacgtgactccagtgtcagtatgacagaaattgtgggggcggccgacaaaagcgaggctgttgctcctgtgaatcctcaatga

SEQ ID NO: 73913 - DNA, 1779 bp, Glycine max
  Peptide Sequence Number=SeqID_165598
atgggacctctccaaatgcaagccttccgcaaggcgtacggaaagatcttagatttgaccatagtagagatatccacagaagccattgcatcactcacccaatactatgaccagcccttgagatgcttcacgtttgaagacttccaattagtaccgactgttgaagaatttgaggagattctaggatgtcctcttaggggaaggaaaccgtatcttttctccggctttcttccctccttaagcaaaattgcagttgtggtcagggatttggcgaggggattggaccgcgtaaagcaaactcgaaacggcatagtgggcctaccacgaaagtacttagaaggcaaggcgagggatatgacgaatcaagaggagtgggtcccgtttatggatgtattagcattgctaatctttagggttgtcctttttccaaacatggatggtttggtggacctagccgcaattgacgctttccttgcatatcaccatatcaaagagagcccggtggtagctatcttggcagacctttttgacacatttgaccgaaggtgcgaaaagagtagtgcacggatcatctgttgtttacccgctctttgtgtatggttggtttcacacttattgcaacaagacgtaaggcatccatgtctgctccgaagccattgctcgtgtgtcgagaaaagaagagtagattggaaccaactcttggctgggataggaggcagaatagtcaattggtttccacgatggaaagaaggaaatgagggttttctcttctcatgtggaagctacccaaacatcccattgataggaacgaggggttgcattaactacaatcccgcgcttgctataagacagttagggtaccccatgaggggagcaccgacggaagaaggcctgtctcctttccttgtgagagattttggcgcgcaaagtttcaaggttatacaaagagtccataaggcgtgggaaaaccccttaaggaaagataaagaacttaggggcattcgtaatggcatcattggtggttatcatgaatggctgaaagtttatacacggggtttagattggctcgccaagttaaagattatcaacgaagagaatttcgaagctttggaagaagatgaagaagtccgagctctaaaaaccgaactaggaaaaacgagacttgccaaagaaaaattcaagttggtcgctacagacgtccggaaagagtgtgccgggttacgagaagaaaatgcagctaccgcaaaagcccttgaacaagaaactaagagggctcgcaaggaagagcatggccgtgacaaattccgtggagcattgtggggaagcaacagtgagctcaagcttcgaagggaagagaaagaccgatcacgagcacatagcatggtcgtaaaagaagagttagccgcttgctcaaggtccaaaaggaacttgactcagcatttgtgtgagacagagaccaacatgttagctatcatcaccaagtaccaagaagaactaagtctagccacggcccatgagcatagggtggcggacgagtatgcccaagtgtacgcgaaaaaggaggctagacgaagggtgatcgactcattacaccaagaggcaaccatgtggatggaccgatttgctcttaccttgaacgggagtcaagaacttccccgattgctagccaaggccaaagcaatggcgaacacctactctgcccccgaggagatccacaaacttctcgactattgtcagcatatgatagatctaatggcccatataattagaaactgctag

SEQ ID NO: 73914 - DNA, 354 bp, Glycine max
  Peptide Sequence Number=SeqID_165599
agacaggcccagggggatgctccgcaggccgcagacgtgccgctacctcatcaggctggcctagctggatcgtttgatacggagcagtatttgcagcatttggttcgccaacaggtggccaaccaccgggcgcatgtacagacccatgattgtctttaccagttgagcctcagcctgcagagccagggttttacttcttttccgtgtcctacttcggaccagttcagggcagaggtcgcatggcctggagattggcctgaggccctggcaggagaggcgccagcagaggctcccgacaaggaagatgaggcccgcgaggacgaggagatgactgatttacttgatttcttatga

SEQ ID NO: 73915 - DNA, 459 bp, Glycine max
  Peptide Sequence Number=SeqID_165600
atggaggtaaacataccctttgggtggaaaccactcaacatcgagcagtatgatgggacaatagatctagacgagcatttgggcacaacagttgtccatatccgaaatctcaaccccaaggtagcattgcattccatgctcctcgccttatgccccaacaagttcatagatagtctatgcaaaaaaccaccaagtagcatggatgaactatgtgaacgagccaagggttacatccaactggaagaaatgtctaaagtttggaatgaagtctatgaagccaagaaaaagcatgaaaagcatgagacacacaccaagctcgactcacacaagctagatctgtgtaaaacagccacttcttcctcattctcttactctaagcccttaccaacgcccctaagcttcttctccaccacccacgaccattggtggccgccacgagccgccgttgtttgccattga

SEQ ID NO: 73916 - DNA, 1134 bp, Glycine max
  Peptide Sequence Number=SeqID_165601
atggttaagtgggatcccgaacttcacacatcgacttcgagagatgcttttaactttgtcaactcttccttgtggcctctctccatctttacgatacggtcagaccaagtgctaaccatggatgaatgtgagaggattgatgagaggccccagggcttgttgccttgtgctgagtgtgtgaacaggtcgtggtcaagcgtccacgctccagtaacaggactaacatggagggtggacacatgtctccgagtgccacataggaggccacatagattttgtgagcccaagacagtacataagccccccaagatcaaagtcaacttgcgggaaaaagaggttgtcttgtgtcaaagtagattgtctcacttcgagggagtctgtcagattcctggggtcaatgtggcttgccaagcctggacatgtgttgttcgggctgcttctgtcaagttgtccatgatggccatgtcattagcgtgtcaggcgtgtaccacacacgttcagtactcttgcatatgtgtttcacgcgtagtactcttgcatacgtgtctatacactgttttggtggatatggtgttgccttcttcatcctcgcatcctcgtgtctccctcgatcatttgtacacctccagtgatgctgactcattatgggctttcaacaagaaccttattgggtcggctggggtcgccaagtggagggttgctgctcggactctatggcaagtggaccgccctaaggtggccaatgccaccgttgcttttactaacattgtaagggcaaaccgccaactatctcctaaggttaagaagataaacctaggtggcaaagtggagagtatggcggctgagaatgacagacttgccaagagaattactgagttggagaccccgcttagggagtcgaagtccagattggaggagtccgagcagtgtgcttccaaggaaagggaggccaacaaggagcttgaagaagagctaatcatgtacaagaaggaggatcttgacttaggtctctttgatcccttcaaggatgtgaaggagggtgtcttgcttgatgaggaggagattgatgcgaaggaggaggttgtgggtgaagggcagggtgttgcggagcaaggcgatgatgcttgtgtctag

SEQ ID NO: 73917 - DNA, 858 bp, Glycine max
  Peptide Sequence Number=SeqID_165602
atgaccttcatccatatttcgaagatgacaatgtcttcagtcattgcatggctttcaaaaggcgacgatgaccttcatccacatgtcgaagacgataatgtctttagtcattgcatgctttcaaaaggcaacaatgaccttcatccatattttgaagacgacaatgtcttcagtcattgcatgctttcaaaaggtgacaatgaccttcatccacatgtcgaagatgataatgtcttcagtcattgcatgctttcaaaaggtgacaatgctttcatttacatttcgaagacaacaatgtcttcagtcattgcatgctttcaaaaggcgacaatgaccttcatccacatgtccaagaaaacaatgtcttcagtcattgcatgctttcaaaaggcgacaatgtcgtcatttacgcttttgaagacgacaatgtcttcatctcaaggacttcaatgtctgttgtccttgtgcttcatggaattcgaccccttgggctcactagatgacttaggggagaagcaaccagctcgcctaggcgagcaagttgcttctggagaaagatccctaaagttccctgaagtccagaggtccagaaagaagaagaaaaaagagaaaacatggccgaaacgctttcaaatcacatccatgatcgattcctacactgttcgttgttcattctttgttcgttcttcgttcttcatccagttagtacttgcttttaaggatttgaatttgatttatggacccttaggggtccccttttttgtttttgcatcttcatctccttcttcgaccatcgatgatctttttcttggtttaaagcgagttttgaccgattgttcataccgtaatctcgtttaa

SEQ ID NO: 73918 - DNA, 822 bp, Glycine max
  Peptide Sequence Number=SeqID_165603
atggtcattccgcataccttttgccatccagacacagtcgtgttcgatggcacaaagagacaaattattgtcattctgcgtcttttgtcatccagaggcggcgggccccatgacatgcgggaaccatttggtcccgcactttttcacctttcgtcatccagaggcggtgggcccgatgacatgcgagaaccatttggtcccgcacattttcaccttttgtcatccagaggcggcgggcccgatgacatgcggagacaaattatggcggcgggcccgatggcatgcgaggaaccatttggtcccgcaccttttcaccttttgtcatccagaggcggcgagcccgatgacatgcggagacaaattatagtcattcggcttacctttttccatccagacatagtcgtgtccgatagcatgcagagacaaattatggtcattatgcgtcttttgtcatccagaggtggtgggcccgatgacatgcgggaaccatttggcgacaggcccgatgacatgcggggaaccattggtcccgcactttttaccctttgtcatccagaggcggcgggccagatgacatgcggggaacctgttggtcccgcactctttcaccttttgtcatccagaggcggcgggctcgatgacatgcggggaaccatttggtctcgcactttttaccttttgtcatccagaggcggcaggcccgatgacatgcgggaaccatttggtcccgcactttttcaccttttgtcatccagaggcggcgggcccgatgacatgcggggaaccatttggtcccgcactttttcaccctttgtcatctag

SEQ ID NO: 73919 - DNA, 273 bp, Glycine max
  Peptide Sequence Number=SeqID_165604
atggcatcaagaaaaagggctagaacagacgacatcccgtcatcatccactccagctccttcgtcagtgaccataggacaggatgtccaaagctcacaaactttagtccctatgctacaaagcttattccgaggacagtttcttatcatgcacagcctgcaagagttggctcacaacacgccaatcatacctatggagcattttctggagcaagtagcctggcctgaagctcaacttccattggtgagacccaacgaggctgctcctccttag

SEQ ID NO: 73920 - DNA, 312 bp, Glycine max
  Peptide Sequence Number=SeqID_165605
atgtctcctccacctctagaacctcacaatcactcacaaactcatctcaatttgtcagagcagcttccttttcatgctcgattctctgcaggtggctttgttcgtgcttgcacgcttagtgcaattctgaaccgcttagcactcattagtggatttcggcttagcgcatgcttttctcgctcagcggatggactgaagtggtgcgcttcgctggatgaccctttgcttagcgcaaatgcacaactcatccttcttccagattcttccttgtgctcagccgaggagtgttgcactcagcggatggctcgctaa

SEQ ID NO: 73921 - DNA, 663 bp, Glycine max
  Peptide Sequence Number=SeqID_165606
atggtttttcaattaaggcttgtaatgagcttcgaaacaaagaaaggggaacataggctcaaaggggctatcaaaggaattaattcaaggaagcatcaacaagaatcaagccaaggctattgtgcaagcaatcaatggggcaaaacacaccaaaagattatgatgatggatggctcaaattctcacaaaggtaccaggggcattgcacaggctgaaaggcatcctcctataggcaaaagtgccaaagggacaggtgaatgtggtcttttcttaatccttaggagcaatagtgatttgcatataaccagaaaaaccatcaaggaaacagtagtgagatttacctgccaggcgttcaagcatctggtcaatgaatggaaggggaaaatggtcctttttggtaacctagttcagcctcctatagtcgatgcagactctctaactgttctgcacccaagtaggaataaactcctccttctcattttttatcacaatgaggccgattttctttggaactacctggacgggactcacccattggctgtcagagataggataaatgattccagcttgcaaaagcttggttacctccttcttcactacatcaataatcaccgggttgagtcttctctatggctatcttactggtttagccccatcttctaa

SEQ ID NO: 73922 - DNA, 483 bp, Glycine max
  Peptide Sequence Number=SeqID_165607
atggtcactttagggacattttccagcccttgggcccacctgggcccattagaaaacttaaaggtgaagcaaccagctcaactgggcgagcaagttacttctaaaggaagcaaccagctcgcctgggcgagctgtcatacaacctcctcccctcatgagagagtggaaagaaaggataaagagcttaagggaagtagcaacgacatcatcagtagctatcacaagttgttgaagtctagaacgcaagggataacttggctcccaaagctaaaaggtctaagtggggaagaggctaaaattgctgaggaaagcgaagaagtgcaagctttgaaagcagagctcaaaaagacaagagtggtgaaagagaagttggaaacgacaatcactagggtcaggaaagattgtgatgagctgaaagacatcaacatgaccacagtcaaagcattagagcgagaaacaaaaagagccagacgggaagaatga

SEQ ID NO: 73923 - DNA, 228 bp, Glycine max
  Peptide Sequence Number=SeqID_165608
atgaacgagacatcgaggtttggcagttcaggagacaacatagaacacaaaagcatttttagatctcccacaggcaacctagttcctctggacttggaaattgaagctaccttaagaaggaacagagccgagaggagaaggaagttgttgcaagatagggcaatagccttcattctagaagaagaagctcaatcttctgactccacatcatctgattcactatcataa

SEQ ID NO: 73924 - DNA, 267 bp, Glycine max
  Peptide Sequence Number=SeqID_165609
atggagaaagaaagcaaaattcctctctgtcggcataatgagcaagtccaatttcatcttgatgttttggatcttgatcttgctatattgaaagagaagtctcctgctattactaatgcgagtagcaatgaagataaaacccattataaagcttgggaaagatctaacaaactcaacctaatgttcatgagaatgactgtagcagacaatattacgacaactttccctaagaacgatagtgctaaagagtttatggggttagtgtga

SEQ ID NO: 73925 - DNA, 429 bp, Glycine max
  Peptide Sequence Number=SeqID_165610
atgcaatacacaatagttagcaaaggggattttaaggatgaagatgagaaaacaaaggagctcaagtaccttagaatttcatatagacaacttattgagaccacagaaagctttactgcttcaagcctaattagagttctttcaagtaacacaagaatagcagtgaaggtgttagacacaacaaaaactggtaagttttcctatgttggtattgcaaggcttgtaaaaagtgatgacaacatgcccacaagtgtcttatctttcagtgcaacacatggcttgttatgtggctcccttggctacattgctcctggtttacctattcaaattttgcatctctatgcttatggtttattggaaaatgttaagctagattatactttgtttagaactgaggcaacattcttccttatttataaatttgtttga

SEQ ID NO: 73926 - DNA, 477 bp, Glycine max
  Peptide Sequence Number=SeqID_165611
atggcccacttggagctctcgattccatggcgcggctcacagagcagccgccaccgtcctacctatttaaactatcctgagggaaacttcggagggaaccagctactagacggcatagttcaccatctttcgggtcccgacaggtatgctctcactcgaacccttcacagaagatcagggtcggtcggcggtgcaacccacagggggatcccaccaatcagcttccttgcgccttacgggccgacgccaggagcgcgcaggtgccgaggcacgccaagggcgcgcgctgccatccacaatcgcgatgatgacgtctccacgagcatatcaacagcccgggcttgggccaccatcgcaatccgcgtcggtcaatgtcccgagtcgatcggcggaccggctctcaccgttccacatccgaccgggacacatcgccggcccccatccgcttccctcccgacaatttcaagcactctttga

SEQ ID NO: 73927 - DNA, 201 bp, Glycine max
  Peptide Sequence Number=SeqID_165612
atggcactggtattgtcacacttaatgggcctaggatcttcttcatcaatggattcctttgcttcttggaagatgaatggcagtggaatggagaaggaagagacagaggacaagccacttcaaggagaagatgagtctagaagaagctcaccaccacaggaggccatggataagagcttggaggaagaaggagatgaatga

SEQ ID NO: 73928 - DNA, 135 bp, Glycine max
  Peptide Sequence Number=SeqID_165613
atgctggctactggtaatcgattactgccttctgcggaatggagaacaagaagagttgagaggagacaccacttcaaggagaagatgagtcaagaagaagctcaccaccataggaagccatggataagagcttag

SEQ ID NO: 73929 - DNA, 591 bp, Glycine max
  Peptide Sequence Number=SeqID_165614
atgtcagcggttcgagtccgcttatctccaactcgtgaacttagtcgatacaagctatatgatagcacttccatttttccgattcggcagtttgatctatgctatgatttatcattcatggacgttgataagatccttccatctagcagcaccttaggatggcatagccttaaagttaagggcgaggttcaaacgaagaaaggcttatggtggatacctaggcacccagagacgaggaagggcgtagtaagcgacgaaatgcttcggggagttgaaaataagcgtagatccggggattcccgatatagaggaaaagaaagcaaaagcgattcccgtagtagcggcgagcgaaatgggagcagcctaaaccgtgaaaacggggttgtgggagagctatacaagtgtcgtgctgctaggcgaagcagcagagaatgctgcaccctagatggcgagagtccagtagccgaaagcatcactagcttacgctctgacccgagtagcatggggcacgtggaatcccgtgtgaatcagcaaggaccaccttgcaaggctaaatactcctgggtgaccgatagtgaagtagtaccgtga

SEQ ID NO: 73930 - DNA, 615 bp, Glycine max
  Peptide Sequence Number=SeqID_165615
tattatcctggtcatcaccaacatcaatcatatgcggaacctaatgtacctccagttcatgttcttggatttatgtcccaacatcatccatcacaagcacaatatcaatcaacaagtttttctggtcatgcgtcccaaggatgtcaacaaagttttcaaccactagggttctcatcatatatacctcaatactcatttcaagtcccttctacctcaaatgttttttatggctcctcacaaatgtttgccaccactttcaacactccaccatctgcatataatcttgcaccatcgagttcttgttatcctctatcattacctattcaaatacgtgacatcagtcacgaagatgaggatggggacgaggatgaggatgaggataacaacaataacaacgatgacgatgatgatggtgatggtgttgatgatgatgacaacagtggtcatcatgttcatcaacaacaacgaacaattacacgtcagcatcctagaacaagaggaggtagaggccgtagactgaggggacaacaaacacagacaaatctagtccaacaagatgagagacctagacgcatatctagaagaactcgttgtgggatatcgtctcattattag

SEQ ID NO: 73931 - DNA, 135 bp, Glycine max
  Peptide Sequence Number=SeqID_165616
atgggggtgtgtgagagaaagagaaacaaaaaagggaattattcagatgatgttgattccaatagtgttgagaaggattctgcagtagctatgagcagattctgcaggctcatggccgggtactaccatagctga

SEQ ID NO: 73932 - DNA, 614 bp, Glycine max
  Peptide Sequence Number=SeqID_165617
gactgcatgtcctcaccttcgtagggctacacgccctaaccttcagagggctacacgccctcgccatcagaggactgcatgtcctcaccttcagagggctacaagccctcaccttgagaggactacacgtcctcgccaacaaaggggggcatgccctcacctttagaggattgcacgtccttgccatcataggactacattccctcgccttcgaaaggcgacacgtcctgaacttcagagggctacacgccctcgcctttagaggactacgcgtcctcactttcaggaccagtagtttccttttaacggttcctgggccaccccctgatattggaggagggccaactgtgcgagcacaaccagagagggaggctatcacacagctactatgcatactggggcaagatttcacccgtgccgctgcaaaagaagacgaccgcaatgtcaatctccccctgcggaagtatcatggtctgtgccgtcccgacatggggatcgcgcctgcaagacacccagtggacccgaagaagtccaacagggtcttggagttgtcaagctctaattacggggcgaaacaccacagcagcattgggatggccggtagcgggcaatag

SEQ ID NO: 73933 - DNA, 441 bp, Glycine max
  Peptide Sequence Number=SeqID_165618
atgagtattggttcaagacccacagctcaatatgatacaaggagatttcactccttggatgcatggaaccggtacacagataatgtattggggagaaacatcttgcaagagaggaaagtggaaatctaccacactgagtttgatgattttaagactgagttggagaggcataatctccataaacacctcatcaatttggttgatgggagcatagatgtggctttagtgaaagagttctatgcaaacctatacaactctaagggtccttcaccaaagcaagccatggtcagaggccatctagtgaagatcaacattgacaacctcaacacattcctagagacacttgtggtgttggcagagggtgagactttgcccacacactccagatactgtaggatgccttcagatcctagggagattgaggctgccctatgcatatag

SEQ ID NO: 73934 - DNA, 216 bp, Glycine max
  Peptide Sequence Number=SeqID_165619
atgaaaaaccctggagaatggaggattgcactagagggtcctcaccagtcaatcatgaagtatggctccaaactctttgggtggaggacgcatgaacgaacatgcaattcatggggctccgaaaaaaaggcgagaatggaggattgcactagagggtcctcactagtcaatcatgaagcatggctccaaactctttggtggaggatgcatgaatga

SEQ ID NO: 73935 - DNA, 620 bp, Glycine max
  Peptide Sequence Number=SeqID_165620
acagcaaaaagaatgtttatacggataaccactcgggtatttccgcccgtcagcgtgactcaaatgtcagtatgacagatcttgtgagcgcggaagatgacacagcaaaaaagaatgtttatacggataaccactcgggtatttccgctcgtcagcgtgactcaaatgttagtatgacagatcttgtgagcgcggaagatgacacagcaaaaaagaatgtttatacggataaccactcgggtatttccgcccgtcagcgtgactcaaatgtcaggatgacagatcttgtgagcgcggaagatgacataaatctccgcgtgcttttcgtcttacagacagcaaaaaagaatgtttatacggataaccactcgggtatttctgcccgtcagcgtgactcaaatgtcagtatgacagttcttgtgagcgcggaagatgacgtaactctccgcgtgtcaatgggcttgtcggccgcgattgacgaagggcgcagaagacgacacttgaaaaagtatcctccagaagatgctgacatttccgaaaaaggcgcagatgaccacattggcctcttctcatcaatcacacttggggtcactgaatgccgaggtgcggataaccgtaag

SEQ ID NO: 73936 - DNA, 441 bp, Glycine max
  Peptide Sequence Number=SeqID_165621
gtgcatcacttaggcagacctgttcctgcaattgcagacatggttgctgggacaagattaagtcctttgatcgcgtgttcaattgacactgaagatcatggacttatatcctcctttgttgacaggtggcaccgggagacttctagtttccaccttcctgtgggggagatctcgatcacgctagacgacgtcgcgactcttctccttctgctgattgtgggcgcactgcatgacttccagcctctatgcatcgacgaggtggggctgctcttggttgagttacttatggtctcatcagaggtggccatggccgagacaggccaatgtggcggaccatacgccctgcgtgacctcactcttgctgggcagtatgcatggggagctgctgggctcgtccatatgttcgatcagcttaatgatgtcagtctcagcaccagctga

SEQ ID NO: 73937 - DNA, 291 bp, Glycine max
  Peptide Sequence Number=SeqID_165622
atggttttcttgaccatacttgaagagtctataaaaggtacatcctttgtggtacaagtagagggtacatttacttgggttgttgtgactgagaacaagagagggtacatctcttgtggatcagttctagtggagggtacatccacaaggttgttcaaagagaacaagggaggatacatcccttgtggatctttgcttgtaaaggaatttacaaggttgaaaagaaatctcaaggactgcaagtcgcttggggactggatgcaggcacaggttgttgccgaaccagtataa

SEQ ID NO: 73938 - DNA, 192 bp, Glycine max
  Peptide Sequence Number=SeqID_165623
atgattatgaggggccaagacatttatagtagtcaagatgaggctactacttcaccttcctctagtgaaagtgaagaaacaaaaggggaagaatatagtgaagaaatctacccccaagaagaaggacaacctttaatggctacagagatttggatgacgccacttccagtgaaggaagataagtcagggtag

SEQ ID NO: 73939 - DNA, 414 bp, Glycine max
  Peptide Sequence Number=SeqID_165624
atgacatttttgggagaaactagcagtcagacgattgtgaactccacattgggttttgtttttccaaatggattgattattcacaacgatagtggtgtttactttcaaacttccactccggtactcattcgagtacctaacgcttgtgatattgcaacgctcaaaaccagaatacacaatacccttcagctaaccgacaaacaatatctggatgaaatttactaccgacagccattcacagatacaggtggaacatgccacgccaacacaactttgtcggttactcattcactggaaaaaaatccaaaaaaagttgacattccttctggatgtaccatcgatgaactaaaggatttgatcaagcaagttgcacctcaagggattccccctgatggtattcatgaatcacaaacg

SEQ ID NO: 73940 - DNA, 327 bp, Glycine max
  Peptide Sequence Number=SeqID_165625
atgaaggtttatctacggatgaatgctttgctagaacctaagcttttgaatcctagaaaaaccacgatttgttggcagcctaaccccattacaagcctagaatgtccttcagattcattttgtgtgttcattgctgtgaaaaagaggctaagtcatgaagtgctaaaacacagcttcagtgtgcttagcgcgacagaagaatctagcagagcatcaatatcaaggccgcgcgctaagcatgagatcagtgcactaagcacagcagctgtcttcagccaggctcagcgcatgattggcgctaagctcaaatccacttacttacgctaa

SEQ ID NO: 73941 - DNA, 690 bp, Glycine max
  Peptide Sequence Number=SeqID_165626
atgtagaaatctccgatgatttttctgatgacgattttgaagaaggattggaagaaattaatcttgaagaaatattttctaaaatgccaccagggtataggattatttttaatttatatgtttttgaagagaaaaagcaccaggaaatagctgagattcttaatatctccgaagggacaaaaatggagataaagccatctcatgatctttggaacaaaatagaagcaggtttggatgaagcagatatttcagttgaaaatctagctgtttcatcgccttataagtggtggaaatatgcagcaattattttgttcttattatcttcaggaattcttgtttattttaatatagacaggataaaaactgcacatataattgcccatgacaagtcaaacgaaaaaactgagactttagataataacccagagttagcattccggaatgagcatctggatcattctgctatatcctcggatattgttgatcgtagtattgcaacaaatggtaaagagaaggaaagagtagatagtatcacatccaatcgtgatcataatagggctattacaaaggatattaaagtgtcaaattatgaagcagatcacgatcttcatcctatagcatctggcgttcaaataaagcctgttgatcttgtaattcccgaggaagaaaagatatctgaaaataaattag

SEQ ID NO: 73942 - DNA, 1848 bp, Glycine max
  Peptide Sequence Number=SeqID_165627
atggtgacattccaatcacggcgaaacacagacagaaagaatgaagaggtatttcgatatcaccacaccaaacccacatcatatgctgatgcgttgacaagaaacataagaagaccagtatatcagaggacagcaaacaccatcgccaactacagatcttcatcttcatcggttcatatcgaagtggcgccagaagatacgctttggctgaaggatgcatgggtaggccgccttaaaaaccaggctctgtttgaacgtttggaggacgagtttcgttgggggatgggactggagatagtccctagatatatgggtgatgatcaagtgttattattgggtctcaccgacgctgacgccgacaaactcatcaatggtggaaccacaggggagtcaatgatgttttcctccattgaaagatggaatccaagcctgcgtgcaggtaatagacttacatggattcactgttgggggattcctattcaagcctggaatcagaaatatatcagtcatattgttgccgccatgggtgaactgatggatctagatgattcaacggaggagaagaggagaatggacagagcgagggtcctcattaagaccccatggaagcctataattcaacacacggtggaagtgacgattggagaagacaagttcacgattcagattgtcgaggagtgctgtggaggctgtcaagatggtttccggagtggaagaaatgtacgagggtcatcggaggacattaactccgatgacagcttcctcgatagctcttcttttgctaactggggcttcggggacgacgcgtcaatcgtgccggaatcggactttcgcagtgctcatactagcacagctgcgacgaccgccaacggcgcaggaaaccacggggagcagcaaccgccactcctccacgcttcggaattacatatcgcgtctcctggcgccgtcgcggagaatgatgtcggagctgaagaccagcagtctcccactgcatccaacggtccaagtgataacggttaccctttggacaatgtgaacaaccatcgggtcgatagcggaaaccagtgggtaaacacgcatggaccaaattcgaattttatgcaggctacggtcacctataacccagaagacagcgcaaaaaggagggctatgaagtgggaaccagtgcctaacatagatgatactttacagagttatcaccaactcggtaatgaagctcagggtgagtccagtggattggaaacgggtcaaaagatggatattgcagtagggggtgacgtggagaggatcaacgatagcctcatgacacgaggcacaggagaatataaggaggtggaggccattattgttgatacagaagcacgggcaattttaacggaccagaattccaattctacccccagtgacaaaagatctaagttgggcctgaacccattaacaggaggaggtgcaactagttgccaagtatactcccgacaacgtaggtgcaagaagaaaataacctcgggcttaattccattgggctctggtgatgaaacacataagggactctcacaacctccaaacacacagccttcttcacttcataacgaaccatacaacgacaaactggaaactccattccagctgcaggtttacaatggtaacatggagacaaccagtgactctgacaaaacatttaatcctgatgcacttcagatgtggagcatggccaaacaattgggcctcacaggagaggggagcaaggaatcagttattcaaaagtttcaaaatatggaggagagggacagggcagaagcaactagaagggtgtctgcaacagccatcaatgaaaataatctcttataa

SEQ ID NO: 73943 - DNA, 480 bp, Glycine max
  Peptide Sequence Number=SeqID_165628
aggtggcacaaggagactagcagcttccatcttccagtaggagagctgaccatcacactggattatgtggtgtcactgcttcatcttctgatcataggcgccttccatagctttgagcctctgcatgtggacaaggtgatcattatgttggtggagttgctagaagtctcgggtgaggaggctagagctgagactgcacagtgttatggggcatatagcactggccgacagcttgctggttacattactttattacagtgttggatatatgaacactttcccagtgttcatgagagcatgactgatgatgggtatgatgagatgtcaccacgtgcctgccggtggcttactatgaaggcttatatgaagggattaacaacattgccgtaccggacacatttagatgcactaacaatccctgacgtatgttggatgccttatggtgaccaccgaggagttagggcatttgatctcatttaa

SEQ ID NO: 73944 - DNA, 195 bp, Glycine max
  Peptide Sequence Number=SeqID_165629
atgatgagcaattttggagctttaatggaggcttcaatggagaggaagaagaagagaaaagcaacgtgggaagttccttgcgtttctcaacacccgtcggggcccgttttcgaaagtaggcaatatatatatcaaaacgctcagaatgaggccctaagcgtggttcagagttatggattactcttcgctaattag

SEQ ID NO: 73945 - DNA, 135 bp, Glycine max
  Peptide Sequence Number=SeqID_165630
atggagacagggggaaaagctgatgtcacaattttgctgtcaccactacagatactgctgtgcttgattactctgataatgaaagttgctgatcccacttgcatgactgctcgtacctgctcaggaagtgtctaa

SEQ ID NO: 73946 - DNA, 1065 bp, Glycine max
  Peptide Sequence Number=SeqID_165631
atggattgggaccagctcttggctggggtaggaagtagaacaatcagttggttcccccgatggaaggaaggaagagaaggagtccttttctcatgtggaagatacccaaacattccgctggtaggaacgaggggttgtattaattacaatcccacgctcgctataagacaactagggtaccccatgaggggagcaccgacggaagaaagcatgtctcctttccttgtgagggatctcggcgcacaaaattccaagactatacaaagaatccataaggcatgggaaaccccgttaaggaaagatcaagagcttagaggcattcgtaatggcatcattggtgggtaccgcgaatggctgagagttcgcatacgagcgaagagaattttgaagcaccggaagaggacgaggaagtccaagctctcaaaaagcgagttagaaaaggcaaaactcgccaaggagaagttcaagttggctgctacacacgttcggaaggagtgtgccgggttacgggaagagaatgcaattaccgcaagagcccttgaacgagagaccaagagggctcgcaaggaagagtatggccggaacaaatttcgcggagctctacggggtagcaatagtgaactcaagttgcgaagggaagaaagggaccagtcgcgagcacatagcatggttctgaaagaggagttgattgcttgttcaaggtccaaaagaagcttgtctcagcgtttatgcgagacagagaccaacatgttagctatcatcgccaagtacgaagaagagttaggtctagccacggcccacgagcatagaatcacggatgagtatgctcaagtatatgcggaaaaagaggctagaggaagggtgatcgactctttacaccaagaggcaaccatgtggatggatcggtttgctcttaccttgaacgggagtcaagaacttccccgattgttagccaaggccaaggcgatggcagacacccactccacccccgaagagattcatgggcttctcggctattgtcagcatatgatagacttaatggcccacataattagaaatcgttag

SEQ ID NO: 73947 - DNA, 903 bp, Glycine max
  Peptide Sequence Number=SeqID_165632
atgaaagatgcgcagcaagcccgcagtatgcgcgcgcgggtccagcgccagtttccgctgatctggcaggagctggaaggactggctgaaggattacaggtaccgattgacgaggtgtttgcgtggaactgccggggcgatctggtgcgttctacttcggatggctgcaccacggtggcgggaaaaagtgccagcggggagttgatcattgcgcacaacgaagatggctttccccagctgcgtgacgactgtgcgctggtcaccgtgacccccgatgacgggctcgcgttcaccagcttcgcctatccggcatcactttgcggtcacacttttgccgttaatgaaaagggcatcgttaacaccgtcaataacattcgcgcacagcatcgtccggatggcgtgccgcgccagatcattgcccgcgcgtcgctgaacgcgaccacgctggatgaagcgatcgccatacttagcgccacgccgcgcgccggcgcgtttcaccacacgctggggcagcagggcgatagccgcctgttcagtattgaagcgacaggctcaggctgttcagtgatcccactgactgcgcctttcgggcacgctaaccatcttattcacccgcagcttgccgccgtcgaacaggtggtcaccgccagttccggctcgcgccagcagcgtctggagacatggctgacgacgcaaacggcgttagatggcgcggcggctaaggcgattttatcggatcagcaggatgcagcattgccgatttaccggctgtcgccgcaggatccggatgaggaaaataccctcgccacggctatttttaccctgagtgacgacgcgatgacgtggcagatcttcacgcgcgaccgccagcgcgccgctttgcaatctgctggtcgtcaatga

SEQ ID NO: 73948 - DNA, 441 bp, Glycine max
  Peptide Sequence Number=SeqID_165633
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagcagttcgctccaagctggactgtatgcacgaaccccccgttcagtccgaccgctgcgccttatccggtaactatcgtcttgagtccaacccgaaagacatgcaaagcaccactggcagcagccactg

SEQ ID NO: 73949 - DNA, 156 bp, Glycine max
  Peptide Sequence Number=SeqID_165634
atggtgccaacggaaagtgctcgacgccggtgttatgcttgtgtcaaaacatgggcttggtcagcatgtctagccattccaactggcgagatcaccacgtcacactccagatggcggaacagccatttcgccattgccacttgcgggatccattga

SEQ ID NO: 73950 - DNA, 102 bp, Glycine max
  Peptide Sequence Number=SeqID_165635
atgaagcaaaatcttgaaaatgaagtgaaacgccatatgttagacatattgaaagaattatcagcctctgaatcacctattaactcgtgtgctcaggattga

SEQ ID NO: 73951 - DNA, 417 bp, Glycine max
  Peptide Sequence Number=SeqID_165636
atggcagagttaccaggatattttcgttactgcttgaacacagggaaacttgtccttttgggaattttggtctctggaggagttgttttgcaaattttggcatgtgcattgtataataattggtggccaatgctaactgcaataacatatgtgcttcttccaatgcctttgctcttcttggtgggatctggacgttcttccttattttctgaatcagatagcagctgggtgaatgcaaccaagttcttaaccggggcctctgctgttggaagcattgccattccagccatattaaagcattctggtgttataggttggggagcctttgcaatggaactctcttccttctttgtgtttgtatttgcaatattgtgttacattcggattaatgatgaagatgattatagtagtctttga

SEQ ID NO: 73952 - DNA, 201 bp, Glycine max
  Peptide Sequence Number=SeqID_165637
atggaggtacaggtgggccaattagctaagcaaatggttgaaaggcccactggaaccttcaaggccaacactgagaagaatcccaaggaggagtgcaagtgcagtgatctagaggaaactaccacacaagctcaaagatccaagaaacgtgaccatcccatgctccattggggaggtatccgtagggaagactctcattga

SEQ ID NO: 73953 - DNA, 582 bp, Glycine max
  Peptide Sequence Number=SeqID_165638
atgacgcgcagtcccaagacagcctcagaagggggagccaacataggacccctccagattcacattagaggtggcctggcacagataacaagacaacgttcacctccagaacatccttccagaaaggaatgtggaggtcgccctttccataggatcgacgtcgctctagtgcacaaattctacacaaatgcctatgatccagaggatggctcgcccaagtactgtcgggtccaggggaaggtcattcgattcgatgttgagacatttaatgactttatggagacctccgtcatcatcctggagggggaggagtaccccaactactcccagtatctgcatagctacccaaaccaccaggtcattatggccaagttgtgcacaccaggcgataaattcattctgaacaccaacggagccccgtggaagctgctcaggaaggacctcaccacattggctcagacatggagcgtcttgagctacttcaacctcgctcctacctctcacatatcagatctgaactggactaggcttgcctcatctatgggctggtgtcacagatggacatggacttgggcaacatga

SEQ ID NO: 73954 - DNA, 375 bp, Glycine max
  Peptide Sequence Number=SeqID_165639
atggtgaatggtggcaacaatggtggtgataatgatgatgtcaacaatagcgacattgatagagatatcaataatggtcacggtggtagtggtggtggtgatgatgatggaggtggtattatcgatggtgacaacgatgacgttgtcggtggtgacagtgacagaggtgatattaatagtggtggtaatggtggttgtagcgacattggtggtagttgtggtgacggtgacaaaggtggtagtggtggaggtggtgataatgatgatgaaagtgacactaatgatggtggtgatggtaatatagtggggacagtcagttatggcaacgacaacgctagtgatagtgacgatggtgtggtggtggcgatgacataa

SEQ ID NO: 73955 - DNA, 1461 bp, Glycine max
  Peptide Sequence Number=SeqID_165640
atgaaaacaaggagaggaaaacgctcagaggccttttggccttcccttgtgatgaagaaatggttaaacataaagccaaaggtgtatgattttagtgaagacgaagtggacactgaaactgagagtgaagatgatgacacaccgtgtaagggctacaatacaaaacatagaagagggaaatcagaaactctgcgtgttcaatacataaatacaaaggaactgagggtaacaattggcacatggaatgttgctggaagagctccaagtaaggatcttgacattgaggactggctttgtaccaatgagccagcagatatttacattattggagaaaagaagagagagaaggtacaatctctgaggcgtgtggagacacttaagattgtttataaaattggtcttctgatgccttttgtgcgattggcttccacactaataacttctctcaacaacagtttccaagaggttgtccccctgagtgctggaaatgttctaggggctgaggataacacacccatccgcaaatgggaagcgatcatccgaagaactctaaacaaatcttctgaacctgaaagcaagcacaaaagctacagtgcccctcattctcctgttcaaaaaacttcttcttctgcttctgttaatgctctagcagacagtgtagatgttaatccactagacatgatgaatgaggagtatttaggaacttttgacaatgatgatctagaacaagaggaagtgaaaagcagcatattcggtataggaaagaatttacagctgaggaaaatacatgacattgatcttcagactatacttgactggcctgaacgtccattagatgcaactccacatactgattccagtccgaaattgcgccgagtactaagcagctcagagagaaccggctttagctggacagatactgcttcaaaatattcgaatgcaatgaaacggtcacaccatagttctggaaatttgggcttgttatggaaagagcagaaagtgatgcctgaagaagtaattgatattattgacgacttatctgacatgctatcagacgaggaagatgatgatgattattttgaagtagcaaatgacaaagaagttaatggaataagtaaggtgaaatctcatcgtaaatatgtccggattgtcagcaagcagatggtaggaatatatgtgtctgtttgggtgcaaaggaggttgagaaggcacattaataacttgaaagtttctccagttggagttggtcttatgggctacatgggaaacaaggggtctgtttcagttagtatgtctctctttcagtcacgtttgtgctttgtttgttcccatctgacttctggccagaaggatggggcagaaataagacgaaacgcagacgttcatgaaattctccgccgcacttgtttctcatccgtctttgatacagatcaaccacaaacaatcccatctcatgagtaa

SEQ ID NO: 73956 - DNA, 360 bp, Glycine max
  Peptide Sequence Number=SeqID_165641
atggattggttctacatgatttcgcactcattcattagtccaacacagccaggggaccctcctagagtttcattggttcaacaatatgacacatttgttgaaccaaatgtgcatcagcaaccggtggcgacagcgacacctcatgaagcagacgttgatgtacatcatcttggacatgcagtggatggttatgtagcaattgctaataagttggagaggcttctaaacctgaggatcctgaacgaaggaacaaaagcctatactgctgctgaagaatgtttgagcatcgcaagaagctacattagtcaatcaactgtaggtcacagatcgaggcgtaggcgacgtacagacggtcattga

SEQ ID NO: 73957 - DNA, 2800 bp, Glycine max
  Peptide Sequence Number=SeqID_165642
atggctgaatcggtggagcttccgagtcgcttggcgattctcccctttcggaacaaggtcctcttgcccggcgccataatcagaatccgctgcacttcccccaccagtgtgaagttggtggaacaagagctttggcagcgagaagagaaggggttgattggcatcctgccggtgcgtgatgttgttgaaattaagccagtgggtcccactgtatctgaaggagctgattcaacaaatcagaactcaaaagttcaaggcggttcattggattctcgtaagcttgatacaaaaaagcagaatgatgttgttcattggcataacaggggggtagctgcccgaccattacatttatccaggggagtggagaaaccaagtgggagggtcacatacacagttgttcttgaaggtttatgcagatttagtgtccaggaactgagcacaagaggaatataccatactgcgaggataacttcccttgaaatgactaagactgaactggaacaagtggagcaagacccagatttcataatgttgtctcgccaatttaaagctactgcaatggagcttatttctattttggagctgaaacaaaaaactggtggaaggacaaaagtccttttggacaacgttccagttcacaagttggctgatatatttgttgctagttttgagataagttttgaagaacaattatctatgctggattcagttgaccctaaagtgaggctttcaaaagcaactgagttagttgacaggcatttacagtcgatacgtgtagctgagaaaattacacaaaaggttgaaggacaattgtcaaaatctcaaaaagaatttcttttgcgccagcagataagggctataaaagaggaacttggtgataatgatgatgatgaggatgacctggctgcccttgaaagaaagatgcaaagtgcaggaatgcctcagaatatatggaaacatgcacatagagagttgaggaggcttaaaaaaatgcagcctcagcaaccagggtataacagttcaagggtttacctagagcttatctctgatcttccctggcagaaggccagtgaagaaattgaactggacttgagagctgcacagaaacggctggatagtgatcactatggtttagtgaaggttaagcaacggataattgaatacctggcggttcgcaagcttaaaccagatgcaaggggtcctgtgttgtgctttgttggaccaccaggtgttgggaaaacatcattggcatcttctattgctgctgctttgggaagaaaatttgtacgcatatcccttggtggagtcaaggatgaggctgatattagaggacataggagaacatatgttggaagcatgcctgggaggcttatagatggattaaagagagtagctgtttgcaatcctgtcatgttgcttgatgaagttgacaagacaggttctgatattcgtggagatccagcttcagcattgctagaggttcttgatccagaacaaaataaatcgttcaatgatcagtatcctttactcttaaagatgtgttccctcaatttgctcttctctcctgttggatcaaataggttgcaacccattcctccaccacttcgtgataggatggaaataattgagcttcctggatatacacctgaggaaaagctccacattgctatgcggcatttgattccaagagttttagaccagcatggattgagttctgagtttcttcagattcctgaggcaatggtgaagcttgtcattcagagatatactagggaagctggtgtgcgaaacttagagagaaatctagctgccttggctcgagctgctgcagtaatagttttagagcaagaacaagtagttccattaaacaaagggatgcagggacttgctacaccacttgtggaaaacagacttgctgatgggactgaagttgaaatggaagtgataccaatgggtgtcaatagtcgggacatctcaagcacgtttaggattgcctctccattggttgttgacgaaactatgcttgaaaaagtgcttgggcccccaagatttgatggcagagaagctgcagaacgtgtggctacccctggggtctctgttgggctagtttggactgcttttggtggagaagttcagtttgtggaggctacagctatggttgggaagggtgaactgcatctcactggacaacttggtgatgtaataaaagaatcagctcagattgcactgacatggttgcaaatgagtggcatgggtggtgaagctaacattgccgtgtttgttgagaccagtcaaagggttaatgcatggttagcccacatgggtgctggggttatagaatgtggtgggatgttaggatccaattgcaaggctgcattatatgtttgtcgctacacattggctgtcatggcaagggctactgatcttaggcttgctgctacagaaggatttaatattttggagggccgtgatgtacacatacattttcctgcgggtgctgtacctaaagatgggccctcagcaggtgtgactttggtcacagcactggtatcacttttcagtcagcaaagggtgagatcagacacggctatgaccggagagatgacattgaggggtcttgttctacctgttggtggtgtcaaggataagatattagctgcacatcgttatggtattaagagagttattctgcctgaaaggaacttgaaggacttggttgaagtaccatcgtcagtgctatccaatttggaggtcctgcttgctaaacgagtggaagatgtgttagagcatgctttcgatg

SEQ ID NO: 73958 - DNA, 726 bp, Glycine max
  Peptide Sequence Number=SeqID_165643
atgaccggcttccgcgtggcgctgggcggtgcccaggcttattacgacgttacgccagacctgacctgtctcggcaagatcatcggcggcggtatgccggttggtgcctttggcggccgccgcgaagtgatggccgcgctggctcccaccggcccggtgtatcaggcgggcacgctgtccggcaacccgattgccatggctgccggttttgcctgcctgtcgcagattgcgcagcctggcacacatgcgaccttaaccgcactcaccgaccagctgtgtgctggcctgctggcggcggcggaggcggaaaatatcccgctggtggtgaaccacgtcggtggcatgttcggtattttcttcaccgacgccgacagcgtgacctgctacgccgacgtgacaaagtgcgatgtggagcgctttaagcgtttcttccatctgatgctgcaggaaggtgtttacctcgcgccatcggcctatgaggccggctttatgtcactggcgcacagccaggaagatattcagcgcaccgtcgatgccgcacgccgctgcttcgcgcagctgtcgccatcaggcctgccgggatttgatccgggaaggccagcatgcggccgcaccagtcggcgaacaccagcaggcccccgccgagcaggccagccatcagcaattgcggcagcgcgcgacggaagccgagcatacgcacaatatgtggcgccatcaggccaataa

SEQ ID NO: 73959 - DNA, 1043 bp, Glycine max
  Peptide Sequence Number=SeqID_165644
tcgccttcagagggctacatgtcctcaccatcagaggactgcacgtcctcgccttcagaagactacacatcctcgccatcagtggactacacgtccttaccttcataggactacacgtcctcgcattcataggactacacgtcctcgcctttagaggactacaccacctcgccatcagaggactacacgtcctcggcttcagagggctatacatcctcaccatcataggactacacgacctcacctttagagggctacacgccctcgccttcagaggacaacatatcctcaacatcagaggactacacctcctcgccatcagagggctgcatgccctcgccttgaaagggctacatatcctcaccatcataaggcttcacatcttcgcctttagaggactacacgtcttcgccttcagaggactacacgtcctcgccaacagagggctgcacgccctaacctttagaggacgacacgtcctcaccttcagaggactgcacgtcctcacctttagaggactacatgtcctcaccttcagagggttgcacgccctcataatcagagggttgcacggcccagctttcagagggctacacgtcctcaccttcattggactagacgtccttgccttcagaggagtacacgtcctcgccatcagagcgttgcacaccctcgccttcagtgggctacatgccctcaccatcatagggctacatgccctcacctttagaggactagaattcctcaccctcagaggaccagacgtcctcgccttcaaaggggtgcacgccctcgcctttagagggctgcacgtcctcccctttagagggatgcacgccttcgccatcagaaggctgcacgccctcgccttcagagggctgcacgccctcgccttcagagggctacacgtcctcgtcatcagaggactacacgtcctccacttcagagggctacacgtcctcaccttcataggacaacacgtcctcacctttagagggctacacgccttcgccttcagaggactacacgtcctcgccatcaga

SEQ ID NO: 73960 - DNA, 51 bp, Glycine max
  Peptide Sequence Number=SeqID_165645
aacttcccttttgggattacactcctagagtcgattaccagagccttgcat

SEQ ID NO: 73961 - DNA, 147 bp, Glycine max
  Peptide Sequence Number=SeqID_165646
atgacggtcattctccttcttggaaggtaccacaggatatgtacctttcttttcagtgcgcgccactattgtgggctaagcgctattcagtgcagccttgatttggctaagcgtgaccctgttgtgctaagccactgtgtgaaataa

SEQ ID NO: 73962 - DNA, 413 bp, Glycine max
  Peptide Sequence Number=SeqID_165647
agacgaaagctaggggagcgaatgggattagataccccagtagtcctagccgtaaacgatggatactaggcgctgtgcgtatcgacccgtgcaatgctgtagctaacgcgttaagtatcccgcctggggagtaccgaagaaccttaccagggcttgacatgccgcgaatcctcttgaaagagaggggtgccttcgggaacgcggacacaggtggtgcatggctgtcgtcagctcgtgccactgccggtgataagccggaggaaggtgaggatgacgtcaagtcatcatgccccttatgccctgggcgacacacgtgctacaatggacgggacaaaggatcgcgatcccgcgagggtgagctactccaaaaacccgtcctcagtcggattgtaggctgcaactcgcctgcatga

SEQ ID NO: 73963 - DNA, 195 bp, Glycine max
  Peptide Sequence Number=SeqID_165648
gttaaaaggtctttctccattggtgccggtgctgttacctcctttggttaccgaaaggatgttgatggtcagtgggttctcaaacaagacttgccatcgcctattcctgatgaacgtatcctatctcctccaccacaaaggtatgcttcttcttctttgttgactgaagtcctcatagagctccacgatctttga

SEQ ID NO: 73964 - DNA, 739 bp, Glycine max
  Peptide Sequence Number=SeqID_165649
atgattatgaagggccaagacatttatagtagccaagatgaggctactacttcaccttcctctagtaaaagtgaagatgcaaaaagggaagaatctagtgaagaaatgtacccccaagaagaaggggaccttttaatggtcagaaggcttctaagaggacaatcttatgacttaacccaatctcaaagagagaatatttttcacacaaggtctaaggataaagtagaaataacactcaaatgggatgaggaaaataatagaaagagaaaagaagaacaaactttaatagttaaggaggagtgtaaggaggtaagtgtctcctccaagaggttagctaagaaggacaatcattttgcaataaagacaaacattaaagaaacttcccttcttagacaacctccacatcttctcctttgtaaaagatcacttgttagcactaccatacctcttcagttggaggttattcctcaagtaaaggagttgttagatgagggtttgggtcataagagcttaaatccttgtgctttgttggtgacaaaaataggtcttatgaggcaccaaatccctatgataagtggtatgatgaatgtgttgagtggtgcaaccctcttgtgtaaaatcacccacgcatccaacatcttcatgattcgcatacatagggactcattaggtagtgatcaagggattcccacgggccctaagagaataaaggtcattcgtgagtggctcactccaccaa

SEQ ID NO: 73965 - DNA, 241 bp, Glycine max
  Peptide Sequence Number=SeqID_165650
atggcgttagtgaggtgtataggtggcaattcagtgccacgtagactgtccaacgtggcactgaggtttgcatctatgaattctctctcacgcaaggctcagtcgctactgcttgttcacttgatttctccatgtctgcaagtggcagttgttgtgcattttctggtagtttcattcggcaatgccaccatggaagacgtgaagctattcgaactgcaagaacaaggaggaacccaggaag

SEQ ID NO: 73966 - DNA, 200 bp, Glycine max
  misc_feature (135)..(135): n is a, c, g, or t
  Peptide Sequence Number=SeqID_165651
atggaagccaatgcggttgcagttgccgctaccagcgttgttgctaaggtgaacctaatgcccccatctggcctcaagcaaatgaatcatccaacctcagatatgatgggcaaagatttgggaagtacgaacggncccatgatgtgcaaattcaaaacaagcacaccttcccgccatatggctcgcttcccaaggaggat

SEQ ID NO: 73967 - DNA, 99 bp, Glycine max
  Peptide Sequence Number=SeqID_165652
atggctgtggtactttaccatggttgtggaaaccacaacagccatgataagatcatcgttgccatcaagatcagcacctatcagtcaatcacgacaatg

SEQ ID NO: 73968 - DNA, 66 bp, Glycine max
  Peptide Sequence Number=SeqID_165653
atggcctgggcgaaatcttgccccgttggccctcctccgagatcaggggggtggccaaggaactga

SEQ ID NO: 73969 - DNA, 213 bp, Glycine max
  Peptide Sequence Number=SeqID_165654
atgtggtaccatgttagtgaaaaaccaccctggggcacttatgagtacataacaagacacaccacaccatgggtttgtcagggcactctcactaatataggcttaaaggagcactcaaacccggtgacccccaaggcctacactccgaagagtccgttagggcctctccctcctgattcaggtccaacccctaaaataattttttgcatgtag

SEQ ID NO: 73970 - DNA, 327 bp, Glycine max
  Peptide Sequence Number=SeqID_165655
atgggtgatcaagaggagacacaggaacagatgaaaggcggcatgtcggctttgaaagaacaaatggcttccatgatggaggccatgttaggaatgaggcaactcatggagaaaaacgtggccaccgctgccgctgttagttcagctgccgaagcagacccaactctcctagctaccgcgcaccatcctcccccaaacgcagtaggacgagaaaggagaacactgaggcacaacagcaacccccatttgggatacaactgggtggcttaccttacccttacagattaccacctaattacacgtcgccagtcatgcatgacgatgcgg

SEQ ID NO: 73971 - DNA, 297 bp, Glycine max
  Peptide Sequence Number=SeqID_165656
aatcatgaaactggccaatacaggctaaaggcccaagtggagaagaacgaaggccaagtggagaaggacaaagcccccgagtggagaaggatgaaggcccaagtggagaaggatgaaggcccagaggcagagacactatcaagactattaattacttatcaaggtaatccttgtgacgtctacccagacttatcttccttcactggaagtggcgtctaccctgacttatcttccttcactggaagtggcgtcatccaaaccttcgtagcctgtatcaaacgatccgctcctactcag

SEQ ID NO: 73972 - DNA, 381 bp, Glycine max
  Peptide Sequence Number=SeqID_165657
gttgggagtggggaaagaatcaaattttggaccgataagtggctagggacagactacactcttgagcagaaatataatcaactttctcggattagtagacagcaaagttccctcatctctagcatgggtaactttaataatgatagctgggagtgggatctcacgtggaggaggaatctatttgatcatgaaaatgatatagttgtgcagtttatggaggaaataagcttcattcctatccagaggcatagtaaggattctatggtgtggctagctgaacaccacgggcattacactactaaatcagcttacaagttcacccaaagtgccactttactcaattctgtgaaggctttgggaaccctgtatatcaggacataa

SEQ ID NO: 73973 - DNA, 520 bp, Glycine max
  Peptide Sequence Number=SeqID_165658
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaattcgctccaagctggactgtatgcacgaaccccccgttcagtccgaccgctgcgccttatccgaggagttagtcttgaagtcatgcgccggttaaggctaaaactgaaaggacaagttttggtgactgcgctcctccaagccagttacctcggttcaaagagttgggtagctcagagaacctttcgaaaaaccgccctgcaaggcgg

SEQ ID NO: 73974 - DNA, 378 bp, Glycine max
  Peptide Sequence Number=SeqID_165659
atgaccaccctcacgcaaatctggatggcgttgctgcttagcaacattctcccaagtgaccatatctcagacctccccctgccgaagtgtcagctggtttatgccatcctgactcagggattacgcctccgagacacccagtggactcggagaagtccaacagggccctgggatttcctgctctcagcagccagaggaggaccagcagcaaccagatgcagttgcaccaccgtcgcctctataggaggtaccatctctggagtccatctccgatcacctacggaggctaaagttctagatgcacaagtacatgcagcatgtgactggcagcaggcagctaatcatagaggccaggtgcaacttaacgaggccagctag

SEQ ID NO: 73975 - DNA, 399 bp, Glycine max
  Peptide Sequence Number=SeqID_165660
atgaaatacgaatgccccgactgtcctgttaatcattactcgatccgaaggccaacacataggatcagaatcctgtgcaccggaggcacgacccggccagttaaggacaggagcgcatcgccggcagaagggacgagccgaccggtgcacaccggaggcggaccgatcgacccaacccaagctggaattaccgcggctgctggcaccagacttgccctccaatggatcctcgttaagggatttagattgtactcattccaattaccagactcaatgagcccggtattgttatttattgtcactacctccccgtgtcaggattgggtaatttgcgcgcctgctgccttccttggatgtggtagccgtttctcaggctccctctccggaatcgaaccctaa

SEQ ID NO: 73976 - DNA, 768 bp, Glycine max
  Peptide Sequence Number=SeqID_165661
atggcagaaccatcaaagaagcgaaagggcacatcaagtcggagtcaacgacattccgaatcacaggaaacactgattccttcctccattccctctggatcattgttttcatccgatgaacagcggatacgtgaaggtgtaccatttgaagatacattgattgatgattggaagttcgatttttccgtgcatgatgcccgccgattggtttgcaccaaccaagcggatatgaccggaaggcttcttgccggttcattggcttttgaaagcctcatccttcattatctaattgtcggcatcctgcttccaagatcttcaaacctttcacaggtttctgaagaagatcttattgttatgtgggcttttcataaaggcttacaaattgattgggcacatcttgttagatatcgcatgcataaggcattgcgattgaatgctccattgccatacccacatctagtcaccctcttccttcaacacttcaatatcccccttgattctgaaccttatgttccaatcaagagatcttttctaataggcgcttcagttattgcatcctttggttatcaaaaagagcatgatggctcttgggttaaaaagggtgctcgacatgttggtgaagaaggacatgatggagaagagtcatctctcctttcaaagattttggataggtttgatggttttcaaacctttgttggtgaaaggtttgataccttggagttacaagtggaaatgcgcttcaatgagatggagtcaataatcaccaag

SEQ ID NO: 73977 - DNA, 428 bp, Glycine max
  Peptide Sequence Number=SeqID_165662
atcgcactttacgacacccttaccagatgcgtgccaaggccagaataataagtgaaattgaagaagtacatgaacaaatgaaggccgatatggaggccatgaaggaacaaatgacaatgatgatggaagcaatgatgagcatgaggaagatgatggaggataacactgctacagttgttgttgcgagtactgctactaagatggacccaatccacctgaccagtttcaatcaagtgaatcgtccagttttagatgtagtaggatataccactaaagggggagagaggccttccacagtacttgagaaggaaaggattgaacatatggaggagaggctacgcgtcgttgaaggagaaggaaattatgcctttgctgacatggcagaattgtgcttggtatcagatatggttatttctccaaagttcaag

SEQ ID NO: 73978 - DNA, 354 bp, Glycine max
  Peptide Sequence Number=SeqID_165663
atgcctcaaaatgttctttacgatgccattggatatatcaacggtgttggaacctcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 73979 - DNA, 561 bp, Glycine max
  Peptide Sequence Number=SeqID_165664
atggctccggaaaagctttccgcgaagagatctaggagggacaccgcggctgaagggaccagtgctacccccgagtttgatagccaccgttgcaagagcgccgagcaccagcagcgcttcgagggcatcaaaggatggtcgttccatagagagagatgcgtccagctcagggacgatgagtacacagattttcaagaggagatagctcgccgacattgggcgtcgctggtgcctcccatggctaagtttgaccctgatatagtcttggagttttatgctaatgcttggcccacagaagagggagtgcgagacatgcggtcatgggtgaggggtcagtggattccctttgacacagatgccctcggcaagttcctgggtgacccgctagtgttggaggaaggccaggagtgcgagtttagtcagaggaggaacaaggccgatgggttcgacgaggaggccattgcccagctattatgcacaccgggtgcggatcatgcgcaccagcatgaacaccttgacccagatgtggatgacattgctgctcagcaatgtcttgcctag

SEQ ID NO: 73980 - DNA, 2148 bp, Glycine max
  Peptide Sequence Number=SeqID_165665
atgccaccgtctccggccaccgctctcgctctccagcttacagatctagctgttgaaatgaatggagtgcagaacagaagggttcacaatgttgagaaaccttttccaggatgcctgggaagaatggtgaatctctttgatttgactggggatgtaaatggaaacaagctactcacggacaggcctcatcgtgatgcatcttcactctcaagaagtcaatcagatgttgcaaggatcatgagtcctaccttgggtgatcagatagaggataagctgattgtttctgactcaatgagagctacaaataagaaaataaatggaacacccatcaagatgctcatagaccaagaaatgtccaaagaagttgtttccaagcacaactcaccaccaaatgtagttgcaaaattaatggggcttgaagccttcccacagggtgagccaaatttatctgtggagagaagccatagaggagattattctcaacatatgtgtggtcaatcagggacaccattcaaccactggcacctggaagatagatttatggacaaggaaatgcttcatgaagttcatccaaacacagaacagattgcttacaaagatatttatgaaatatggctgcaatcacagagaacaagcaatgtaagagacaagacaccggagagagaaaagtggactgaagatgttaatgggaagaaaatggctctcattcgccagaaatttatggaagctaaacgtctgtctacagatgagaggctacgccagtccaaggagtttgaggaggccttggaagttttaagttccaataatgatctgttagtcaggttattggattctcaaaatctttatgaacttcagtctactccagtagcagagactaagcgtattactgttcttaaaccttcgaagatggttgacaatgaaaattctggtggaaaggggaagaaaaacgacaagcagattaagaaaacagcaaatgttggtgctggatgggagaaatacagtcctgcgtactccccagctagtcagaaaattgacaagtttccagttcaacctactcgaatagtggtattgaagcctagccctgggaagacacatgagattaaggctgtggcttcacctactatgccatcacctcaaaatctgcagagtggaaatttctaccaggaacctgaggatgatgatgtactggaatcaagaaaagtgccaagtgaaattacacaacaaatgcatgaaaatctgaggagccatcaaagagatgaaacattgtattcttcagtattctccaatggctatactggcgatgagagttcattcaacaagtcagatcatgagtacactgcagggaacttcagtgatttggaagttatgtccccatctccaagacattcttgggattacgtcaatcgctgtggcagtcctttttcttcctcatccttcagccgtgcatcttgttctcctgagtcgtcagtatgcagagaggccaagaaacgactctctgaaagatgggccatgatgtcatcaagtaagggttctcaagaacaaaggcatgtgcgtagaagctctaccttgggtgagatgcttgctctttcggatataaagaaatctgtaatatctgagtttgagggtattcataaagaacaggagccaagtgaatctgcttcttgtagtcgaaattttagtgctgaaacatgtgtggatggttctcctagaaacctttctaggtcaaaatctgttccgacatcttctactgtctatgaaaatgggctcaatgttgaagtttgtgataatgatgctggcaaagcacatgggtctggggagctgacaaagtcaaagagtatgaaatcatcgtttaaagggaaagttactagtttcttcttctcaaggaataagaaaccatccagagaaaaatcttgtctatctcaatctaaaattgaatcccaatccactgtcattgaagcatcagattctccagtgaatttgtctagagtccttacggatgatgtgtctcaaagtttcaacagtggatccatcggacagtgttctcttccagctccatatgaatcatcaggcaaaattttagcagattctaactctaatggacaaggtgttgtaccactggagattgcggaatgtcctaggatcatataa

SEQ ID NO: 73981 - DNA, 540 bp, Glycine max
  Peptide Sequence Number=SeqID_165666
atgggtcagggaacaccgggcggtctgaaccggcagggtcttccgggggaccggaagccggacggcggcgacaagaaggagaagaagttcgagccggcggcgccgccggcccgcgtgggccgtaagcagcgtaagcagaagggcccggaggcggcggcgcggctgccgacggtgacgccgctgtcgaagtgcaagctaaggctgctgaagctggagcgcataaaggactacctcttgatggaggaggagttcgtggcgaaccaggagaggctgaagccgcaggaggagaaggccgaggaagacagatccaaggtcgatgatctccgaggttctcctatgagcgttggtaacctagaggaactcattgacgagagtcatgccatagtttcgtcctcggtggggcccgagtactatgttggtatcttgtctttcgtcgataaggatcagctcgagcctggatgcgctattttgatgcataacaaggtagggttagggtatgctgctgatttgttgaattgttttagcgttttgattgattga

SEQ ID NO: 73982 - DNA, 672 bp, Glycine max
  Peptide Sequence Number=SeqID_165667
atgataatcaatggtcacgttataataatgatgatggcagaaaaaaaatattggggagggcgaggacgagggcgagggcgaggacgagggcgagggcggccggctaaaattccggtgccaccgtcaacaactactcaaaaatcaccaccgaaattgaacccggaacctagcaatgctagtcatgaagttactgttgaagactatgtgagctctgaggatgatgaatctgaagaaaccccaattccttcaactaacctaccgaactgcaatgtaccagagaaacctaaagaggagacgaacgaaaataaggtaccaagaaagctatggactgatgtaattagtggaaatcgtaagcctgagaatgggatggctcttgagttttttgctccaaagattgtggaaggaaagtcgattgctgaaattgaacctgaagacatcattggtgagcttaaatattgggaatctgctttgattatgtatgtcatagggagagatcttagtatgaattctgttaagcaattcatggaaaagaattggagttttgtgaaattgccagatctgttctataatgatgaaggatacttcattatgcgtttccattcttcccaggacaaggatgaaattttatcgaagggtccttacacaattatgaacatgactatgctcctttag

SEQ ID NO: 73983 - DNA, 441 bp, Glycine max
  Peptide Sequence Number=SeqID_165668
atgtcgggtcgtggaaagggaggcaagggtttgggtaagggaggagccaagaggcacaggaaggtgctccgcgataacatccagggaatcacaaaacccgccattcgccgtttggctcgcagaggcggcgtcaagagaatcagtggcctcatctatgaagaaacccgcggcgtccttaagatcttcctcgagaacgttattcgcgacgctgttacctacaccgagcatgctaggaggaagactgttaccgctatggatgttgtttatgctctcaagaggcagggcaggactctctatggtttcggtgcctttcttgttaggtgtattgttatttttgcttcaattgaaatggaacaaagagtgttttgtttctggaattctcttcttgttgaagcttttgtgatcgttattgcgtctgttcttaccgtgctcaaagggtag

SEQ ID NO: 73984 - DNA, 657 bp, Glycine max
  Peptide Sequence Number=SeqID_165669
atggtgcgaaaagcggtcttcagtgtgtcctgtggcgccattaagatctggtggaagccctgccggagatccagtttggaaaaacaggtggcgatgcctagttcatcgaggagctcatcgatggtggggatagggaagcagtccttcttcttcaccagcagcaccagtgaggagaacggggctatggctgagggtgatgaggccggtcgacagaagttcattcacctgacgttcaatctctgctttctgaaaataagggtagcggtacaggcttatgttcatgaggtgggaatatcggagaagaaggtggtggattgcggggagagggcggcggagttgcaaggaggaggtgtccgcgggggtggttggtgcatcaacgtggagggtgattggacggccgtcgaggtggaattgcatggtcagcgaggcgtaatcagtgacaacaggtccgagttgtatgagccactgaatgcccaagacgatgtcagcaccgttgatgggaaggacgtgaaggtccacggtgaacgtcgtgccctgaaggaggatgggagcttggtagcatacatgggtgcaaggaatgacggtgtcgttaccgacagtaacctggaggggaagggtgggggaggagggaagacggagatgctaggccacccgtga

SEQ ID NO: 73985 - DNA, 1122 bp, Glycine max
  Peptide Sequence Number=SeqID_165670
atgagaacagagtcaaagaagatatctaagtcttcgtggccaaaattagccgtgagaaagtggctcaatataaagagtagtgctgagcggtttcactcagactatgatgcaacaacagcaattgcgaaggaaaggagaaggagttgttccgaccgagatcgttacgtcgtcgtaccggatgatttatcagaggggtgggtgatggattctacaagcggaatgaagaagaaatcagctcctggtcctggcactgggggtccagacctcaggatgttcgtggggacgtggaatgtcggagggaagtcaccgaacgaaggcttcaatttgaggaattggcttacgtgtccttccccagctgacatctatattatagggttccaagaaattgtaccgctaaatgcggggaacgtgctggggccggaggacagtgggccagcagcgaagtggctggggcttattcgtgaagccttgaacagcaacgaggagttggataatactggacaaaactctcccaagagttcaccacgctattgcttagcagcaagcaagcaaatggttggcatcttcttgtccgtgtgggtacgagctgatctttgcaaccatgtcaccaatttgaaagtatcttgcgttggcagaggcatcatgggctatcttggaaataagggatcaacatcaattagcatgacattgtacaacaccacattctgcttcgtttgcacccacttgacttctggggagaaatttggtgacgagttgcgaaggaacttggacgtctccgaaatcttgaagaaaactaagttttatcactcgtttaagtctcttgctcatccactccctcctgaaagcatactagaacacgataatattatttggcttggcgatttgaattatcggctagcttctggctacgatgacacacatgaactactaaagaagaataattggcaggcattactagaaaaggatcagttaaggatagagcagaaagctggtcgagtattcaaaggttggaatgaagggaacatatactttgctcccacttacaaatacttgaccaattctgaccactatgttgcccaatcctccaaatccaagataaaacgacggactcctgcttggtaa

SEQ ID NO: 73986 - DNA, 860 bp, Glycine max
  Peptide Sequence Number=SeqID_165671
atggaagccaatgctaagataaagaaatatgaggagacagttaaacatttgtataaacttttaaagaaagtttgccaagaaagagacgaagcaagaggccaacttcaattgataaggaatttccaagcatctaccccagctgagacaagcagtactattccacaagttgatcatccatgcctccaatacaaaacaaagccatcattgaatagcaccaagagcttatctcacacaagaattgctgaaccaagcaacttgaccttaacaaagcaaccaaatcatatgaaggcagacataggtgcttcaagagataataatatggttgatggtgcttccctagtgtttgataaacttgtttgtgggaaacccttgcctcaaattggtagattgttgcaaagtgtaacagaagctggacctttgcttcaaacacttctagttgctcctgctccacagtggcaaaatcctccttctttgtcttcctctggccttacacttggtacacaagacaatagctcttctactaacacagatgataaggcaaatgttaatccaaatggattcattccaacttctttgggtttggtatttccagggaattctcatgtaccttctcagatgtcttatgcatccggttttgggttagcgctaaagaatgaactggttcttcctacaatgtactgcaagcaggaggttaggaatggaatggttccaaaccatgcttatccatttgtgttttacaggggaatgccacgcaatgggtcaccccctggaggcctgatgataaagacgtaccgtgaggctgcaaggactgaagttgaagtctggttgaggctagccagacatgatgttgacggtgcacg

SEQ ID NO: 73987 - DNA, 411 bp, Glycine max
  Peptide Sequence Number=SeqID_165672
atggaagaaaagaaaccgaaagtgaacgaaataaagatgaaagcgaaaaaaacaagaaatgaattgaaggtctcggattcaaaaacttacccgttgaagaacgaagaacggatgaagaacggtgaagaacgacggaaaaccttcacggatttgctcacagaaatgtctcggaagcgttgcggaaacacctcagcttggattttcttcacggaaacaatttattttcacccaaaacagctgaaatgcatagccaggggggttggggatatttggaacagccccctttcgcctatttataggaaaaagggggaggaggttgccgcccagctcgcccaggcgaactgggttgattcctccagaaccaaccctgcttccaaaatattctggaaggccccagattcaaaaatttga

SEQ ID NO: 73988 - DNA, 375 bp, Glycine max
  Peptide Sequence Number=SeqID_165673
gtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaattcgatcagccattggtgggtaccacgaatggctgaaagttcatatacgaggtttagattggctcgccaagttaaaagtcgtcagcaaagagagttttgaagcaccggaagaggacgaagaagtccaagctctcaaagcgagttag

SEQ ID NO: 73989 - DNA, 333 bp, Glycine max
  Peptide Sequence Number=SeqID_165674
atggcttccggggattccataaaatttctgaaaaccttggattttccgtcgttcttcaccgttcttcaccgttcttcgtgcgttctttgttcttcaaccggtctgagttcctcatcgcaattgaggatacataggagcaaaagccccgcttttgttgaccaccccaagagatcgttaatggtccaacgccttaacgtttctctcatttcaaaaaccaagagatcgttaatggtccaacgccttaacgtttctctcctttcaaaaaccaagagatcattaatggtccaacgccttaaagtttctctcctttccaaaaatcaaaagatcgtttaa

SEQ ID NO: 73990 - DNA, 189 bp, Glycine max
  misc_feature (45)..(45): n is a, c, g, or t
  Peptide Sequence Number=SeqID_165675
gtgctccagtggcttctgtttctatcagctgtccctcctgttcangctactgacggggtggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 73991 - DNA, 480 bp, Glycine max
  Peptide Sequence Number=SeqID_165676
tgtcgtgctgctaggcgaagcagcagagaatgctgcaccctagatggcgagagtccagtagccgaaagcatcactagcttacgctctgacccgagtagcatggggcacgtggaatcccgtgtgaatcagcaaggaccaccttgcaaggctaaatactcctgggtgaccgatagtgaagtagtaccggaaaccaccggagccgtagcgaaagcgagtcttcacagggcaattgtcactgcttatggacccgaacctgggggtgaaatgccactcgaacccagagctagctggttctccccgaaatgcgttgaggcgcagcagttgactagacatctaggggtaaagcactgtttcggtgcgggccgcgagagcgggaaacagcccggatcaccagctaaggccctaaatgaccgctcagtgataaaggaggtaggggtgcagagacaaccaggaggtttgcctagaagcagccacccttga

SEQ ID NO: 73992 - DNA, 152 bp, Glycine max
  Peptide Sequence Number=SeqID_165677
actgccgtcccttgttgatggaagcttgcttgtggagcttctatggaggctggatctttgagcttcaatgtggtccttcaatggtgatttttcaccatggagatgcagcagaaggcaaaggagaagaggagaggggaggcaccatccactag

SEQ ID NO: 73993 - DNA, 405 bp, Glycine max
  Peptide Sequence Number=SeqID_165678
atgaaagcaactttcactgacacccctcatcagtgcccaacatacccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 73994 - DNA, 615 bp, Glycine max
  Peptide Sequence Number=SeqID_165679
atgaaaggaatatcctatcgagggaatcatatttgcttcggaagatatgctcttcaagcacttgagccagcttggataacatctagacaaatagaagcgggacggcgggcaatgtcacgaaatgttcgccgaggtggacaaatatgggtacgcatatttccagacaaaccggttacagtaagacctactgaaacacgtatgggttcaggaaaaggttctcccgaatattgggtagctgtcgttaaacctgggaaaatactttatgaaatgggtgggctgataatagccggagcacgcgaactgatgtgtattcgaatcctaggagctagtaatcgacgatatgcttatattggtgacattgttgttgctgtaatcaaacaagcagtaccaaatacgaacttagaaagatcagaagtgatcagagctgtaattgtacgtacttgtaaagaactcaaacgtagcaacggtataataattcagtatgatgataatgctgcagttgtcattgatcaagaaggaaatccaaaaggaactcgaatcttttgtgcaatcgcccgggaattgagacagttaaatttcactaaaatagtttcattagcacccgaggtattataa

SEQ ID NO: 73995 - DNA, 357 bp, Glycine max
  Peptide Sequence Number=SeqID_165680
atgcagattgtatatgaccgtatgaacagattaaacaaccttcatgtttatatagcagtgtgcgtatctgggctgcaacaacttgcgctggataagatctatcattctcctgaagaatctgcacttaaagatctaaaagataaagatgtcctggacattgtatccgacatcgtggatcctgcagcttcaattcttcacttgacttttatcttgccttgtgcattgtacagcaactccagtattttcgggcaggatgtcctggacattgtatccgacatcgtggatcctgcagcttcaattcttcatttgacattttatcttgccttgtgcattgtgcagcccgatctgattccttga

SEQ ID NO: 73996 - DNA, 382 bp, Glycine max
  Peptide Sequence Number=SeqID_165681
cctcctttcgggttactgcaaagaaagggatggctcttgggtaaagaagaatgctccaatacaagctgctgaagatcgctctccatcaccacattctcagagagatgactcttcatctcttttgcacagtattcttgaaaggtttgatggacttcaaacctatgtaggattgtcatcatcaaaagggggagattgtggaagcaatgccttccaagattattttgatgatgccaaagaatcaagagttaagcaaattccaaagattcaagaatcaagtttcaagaatcaagattcaagaatcaagaatcaagtttcaagaacaaacaagatcaagattcaagactcaagattcaagaatcaagagaagactcaatcaagataa

SEQ ID NO: 73997 - DNA, 323 bp, Glycine max
  Peptide Sequence Number=SeqID_165682
cctcttcctcaatacaagaagaagaagaagaagaagaaaaagaagaagaagaagaagaagaagaagaagaatttgatgatgaagaggacttctcactttttgtgaagaagtttcataaatttgtcaaaaatagaagaatggagagaaaccataacttcaacaatgggaagagatcccaagaagtttctcgacacttaaatgctataagtgtaatcaacccggcgtatattgcttgggatgacaatgactcatctgatggttcgaagaaggagattaaccttctatccatggactatgaaagtgatgaaaacatctctcaagaa

SEQ ID NO: 73998 - DNA, 608 bp, Glycine max
  Peptide Sequence Number=SeqID_165683
ggggaaagataaaactgaagaccccggaagaagcaacagagctaattgagaacatgtcagcgagtggtcatgccattctacgagatagaacccaccaacccatgaagaaaagcttgatagagctatcatcgcatgacgcgttattggcacagaacaagttacaggttgtaccatctgtggtgaggctcatgaaacaagccaatggtccatataatcaacaaggacagtggaggacacaccctagcaatcagttcaacaaagaccaaagtgggccttcaaacatgccaatccaacaaggacctaacatattccagagaactactaagttggaggagaccttgactcagtttatgcaggtaacaatgtcaaatcataaaagcactgagtcatcactgaagaaccttgaggtccaagtgggacaactggccaagcagatagctgacaagtcatccaacagttttgtggcaaatacagaacaaaatcctaaggaggaatgcaaaactgtgataacaaggagtaaaaggtttgtggaggttgaggatgaggatagtgttgtgcatgagaagaaaattgctgacaagaaaagtactgatggcaagaaaaataag

SEQ ID NO: 73999 - DNA, 366 bp, Glycine max
  Peptide Sequence Number=SeqID_165684
atgccgcctaccaggcaccctctagacccagataagtctaacagggccctgggttttccagcattgatcacgggtctctgccagtcgttcgatgttcccgtcacacctagtaagagaagtattgctcgcctagacaggcgcaaggtggcgcacccgcaggccccagacgcaccgccgccacctcatcaggctgatccagctgggtcatttgacacagagcgggtagaggtcgcatggcccagagattggcctgaggcccaggcaggggaggcacccgcagaggctcccggcgatgcagatgaggcccgcatggacgaggagatgacagatttactcgatttcttgggagggagcggagccacatga

SEQ ID NO: 74000 - DNA, 327 bp, Glycine max
  Peptide Sequence Number=SeqID_165685
atggctctgaaaaagatttccacgaagaggtttagaagagacaccgcaacggaagggtccagtgctgcccctgagtttgatagccaccgtttccggagcgccgagcaccagcagcgcttcgaggccatcaaaggatggtcgttccatagagagaggcacgtccagcttagaaaggatgaatatacggactttcagggggagatagctcgtagacattggacgtcgctggtgactcccatggttaagtttgacccagagatagtcctagagttctatgccatgcttgacccacagaggagggagtgcgagatatgcgttcatgggtga

SEQ ID NO: 74001 - DNA, 276 bp, Glycine max
  Peptide Sequence Number=SeqID_165686
atgtacatccccgtgttacgcttttgcatgtctgcatcatgttgtcacacatgcattgtatgttggtctcgtctttttgtcatgggaagccagaagatccatatcaccttcttaactacacacatggggcactgcacccccaagtgtgcaactcatgattttacgaaaaaggttaatcaagtcaagttgaagtatggaagtaaccatcttgcaaaaattggggcaaaagatggatcgggttacatcgttgcttcgtctactgccaaacacatttag

SEQ ID NO: 74002 - DNA, 435 bp, Glycine max
  Peptide Sequence Number=SeqID_165687
atgtttctctttctttgttttgaagctcattgcaagcctcaagtgaaaaaccatgatctcaccttaaccttaaggaattttggagctttggaattgttagctcctacctcccacaccttagacttgaatatggacagagctaggttggtttatggcttagtcacagggatggacatgaacattggcggcttgatctctggacagataaccattatggctcagtccaactcttctcgcctaggcttcccagctttaatcacagccttgtgcaggtcgaggggagttggatctgatgctcttacttcttacaagagcctgaggccggtcattaacttggcctatattaaaaggaaatgttggaatgtgaatgaccaaacagttaattttccaggggcaaggaaaaccaggtccagagcagctggtgttctgcactag

SEQ ID NO: 74003 - DNA, 575 bp, Glycine max
  Peptide Sequence Number=SeqID_165688
atggacgttgataagatccttccatctagcagcaccttaggatggcatagccttaaagttaagggcgaggttcaaacgaagaaaggcttatggtggatacctaggcacccagagacgaggaagggcgtagtaagcgacgaaatgcttcggggagttgaaaataagcgtagatccggggattcccgatataggtcaacctttcgaactgctgctgaatccacgggcaggcaagagacaacctgcctaaaccgtgaaaacggggttgtgggagagctatacaagtgtcgtgctgctaggcgaagcagcagagaatgctgcaccctagatggcgagagtccagtagccgaaagcatcactagcttacgctctgacccgagtagcatggggcacgtggaatcccgtgtgaatcagcaaggaccaccttgcaaggctaaatactcctgggtgaccgatagtgaagtagtaccaatgagccggcgactcataggcagtggcttggttagggaaaccaccggagccgtagcgaaagcgagtcttcacagggcaattgtcactgcttatggacccgaacctgg

SEQ ID NO: 74004 - DNA, 615 bp, Glycine max
  Peptide Sequence Number=SeqID_165689
atggcacaacctccaccccgtgagaggactctaagggaaatggctgcacctgatttcacctacgaaagcttgtgcatccaataccctgatgaggatgtcccatatgttcttaaaactggactgatccatttgcttccaaagtttcatggccttgcaggtgaagacccgcacaaacatctgaaagaattccatattgtctgctccaccatgaaacccctagatgtccaggaggatcacatatttctgaaggcttttcctcattctttagagggagtggcaaaggactggctatattaccttactccaaggtacaatcccgggtggaggaatcatcccaaccttagatggtcgaatccttcacaacagcagcaacaacaacaacaaccttattttcagaatgttgttggcccaagcagaccatacgttcctccaccaatccaacagcaacaacaacaacagcaacagccccagaaacatcaaacagttgaggctcctccgcaaccttcccttgaagaacttgtgaggcaaatgactatgcaaaacatgcagtttcaacaagagaccatagcctccattcagagcttaactaatcagatgggacaattggctacatag

SEQ ID NO: 74005 - DNA, 177 bp, Glycine max
  Peptide Sequence Number=SeqID_165690
atgaagttggaaattggaagtggaaattattggaagttgaaagttgaaaatggaagttggaagttggaagttggaagttggaagtggaagttactggaagttggaagttggaagtggaagttattggaagttgaaagtttaaaatggaagttggaagtggaagttactggaagttga

SEQ ID NO: 74006 - DNA, 426 bp, Glycine max
  Peptide Sequence Number=SeqID_165691
atggcacaacctccaccccgtgagaggactctaagggaaatggctgcaccagatttcacctacaaaagcttgtgcatccaataccctgatgaggaagttccatatccaccagatgttcaggaggatcacatatttgtgaaggcctttcctcattctttagagggagtggcaaaggactggctatattaccttgctccaagcaacatggagagaagtatgatagatgctgccagtggtggagcccttcgagacatgacccctgctgaagccagaaatttaattgagaagacagcttcaaactcccagcaatttagtgccagaagtgatgctattgtcattagaggagtgcataaagtagccacaaattcatcttcatcagctgagactaaaaagcttaaaggtaaactagatgccttggttaacctg

SEQ ID NO: 74007 - DNA, 390 bp, Glycine max
  Peptide Sequence Number=SeqID_165692
atgacggacaaaagaaaagttttaggaaaaaataatgaggaaacaagaagttattttacatggaatttggaaatggaacgtgtattggctgatgtacttagagatcaaaggaatttgggcaacaagggggacggaggttggaaaaggtcaatattgaatgttgtagccgcagttttatctacaagcttcaatgttaatgtcacatcagataatgtcaaaaaccgtatcaaattatggagaagtggatttgattgggatgacactaagcacatgatcacagttgagaatgaaaatgcttggaatgaatattgcacttcacataaatcggctaaaccgtttcgatacaaggtgcttcaaaattgggatgatatagtggatttgtgtgcttaa

SEQ ID NO: 74008 - DNA, 730 bp, Glycine max
  Peptide Sequence Number=SeqID_165693
ggaaacatcccttagcaccgccatacctcttgagcttgaggttattcctcaagtaaaggagttgttggatgagggtttggttcgcaagagcttaaatcctcgtgctttgttggtgcctaaaataggcattattaggcaccaaatccctatgataggtggtataatgaatgtgttgagtggtgcaacactcttttgtaaaatcactcatgcacccaacatcttcatgatttgtgtacatagagactcattaggtaggtttgttcttattttttatttcaatgcaaacctaggtgctcatgtgggacaccttagtgatcaagggcttcccatggaccctaagagaataaaggtcattcctgagtggcctactccaccaacaccactcattgagttggtgaggaaccatgttccctcatgggaagatatccatgaaaggggtgtcgagggaagaagcctagagtatgaagaacctcgggatttgaggtcaaatcctttccaaggtggaggggatgatgcaatcctaccccccaaggctctagcttctttaggaatcttctcaaggaagcttctcaaggaggtgagcttagctattataggggaaaacccccttacctcttgtagtctccacatgaaagagaagggtaaagccaagaatgaagttcttgagtcaaaacaatctttaacaaaactcaagagcatgagagaagactcaagtgatgaagaagaatga

SEQ ID NO: 74009 - DNA, 307 bp, Glycine max
  Peptide Sequence Number=SeqID_165694
atggagcacattgttcaaatgaagggaagattgaatttgaatgttaccacaaccagtaatgggggtatgagaaccattagcaacagtgatgtgttggagcaagagctagatgtcttattgaaaggatccataaaggctcgtagatgttccaatgacgacggtggaaagtggctgacggcggaggacggcatcgaacggcgaccaatgccttacccttgcatatgcaaagaggctgtttccggattcgaacccatgaccaacaagtcaccaaggcgcaactttaccgctgcaccagggctcgccctca

SEQ ID NO: 74010 - DNA, 516 bp, Glycine max
  Peptide Sequence Number=SeqID_165695
atggaattttcaatgagtcctggaattttcaatgagtccaagttcccctatgttgatatgtttgaaaattctactcctgtcagtcagtctacttcctcatccataccctttcagtttccctccattcctatagttcaatctccaaatttatcccaacctacttctactccctcccaacctactcaaactcatatctcatccacttctgtccattcccattcttctgatgctgatcactccccttctgtgtctgcacaatcatctcctattcatcagcctgctcagtctaaaatagaaatacctacctctaatccaacacagttgtctgagcataacactacagatcagtctcctcctattactgatgtttctgttccaggtatcagttcagaagctacttcctcatctatggatcctacttcttctcacagacctgtgaacacgcatcctatgcaaaccagatctatgtgtttagcaacaagcattgtgattatgcaagctgaaaactactgctga

SEQ ID NO: 74011 - DNA, 1920 bp, Glycine max
  Peptide Sequence Number=SeqID_165696
atggcatctgccagtcctacgttctccttctctggaactcccaccatcactactgcaaaactcaattggaagaactacttgtcttggtctacctcagtggagttgtggtttcttggccaaggctatcagaccacttggaaaaaggagctagtgctgttccaaatgacaagagacctgagtggaaaaaacttgactttcaactatgtgctgtgccgtggcaatctgttgagccggatgttttggaaatccttagatcattcaaaacataccaaccatgatatgcttgcacatataggtaaagctcgagcggcagtggaagagttaaaaaggtttcttgtgactgattctttggaggaagtaaataggaagctgaataagttttgcatggttcttattttgagaagtttacattcagattttgatcatgtgcatgatcaaattctgtcaatggactctttagttactagacttcttcgtgtgtcccatgtgttgaaagatgaaaacttagctgaagtcgtggaaacatcggccatggtagcacctcgtggaagaggagcaatggacatcctcaatgcacctattgcaagaggatgggtcatactcaagaaaattgttactccttacatggctttccgacaaggaacatggtacgggtcgtctgattggagaaggacggcgagccctggtgcagcggtaaagttgtgccttggtgacttgttggtcatgggttcgaatccggaaacagcctctttgcatatgcaagggcacccaaacacagaaaggctatatgctaatccccccctaaacacaaaaaccttccctaatattactggaccaggagtggaatcggatgattctgtttctgtggtgccaaatacaccatgtcaaggatatccaccaagtctgccagcgctgtatgttaatgtcctccacaatacaggggtacagccgcttctggatggtgtaattagttatctgccatgtccaatagaagttagtaattatgcccttgaccaagctaagaatgaggacaaggttgagttgcgtggaagtcctgatgggccacttgtggcattggctttcaagttggaggaagggcggtttggtcagttaacatatctaagaatttacgagggtgtgattcggaagggtgattttattattaatgtaaacactggcaagaagatcaaggttcctcgtttggttcggatgcattctgatgagatggaggacattcaagaggctcatgctgggcaaatagttgctgtatttggtgtcgaatgtgcatcaggtgtttgccaagaatcttttgctggagatacttttactgacggttcagttaaatacacaatgacttctatgaatgttcctgagccagtgatgtcattagccgtacagccggtttctaaagattctggagggcaattttcaaaagctttgaatcgcttccaaaaagaagatcctacatttcgtgttggcttggacccggagagtgggcagacaatcatttctggaatgggggaactgcatttagatatctatgttgaacgcattaggagagagtataaggttgatgcttcagttggaaaaccccgtgttaacttcagagaaactgttactcaacgtgctgattttgactatttgcataagaagcaaagtggaggacaagatcgtgctggattgctgtggaagatcgatgcttgcagctgcacggtgcttgtttgcaaattcctatttggcttgaatgtgggtcaggattgtgacctgggcaatccttttgactcatccaaagtgatggatgatgctttactcctagcatggtcctggctaaaaggtggcaccataggtgtcttgtatttgtttatatttcaccagtacctctggatgggaatgggaatgggattgctgttttgtaactag

SEQ ID NO: 74012 - DNA, 1335 bp, Glycine max
  Peptide Sequence Number=SeqID_165697
atgcagattatagttagaacaaaaggtttgggttggactttaggtagggttataggaagagctctagggagagaagtaaatcgtgatttggatgaagctctccagcggcgaaggcccacaacatctgcatataggcaaagggaagctgcacctgttgctgaggatcctgaagaagcagctgttgatgatgtagttccttatgtagatggttttctgggtggaacccatgacacatcagttctgattggctatgttcatcatgttgcagaacgtcctgagttgaagttatcctctcatggaaggaaggttgagaaatttggtaggcctactccagagattgaaggattagtagctgtcacaggattaagtcccatgatcgcatgttccttgggcactggcgattggggacttatatcagcttttgtggagaggtggcataaggaaactagtagttttcatcttccagtaggagaggtgactatcacctttgatgatgtggcatcgttgcttcatctgcccatcataggcgcctttcatagcttcaaggttcttcatatggacgaagttgtgttgctgttagttgaattgcttgaagttagtgcaaatgaagcaaacgttgagacaatacaatgttgcactctctttgctaacaaaagtgtggtattcttggatgcctttcgtgacctcacccagagtggaagctatgcatggggatctgccgccctagtccatatgtatgaaaatttgaatgatgcatctaagagcagtgccaaacaacttgcaggatatatcacacttttacagtctgggaaggcattaccagtgttgacatatcaggagcgactgaatagattgacgtctgatgttgagtactggattccttatgatgaccatcgtgcatatagagaattcaagctgatttcactattttccagacgcatccgatggggtccatctgttgtcatacaccgaccagagaggattgtgcgacagtttgggtatgctggggatccacctagacatccacctgtggttcacgatgacacatttattgaaatatatattcctcaacacctaatgacggcaaaagctatggaggaagcacctgcagatgcacttggtcatgtagagaagcctcgacatgcagtggaggcttgccaaacaatagctgaaaggttggaatggttgctcaacctaaggatagtgacaaacggtacaaaagcatacattgtcatggaagactgcttaaggatctcccaatgtgtgatgcggaacacaatgtatacgtgtagtcacaatgaaggcagcatatggaagacgcatgaagacctttag

SEQ ID NO: 74013 - DNA, 699 bp, Glycine max
  Peptide Sequence Number=SeqID_165698
atgatgattggatgtggaattacctggatgttgtggaagcttgggaggattgatggggacccgacgttgagaggaacgaggataagggctacgtgggagtacatgagctcagttggaggtgggcaacaggggatggtggagtggtacctggagatatgtcgcgggggtcaggagaccttggggacgtcaggtggggtgctatttcccaaaaccaagcttgaccaatcccaacccaacccgggcatagtcagtcagcttgaaaacgaggtcaggaagctaggaaggcttctgatcgtgatggcggcgcagctaatccatgatcgagtggagatggagtgcctagagggagcttgggagaccctcgaaggcaacacgaggtgcctatttcggggcacgattcgatttacggctacttcattggtgcatccagatgaacccgcgcgcacgcttcagcgtactgtggagtggatactacccacgcctacaccataccgtctcgtggagccagtccaagtgatcaaggatcctgaggagctacctcctgagcctgctgtggatgctcttgactttctagagggtgatgaggacccactccctgaggtggattctcccgaggacgtcatgtcggcatctgaggcagactctacggaggatagtggccctggagagatggcgatcagtggaggctcttcatcatag

SEQ ID NO: 74014 - DNA, 222 bp, Glycine max
  Peptide Sequence Number=SeqID_165699
ggtacatcctttgtggtacaagtagagggtacatctacttgggtttgactgagaacaagaaagggtacatctcttgtggatcagttctagtggagggtacatccactagggtttcaaagagaacaagggaggcaaaggcggctcgtggtggtcaccagtggtcagtggtggtggaggaggaggttgggggtgttgggcgagggtttaggggaagagatgcag

SEQ ID NO: 74015 - DNA, 975 bp, Glycine max
  Peptide Sequence Number=SeqID_165700
atggccacaccatttaagacaaaggatgtcaacgaagaaataaccccgaaggatattaggagcctaatggaacaggctaattacaccaacaaataccttcaggtgttaggggaatctattagtaaagaaaaggtctttactaaaccaaaggaccatgggtcgtcatcatcagccattcaaaaggaaaaacctttgttcaaaccttttaaggttagcgaaaaagccaaacagagattcagggaacttagaaaacaaaaattacctaatgaggaggtagaacaagtgtctgaagaaggttcagtatctgaaaagataattaatccaattaacaccaaacattggaaaacaccttccaaactttattaccaaagaccaaacacccctgatcttctactagaagaaaaaggcaaaaataactttaaaagttttagtgaaaacaacatctatgaatggaatatagatgctcaaatagagtacaacatcatgaatacccttcaacatatgaccatggtggctacggcataccaaacgtcccataagtgtctagaagaaacaattgtagacattcttgtggcaggattctctggtcaattaaaaggatggtgggataattatctcactaacgaagaaaagtcaaaaatctacaacgcaattaaaatggatccaaatgggaaagtcattacaaatgacgataatgaagaaatccctcacactgtcaatacccttatttttacaatcgcccaacattttattggtgacccatcactttggaaagataggtcagcagaattactatccaaccttaagtgtaggactttagcagactttaggtggtccaaagataccttcttgaccagagtctacgccagagaagatagccaacaacctttctggaaagagaaatttctagccggtcttcgaagatcgttaggagataaggttagagataagatccgtagccaagatattccatag

SEQ ID NO: 74016 - DNA, 474 bp, Glycine max
  Peptide Sequence Number=SeqID_165701
atgatttaccacacaaaatttgatgagttcaaggcagacctagaaagaaggaactggcacaaggaattgacaaactttctagatgggagcatcgatgtggcaatagtgaaggagttctacgctaacctttatgatcctgagggtaaatcacccaagcaggtgagggtgagaggccacctaattaagtttgatgaagatgccctcaacaccttcttgaagacaccagtgattatcgaggagggggaagacctcccagcttactccagattctgtcgtttgaggccagatccacaggaactggcaaaccgactattcatccctaggaggggatttgagcttaatgctgatgggctgccattgaagatcttacggaagaatctgaccacgctcgctcagacatggagtgttttatcattctccaacctggcccctacttctcacacgctggcatcacactggacagggccaggttga

SEQ ID NO: 74017 - DNA, 171 bp, Glycine max
  Peptide Sequence Number=SeqID_165702
atgtatcatcaagagaggaaaactctagatgaggcttcactgttatcaagcgagtcggagatccagcatgaccacagatcgacctccacttcttatgactcacacagacccagggtgttgcccgtgctcttgcgtatcctcaggtgcgatgaggaattcagacctacgtag

SEQ ID NO: 74018 - DNA, 192 bp, Glycine max
  Peptide Sequence Number=SeqID_165703
atgagggtgaggaagttgcatgagcatgtgaaagctcaaatcgaaaataaaagggagagttatgctaagcaagctaaaaagggaagaaagaaatttgtttttgaacctggtgatggggcttttgaaagattcattttaaataacaagcaaaagagacagctaaggcgttggaccttgaatgatctcaagtga

SEQ ID NO: 74019 - DNA, 1357 bp, Glycine max
  Peptide Sequence Number=SeqID_165704
atggctactccacccagcgttcctcctcctcctcctactaatgtagcatcacagtcatcgtctaccttgaaatggacaagaaaagccacacgactaagatcattggcgactagaccagctagggcagagagacaggtcgatgtgacatacgagaattggaagcaagtccctactgctcagaaggatttgatatgggaggatattcagtttaagtttgccttgatgtcgaaatgggcacttagagccgacaaggacagtgtcgatgacattagatccttcgtgggaggtatctacgttgtaatcatgagtttcatcaatgttgaatttttgcaggataagctaatggatgagaagacaaataaaaaactggaggaagctggtcaatccggaagcactgaagccatgattgatcctccatctcccatcagacaacacatcaaatggaagatggcccgcacaaagaaaactggccagatgacatccgaggcagcaaagcaaattgctgacaagattgattcgttaaaggagctgacgtcacagggttcctttgttgcccatggacgtcaggatgtactgactgctaccattgggcgaccagaacaccccggttgtgtgcgtgctgctggagtcaatgtgacgatcaagcaatactttggactgactccaaggacctcttgcacgtcttcctctatggctcccgaaggcctagagcacctgactcaacaaatcagggaccaactggaggagtcgatcacagaaaaaggacttgcactgcctcctgagcttgaggttggtcctttagctgcttgtgtcagcgcaaaggagagttgtgttgatcccttagggaaaaatccagactcaagtgattcagacaaatgcgggttgtacatcgaagaaaatcctccccgcctggttggtgttgaggaggttagagatgcagatgctcctattcctgtacctactgaagaggttaagttagtggggcagacacttaacaccttccttgcttggccgacacatctcgtcaagtgtttatcagaacagggagctgtgggaccagcaaaacctgcagataggcaagatcatgaggtcgatgatcccctatatctgatggcattgaccatcccacaactttttctgaagccattgcaggttatgtgggatgctaccatgttcggggtgtttaatgaagacttccccttgtacataaagcatgaagatctgtctgaaatagcacacggtggaaactacaactatgtgcaactgcaaagtactgacacactgattaaagttatattggttgtcaagaaggttgaactaccaaatcttgacagtacagacccggtggggattgttg

SEQ ID NO: 74020 - DNA, 267 bp, Glycine max
  Peptide Sequence Number=SeqID_165705
atggaagagaaggtaaagaaaaaaattaatggaggtttaaggagcacctacttgaagctcttgtgctctgattaccacttgatggaagcttgcttgtggggcttctatggaggctggatctttgagcttaaatggggtcctttaatggtgattttccaccatggagatgcagcggaagacaaaggaaaagaggtagcttccttgagaagctttcttgagaaaatttccttgagaagcttctttgagaaaacttccttgagaggctag

SEQ ID NO: 74021 - DNA, 210 bp, Glycine max
  Peptide Sequence Number=SeqID_165706
atgaccaccataggtaatggggagattgatagggatgtacatggattgaagctagtggatgaagtggccaaatgcttcggttcttgcttgtggggcttctatggaggctggatctttgagcttaaatggggtcctttaatggtgattttccaccatggagatgcagcggaagacaaaggaaaagaggttagaggaggcgccatccattaa

SEQ ID NO: 74022 - DNA, 252 bp, Glycine max
  Peptide Sequence Number=SeqID_165707
atgtcaaatgaaagtgaacccactaatgagaactctcgaaggaatcctcttacactcaaagatgctaacccacagttggagatccgtcctgatgctcatcattcgaataaaatggaatggatgaggagaatgaagaaggtggttggaagaatcactcctccggaattagtgtcacacacaaggtggtgttccttgataaaccaatttcttgaatcactcaaggaactaaggagattcactctcacactttag

SEQ ID NO: 74023 - DNA, 420 bp, Glycine max
  Peptide Sequence Number=SeqID_165708
atggccactgttcagcatctggtgatggacaacaagaagaggatgcccattatttgcaaaaccaggccagacctcaacaaaactttcaaacaagctaccaaggctatagaggtggctcaggggtccacaacaacaacaagctcaaccagacaaattgtccaagatggaagatactttaacacagtttatgcagaagttcaagttggacaactggcaaaacaactatctgaacatggaagtggatctttctcaacaaccacacaggtcaacccaaaggaacattgtaatttagttacaacaaggtgggggactgtgattggtttgaaggataatgatgagaaaatgaataaagaaggagttgaaaaagaaaacaagaaaaatgatgaagtggtgactagtgaaaaagtggaagaaaaatag

SEQ ID NO: 74024 - DNA, 894 bp, Glycine max
  Peptide Sequence Number=SeqID_165709
atgggttacgtgggagtacgtgagctcagttggaggtgggcaacaggggatggtgggtttatgcgcgatttgtggatgtggaaaacttgttgtgcaccatcgcccgaccgccacctagtaccacatgtgatggtggtacctggagatatgtcgcgggggtcaggagaccttggggacgtcaggcgagctcctggcagtcaacagataaaaggaacaaagaccacaaagcaaggaggcttgtgtggtggctggccagctgtgaactttgaatttatatgggatgtggcctctggtaatcgattaccaagagtgggcttgaaaacgaggtcaggaagctatgagggcttctggcagcaggttgtggaggcctctggtaatcgattaccagtctgtgtaatcgattacatagaggaatgggtcactggtaatcgattaccagcgcagctaatccatgatcgagtggagatggagtgcctagagggagtttgggagaccctcgaaggcaacgcgaggtgccgatttcggggcacgattcaattcacggctacttctttggtgcatccagatgaacccgtgcgcacgcttcagcgtactgtggagtggatactacctacacctacaccataccgtctaatggagccagtccaagtgattgaggtaacgtcatccgaggaagaccctgaggaggatcttgaggagctacctctcgagcctgctggggatgctcttgactttctagagggtgatgaggacccactccctgaggtggattctcccgaggaaatcatgtcggcatctgaggcagactctacggaggatagtggcccgagagagatggcgaccagtggaggctcttcatcataccaccactgtggacacctttgctctggatga

SEQ ID NO: 74025 - DNA, 474 bp, Glycine max
  Peptide Sequence Number=SeqID_165710
atgactgttcacgtggcccagataattgctaacgccatttatttgtttgcagggacagcacccactaggcaccctttggacccagagaaatcaaacaaggccctgggatttccgaccttgatcacgagcctctgccagttctacggagtagttgtcatccccagcaaggtaatccggccaccgatcacccgagctttcatcaagaaatattgcacccctaggcaggcacagggggacacacaacaggctgtagacgcaccaccacctcagcagcccgatccgattagaccactgagcgtggagcagtatctacggcatgtggttcactaccaggcggccaacaaccgtgggcaagtgcagttgcatgagtgcttctaccatttcagcctcagccagcaagggcagggctccactccttttatatgccctaccctagagcagttcagggctgaggttgcgtggcctggagattag

SEQ ID NO: 74026 - DNA, 597 bp, Glycine max
  Peptide Sequence Number=SeqID_165711
atgagaggagtgccgtcggaagagagtattgcgcctttcatcacacgaggcttcagtgaccccaatgcaagaatgcttcaaagagtccgaaaagcatggaatgcggtgcaatggaaggataaggagattagagggagcaactataaagccactagttgtgtttgtacctctactgctctcaacatggatgattacaagtctttgcaaattgaatttgaaattttcaaaaaggaccactatgcagaatgtatgaagttgcaaactgagctttcctatcttaaagttctttttagaaaattaaacaaaggaaagagtgatctcaatcacatgctcaacgtgcaaaagcatactaccgataagactggtttggggtataacaagcaaactacattttctaagaaaactaagtttgtatcctcaaaaggggtgaacccagacaaggtgtgcctaaaagcaagagactcactatggtacttggacagtggctactttaggcacatgactggtgacaagtccaaacttacagactttgtgtcaaaagaaggaggatatgtcacttttggagacaacaataaatggaaaattatgggagaatga

SEQ ID NO: 74027 - DNA, 357 bp, Glycine max
  Peptide Sequence Number=SeqID_165712
atgtcctttgtggcacaagtagagggtacatctacttgggttgttatactcagaacaagagagggtacatctcttgtggatcagttcaagtggagggtacatcttggttgttcaaagagaacaagggagggaagacataggtcacatcttagacctcacttccataggagagaaaaggaaagaaagcctcaagaggctaacattatccttccatacttccatggaaaggacaatgtagaggctaacttagattgggaaataagggtagagcaacaacttaaaaggaagtctacttcaaaatcttatggctctcactcttatccaaagaaagaccaaggtcaaggcatcttagggtga

SEQ ID NO: 74028 - DNA, 503 bp, Glycine max
  Peptide Sequence Number=SeqID_165713
gggtagtggacctagcagcgattaatgctttccttgcttatcaccatagcaaggaaagctcggtcattgctattttggccgatttttatgacacgcccgcctatccactgcaaggtcactgcttatacgccaagaaaggaaaggcaaacttggagcaactcttggctagatttccaaatgttcccttgatgggaacaagggattgtattaattataatcccgtcctcgcgataagacagcttggctaccccatgagaggagcaccgtcgaaggaaagcatcaagcctttcatcgcgcggggtttcagtgaccccaatacgagggctgcaagagaggaagaggttgaaactccggaggaaagtgaggaagtgcaaaccctaaaggcggaacttgaaagagcccaagcaatcaaagagaagttcaagtcaacggccatcaaattccggaaagagtacgatgaactaagggatgtcaatatggccaccaccgaagccttggaatga

SEQ ID NO: 74029 - DNA, 483 bp, Glycine max
  Peptide Sequence Number=SeqID_165714
atgcagaacagatgtggatttgaaaggaaaggggatatctgggtcaacgacatacttaatctcggagtctcacctgcaaagcttatagagattgtaaagacacggtttatctcccttggtggagtcatttttgaggggtgcggtgtttcctgcattaatgtatatgaggatgctgcagttctgaaactttctggggacaaaatattgtcatcacgtcttataattgatgccatgggaaacttctcccctgttgtaaaacagataagaggtgggaggaagcctgatggtgtttgccttgtcgttggaacatgtgcacgtggctttgaaacaaactccactagtgatgtcatattcagcagttcatcaataaagaaagttggagattcaaaagcacaattattttgggagggtgtttcacttgacaatttggagatactgagagttatttatggaatatttcccacatatcgccagaggtattaa

SEQ ID NO: 74030 - DNA, 798 bp, Glycine max
  Peptide Sequence Number=SeqID_165715
atggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcaggggggcgtaatttttttaaggcagttattggtgcctagaatattttatctgattaataagatgatcttcttgagatcgtttggtctgcgcgtaatctcttgctctgaaacgaaaaaccgccttgcagggcggttttcgaaggttctctga

SEQ ID NO: 74031 - DNA, 805 bp, Glycine max
  Peptide Sequence Number=SeqID_165716
atcatcgaagtgctgcgcaagaaaaagcgacgtgccgattctgtttctcaccgctcgcgacggcgtgcaggatcgcatccacgctggacgtgctgcgccgccgggcggtgcgtcaggaacaggtgatcccgttgaccaacaaggagttcatgctgctgcacctgctggtgcggcgcgagggcgaagtgctgtcgcgcacgcagatcgcctctcagcgtgcgcggcatcggctatgtctgcgagccacgctcgtgaacgggcgcacttcacgtcggccggtgtcgctgacgctgcgcaccgccacgctgttcgcgctggtggccgctttggtggacgtgctgattttccaaattccggggcaaaaaccgctcatcaacgtgaacccggccggggtggcattgccgccgatcgcgccgacgccggccggccaggcgcagacgttggccgccgtgcgcggcggggaaacggcgcagggggtgccgctgcgcgcggcttcagcgatggtgcgcctggaagacggcagcctgttgcagatctccgccgcgcacgtgatggtcaacgagcagaagatgctggcgcgttacctgtggcgcatcgtcgcggcggtggcggtggctttcctgctgattgcgctgttggggtatggggtcatgcgccggggattgaagccgttatggcgcatggcggcgcaggcgtcgcagattgcgcccaatacgctgtcgacgcgcctcaacgagcagggggcgccgaaagagttgcagcagttgacccgttcgttcaatgcgatgctcgatcggttgaatga

SEQ ID NO: 74032 - DNA, 321 bp, Glycine max
  Peptide Sequence Number=SeqID_165717
atgaagaagaattacacgacgtggatatggcatggtgaagtgactgacatgcagagtgggtcccaatttgaaccgtttgatgtagaaatgggagatcgcttggaggacatgatttgtgaccttggacaaaagtgttttcaagaagctagacaaggcaaatcaattggtgttaatgtagaagatgatgattcatacatggacacctatgttagtcctttgaccgctcaaatcactcctaacgttgtcggagaagaagaagctgacgacattcatgcaaatcgaaatgatcatgatgaaggagaattgattaacatcgtctaa

SEQ ID NO: 74033 - DNA, 357 bp, Glycine max
  Peptide Sequence Number=SeqID_165718
aactcaaattcctcgcctttatctttcacgggactcaaagtcctcgccgtcacaggactcaaagtcctcgcctttatctttcataggactcaaggtcctctatctttatgctttcatagggctcaaagtcctttgtcatttacatttcaaagacttcaatgtcttcagtcatttacgctttcaaaagactacaattgtggaagcaatgacttccaagattattttgatgatgccaaagaatcaagagttaagcaagttccaaagaatcaggagtcaaaaagcttcaagaatcaagtttcaaagaatcaagattcaagagcaatcaagtttcaagattcaagattcaagaacaatcaa

SEQ ID NO: 74034 - DNA, 204 bp, Glycine max
  Peptide Sequence Number=SeqID_165719
atgccaaaagatagggggacttgtcttgatttcagggattgtcatcatcaaaaagggggagattgtagacgaaggatcaagctgaatgttttgatgatgccaaaggttcacatgcgtctcaaagctttattcaagacaaagaaattaaagatattcaagatgaatgatcaagacaagtctctagtcttagaaagggtatattaa

SEQ ID NO: 74035 - DNA, 313 bp, Glycine max
  Peptide Sequence Number=SeqID_165720
atggcttacgaacggggcggagatttcctggaagatgccaggaagatacttaacagggaagcgtttccccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgacccccccgttcagtccgaccgctgcgccttatcccggaaactattcgtcttgagtccaacccggaaagacatgcaaaagcaccactggcagcagccactg

SEQ ID NO: 74036 - DNA, 715 bp, Glycine max
  Peptide Sequence Number=SeqID_165721
gtatttattcggcgcaaagtgcgtcgggtgatgctgcccaacttactgatttagtgtatgatggtgtttttgaggtgctccagtggcttctgtttctatcagctgtccctcctgttcagctactgacggggtggtgcgtaacggcaaaagcaccgccggacatcagcgctggcaagtgtagcggtccccctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatacgaggtcaaccgcgtgatcctggagttctttgcgagcgcctcacaggcgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 74037 - DNA, 408 bp, Glycine max
  Peptide Sequence Number=SeqID_165722
atggagtggtatcaaagtaatactctaatttttttaaatatgcaaccgtcaagtgaatcgtcaatgaatttcgaaactggtcaatcgtcaaaggcaacaaacatcgtgcaaccagaatattacattcttcctggtgcttcgaacatggactacactccaccagttgtccaaccagatgatttcctgagcaatgtttttggaactgattgtggcatgccagcatcagcttgtgaatacatgcatagcctacagaacaaagtggaaccaagtttcactctaatgtttaaccaagatgttgaagagaataatccatcactacatgatataccagatgagtgcccacatcgaaattcaggacgtaatatgagatgccctccatatggaccaggacaccattatggggattaa

SEQ ID NO: 74038 - DNA, 228 bp, Glycine max
  Peptide Sequence Number=SeqID_165723
atgaagaataacaaggttgcaacagctggtgtctcactaagcgagggatatgcgcttagcgagcaatatctgctaagcaagacaatagctggtgaggagaatctggaagagaatctgccacgtatgcacgcgctcagtgcgccatcagcttgcccagcgagtcatttgtctcttctggcgcccaacgcgcttgactcgctaagccaaaaatcactaacttgtgcttag

SEQ ID NO: 74039 - DNA, 264 bp, Glycine max
  Peptide Sequence Number=SeqID_165724
atgaatagccaatatatttgcttttatctcatgcctttcttcgttcatggttcgatattctggtgtcctaggcgtagaggaaccacaccaatccatcccgaacttggtggatactccggggaacagatatccagtggagatgacggggtggggcctgtagctcagaggattagagcacgtggctacgaaccacggtgtcgggggttcgaatccctcctcgcccacaaccggccaaaaaagggaagatttttccctctggggtag

SEQ ID NO: 74040 - DNA, 162 bp, Glycine max
  Peptide Sequence Number=SeqID_165725
actcatcttctccttgaagtggcgtctcctctctctctccctttctccattccgctgccattcatcttccaagaagcaaaggaatccattgatgaagaagatcctaggcctacaagctccaatggagcttgcatcattactcgtgctacacatttggtgagg

SEQ ID NO: 74041 - DNA, 204 bp, Glycine max
  Peptide Sequence Number=SeqID_165726
atgtcctcaccttcagaggactacacgtccttgccatcagaggactacacgtccttgccaccagaggacaacgtgtcctcgccttcagagggctgcacgccctcaccaccccttgctatatatatatgtttaggtagcaagataccttggatatgcatgtatatagcaaaaatacctcacaaaaatatacacatgtttaggtag

SEQ ID NO: 74042 - DNA, 696 bp, Glycine max
  Peptide Sequence Number=SeqID_165727
atggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggcccatatggacacttcttcgcccccgttttcaccatgggcaaatatatacgcaaggcgacaaggtgctgatgccgctggcgattcagtggtgcttttgcatgtctttccgggttggactcaagacgatagttaccggataaggcgcagcggtcggactgaacggggggttcgtgcatacagtccagcttggagcgaactgcctacccggaactga

SEQ ID NO: 74043 - DNA, 246 bp, Glycine max
  Peptide Sequence Number=SeqID_165728
atggtagccataaccctaaccaaggttcctcaacctccattttttcgaggatacaactcaaacgcaacatgtgtttatcatggaggagttcaggggcattccattgagcattcaatagataccttagagccctacactggggcaatgagaggcaccatgcatgagcctcaagcaaacctaggggcagatcagaagttcttacccgataggttgaaaacccaaaagggaagcctaggcaaaatttag

SEQ ID NO: 74044 - DNA, 225 bp, Glycine max
  Peptide Sequence Number=SeqID_165729
atgacagcggaatggagaaggaagagagagaggagacaccacttcaaggagaagatgagtctagaagaagctcaccaccataggagaccatggataagagcttggaggaagaaggagatgaatgaagggagagtgtcataccttaatttcgtctgggaccattatttgttggcatgcgaccttctcttgaccgcctcaaaatgtttaacacgcatcgttatataa

SEQ ID NO: 74045 - DNA, 241 bp, Glycine max
  Peptide Sequence Number=SeqID_165730
atggatgttattggagggcgagagcatcgttcagcaaaatacgcaaaagctgctcaacactttgtaccaggtatcatagtaaaatacaaaacttcatcttcaatagaggaaggtgacgatgaccctcctagggtgattcttaatcgtgtattttgggcgtttaatccatacattgaaggcttcaaatattgcaagccacttgtgcaagtagatgagacatttttaactggcaaatatcatg

SEQ ID NO: 74046 - DNA, 135 bp, Glycine max
  Peptide Sequence Number=SeqID_165731
ggagaaaaatcatacaattatggtctccttcatcggtcagacagagaatacagggaggtgatcaagtgccatcgaaatgcactgagaattgatcccgacaatattgaaattcttcgtgacctatcactcctacag

SEQ ID NO: 74047 - DNA, 330 bp, Glycine max
  Peptide Sequence Number=SeqID_165732
atgaaaggtggtcagtggttctacacgaaaaaattattggtgttaatgttgaagatgatgattcaaccgttgatacttctctcagtcctttctccatacaaatgtcacctaacatctatggagaagaagttgacgacgtttgtttcgctctgggatactacttgtttgtgtagatgtgaaatcaaccggcaagtgcaccaggttgtcaaatatctaaaggcgttgggtcctcttactgagaaaattgatgtaattaaagatgtttctgggttctatgttgaagactcaagtactaaacaccgatgtctcgtgagtttagccgaattataa

SEQ ID NO: 74048 - DNA, 348 bp, Glycine max
  Peptide Sequence Number=SeqID_165733
atggtaagggggatttcgaaatcttcccaatttgtgcagcaaaaagctgtcaaattttgtgcagcaaaaaattgtgtttgtgcaaaaaatgttgtgtattgctggttgtggaaaggggagtacatattgggttctggacgctttctagcagatcccaacgcttcaatgaggtcctttaatggtggttttccaccatggagatgcagcggaagacaaaggagaagaggggagaggaggcgccatccactagggaataagccatggaagaaggagcttcaccaccaagatgagccttggataagaagcttggaaggatgcttcaatggaggaaaagaaagagggagataa

SEQ ID NO: 74049 - DNA, 339 bp, Glycine max
  Peptide Sequence Number=SeqID_165734
atgtataatactacaataacccatattggtctccactgcagtgcacactggcaaatggtcatcattttgcttaaggaaaatcttgttgtccggttttgttcctcgcataacaggctagacatctaccttaaaggaataattaacagtgctttgaaaggacttgatgatactccacaacctaaatccaaggctggtgctaggtggattgttgttaaatgtaatagacaaaaaggaagcactgagtgtggctattacatgatgcactggatgtccactataatcttaggaagtttcaggaataattgggaaacggttttatttgatcatgcaatattttaa

SEQ ID NO: 74050 - DNA, 258 bp, Glycine max
  Peptide Sequence Number=SeqID_165735
atgggggacatagaagaggtgcaggaacaaatgaaggccgatatggaggccttgaaagatcaaatgacctccatgatggaggccatgttaagcatgaagcgaaagatagaaagcaacgtggctgcagcagccgccaccagcgccaccgctgaggcagatccgacccatccctctaccataatccaagcaaaccaacccatcccggacgtgttgggtcaaggaggagaggtgttgggcagcaccagcagcccatgttag

SEQ ID NO: 74051 - DNA, 1014 bp, Glycine max
  Peptide Sequence Number=SeqID_165736
atggatcatgagcaagaagcaagtgaagaaaacaaattaagccaagattgtaaggagttaattctatctcttcctagagagaagggttggataacaccgtatctctatttattccaaggcttttggtactcatcaactgaaatccaagccataaacacttttcaaaaccaattccaagctaaggacaatgatgttgttattgctagtgttccaaaatcgggcaccacttggttgaaagcccttacctttgctattctccatcgccagtattttccttccttagagaaccacccattacttattttcaatccccatgaacttgtgcctccatttgaatttgtcatttatgatgaaattaatggccaaactcatgacctatccaaaatgcccgagccaagaatttttgggactcatgttccattcacttcattggccaaatcaattaaagagactgactgtaagatcatttatatttgtaggaatctatttgacacctttgtttctacttgggtttttgtcaacaaaattatgccaaagtttttgcctacattacctctagaggaagcttttgaaagatactgtgaagggataattggctttggtccatcttggaaccatatactagattattggaaagagagcattgctaggccgaagaaagttttgttcttgaagtatgaggaccttaaagaaaatgttcattttaatgtgaagaaaatagctgagttcttgggttgtcctttcactaaagaggaagaaaatagtgaagtgattgaaaatataatcaaattatgtagctttgagaagatgaaggaattaaaggtaaataaatctggaacaatgggaaaaggcaggattgttgagaataagtacttctttcgaaaggcagaaataggagattgggtaaattatttctccccttcaatggttgaaaaactatccaaaatcatagaagaaaagttaagtagatcgggtctatcatttagagtgtacgacttcaatagtagtagctag

SEQ ID NO: 74052 - DNA, 225 bp, Glycine max
  Peptide Sequence Number=SeqID_165737
atggaagaacaagaggagttcagatatgaaggtctcggttgctccatccaggaagagcaagcttcagcggtagcaatggcagtggtgaaagcgactatcagccggaatttgatgcggcacaatgaaaaagccatggcgttgccggagaagctaatggcgggaaaagatgctgaaaaggacatgaaagaaatcatatttgctacttgctatattgggagcttgtga

SEQ ID NO: 74053 - DNA, 159 bp, Glycine max
  Peptide Sequence Number=SeqID_165738
atgactctgactaacctgagcatcccttacatacatgatatgcatggtgccttgcatgctcgttaccctaataattatatggattatggatggtgttttgactctgattctgaagcactgaaaggcttcttggccatgcctagggcaatcaccaagtaa

SEQ ID NO: 74054 - DNA, 720 bp, Glycine max
  Peptide Sequence Number=SeqID_165739
atgttcacctctagccaaaaacaaaatggattgaaagaagccaagattgaccttgctgatccaacacctggcccaagtgtttgtgggcttcatcacaaaggcaataacttctgtacccccaatattttcaaagttccatatttgcccgtcttcttatataagttctctctcacccttatctcaaccctcttcacccccgttggggatttcactttcagagttatattccattctcattcttgcaaatttgaatccctcggaaggcatcaaaacaatcaacaaatatgttggtataaagaaaattgtgcaaaactgcatactatcctcctatatttgctaaatgtgaaatcggatgaaaaatacaagagtaacaaagaagcaaaattccactctaaaaagggatcgatattttcactgatgatcttaggatcatctgatccggaaaacccaaacaagcttgtggattctctaatctggaacataccaacaaatgtgcacaatacagctaaaattacggattttcataattcggaaacacatgaacgaaaagaaaaacaaaaacaaaaacaacctgttccacaaaatgaatgtgcttcgaatgtgttggtgattgtcgtctgtgttggcagtgatagtcctcacgggtggcaaagaaagtcgaagggggatgcaaaggataagggttcgaagaacaagaaaataggggaagcaaagaaatga

SEQ ID NO: 74055 - DNA, 82 bp, Glycine max
  Peptide Sequence Number=SeqID_165740
atggaatataactctgaaagtgaaatccccaacgggggtgaagaggcccacaaacacttgggccaggtgttggatcagcaag

SEQ ID NO: 74056 - DNA, 1096 bp, Glycine max
  Peptide Sequence Number=SeqID_165741
atggctgcccagacaattgctgagactgcccagaaaattctcacccctgaaacccttcgctatgctgccaaacaatctgcacgttgccttgttgtccctgtccgtctccgccgtgccattaagaaataccttcgagagcaggaggagccatatatgaagaggaaagtcttgagattgtctcaaacattcaatcaaatcaaggatgtcaatctccagctggcatccaccacagcaaagaagatagttgaagacccttttgaacaatcaaaacgttggaagattaccagctcttatggggacattggtctcatatatagagatgaagagacaaatgcatatgtggcttctcgaatgccagctgtttactctgcttgttacagagtacttaaagagaagtaccgtaagtcttctcgtaagaataatgaagtttgtaaagatttgatcactgagaaggccggtgcctttgtggttgctccttgtcctcatgatggggcttgtcctctggtaaaatctgggaaatattgtcattttgttcagcgtttggaaaggacatcttcacaacgtgcctacaagatgaaaaattttcctatgttgtttttagacgaggatcaaggccaaggcaatgatccttggccccttgatggtatggaatttgagactctgaaggagcagcatgcaaaaagaaatccagaggatcttgaaattgactacgaggactggttgaagttgcaacaatctgatgacactcctcatgaagtagctgatgcagaaactgacattgctgatgatttggaaactgatgacgctcctcgtgaagtagtgaatgctgtaacttatgattctgatgatgctgtggaaactgatggtcccattgatagtgaagaggacgaggaaagggaagaagaaagaggcagtgctgatcttggaggtggctggggcaggattgtcttcatgcctgtcagaaggggtagacaagtcaccatgaatgtgtgcagatccaccaaaagggatgcctcagagggttcatatgaccgtattgtcgtcactcggaccaagaaccctaccttgcatcaacaggccaaaagatctatttggg

SEQ ID NO: 74057 - DNA, 1140 bp, Glycine max
  Peptide Sequence Number=SeqID_165742
atggactggtactatggatgtgaaagtagtgattttcttgttcccaaagatcaagaagatttattggaaaggcatccttcaccagaaaattggtcagaatggggaataaatgcacctgaaggctttaattcaccccaggagtatttgatcatggacacagatgaaacagaagtagaattcaatttcattgatgaaagtttcaaaaatgaaattgagtttgacccttgtctgtatgataaagatcagtctagcagttcaagtgcatgtggaggattgcctgagcaatcgtttcaacaaacggaactttcgtgtgatcaccagcttcaagaccaatcaactttagaacagaaggatgacattttcttggattctgtacttgaagattttccatgtgttgaaagcctacgcaaatctttcttttaccctgaaaaccagtgcagcaacacaactggtgagaactacattttagtttctgaacaagtaatttctaaaagatctataatatggatgtacaaaattacaaatttgttctttccatcaggtggagtgcagaaagatattgcagcttcaggaactaatttccatacaaattctaattgcaaagtcttggacccttttgagcagttcaatgaagatgacatcatggttgagcagttatctcttgaggaatttacactgcagggttttgagatgttaattgcacagttcactgagaagactcgtatttgtttccgagatgccctttaccgtcttgctagaaatacaaaacaacatgtagtagaggacctggatggagatcttaacatgcatcaggaaatgccagactcagtttacaatgataccatgaggtctgaggacagtaaaccaatggaatcagagaccaacagtattgacagagcagttgcaaatctcatgttcaacaagatggaaattaacataatagatcttccccttacaacactagtaaacttgaagaaagaagtaattggaagtaaaggtcttcaaggaaaaagctcaaaagccttggatgtgacaaaaaaatctcactctccacacgcagaaaagttacctgctgatgctgaggttccaaggtttgaaccagaggatcaacaagaagccacagaatcatatattgcctaa

SEQ ID NO: 74058 - DNA, 102 bp, Glycine max
  Peptide Sequence Number=SeqID_165743
atggcatttatcatagttgggataacagctcttggcagaaaaggaaaagctggacattcaatcgttgttgaaacctctactttctcaactgtttctaactag

SEQ ID NO: 74059 - DNA, 291 bp, Glycine max
  Peptide Sequence Number=SeqID_165744
atggtgatgagaatcatgaaactggccaaatacaggctaaatgcccaagtggagaaggacaaagcccccgagtggagaaggatgaaggcccaaacttatcaaggtaatccttgtggcgtctaccctgacttatcttccttcaccggaagtggcgtctacccagacttatcttccttcactggaagtggcgtctacccagacttatcttccttcactggaagtggcgtcatccaaatcttcgtaacctgtatcaagcgatccgctgctactcaggttcacatcaaatggtag

SEQ ID NO: 74060 - DNA, 650 bp, Glycine max
  Peptide Sequence Number=SeqID_165745
atggcggttttccgtggcggaatttcgaaaaaacgccaccgaatagcggtggcgttgcgggtttgggatggcggcgccatggcggccgccatagccatggcggtcgtggcagggtggcggaaatggcggaaatggcggatttcgtgggtttttgtccgcgcttacccagccgcacgcacgggaaccgccgtgacgagcctacctgcagccgcgacgacaccacccaacagcctacctgcagccgcgacaccacccagccgccgcgacaccacccagccgccgccgcgacaccaccccctgcagcacgcacgaacggcggcgacgagcgaagaagaagaccccggcaacgcagtgaacgcacgaagaagaagaagacaggaagaagacgcgggaggaataacccgagccaaacaacacctgattgggaagtcgggcaacgttgcagcttgcaagaaaactcccccaaatgtaatcgaagagttgaaggaatatatggctacaaaaaaaagtgggaccacttacagtacttctggcagtggtaatatggcaaatataagagattttgaatttggtgaaccgattggatgtgatggaagtgaagaagatgagtttgcggactcttgtaatgctgctgcaagtgcaaagacaaa

SEQ ID NO: 74061 - DNA, 1914 bp, Glycine max
  Peptide Sequence Number=SeqID_165746
atgagacagctaatgtttggaaaccatatatccgagtcaatggatattagaacaagacaaggcttgctaaatgctctggtgggaaaggtggggaaaaggatggatactctattgattcctttggagttgctttgctgtatttcacgttcagaattttctgataagaaggcttttatacgttggcaaaagaggcagttaaaagttttagaggaggggcttgttaatcaccctgccgttggatttggtgaatctggacgcaagacaaatgagttgaggattctgttggccaagattgaagaagcagagtttctcccatcttcaactggtgaacttcaaaggacagaatgcttgagatccctaagggagattgccattccacttgctgagaggccagctcggggtgacttaactggtgaaatatgccattgggcagatggttaccacttaaatgtcagactatatgagaaattacttttaagtgtatttgacatgctagatgaaggaaagctgacagaggaagtggaagaaattcttgaacttttgaagtcgacttggagagttttaggaatcacggagacaatccatcaaacctgctatgcatgggttttatttcgtcagtatgttatcacaagggagcatggggttttgctgcatgctcttgagcaattaaataaaataccactgatggagcaaagaggccaacaagagaggttgcacttgaaaagcttgcattctaaggttgaaggcgaacgagatatgtctttcttacagtctttcttaacaccaattcagagatggactgacaagcagcttggagattaccatctgcatttcaatgagggttcagcaactatggaaaagattgtagcagttgcaatgattaccaggaggcttctactggaagaaccagaaactagcacacagtccttgccaattagtgatcgtgatcagatagagatatatatatcatcatcaattaagaatgcattttcaaggacagtgcaagttgttgacagagtagatatgtcacatgagcatcccttggcattgcttgcagaagaactcaagaagttcctaaaaaaggaatcagcatctttcttgcctattttatctcagaggcatcctcaagcaactgttgtatctgcatcattagttcacaaactttatggccacagactgaaaccctttttggatagtgcagaacatttaagtgaggatgtcatttctgtatttcctgcagctgaaagtctagagcagttcataatggcacttattacatctgtatgccatgaagaaaatgctgagatcctgttgaagaaattaaatctctaccagattgagatgaaatctggaacattggtgttgcgttgggtcaattcacagcttggaagaattttaggttgggtagagcgggttattcagcaagagcattgggacccgatatctcctcaacaacgacatgctggttctattgtggaagtttacaggattgttgaggagacggttgatcaattttttggtcttaaagttccaatgaggtttacagaattgaacagcttgtttcgtggcattgacaatgctctccaagtgtatgcaaataatgtagttaatgagttggcaagcaaggaggaactgataccacctgtgcctattcttacacgatacaaaaaggaagctggaataaaggcttttgtaaagaaggaactgtttgatgctcgtgtgcctgaacctgatgaaacaaggcccagccaaattagtgtccttgcaactccaacactttgtgttcaattaaatacattatactatgcaattagtcatctgaataaattggaagacaacatctgggagcgatggacaagtaaaaggtcccaagaaaaactcataaaggtggagaatagagatgaaagagaatga

SEQ ID NO: 74062 - DNA, 936 bp, Glycine max
  Peptide Sequence Number=SeqID_165747
atgaatagtctacctttgaaaaaggctagtgatgatggagttggatcaggatcgggtagtaaagtgccacaatcaacatcttcggtggttgaaagtgatatttgtgacagagatgatgacaaagaaaggatttttgaatggctcacttctgacactgataagaagctatcaatactttctatagtgagcatgggcgggttgggtaagaccacacttgcccaacttgtatacaatgactcaaggatagatggtacatttgatattaaagcttcggtctgtgtctcagagaaatttgatgttttcaacgtatcaagatcaattcttgacacgattattgattcaactgatcatagtagagagctagaaatggttcagagaagactaaaagaaaatttggcagataaaagatttcttctcacgacacgcagtgagaaggtttcttctaccattcgcactgagctatccccaccttcctcccgtctcaagacatgctttgcttactgtggtttattcgggaaggattatgagtttgacaaggagtgtttaattcagttgtggatggctgaaaatttcctacactgtcataaaagcagtaagagtccagaagaagttgagcagcagtacttccatgatctactatcgagtatgtcaaagatacatgatttgttctccaagtttaagctcttgcgtgtcttatctctgtctcagtgttctgacattgaagagctgcctgactctctttccaatcgtaaacatctccgttcatttgagctctccaacacttgcatagaaaaactacctgaacccacacgttcactttacaacttgcaaatactgaagttgggctattgtcctttgctcaaacagcgttgccagaaaccagaaggccaagaatggccaaagattgctgatcacattcaagacctgcagatatag

SEQ ID NO: 74063 - DNA, 321 bp, Glycine max
  Peptide Sequence Number=SeqID_165748
atgtcactgctattcggtggcgttttttcaaatttccgccacccttttttgccatggccgggagatggtagtggatgtgtttccatctatggactcaagtttgatgatgaaaactttacggccaaacacactggtcctggccttctgtcgatggcaaatagcggacaaaataccaatggctgtcagttctttataacatgtgcaaaatgtgactggcttgacaacaagcatgttgtctttgggtacaacgcagcacaaggagaacagtacaaaacacagtacaacgcagcacaaggagaacagtacaaaacaaatacttaa

SEQ ID NO: 74064 - DNA, 318 bp, Glycine max
  Peptide Sequence Number=SeqID_165749
atgaagaacaaaagggcagcaacaaaagggacaaaaaggatatcaaaggcccttgtgcaagaactcactggccaatactccaatgttgctgaaacctccatgcctatggaagaagaagaaaatggccattccgagagagtgcacaaaactcatcttcttcatgaaagtgaaactcaactatggagggtggatgttgatgagggcaccaatttgatgaaacctcttgagtatagtgagtacctctcaagatccttgatggagccattcaaccaacaacaacaccttcaatacgatttgttgagttttgacatgtcatag

SEQ ID NO: 74065 - DNA, 84 bp, Glycine max
  Peptide Sequence Number=SeqID_165750
atgcgtcctccaccatcaggtgcggagcctacggtggctgggaaatgtgaaaaaaaggagaaggagagacgggagtcgtcatag

SEQ ID NO: 74066 - DNA, 276 bp, Glycine max
  Peptide Sequence Number=SeqID_165751
atgaagacaaaagcttgcatcaaaatcactgacaatatagtaagtgaaactaagcaagaagctctataccaagatgatgagcttgtggggcttcaagaagtgttggaagtttaccctgatatcattaatgaatctcttgcagatgttgatggaggtggagaaaagatagatgcaaatttacttaaacaaccaaacttggttgaaccaaatgaggatgaatgcatattaagtgagaatgagattgagagtgattttgatgatacaaatacttcttag

SEQ ID NO: 74067 - DNA, 543 bp, Glycine max
  Peptide Sequence Number=SeqID_165752
atggtagatagaggtagaggcggtggtcgcagaacatttaatcatggtagaagacatggtgttagtttaggagttccaattaccaccaacccttccacctcttccattcacatatcaacctcaaagtcgatgattcatgttgttgcaccagcactaaacacacttcctaaaactcaagaccaaccaaatccaacctttgtaagggagtcaattcccactacccctgttggagatgcttcaccttcagcaccagatgattctcttacacctgagtatccacctaatccaaattgtgaacatattgttgatcagaggcctttcattcgtgcatataaaggagagtttcaaccaacatatggatgttgtaatatcatatcagatatcattagagcaaagtttgatgaaccgactccaagttggttgaagtataggtggaacccagcagaagagcgagccattagagttgattttgagacaaaaggttcacgtattttgaaaaatgcaatgaacaagatgagaaatggtcaagataaaggaaagtag

SEQ ID NO: 74068 - DNA, 767 bp, Glycine max
  Peptide Sequence Number=SeqID_165753
gttgcctcctagtagcgcttctttaacgtctttagctggacgcatgatggcttgtaggcaacgctctaacctttttgcggatgagctgaggttaactctagaggtggtggcggtgtgtctattgcccgctaccggccatcccaatgctgctgtggtgtttcgccctgcgcctgcctgggggcgcaggcaccctgtaggactgatagaggcccgtaaccagagctggaaaccccagggccctgttggacttttccgggtccactgggtgtcttgtggggggagattggcattgcggtcgttgggcagaatgttgctaagtagcaatgtcctctatatctgtgtaagagtggtcatgttggtgcgcatggtccgcactcttctctttgcagcggcacgggtgaaatcttgccccagtatgcatagtagctgtgtggtagcctccctctctggttgtgctcgcacagttggccatcctccaatatcagggggtggcccaggaaccgttaaaaggaaactactggtgagggcgtccagccctctgatggcaaggacgtgtagtcctctcaaggtgagggtgtgcagccctctgttggcgaggacgtgtagtcctctcaaggtgagggcgtgcagccctctgttggcgaggacgtgtagtcctctaaaggcgaggacatgtagtcctctggaggtgagggcgtgcaaccctctgatggtgaggacatgtagtcctctcaaggcgaggacgtgtagtcctctcaacggtgagg

SEQ ID NO: 74069 - DNA, 270 bp, Glycine max
  Peptide Sequence Number=SeqID_165754
atggactgccccctgtggatgctctggagcatggagtgcaacatctatggtgtgaaaataaaatttgatggtcctacaaatataggagctggaagtggtctccgagtagatgtaggaggaataactagagctgaggaaggtactggagctgtggaagaagaaggagctggtgtctctggtggcactgaagtaatgggggcctctgatctcttacccctggcattccttggccctctaaatgtcactgttggatcctcaagattccaatag

SEQ ID NO: 74070 - DNA, 2346 bp, Glycine max
  Peptide Sequence Number=SeqID_165755
atggtgctgcgcacgccaatcatctctgaacgctattcggtggacgaactgccgggtgaagacgccaagccggcagggaatccgctgggttatgtggcgattgagctggatctgcagtcggtgcggctggagcagtacaaagaggtgtttgtcgccactctgctgctgctgttttgcctgtgtatcgccatgttgtttgcctatcgactgatgcgcgacgtcaccggcccgattcgcaacatggttaccaccgtggaccgcatccggcgcggccagctcgacagccgcgtggatggctatatgctgggcgagctgagcatcctgaaaaacggcatcaacgccatggcgatgtcactcaccgcctaccatgaagagatgcagcagaacatcgaccaggcaacctacgatctgcgcgaaacgctggagcagctggagattcagaacgtcgagctggacctggcgaaaaagcgcgcccaggaagcggcacgcatcaagtcggagtttctcgccaatatgtcgcacgagctgcgcacgccgctcaatggcgtgattggctttacccgccagatgctgaaaaccgggctgagcaccaaccagcgtgattacatgagcaccattgagcgctcggccaataacctgctgagcatcattaacgacgtgctcgatttctccaaactggaagctggtaagctggtgctggagtcgatcccgttcccgctgcgcgccacgctggatgaaacgctggtgctgctggcgccgtccgcgcatgagaaaggcctcgagatcaccgtgtgcctggagaaacaggtgccggataatgtgattggcgatccgctgcgtctgcagcaaattctgatcaacctgattggcaacgccatcaaattcaccgagcgcggccacattgatctgcgcgtcgagctgcgtcatctcagcatcacacgggcggaactggagattcaggtgcacgataccggcatcggtatctctgagcagcagcagtcgcagctgttccaggcatttcgtcaggcggacgccagtatttcgcgccgtcacggcggtaccggtcttggcctggtgattacgcagaaactggtacacgaaatgggcggtgagatcgccttccacagccggcagaatcagggctccaccttctgggtacaagtacatctggatctcaatcctaacgcaccggcgattccacgcatgctggacgatctgcacgccacgccgctggcttatatcgaaccccatccggcggtggcgaaagcggttcaggagatgctgagcattacgcctctgcaggtgcagcactttgccagccttgacgatctgcccgacgcccatttcccgctgctgctgatggggctgccggtcagcgatccgcatccggctacgctgtccgatgcgctgattgcccgcctgcgcgcacacgccgactcggtgctgctggcgctgccgagcgaaatgatgctgttcgccgatgatttgcgcgcgcgcggtatcgccggctgcattgccaaaccggtgtcgctgacgcgattgctgccgatgctgctcgatctcaacatgcgtcacagcgacgacgccccgcgcggcgtaagacagccgctgacggtgatggcggtggatgataatccggccaacctgaagctgatcggcgcattgctggaggagcaggtccagaacatcattctgtgcgacaacgccagtcaggcgattcaccaggcgcgacagcagcggctggacgtgattctgatggatattcagatgccagacatcgacggcatccgcgccagcgagatcatccgcagcctgccacagcacgccagcacgccgattgtcgcggtcacggcgcatgcgctggatggcgaacgtgagcagttgatcgccgccggcatgaatgactatctcgccaagccgattgatgaggacaagctgaagcagctgctgcagcgctatgcgccgggcagcgtggcgagcgcggtgcgacaaccggcgatcgcaccctcacttgactgggcgctggcattgcgtcaggcggcgaataaagccgagctggcgcgcgatctgctgcagatgctgctggattttctgccggaagtggagcagcgcgtggcgcagtgtatggcgcagaatgacgtcgatgggctgcgcgagattatccacaagctgcacggcagcgccagctacagcggcgtgccgcggctgaaacagctgtgtcagcagctggagaagagtctgcaccaggagagcgacatcgcagcgcttgaaccagagctgctggagctgagcgacgagatggcgaatgtagcgcgcgaagcgcgtcaggtgctgggcgtggcgtag

SEQ ID NO: 74071 - DNA, 363 bp, Glycine max
  Peptide Sequence Number=SeqID_165756
atgacgccagactggatgcccagaaacaggcacatatccttctgctcgagaaagcccaagctgctcaacatgaagtcgaacgtctcaccaaagaggcgaaagaaggaacttctgagatcaaagcctgtcgatgatctaaggcagaaaattgtaacagagcaggccaaacgcaaggaactccaggagaaggccgataactcgattcagaaactgattactgaaaaagggagggaaggcctgaaggcctttagcgcatctcaagctgtagcagatgaggcaagagttatggagagtgctgaccaggtcttaactaaagagatggccaccctgaagaaactatatgaggacttggtcctgacttag

SEQ ID NO: 74072 - DNA, 258 bp, Glycine max
  Peptide Sequence Number=SeqID_165757
gcggccaaccaccgtgggcaggtgcagatacatgagtgtctctaccgattcagcctcagtcagcagaggcagggttccgctccttttgtatgccctaccccggaccagtttggggctgaggtcgcatggcctaaagactggcccgatgcccaggcaggagaggagcctgcaggatcccccggtgaggtagaggagtctcgtatggatgaagatatgactgacttgctcgatttcttgggaggaagcggagccacgtga

SEQ ID NO: 74073 - DNA, 507 bp, Glycine max
  Peptide Sequence Number=SeqID_165758
atgtgttcttcaattcagaaacgtcctgacttgaagttggcctcccacagtaggaaggtagagaaaattgggaggccaacgcctgagatcgaagggctagtcgctgccacaggattaagccctttgatcgggtgctcagtagtcaccggcgatctgggacttatatatgcgcttgtggagaggtggcacggggagaccagcagcttccaccttccagtaggagagctgacgatcacactggatgatgtgtcatcactcctatatctgccgatcacaggcgccttgcacaacttcaagcctctagttgtggaggagacggtcatcttgttgatggagttgctcgaggatatctatttgagtagatgcgaggcccgacggtggattgtagcagctcgtgcttatctcctccacttggttggttgcactcttttcgctaacaagagtgcaacacatgtccatgtagtgcatctggaggcttttcaagacctgggtgagagtgggaggtaa

SEQ ID NO: 74074 - DNA, 395 bp, Glycine max
  Peptide Sequence Number=SeqID_165759
atgacggtgaaaacctctgacacatgcagctcccggagacggtcaccgcttgtctgtaagcggatgccgggagcagacaagcccgtcagggcgcgtcagcgggtgttggcgggcgccattcgccattccggctgcgcaactgccgggaagggcgatcggtgcgggcctcttcgctattacgccagctggcgaaagggggataggaacaaggcgattaagttgggtagcgccatcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 74075 - DNA, 1029 bp, Glycine max
  Peptide Sequence Number=SeqID_165760
atgacggtgaaaacctctgacacatgcagctcccggagacggtcacagcttgtctgtaagcggatgccgggagcagacaagcccgtcagggcgcgtcatcggatgcgtaaggagaaaataccgcatcaggcgccattcgccattcaggctgcgcaactgttgggaagggcgatcggttcgggcctcttcgctattacgccagctggcgaaagggggatgtgctgcaaggcgattaagttgggtaacgccagggttttcccagtcacgacgttgggtatatttgatgtaaacactgatacattaacggagaagctatggaaggttcctggagttgacataacggattactttaactttggttttaatgagagcacttggaatcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggaaccgtaaaaaggccgcgtctgctggcgtttattccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggattagcagagcgaggtatgtaggcggtgctacagagttcttgaagtggtggcctaactacggctacactagaagaacagtatttggtatctgcgctctgctgaagccagttaccttcggaaaaagagttggtagctcttga

SEQ ID NO: 74076 - DNA, 135 bp, Glycine max
  Peptide Sequence Number=SeqID_165761
atgattatgagaggtcaagaatttatagtagaaacaagaggagatacttcttgcccttcctctagtggaagtgaagatgaagtaaggggtgaagagtctagtgaaggaaagtctacccccatgaagaaggaataa

SEQ ID NO: 74077 - DNA, 240 bp, Glycine max
  Peptide Sequence Number=SeqID_165762
atgaaacataactacggcttagcgcaacagctgcgcttagccttattcaaaggactaactaacagaagcatagtggcgcttagcctaacagggatgaacgcacttagcgcgatcatctggaaatccaaaattttaacagttgcgatgaacaagctaagcgcagtaggcgcgaatgaagcaagaaacatggagacaagtcagttccagcatgcaaaaggaagcacagaagctcaaggttag

SEQ ID NO: 74078 - DNA, 360 bp, Glycine max
  Peptide Sequence Number=SeqID_165763
atgaaaaaaggaggagaaaagctttgcaagagaggacaacacaaccaagttcaaggggaacagtttaaagacatgggaagaaatgaatctttgagtgaagcgctagaaagattccatagcttcctgctgaaaacacctactcacggattctccgagcctattcagttgaacattttcattgatggtttgagactacagtccaagcaattgttagacgcttctgctgagggaaagattaagttgaagattccagaagaagaaatggaacttattgagaatatggttgctagtgatcatgccattttgcatgatagaactcatgttcccaccaaaagaagcctgttagagctttcttcgtaa

SEQ ID NO: 74079 - DNA, 501 bp, Glycine max
  Peptide Sequence Number=SeqID_165764
ttaggccaccacttcaagaactctgtagcaccgcctacatacctcgctctgctaatcctgttaccagtggctgctgccagtggcgataagtcgtgtcttaccggcgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtaccgcgatgattttcttagtgaag

SEQ ID NO: 74080 - DNA, 483 bp, Glycine max
  Peptide Sequence Number=SeqID_165765
atggctccaaagaaactctctacgaagaggtctagaagagatgccacaggagaaggatccagtgctgccccagagtttgatagtcatcgtttccagagtgtcgagcaccagcagtgcttcgaggccatcaggggatggcgttggacaccgctagtgactcccatggccaagttcgaccccgagatagtcctagaattctatgctaatgcctggcccacggaggagggagttcgggacatgcgctcgtgggtgaggggtcagtggattccctttgacccagatgccctcagccagttcctgggcgacccgctagttttggaggaaggccagcagtgtgagttcagccataggagggacatggccgacgatttcgatgaggaaaccatcgcccagctgttggaggcgggtgcggatcatgcgcaccagcatgaccactttgacccggacatggatgacgctactgctcaacaatgtcttgcctag

SEQ ID NO: 74081 - DNA, 795 bp, Glycine max
  Peptide Sequence Number=SeqID_165766
gaggtttccggactatggaaagctaaatcctctgttggatcttccctggtagcttttacctttgatcacatagatgcatgctttgttagggtcattcaacaatggaaactggaatcggggtacaagaacttagttgtgtatgtgtgtcttaatgcggtcttggttgagtttagtcttacaagaggaatctacggacgaggcttgatcaggactaggctaggctatcatgaggaatcgagcaagcctgtcccattcccttatagaagcaacaaggcggtcccatggaggtacacctctcaaaagccaaatgaaaagaaggaagaggccgtcgagggtgacctatgctctgccaaagttactaacatcaccagcataagcggtgtgacccgtagtgggcgtgtcttcgtggcacctgacccgttggtgcgatccaaggacgccaaggtaaaagcaaaggtaggcatggaggaaagcaacaaagtaaactcgactcaggatgaggatgtcccgactgggagattcgctgagaaaggagactttggtggaaagaaggtggtcgttgaagaagcgaatgagttccttcggatcattcaacaaagcgaattcaaagtgattgaacaactcaacaaaaccccagctaggtctccctgttggaactacgcacggaggtctgtcgcaacctaccctttggcgggagggcgacgcgagggctcacgggtgcgtcttccaagaaaggaaaatgcacggagtcgccaacaacgtttattcgaggaaaacgtcggaaaaaccggaaag

SEQ ID NO: 74082 - DNA, 234 bp, Glycine max
  Peptide Sequence Number=SeqID_165767
tatgcaagtaccacaggtggccagaatgactagcggcacaacgtgtcccgcaggtgaagtggggtggccagaatggctagcgggcagggcaagtaccgcaggtggccatggctatactcgtggactttcgctcgagggggagactaccatgtggaagagactcacacttgaggagaagatgtgttgggttacaagtgtgaggcttccttatgtggtggctcctgatccacaagt

SEQ ID NO: 74083 - DNA, 124 bp, Glycine max
  Peptide Sequence Number=SeqID_165768
atgatgctctcctacaacctaagacaaggtagatggagattacaatttacaagttcagggttcaagtcaatcactcaattttcagctcaacatgggtgcaagggatcattcattcatatacaag

SEQ ID NO: 74084 - DNA, 660 bp, Glycine max
  Peptide Sequence Number=SeqID_165769
atggccaagttcgacccagacatagtcctcgagttttatgccaatgcttggcctacagaggagggtgtgcgagatatgcgatcttgggtgaggggccaatggatccctttcgatgcggatgccctcaaccagttcctgggatatcctttagtgctggaggagggccaggagtgcgagtatggccagagaaggaatcgggccgatgggtttgatgaggaggccatcgcccagttgctgtgtataccggggcaggattttgcccggaccgctgccgggaggcgggtgggaatcatgcgcaccaatatgactaccctgactcagacatggatgacgttgctgcttagcaacatcctacccagcgatcataattctgacctccccctgccgaagtgtcagctggtgtatgccattctaacacagatgagcgttcatatggctcagttgatcgctgatgccatttatctatttgcaagtatgccgcctaccaggcaccctctggagccggataagtccaacagggccctgggatttccagctttgatcacaggactctgccagtcattcggagtccccgtcgcacctagtaaggcacagggtggcgaccctcaggccccagatgcaccgcctccacctcctcaggctgacccaaaatcatggtaa

SEQ ID NO: 74085 - DNA, 443 bp, Glycine max
  Peptide Sequence Number=SeqID_165770
atggccccgaggaaacttgcctcaaagagatccaggaaggataaagcggccgaaggaactagttctgctctcgagtatgacagtcaccgctttaggagcgccgaacaccagcagcgcttcgaggccatcaagggatggtcatttctccaggagcgacgtgtccagctcaaggacgacgagtatactaatttccaggaggagatagctcgccggcggtgggcatcactggtcacccccatggccaagttcgatccagacatagtcctcgaattttatgccaatgcttggcctacagaggagggcgtgcgagatatgaagtcctgggtgaggggtcagtggatcccgtttgatgcagatgctatcagccagctcctaggatatcctttagtgctggaagagggtcaggagtgcgagtatggccataggaggaaccggtccgatgg

SEQ ID NO: 74086 - DNA, 519 bp, Glycine max
  Peptide Sequence Number=SeqID_165771
atgggcccgaaatctaccctaaggctcatgagaaccctagggccttctcttgcatctttggcccaatcttcttggactcttctatccaatgcccttgggagagggtacatctacttgggttgtaatactgagaacaagagagggtacatctcttgtggatcagttcaagtggagggtacatccacttggttgttcaaagagaacaagggagggtacatcccttgtggatctttgcttgtaaaggattttacaaggttattggaaatctcaagaaccggtggttgcttggggactggatgtaggcacggtaaagacacgttcataattaattcaacccctcttcttgattattccgaggcactttatccaacaatcaatctagtttgcaacaaggtagatgatgcaatcctacccccaagggcattggataaaagactccaagaagattgggccaaagatgcacgagaaagccctaggattctcatgagccttagggtagattttgggctcatgggctaa

SEQ ID NO: 74087 - DNA, 240 bp, Glycine max
  Peptide Sequence Number=SeqID_165772
atggaggtgcattggtcttgggctcttgcatctcaattagatgaagaaatagggaagatggcttgggcaatagaggaaagaagtaggcaggaggtagtgaaagattttcatgatcatcagcttctaccatttgcaatagttcaattctcaatggtgccttgggttcttgttagccatgcaaaggcattgatgctctgttatagggctaaaaatataggagaaaacagagcattggaatag

SEQ ID NO: 74088 - DNA, 2709 bp, Glycine max
  Peptide Sequence Number=SeqID_165773
atggcgggtcagtcctccaatgaaggctccagtactggaaacatttcagcagaatgttcagattcaactgttcagctcaatatcaagactctagattcccgcatctacagttttcaagtggacaaaaatatgcccgtctcgttgttcaaagagaaaattgcaaatgaaattggtgttccagttaatcagcaacggctgatatttagaggaaaagtcttaaaggatgagcacgctctttctgagtattgtatccttcaaattgcttctggtacgagttctggtgagtcaactggtacaagtggtaaccgaggctcaggggctcctcgtaatcatgttgggcaaatttcacacagtgttgttcttggaacatttaatgtgggcgaacaaggtgaaggaattgttcatgatctcactcgggttattgggcatgttttaaactctattggaaacggtggccagagcacacttagtggtcctaatgctacacaaacttcttcagttcacccatggaatgaaactgaaggaatgcatgctggaaatcaaaactcagcaggaaatcaggcaccatctggacagacatttcatggcccaacagttcaatctgtctctcatgttgttcagattcctgtggcagcaggggccatacccattccttctctcaatgcaccaattcctgattcattgaacacactgtctgagtttatgaatcgcatggaacagacactaacacaaaatggttatcaatcaaatctttcatccgctaaccctggagatcagcaagcggaattgccttctaatgcacaagggttgccaacacttgaagcattaagcactgtcttgcattccgcagaacggttacttggtggtcaagctgttgctgcactatctggtgctgaagtatggagatggacatcctttgtatcttttagtctgaacatacttttagaagggcgcttggaaagagaaggaacttctgctgatctgcgcgtaagggatcaaatacaatcagagtcagtgcaaataggacttgctatgcagcatttgggtgcacttctacttgaacttggccgaacaatgttgacactgcgtatgggacagtcttctgcagaatctgttgttaacactggaccagcagtttacatctctccatcagggccaaatccaataatggtgcagccttttccattacagacaagctccctctttggtggtccagttcccccctcaactcctgcaactttaggcaccattggtattggaaatgctcctaggaacgtaaacattcatatacatgctgccattggttctggggcaaataatggagaggggacaagaagtgaacaccgtaatgagcctggctctggtgattcaggttcaacacgggtattacctgttagaaatgtcatagcagcaactatcccatcacaccctcctggtgttggaatctctagtagcacacaaactgggtttggtattcctacttcacagccaccttctgattcagcttcattgtcatctgttttagcagaaatcaattctcgccttagaaacgttgttggtaatatgcatggagataacacagttccatctggtcaaatggaatcaaacagcagggacttgccttctggatctgaatcaagacctgctacagtaaatgaacagcgagataccatggacatgaatggttttggggctactagtgcttcctcagttggctgcacttctgaaagtgaagtacaaaaggcagtccaaacctctagtaatgatgagagagatgttttggttgacaaatttgtttcaagttcttccaaccaagatttacgaagttgttctagtggagaaacaatagtaaaaccagaaaaagaacaagatgttccggctgtaagtgaaagacaaaatgtaactgaacctgccaaagctgctccgctaggattgggtgtgggtggtttagagcgcaagaggagaactagacttcaacctcctgtaagtaaaggtgctgatgatagatcatccagttcttctgccaatcaaaatcagcaaaccagaacagatggtcaacatatattgcaaactcttgcaagtcatggatctggtttgaattcaagaaatgctaatgggccatcccagcggtccttgccctccagtgatcgtccaattgatgtggctggtttaatgtctcaggctttacgtagtcctgccttgaatggtttgttggaaggagtttctcagcaaaccggagttgactcacctgatggcttgaggaatatgttgcagcagttcacacagagcccacagatgatgaacacggttaatcaaattgtccaacaggttggcagtcaggatgtggggaatatgtttgctggaatggaaagagggcagggtggtggtattgacatttcaaggatgtttcaacagatgatgcccattgtatctcaagctcttggtgggggaaatccttcctcactattctctgctgaagaagctgaaccccatgcaccctactgtgatggaacaattaacagagatgaatattctgataatcaaagtttacagcttgaccttcaaccactggctgagaggattgagcacctgggtccttctactgatattttccgtgctgtagctgaaaatgctgtccagctatctggcagtggaagcacttctaatgatcttctggatgagttgtgcagcaatgagagtcttgccagg

SEQ ID NO: 74089 - DNA, 681 bp, Glycine max
  Peptide Sequence Number=SeqID_165774
atgcaggcattcaactgggagtctaacaaatacaactggtggaataatttagaaggcaaagttcctgacatagctaaagctggatttacttcagtctggttgccgccaccaactcactccttctcacctgaaggagatattttccatggatttcccaatatcgaccatactaaagattttgtgagaaaggatatcataggatggctccgttggttgcgccatgaggtgggcttccatgattttcgatttggttttgtaaaggggttttcaccaaaatatgttaaagaatatattgaaggagcaaaaccattattttgtgttggggagtactggcattcttgcaactacaagggttctaccttggactataaccaagatagccatagacagcgacgactaatcaattggattgatggcactggacaactttcaactgcatttgactttacaacaaaaggaattctccagcataaacaaccaatcccttttttcatgtctgttgatttcttcttaatttggaagcccccaggtgtgatcggatggtggccctcaagatctgtcacatttgtagatgatcatgatacaggttcaactcaggctcattggcccttcccaaaagaccatatcatggaggtattattagttacatctggtaccatgcacgttcataaatatgtttga

SEQ ID NO: 74090 - DNA, 730 bp, Glycine max
  Peptide Sequence Number=SeqID_165775
cactcctgcttcaaacaatttcttcttccttccttggcaaatggagaaggagaaagagaaagagaaaaagtctaagctgaagaacaagatcttcaaaatactgccaaaagctgctgcaatgagcgtgacattccaaaaccctcccttcagcccaggcagggatcacaagtgcaaacactatggaggcaaagggttcttctctggccgcatgattcccgatgaagccagaagaaaggcaaagaatggtcatggcgttgaaactcaagaacccacttcccccaaaatctcctgcatgggacagatcaagcacaagaagggaggggcaaagaacatgtccatgtccatgcctactcccagagaccccgaggtaaagaaacacgcttccaagtttcagaggatgttgttgttccacgcggggaaaccaaaacagtctgatgcggatgtggagagtgagagagcacctgcaccgccaatgggtcacatgaggcgatttgcaagtgggcgtgaaaccttttcgaatttcgattggaaggctcagattgcgcctcatgatgatgttgatagattggatgatgagatcattatccctttctctgctcctcttacccttggtggtgcaactgcgcttaatcttaatgtgcagccacggaaagagattaatctatggaagagaagaaccatggcaccacctaggcctcttaagttgaatccacttcttacagccaaatga

SEQ ID NO: 74091 - DNA, 660 bp, Glycine max
  Peptide Sequence Number=SeqID_165776
atgcttaacaaccatacactcgtaacaactccaagtttcccgtgtcaccgcctcgtctctacaaataccattctcgttaatgtgaatagaaatatggcagctattgctacagttattatgctcataactatgtccctggcttctcttgtgagtgcactaaatgtaaattactatgaaaatacgtgcccccataatgtagattccattgtagctgctgctgttcacaaagcaaccatgaatgacagaactgtcccagctgctctccttcggatgcattttcatgattgcttcataaggggttgtgatgcctctgtacttctggaatcaaaaggtaagaataaagcagaaaaggatggacctcctaacatttctttgcatgcattctatgtcattgacaatgctaagaaagcagtggaagccgttttccccgggatcgtatcttgtgctgatattttggctcttgctgctagggatgctgttgccctttccggaggacccacttgggatgtgacaaaaggaagaaaggatggaagaatatcaaaggccactgaaaccagacaactgccggctcccaccttcaacatctcccaattacaacaaagcttcttccaaagaggcctttccttggaagatcttgtggccctctcagaaaaacaataa

SEQ ID NO: 74092 - DNA, 387 bp, Glycine max
  Peptide Sequence Number=SeqID_165777
atgcgtgccatcacagagaactctggctggagggctaacaagaaagtgctcagaaaagaacttgattccctcggtcacaacttgtcagataccaggatagtttacattgatgtttactcccctctgctcgatatcattgataactaccaaaaatatggctataaagttatggacagaggttgctgtggcacaggcaaactagaggttgcagtgttatgcaaccctttggatgacacttgttccaatgcttcggaatatgtcttttgggatagttatcatccaacagaaggagtgtacagaaagatcgtaaatcatgttcttgaaaaatttaatattcatagcaggcatcgatccatctcagggacgtttcagatttttcctctgtga

SEQ ID NO: 74093 - DNA, 441 bp, Glycine max
  Peptide Sequence Number=SeqID_165778
atgggaattttgagtactattgcaagcttttttggatttggagtgggaacttcaattgggctagtcattggctactatttgttcatatacttccagccaacagatgttaaggaatatcagggaatgctgaaattcatagtggggaaagagtggcatcttagggatccagtaattcaacctttggttgagcaagatgctaaaacattacaactgttgcttccagagatacccacttggattaaaaacccagactatgaccgtctcgactggcttaataaatttatattgtatatgtggccttatctggacaaggcaatttgcaagactgcaaggagtatagcaaagcccattattgctgagcaaattccgaagtacaaaattgattcagttgaatttgaagaacttagcttgggttctctgccaccaacttttcaaggttga

SEQ ID NO: 74094 - DNA, 462 bp, Glycine max
  Peptide Sequence Number=SeqID_165779
atggctgtgtctgatgctgtggtgagtaacctaacgctgctctatgtggcgctgatcctctctattaaggcctacggcttcctgtgcggacgcagcttcagcggctgctttgtgctcgttgcgtccaccgccgcggtggcgctcattctcgttgccacgctgacgtgggacgtgtctcgcaaggccacgtatgcatttgccgccgttcagcctcctcctcctcctccgccgccgccgcaccacacccacgaaacgtgcaaaggtggcatctgctggcacggcgtggcggtgcgatcgccggcgtcgcagttaaaaaaacttggcactcattgtccaagactcttcgctatgcaaagatatgggaatgactcttcgctatgcaaaggtttggagttggagacactgatgactgatcataatggagtgagcaaagcagcggtttcttttgctgacatgatatga

SEQ ID NO: 74095 - DNA, 255 bp, Glycine max
  Peptide Sequence Number=SeqID_165780
atgttgagtcaacatcccaatatcttaaacaacattgactctgtgatgaagagagaatctcctctatccctgcattacaaactgtttgaggggacacatgtcccagacattgtctcgacatcagggaaagctgctgtttcaggtgctgtgtccaaggatgatttgattgctgaactcaaggacacatgcaaactgatagaagatgctgcagctagagcatggagacagggggagcagaaagctgatgtcacatga

SEQ ID NO: 74096 - DNA, 294 bp, Glycine max
  Peptide Sequence Number=SeqID_165781
atgccaaatcataaaagcactgagtcaacactgaaaaaccttgaggtccaggtgggacaactggctaagcagatagctgacaagtcatccaatagttttgtggcaaatacagaacaaaatcccaaggaggaatgcaaagcggtgatgacaaggagtaagaggtttgtggaagctgaggatgaagaaagtgtggtgtacaatgagaaagtggctgaaaagaaaagtgttgaagtaccatatcctgtggtaccttctaagaaggaaaaagtgttggatcaagtggcctcaaaatag

SEQ ID NO: 74097 - DNA, 174 bp, Glycine max
  Peptide Sequence Number=SeqID_165782
atggcggtttgtggtggctactggtggctgtgggtgacggagaaagtgcttggaacattggaaatggctcaaaacgcacaagtgactaaagctctcggaaacggaaacgtcgccctcactccagatgtcttgtcaaagatccctatggtccgatcgtggacaagtgttctgtga

SEQ ID NO: 74098 - DNA, 561 bp, Glycine max
  Peptide Sequence Number=SeqID_165783
accgagacacacatgttggccatcatcagcaagttcaaagaagaattaaatttggccaccgcccacgagcacaaagtggcggacaaatacgcccgagtgtacgtggaaaaggaggctagaggaagggtgattgactcattacatcaagaagcaacaatgtggatggaccgatttgctcttactttgaacgggagtcaagaacttcctcaattactagcaaaggccaaagcaatggcggacgcgtactccgcccttgaggaaatccactggctcctcagctattgtcagaccgacgccataactaagtgcgccctaaggcatccctatcgccccagatccaagtctaggacgatgggtgacctagaggaagtacaggaacagatgaaagctgacatgtcagctttgaaagaacaaatggcttctatgatggaggccatgctgggaatgaaacgactaatagagaggaacgcggccaccgccgtcgccgctagcacggttgccgaggcaaacccggctctcccgattgctatgcaccatcccgttccaaacatggtgggatga

SEQ ID NO: 74099 - DNA, 624 bp, Glycine max
  Peptide Sequence Number=SeqID_165784
cgtgactcaaacgtcaatatgacagatcttgtgagcacggaagatgaccaaaagaatgtttatacggataaccacttgggtatttctgcccgtcagcgtgactcaaatgtcagtatgacagatcttgtgagcacggaagatgaccaaaagaatgtttatacggataaccactcgggtatttccgcccgtcagcgtgactcaaatgtcagtatgacagatcttgtgagcgcggaagatgaccaaaaaaatgtttatacggataaccactcgggtatttccgcccgtcagcgtgactcaaatgttagtatgacagatcttgtgagcgcggatgatgacacggataaccactcgggtatttccgtccgtcagcgtgactcaaatgtcagtatgacagatcttgtgagcgcggaagatgacgctttctgtcctacagatagcaaaagaatgtttatgaaagtgcggacaaccacttgggtatctccgcatgtcaccgaggctcttgctcctatgtatcctcaaatgaggaattcagacctacgtagtcctggagcaacatatgcctttcggatgaaaaacaatgtgtctaccggggatggggagtacgctgatgaaatcctcccataa

SEQ ID NO: 74100 - DNA, 459 bp, Glycine max
  Peptide Sequence Number=SeqID_165785
atgggtaaagtagaggaggcgcaagagcagatgaaggctgacatggaggccatgaaagagcaaatggccacaatgatggaggccatgatgagcatgaagaagataatggaagccaatgcggttacagttgccgctatcagcgctattgttaaggtgaacccgatgcccccatctggccttaaccaaatgaatcatccaacctcagatatggtagacaaagatttgggaactgacttcgagccttgcctcggatatgccactgaagggcaagcagttggtggtatacccatgccaaacactttggagggccctcagtttcgcccacaaccacaacccttgcattttgcggtgggaagagcctctcctgctatgcctaaaaagggaaaggtggatcatctaaaggaaaggctcagggccattgaaggaggtgaagattatgcctttgctaacctagaatag

SEQ ID NO: 74101 - DNA, 552 bp, Glycine max
  Peptide Sequence Number=SeqID_165786
atgaaagtgacgatgatgccccctagcagtgaaggcctactgcatcagcccgaattgatcgacgaccagccagaagcacctgttgaagaaggtgttactgatgttgagggttttccaggtggaccccatgacacgtcaattctcacagattttgaaaatcacatcgctttgagagtgtggaatggagaggaatgtcctgagttgaagctatcttcccatggaaggaaaatgactaagtttgaaaggcctgctccagagattgaaggccttgtggcgactagtggattgagtcctttgatcgcttgttccctagatacaggcaatcggggactaatgtttgcatttgtggaatgctggcataaggaaactagcagtttccatttgctcgtcggagaggtgactatcaccttggatgacattgcatcgttgctacatttgcctgttataggggcgttccacaacttcgagctacttcatgtcaacgacgttgtcgagatgttggtggaattactcgaggtcagcgctgcagaggcaagacttgagacaatttag

SEQ ID NO: 74102 - DNA, 579 bp, Glycine max
  Peptide Sequence Number=SeqID_165787
atggccaagtttgatccagacatagtcctcgaattttatgccaatgcttggcctacagaggagggcgtgcgagatatgaggtcttgggtgaggggtcagtggatcccgtttgatgcagatgctatcagccagctcctgggatatcctttagtgctggaagagggtcaagagtgcgagtatggccagaggaggaaccggttcgatgggttcgacgaggaggccatcgcccagttgctatgtatacggatcatgcgcaccatcatgacctccctgactcagatctggatgactttgctgctcagcaacatccagcccagcgaccataattccgcctccccctgccgaagtgtcagctggtgtatggcgcctaccaggcaccttctggacccggataagtccaacaaggccctgggatttcccgccttgatcacaggactctgcctgtcgttcggagtccctgtcgcacctagcaaggtgatttggccgcccatcacccgtgcttttattgagaagtattgcaagcagagacaggtccagggggatgctccgcaggccgcaaatgcgccgccacctcattag

SEQ ID NO: 74103 - DNA, 608 bp, Glycine max
  Peptide Sequence Number=SeqID_165788
atgtcggtctcttcgcgtcaacgggctcgtttgccccctggtttgacgaaaggtgcgagtaaccataaggagacaatgttagtctcagtgcgtcaacgggctcgtttggcctctggtgtaggagacaatgttagtctctgtgcatcaacgggctcgtttggcctcgggttgatgaaaggtgtgggtaaccataaggtagtctacgcggaagacgacgtaaatctctgtgtgtcaatgggcttgctggccgcgattgacaaagggtgcagaagacgattctgcacggaagacgatataaatctctgcgtgtcaatgggcttgctggccgtgattgacaaagggctatggtctgcgcggaagatgtgctctgctgtatggctccgcatgtcacctgacaaaggggatgacagtgtctctgcaatcatgccattcgcgggcgagcgagggcgaggctcacgggtgcgctttcccaaaggaggaaagatgcgcggagtcgccaccaacgtttatttgtggaaaacgtcggaaaaaccgaaggaaaccggtcaaaatgaaattctaagttcgggagttgtatttacacttgaggaaggtattacacctctcac

SEQ ID NO: 74104 - DNA, 63 bp, Glycine max
  Peptide Sequence Number=SeqID_165789
atggcattagaagaactcagagccaaacctagttcaactacaacaaagcaaggagagttgtaa

SEQ ID NO: 74105 - DNA, 192 bp, Glycine max
  Peptide Sequence Number=SeqID_165790
atgactctttcacagcaacacgatgccccaatggcaacacctaacgccccatttgctccgcaatggaatgagttttctactgaggctgagcaagtagaagcggggagacaacgcggcagaagaaatcctgatcgtcaagcgaagatgggatcgaccatgtggcacatcctcacgacatcacggacaccataa

SEQ ID NO: 74106 - DNA, 147 bp, Glycine max
  Peptide Sequence Number=SeqID_165791
atgaccacatttaaggttcctaacaaaaaactcactgatgtaatcctccctaggaagggactagtcactagagccatgagcaagaggctccaagaggattgggctagagctgctgaagaaggcgctagggttctcatgaatctcagg

SEQ ID NO: 74107 - DNA, 397 bp, Glycine max
  Peptide Sequence Number=SeqID_165792
aatcatgcctctgcctttctcttatttgggaataccaatcggggctaatccaaggcgctgtgggttatgggatccaatcctaagaaagactgaatctaaattgtctagaattcctaacagggtagcggaaaaactgacccaaatccagaggaggttcctatggggtggtggccttgatcagaagaaaattgcatgggttaaatgggactgctggctcatggaacaggaacctttaagggcgaaatatcccagattgtataacatatcctgtcaacagcagaagcttattcaggatatgggatgtcactctgcaaatgtttgggaatggaaacttgaatggagaagacacctttttgaatggagaagccagtttctgtgtgtgtgtgcggaagcttga

SEQ ID NO: 74108 - DNA, 117 bp, Glycine max
  Peptide Sequence Number=SeqID_165793
atggcctttgtcgataactgggcggtgggtaaggacaagtcacagcacgggcttctccttcatcctcaccctcttcatttgccccagttttctcattcgtccaagcaggatgagtaa

SEQ ID NO: 74109 - DNA, 573 bp, Glycine max
  Peptide Sequence Number=SeqID_165794
atggtgctggtactacgtgggatgcatctagattttgatcatatttgtgaccaagtcttaactggccaagaagttgtttctctagagaatttaattatccgactccttcgagtcccctcaccaaaaataagaggaaattcagttgacagtattgaaacttctgccatggtatctaatcgaggtggacgaagtggttgtggaaaccgaggaggacgaactagaagaggaggtcgccctcaatgttcttactataagagagtgggtcacacacaagacacttgttattctattcatggattccccagaaaatcggtgaatatttcaaagtctgaaacatctgagataaagttttcgaagactaactatcaagagtatcttcaactaaaagctgccaaggaatctcaaacatcatcttctataagtggtcataactccattgcctgcatttcccaatttgccgatggttctagagttgcagcaacaagaatcggccatgaatgtggtacgggtcggacgattggcgtaggacatgaatctcatggtctttactacctcaagcctaatctttcttgg

SEQ ID NO: 74110 - DNA, 270 bp, Glycine max
  Peptide Sequence Number=SeqID_165795
atggcagcggaatggagaaggaagagagagaggagacgccagttcaaggagaagatgagtctagaagaagctcaccaccataggaggccatggataagagcttggaggaagaaggagatgaatgaagggagagggagagaagagcatgaaattttgtgctctaaaagagctctgaaatctgaaatgaataagagcggaatggagaaggaagagggagaggagacgccacttcaaggagaagatgagtctagaagaagctcaccaccatag

SEQ ID NO: 74111 - DNA, 174 bp, Glycine max
  Peptide Sequence Number=SeqID_165796
atggaggtgagggtggggtttgtcgcggagtggagagtgggggtggcgtgggtggcatgtgaccgggatcaccttgatgattcaataaacgaaaggcatctccacggaggaggcgtgacccctaacgccaccgagcccagggctttgcggtgcgaggccgccataaggtcatga

SEQ ID NO: 74112 - DNA, 1299 bp, Glycine max
  Peptide Sequence Number=SeqID_165797
atgacgtttagcaacaccaaaatcaccataaaggtgttgaggggtgaggatgcacagatcggactcactgcaccgcagaaggatccgaactccgcgagcgaggaagaggaggtggagatgcgggggctggaaacaatgagagggtcgattgggtcgtcgaggaataagggaacaagaagaagaaagttgatatcgacggtagaagcagtggttgacggtggcaaggtagtaggttgcgttattgatatcgacggcgacgaaggtggcccaggtgaagaagactggaacatgaccacaaaattcaatgatccttcaccccaaaattactatgggcaatatcgacattctaatttaaggaacgaacaaaaatggagaattcgacccaagaatcccacctccgatccgaaaactcccttcattgaagaatacaccaaccgcgttgacatcctctccttccaccccgacaccctctccctcacccccaacccttctctctcctttgaccacccttaccctcccaccaaactcatgttccacccccgcaaacccccctcctcctcctccgacctcctcgccacctccggcgactacctccgcctctgggaggtccgcgacaactccgtggaggccgtctcccttttcaacaacagcaagaccagcgagttctgcgcccccttaacctccttcgactggaacgatatcgaccccaaccgcatcgccacctccagcatcgacaccacctgcaccatctgggacatcgaacgcaccctcgtcgaaacccaactcatcgcgcacgacaaagaggtctacgacatcgcatggggagaggccagagtcttcgcctccgtctccgccgacggctccgttagaatcttcgacctacgcgacaaggagcactccaccatcatctacgagagcccccaccctgacacccctctgctccgtttggcttggaacaaacaggacctgaggtacatggctactattttaatggacagtaataaagttgtgattttggatattaggtctcccactacccctgttgcggagttagagaggcaccgtgggagtgtgaacgctattgcttgggctcctcatagttccacgcatatttgttctgctggggatgatactcaggctcttatttgggatttgcccactctggcttctcccactgggattgatcccgtgtgtatgtattctgctggctgtgaaattaaccagctgcagtggtctgccgtgcagcccgaatggattgccattgcttttgccaacaagatgcagcttttgaaggtttga

SEQ ID NO: 74113 - DNA, 252 bp, Glycine max
  Peptide Sequence Number=SeqID_165798
atgtggggcttcgaggacgagactaggaagcagacggagagggccgtgaggagtagatccggcagggaggggagggtcgtctgcggcggcggcgggaacatctcaaccggcggagcgatgatgatgcagcgtgtaaggggtgcgtgtgttgatggaaaggtccatgcttggaaaaacaaatacgaggtcggggatggtcgtttggttgttgcgtttttgttagacgtgttctcaacaatgcctattgattga

SEQ ID NO: 74114 - DNA, 831 bp, Glycine max
  Peptide Sequence Number=SeqID_165799
atgcctctccaccaaaaaccatcattctccaatctcccatgcttaacctcaccctctctcctcctccagtgccaccgtcgacaccagagccagcgtcaccaccgcaaccctatcatctccggtcacaaccacttatccaatatatcccaacaagccaacctctgcaaagtccacatcgtactctccctcggattcttcgaacccgcgttcctcgtaaccctattattccttctcaatgcttcgataaaaaggaagacaccgaataatgacaagtgggccatcacgtccgtgctcctcacgtgcctccccgttgcgacgctccaagcattgctcatattcttcgcccctttcaagaaccgtgtgccggcggaaagctcggtggttctgaacgacggttacggcttcgagaccgtgctctgcgcgtacccttttctgagtagtgttctttttgcggtgtttggtgttgcgtactcgtcgtggttcttgttctcgtgttggagggttttgttgcttgtcatcaacaaaggcttgagggtgaggatttacgtgttggcttcgattgtgctcgtggcgattccgctgcagattgtgtctttagggttcagcgttctgtggagcccgcaccaggaggtttacggagttgtttcgctcgtggggttcctcgccgcgttcggctgcgccaccgccggggagggcattctcgtcattaagcctatctccgatgcgttggacgctgggggaaactgttgcgtgtcgaccccgcagccgggggcaaggcaaagtgaagaaaccgaagaatcaggtgtcgtcgttcgtttggagggagggtaa

SEQ ID NO: 74115 - DNA, 312 bp, Glycine max
  Peptide Sequence Number=SeqID_165800
atggcagtctcagtttgcagtatcaacattaaccccatagcattagcaacaccatctttctcattcaagtctctcaaattcccttccttctggccaacacaaaaggtgaagatgggtcctctgagtgtgtctcccatgagatttggaacatgggcatgggggacaacggcatcaatctctttgatctttgacactgctgattcttatggcactggaaagttaaatggtcagggcgagaagcttctggggaggttcattcgagaatttcaaggtttcatcacgcattcctttctcactttgattcaattttag

SEQ ID NO: 74116 - DNA, 804 bp, Glycine max
  Peptide Sequence Number=SeqID_165801
atgtatcgaatgattggagcattgtatatgcagaaacaaaagctacgtacggtcttacttggagttctcaattgcattgacatgaacgtcacgaggcgcgagagtggagttacttttcctcttggcgagaaacttgttcttggttttcttctctctgactttccaaacgttgttcttcctgaacacgaacttgtccaccttccacccagggctactcgtgtcgatcaccgtcacttcgctcttcgtgaaccccttcaattcgttcccctcttcctcgtcctcaccgcggtccgcggcggcctcctcttccacttccggcaccgccgggtcgccgctgggagcggcaggcaaggcggcggggacggagggtttggagtttgtggtggtggtggtggcggaggaagcgaggaagattttagggtttgtctgtttccgggggcattttttgttggttttggagagggtggcgcccatgcagaagagctcagcgaggatggtgctcatgggcatgggctcgtcgcgggcctcggaaggagggttccggggcgggtcattggggcgggcctgaggggattgcggatgggccgtgaggaggaaggaatcgaggttgggttcgtcgccggtggggatgcccttgttggaccggaggcggtcgagccagttcagaccggattttccggtctgggccgagcagagcatggggaaggttctagagaaaatggacgggcactgcaaggagtaagagagaaacaaaggggaaaggaagaatgcgcgtcggtgactgccacgtggacgacaaagtga

SEQ ID NO: 74117 - DNA, 2220 bp, Glycine max
  Peptide Sequence Number=SeqID_165802
atggcttccacttttgagggtggatcagacttagagaaagagaacaacaacattgctgagagtgaagaagagtgtccagtgaaacaagttgaactcaccgtccctaaaacagatgaccccaccatgcagcttctaacgttcagaatgtgggttcttggggttctttcgtgcgtgttattgtcctttgtgaatcagttcttttggtacagaacacagcctttgattgtaacctcaatttctgcacagattgctgttgttcctattggccacttcctggcaaggactctgccaacgcgtgtgttcttcaaggatacaaggtttgagttctcactcaaccgtggaccgttcaatatcaaagagcatgttctgataaccatctttgcaaattctggtgctggaactgtgtatgctactcatattttgagtgcggtgaagctcatgtataaaagaaggctcgatttcctccctgccttattagtcatgttaactactcaggtgctggggtttggttgggcaggactgttccggaaatttctggttgagccaggggaaatgtggtggccttctaatctggtccaggtttcattattcagtgctctacatgagaaaagcaaaaggcctaaaggaggcacaacacgtacccaatttttcctccttgccttggtcttgggcttggcttactatgtgtttcctggctatctgttttcaatgttgacatctttctcttggatgtgttggcttgcccccaagtctatcctagtccaacaactaggttctggcttgaggggtcttggaattgcagcatttggaattgattggtctaccatttcttcttacctcggcagtccactagctagcccctggtttgctactgctaacattgctgttgggtttttccttgttatgtatgtgatgacaccaattgcttactggtctaatgcctatgaggccaagacttttccaatattttcaagcaagctgttcatgggaaatggttcactgtatgacatttcgactattgtcaactctgaattccatctcgatcggcaagcttattcaatcaacgggcctgtgcatctcagcacattctttgcaatgacatatggccttggattcgcagcactttcggctacagttgtgcatgttctgctctttcatggaagggaaatattgatgcaaagtaaaagggccttcggaaacagtaaaaaaattgacatacacacaagacttatgagaaggtacaaatcagtccccatgtggtggttttacatcattctagcagcgaacatagctcttattatatttatttgtgagtactacaacgaatcactccagttaccatggtggggtgtattgctagcttgtgcaatttccattttcttcactcttccaatcggtataataaatgctactacaaatcagcaacccggtttaaacatcataacagaatacataattggttacatgtatccagagcgccctgtggctaatatgtgctttaaggtgtatggctacatcagcatggttcaagcactgagctttttgcaagacttcaaacttggacattatatgaagattccaccaaggacaatgttcatggcacaggtggtaggaacaatcttatcagtatttatatacacaataacagcatggtggttgatgagaaccatccctcacctttgtgatactaccatgttggatcctgatagcccttggacttgcccaatggacaatgtgttctttgatgcatcagttatatggggtcttcttggaccgcgcagaatctttggagaccttggtgaatatgccaaagtgaacttgttcttctttggtggagctattgcaccctttctagtttggcttgctcacaaggcatttccagggcaaagatggataactctaattcacatgcctgtgttgttgggtgcaacatcaatgatgccgcctgcaaccgccgttaacttcactagttggttactggttggctttctctcagggtacgttgcatatagatatcgacaagaatggtggaagcgctgcaattatgtgttgtctggtggtcttgatgctggaactgcctttatgacaatcttgctgtttcttgctttgaacaataacaacattatgcttaactggtgggggaataaccctgaagggtgccccttggctacttgtcctactgaaaaaggcattgtagttaaaggttgcccagtgcattaa

SEQ ID NO: 74118 - DNA, 78 bp, Glycine max
  Peptide Sequence Number=SeqID_165803
atggcaaagagccaacaaagcactgatttcaaattgctgctcttcagtaaaattatgaggcatcctaataagggttga

SEQ ID NO: 74119 - DNA, 2112 bp, Glycine max
  Peptide Sequence Number=SeqID_165804
atgggtagcttcagcgaagacgaggaatgtcggtttttcgatgctcaagaggatgttgtgtccattccagatgaaggggtatccaatggttttgattatgaagtgtggattcggagtccaaggagtgtgagagagcgtaggggcaagtttatgaagaggatgggactgagtagtgtggatttggttgcccttgaaaatgaaaattcagtagatgtgcgtagtgttgaatgtgaagaggaggttatggacagagtaaatgttaacagtggggccgtgacccgaaattgtgttatggaagaggaattctgttcaagcaggacatcaatgtcttgttggcatagggagaattcttcaggggagtttggtatggtggatagttcgccgtgtcatgatggaaatttggagggtaatgtggatcaggaggggttgcagtgtcgggagatgagtgagggaagagatctggattcagatcggtcggtggttgcggaggaatttaaggaatcagaaaatgccttaaggggaacgaatggtaatgttactgttgggaagatgaacaagtatagaaagggttggctcagaagattgcggtcgataacgtgcatggttaataggcaagaggaaggtgataatgggagagaagaaggtcttggtgaaatgtcaggaacttgtaggcttcagaaagttaaggtccgccagtccaagaagcaaatgaaggaactttcggctctttacatgaggcaagatatccaagcgcatgaaggttcgattttgaccatgaagttcagtcctgatgggcagtatcttgctagtggtggtgaagatggggttgtgcgcttgtggcaagtggttgaggaggataggtgtaatgaagttgacattccagaaattgacctgtcctgcatttattttactgtgaataatctctctgaattgacaccactgtttatcgataaagaaaaaataagcaaactgaagagcctgaaaaaaacatcagattcagcttgcattgtttttcctcctaagatcttccggttgttggagaaaccattgcatgagtttcgggggcacagaggtgaagttttggatctctcttggtcaagcaataattatcttctgtcatcttcagttgacaaaactgttcgtctatggcaagtgaatcatgaccgttgcttgaaagttttctcacacagtaattatgtgacgtgcatacaattcaatcccgtggatgataattatttcattagtggatctatagatggaaaagtacgcatctgggcaattcctgattgccatgttgttgattggattgatatcaaagatatagtaactgcggtatgctatcggcctgatgggcagggagggatcattggctccttggctggcaattgccggttttataatgtatcagagaatcgcttgcaattagattcccaactatgcttaattggtaaaaagaaactttcaggcagagggataactgggtttcagtttcttccacaagattctaacaaagttatggtctcctgtgctgattcacaagtcagaatccttgatgggtttaatgtgattggcaagtacaaaaaccttagcacagggagcccaatgtgtgcatcattgacttctgatgggaaacatattctatcagcatgtgaggactctaacgtatatctatggaatgttagtcaagaagagtctaatcctgtgaaagctaagaagattacatcttgtgagcgttttttctcaaatgcgtccatagcagtaacttggcatggtttgaaatcgcaaaatattgaaatccaacatcaactggatgccttggataaaagatcatctcaagttatacaactcagtcctcctgcttcattctccctgagtcaagagttcttcttggagtcttttccaaagggatctgcaacttggccagaggagaagcttcctgtttcaagccccaaggctaaaacatcagtgatgcgtaaatccgagtacaagttcttgaaatcttcttgcaagagtacctcctctgctcatgcatggggtatggtcattgtcactgctggctgggatggtaggataaaatcattccacaattatgggctacctatactggcttga

SEQ ID NO: 74120 - DNA, 261 bp, Glycine max
  Peptide Sequence Number=SeqID_165805
atggaagccattcatggatttgccagggaaggagatatggctaatctgctcaagtgtattgaaaatggtgtttccatgaatttaaaggacagtgagggccggacaccattacactgggctgtggatcgtggccaccttaatgtcacagagttgcttgttggcaagaatgctgatgtgaatgccaaggtattctcattcatatatgctttagatgtgctaatgtcggggactacttatatttctatattggcattgccgtaa

SEQ ID NO: 74121 - DNA, 657 bp, Glycine max
  Peptide Sequence Number=SeqID_165806
atggagatttcaccattggagggtttctccgagcttgattggccatattcaagcaaccacctttgcttcaatgagtttccagatttagaaaatctggacctcgatttcagcctcccaccccttggtgaatatttggaggaggagctggaccaaaagcccttgaacattgttgtttcccaaggggtccattgtaatcgggaaaagggttttggtgaagcttcttcgttcacgattgaaaatgggtcagccactgcgagctatgtgcagaatattattcgtcagaggccacagccggtgtctagtagcagtaagaagaagacatgtgtgttaaaatttgatgagataaggaagcattttggtgttcctataactgaagctgcgaagcgattgaatgtggggctaaccatgttgaagagaaggtgcagggagctcaacgtgaagaggtggccacataggaaactcaagagcttgcaattactcatcgacaatgttaaggaaatgggtttggaagacgaggttgcaagggtggagaagcataaaaggttgctggaaaaattaccaggaatggaactaagtgaagaagccaagaagctgaggcaagcttgctttaaagctaattacaagaagagaaggtgcatggcatcactccaagcttga

SEQ ID NO: 74122 - DNA, 468 bp, Glycine max
  Peptide Sequence Number=SeqID_165807
atggtcttatctctgaaacgtgttcgctgcccatgtgctggccatgcacttgaagccgctgcagacccacaaccagatgacaaagaggacagcgcagacgaacaaatcgaggaggaggaggacccacacgtgtttcttccaaacgtgcttggccttgttgctgtggttgtggagctggggcttgagcgaaacggcgtcgtcggagacgtcgagcgtggcgggcgcgtcattgggccttttctttttcttcaagccctgagctggagggttgagaggaggagagggttgttgttgttgctgcgatctgttgttgtcgtgaagcgcgttttggaagatggaggatctgatgcggtggaggaaggggagggtttgggatttgaggagggagtggtgggagatggagaagaagacgaagggagggtcgatgaggaaggtgtatgtgcggtggttgacggtgtgggagaatag

SEQ ID NO: 74123 - DNA, 471 bp, Glycine max
  Peptide Sequence Number=SeqID_165808
atgaggacgcgggttcatgggggcgtcgttgaggaactgcttgtagtgttcgagggcggtgtcgggtttgcggcaatcgaggtaggtctggaatacgaggttgtgggtgatgatgttggggaccacgccggcctgcgtgatgaagcggtggagggagaggaggtcggagtagcgggactggcggaggagggcggcgaggacggcgttaatggtgaagatggtggggcggcagttggagtagatcgagtggcgcgtgtacagcgccgcctcgtcgagggtttagataatagggtgattgtaggggctttggagcggtttgggtgcggttcagggcggagaggggcggttccatgcggagctggcgctttcttcggcggcgctccgccgcggcctcctccggggaggagaaggagaggaggcggattgaaacgcacgaggaagggcggcggtgagaattggagagggttctga

SEQ ID NO: 74124 - DNA, 747 bp, Glycine max
  Peptide Sequence Number=SeqID_165809
atggaggttagctttaaagcaaaaatctttatgggtgcagaaaggttgcactatcaaggagatggggtcatgggttgctgggaggtggatatggtcgtttgtgtggaggcgagcgtggttcgaatgggaaaccccaatggtggaggacctaatgcggcagatgcaacagctagggttttcaaagatagattaccaactagtgtgaacctagaaaaacgtgggattcgactaggaggactacaacaccggtgtgtattctgtaatatggaggaggaagatctaacacacatgctctttaaatgcaaattttctatggcagtgtgggcaaattgctataaatggctaggccgggagtacaatgggtcagccataaagatccctgtatgcatcttcagcaacacaattgttattggttgggaaagcgatcctttgcagtatggtgtgcagtggcttggaccctatggagccatcgaaacagagttatttttgcagaagagagggaggattttaacgaggaattgggttggttgggattatcggcatgaaggagacaaaaactgcaccgtgttctttaattgcagtgaaggaaagaggtgttatcaaccaagttggtcatgctcgggggaaggggtgacaagggagttaatggatataagggcacaaaaggaattggtcaatatgaagcagaggataggaagttactctgaatttgtaaatccgatggggtatttccagtacccaaattaa

SEQ ID NO: 74125 - DNA, 852 bp, Glycine max
  Peptide Sequence Number=SeqID_165810
atgcttgctgatcctgtggttgcagctgctagtggttctggtttcatcgcaaaagacatgacgttcgagaactacgcagggccggggaggcatcaggcggtggccctccgcgtcggagcagaccacgcggtggtgtaccggtgcaacatcatcggataccaagacacaatgtatgtccactcgaaccgtcaattttaccgagaatgcgacatttacggaaccgtggacttcatattcggcaacgccgcggtggtgttccaaaactgcaccctctgggcccgaaagcccatggcccaacagaagaacaccatcacggcccaaaaccgaaaggacccgaatcagaacacgggcatttcgatccacaattgtaggatcatggccacgccggatcttgaagcatccaagggtagctaccccacttatctgggacgtccttggaaactttacgctagaaccgtcttcatgctgtcctacataggggaccacgtgcatccacgtggctggctcgagtggaacacttcctcctttgctttagacacgtgttattatggtgaatacatgaattatgggccgggttcagctctgggccaacgggttaattgggccggctatcgggccatcaattcgacggtggaagcgtctagattcacggtgggccagtttatatcgggctcgtcctggttgccctctaccggagtggcgttcattgctgggttatcaacgaaaaagaccaacgcaactggagaggagagtcgtggaaaaaccgaaaaatacttcgcgtttgtcagctttgctttctttctttttggtgggggatccatcacgttatcagcattcaacatgacctcttga

SEQ ID NO: 74126 - DNA, 801 bp, Glycine max
  Peptide Sequence Number=SeqID_165811
atgtctttaatgcaggatgaccttgttcagtcttctgtcatgtcagagtatgatttggcagcagagggagatctgttcaaagctcctgaacctattattgaagagccaatcatggatatggatcccatgacagccaccatctccatgatatcttgtggggaagatgtctcctcacagggactaaaatccactgatattgatattcttcaaaatgatcagtttctgcatgaggtgttctatgaatgtgaaaaggatctcttagaaaaggcagcaatagagccaccattctctgagattctggaaatcaaggttcctcttctgaacattgatgagaacacaattcaagaaaacaagctgcttcctgacatgcaattagcaaagagtgtcagctcaggaagtttgagctcaatggactggatgcgtggagctgcaatgaagcctgctttcattgatatccctgcaatagatttcaatgcagattatggcatgcggagatcatttagcgaaggagatataaagactcttggtaatggtaacatgaacatcgtccaatcaccccttgagaggcccttgcttatcagcaactgcaccagtgaggaacgctttcaaaagctctcaagatacaggaataagaggacaaagaggaattttgggaggaaaatcaagccaaaacaaattccgaaatcagctgatgatatgcttttttttcagtatgcttgcaggaaggctcttgctgacagtcagccaagaatccgtgggagatttgcaaggactgaagagtctgatgtcaagagggaatga

SEQ ID NO: 74127 - DNA, 1959 bp, Glycine max
  Peptide Sequence Number=SeqID_165812
atggcgctttgtagaactgggccgaacccaattccggggagttattcagctcaaaatttgtcgacaaaacttattgtacctgctcccctgcgttttaccagacaattctctaatttagtcaggagaaagcgcaagggagtgtgctgctcttcattaaggaatgctgcatctgcatcttctaaggagtcactggaagatgctccaactaccttgtcagtttgcttggaggaggaaacagatcatgttatacagttcaaaatgtcagactttaagattttagatactgttagtgttggccttggcgggaggagttgtacttcgacagcttccagtgcacaagctcagcgtcgtgggaaacgagcaatagaggtattaaagaagctggttcggcgtaaactgctgtatcattcttactcaatgcaagttcatggttatatctctttgcctgcaagtgatgctagtggttcatttatcctagtacatgggtatcacggtagtttttctttgagacactggcttcaacagtcggattggcttccaactttggaggctactcttgcactggatgaagagtctgttaggaaggtaggagaagatttcactggaggtcctgcagtttctaggcagttgcgacttgttcgaatattgatgagggatcttcttattggggtaaattacttgcacagccatggtcttgcccatacagagttgagactggaaaatgttcatataagtccaatagacagacatattaaagtaggtatattgggtaatgctgctgacttttacaaggatggttcgaatggtagctctttggacaacttggacaggagacagatgatgattgcatttgacatgagatgcatgggcttcataatggctaaaatggtaatgcgggaacttatggatcctttgatttttgcaaagttcaaatcgttcctcacaaaggggtatgatccttcatgtctgcgagagtttatattggaaatccttggcagaagttccccttatggaaatgctggattacaaatacttgataggaactggggagctggttggcaccttttatctttattgcttgctactaaaccttctcaaaggataagttgtttggatgctcttcgacacccattcctttgtgggccaagatggcgagtagtcccatcaatggatattatccgatggggtctgggttctactgcaatgcgtattagggagaagtacatctatcgtcagcctcagcaaagcaggcttgcccacttcattgacttaatggagatgttgaatccccatccacagccaaggaactggttggagctgcttccaggcaaatggcgtctattatactccactgggaagcatgtaggcctgacccttcgccaacctcctctccgtgtactcgtcagcgacgtgcatttaaccgtgacaagagaatcaaaattgaaagataatctttcatttggctctgacattggattctctgtaatgattggtcaggactggcctcatgacaaagctggtaagagtggaagattgcaggtgaattctttatttacactaagatctgggagacggttatatctgaaacaagacaagaccacagagaagttcttctttggcccttccagcaatgtggaggctttagctcagaaatttaagggcaagaaatggagaaagatagtccctttcaaggagtttccatcaagtcttccagcagccaagcttgcatctggtgatattgatgtgagaatgaatcttgatgatccattaaatcgaaacgttgatactgcgagaaatgttctacaagaactaagaacacaaattccaccagaaatatttgatttgtcaaggcttgtgtgtggaacatatgtggactcaagaatgcttgtcctacgaggtgttaatggatccgcgctcctatttacaaggtcttttgtggatagaaacggttctagttag

SEQ ID NO: 74128 - DNA, 420 bp, Glycine max
  Peptide Sequence Number=SeqID_165813
atgggtcctatagtttttgaaaggaattggatatgtttgagtctttttccaggaagggacttcctcaaggagcataggaaatggttagcaggggatagaaaatcaatagatcctcggagagacaatgaaggggcgggggaggtggaagcgggagtggcaggagtggaggaggagcacggcggagatcacggcgcaatgatggcgaagtctttcccgcagagcttgcagaagtgcatgtgcctctgcaaggattttcacatcgttaagctccacgattttgctgttgtcatcgaagtcctctacgtcatcatcatcttcgagaggcgtagttgcctctttttattgatgacggcgggttctggattcagcttctttgaatgggacagtggatccggtgctccaacggcggcaaaattttga

SEQ ID NO: 74129 - DNA, 768 bp, Glycine max
  Peptide Sequence Number=SeqID_165814
atgtatctgttattctggaaacagtgcccttggatgcttaaagatgtgcattcatgtagggccaagtaccagaggaatgttgaagcctatcacaacaaaagcagcagcatgaagccaaacattgttcccaactgcatccggacagagaattacatgattacttttgaagttgaagaagaaaagtttccgttatttggaaagaaataccagctaaaatttgctaatgatgtctctgctgaaacccattgcttggttcattttccaagtttcatcaggttggccagggaagctggtcttgagtacgtggagattcaaaatttgaccgagttttatgatgacaacagagcacaattagcaggcctgctaacgcactatgttccaaacctcttggatcctagggggagacttcttcctcgttcatatgatgcactaggtctctacaccacatttatatttcaaaagcctgacccggaaattgcacccccaattgcgactccattattgccagatgttagttataatctcgacgaggtgcttttgtttctttttaattctatcaccacgattcctctaacttgctgggttaacattctcttaaaagatagtgtcgtccaccatgcagaccgcagaaaggtaaccattcggccagatgatgaaataataaatgggcatgcagtagaacctgctattgggctgggcaagataagcgaacaaaaagggatattgggcccaggccctgcagatttacgttttccagaagcactttga

SEQ ID NO: 74130 - DNA, 573 bp, Glycine max
  Peptide Sequence Number=SeqID_165815
atgtataaatgtcttgcgtttttttctcccaggatgattggtacaaattatattggtgcatttgctttaacaaagcttctactgccacttcttgaaagcagccctgtatcctccaaaattgtgaatgtatcatcctttacacatcgagctggtaaggataatcattataatccttacttctattattgtctggttgatgagggaactgtttctgggaagagattttttagatcaatacaatatccatgtgctcacatctatgagtattctaaatatcctggagttgtgcagacaaagctcatgcaagaagttccagcaatcctatcttggttagcattatatgtgttgaaacgtctacagctgttgcaatcccctgagtgtggggttgactctattattgatgctgctctagctccaccaggaacatcaggagcttacttttttgggggtaaaggtaggaccctcaacccttcaccactttcgcgaaacgccaaattagcacgtgaactttgggagagtacaagtaaactgctatctgtgaccccttttggtgctgagggtaacagctggtag

SEQ ID NO: 74131 - DNA, 90 bp, Glycine max
  Peptide Sequence Number=SeqID_165816
atggatcaacttgacacaatccaaagaaataaagtagaacaagatatcttcaagctaaggcttttcgtagggtacaggtttaatgcttaa

SEQ ID NO: 74132 - DNA, 912 bp, Glycine max
  Peptide Sequence Number=SeqID_165817
atggaagacagtatcctatgcaaacacacagtgcatcgcagcgtcaccaagaaactcatctcccccaaaaaatcatcccaaaccaattcttcaacacaaacagagcgcagaatagtgcggatttcatacactgatccagacgccaccgactcctccagcgacgaggaaggtttccccttggttcgcaaaagaatgaagcgctatgttaaccagattgaaatagaaaccgccgcggaaaaagttgttcggaagaggcccgccgcggccgtggggaaatgggcggcggagattcgagatccggcgagaagagtgcgtctctggctgggaacctacgacactgccgaagaagctgccatggtctacgacaatgccgctattcggcttcgaggccctgacgcgttgacaaacttcctaacgccaccgcaaagagagtctccgtctcaggcgacaacggtggcggtgaccgaagaagcctccggctccggctacgactccggcgacgaccattgccagcacaacctctcatctcccacttcggtgctccacttccgaagcaactcggagtctgatcagaaatcagaacaagtgttgagagagtgtgagggtgagggtgagtttttggcgctggataacatgcctctgcctgcttgggatgaagtgttcaatttcgaaacgccagagtaccctccccttctctttcaagaagggaattttcttcatgattatcagtcccagatgttgggtgaaacggtaccgttttcctcggaccaagggttcagtgacagtagtatcgtgctcgcagactcgctcatagatttcgacaaagcttgccctccaccatctaccttgtgccaggtggacgatttcttccaagacattttgttagcttctgatcctctcgttctgctctga

SEQ ID NO: 74133 - DNA, 543 bp, Glycine max
  Peptide Sequence Number=SeqID_165818
atggttccttttggggtgccaccttttgacctcggccttggcccttgggtaggaaaaaaggaaagggtttcgtacagaaaacgccaagttttagccatggcatcgaagcggatcttgaaggaactcaaggatctccaaaaggatcctcctacctcatgcagcgccggtcctgttgctgaagacatgtttcactggcaagcaacaattatgggtcctccagacagtccttatgctggaggtgttttcctagtcactattcatttccctccagattatccctttaagccacccaaggttgcattcaggacgaaggtatttcacccaaatataaatagcaatggaagcatttgccttgacatattgaaggagcagtggagccctgcgctaactatttcaaaggtgttgctctcaatttgttccctgttgacggaccctaatcctgacgatcctttggtccctgaaattgcccacatgtacaagacagacaggaacaagtacgagtcaactgccagaagctggacccagaaatatgccatgggttaa

SEQ ID NO: 74134 - DNA, 1329 bp, Glycine max
  Peptide Sequence Number=SeqID_165819
atgcagatcaggggatcgagtcacagactctccagtatgggcaataatcgatcccgcattcccgcgctcctcatctccatgttcgccactttcgcttctatctacgtcgctggaaggctgtggcaggacgcagagaatcgcgtttatctcatcaaagagctcgataggatcactggccagggacaatctgctatatctgtggatgatacattgaagatcatagcctgcagggaacaacataagaagctcgatgcaattgagacggaacttgctggagctagacaagagggttttgtttcaaaacccttgatagagactaatggaacttactcaatgagaaggccgttggtcgtgataggtatactgacaaagtttggtcgccagaagaatagagatgcaattcgaaaggcatggatggggagtggtgcatctttgaaaaaaattgaagaaggaaagggcatcattgtgcaatttgttattggtagaagtgaaaatcgtggagacaatcaagataaagacattgatcgtgagaataggctgactaatgacttcataattctcgacattctaggtatatcatttggcattcacttttctatgaaaatcctattgagttgtcttattctgaatttggaaatggaacctccagagtataattttttggatagattcaataatgcccctgagaattctgcccatgcaaaaattgaatctaccaagttgataaaagttagaatagggggaaatttcaccactgagaattctgttgcaagcaatttgtcaccacaaccaattgtgctggtcaagttagaccaagataatcatgtggaaacaaatgatgcattcccaaagaaggccaaattgttctttgctcatgctgcagacaaatgggatgctgagttttatgcgaaagtcaatgatgatgtctatgtaaatattgatgccttgggagctacactagctactcatttggacaaacctcgtgtttacatgggatgcatgaaatcaggggaagttttctctgagctagaatatttaatgattctcatactggtatctgtgaaatatgacaggaaccataaatggtatgaaccagagtggtggaaatttggtgacaaaaaatcatactttcgtcatgcatcaggagagatgtatgttatatcacaagctttggctaaatttatatcaataaacagatctattctccgtacctatgcccacgatgatgtgagtgctggatcctggtttatcgggcttgatgtgaagcatgttgatgaggccaagttttgttgctcatcttggtcgacaggtctccctctcttttcatga

SEQ ID NO: 74135 - DNA, 462 bp, Glycine max
  Peptide Sequence Number=SeqID_165820
atggacttcctgagttcgctctgttggccgctccaacgtcggaaaatcctcgctcctcaactccctcgtgtgccaaaagaagctcgccttaactttgaagaaacctgtgcaaagaaaaattgtgttctcaatgtcaggcatgtggtgatttcttctgtgttgaagcttgaaaggtgctgcatcttaagtgcacttgtacaaaaaacaaagagtttgacggtgaatgcttttttaaagaataaatgcttgaattattttgagagtgcagttacatcaataataattgatggcctggagagattgtatgtggagaggcttaagccattggagttcacctatcgattcaatgattgtgtatctccattattgaccgacagtgattttgatgctaaaccaatggtcatgctccttggtcaatattccacggaaaacaaccttcataaaacatttactaagatgtga

SEQ ID NO: 74136 - DNA, 828 bp, Glycine max
  Peptide Sequence Number=SeqID_165821
atggcattgagactgagactcaaagtgtcttcaattgggtcaccttttctgcagttaggttcttctgcaactgctgccttctcattctcccaaccatgctctcttcccaaacttgcttttcatccaccacgcttgcaactcaacaaaaattcacacccaataaggttccttgttcgggctggtagaactgagtccaaaggtgttaccttgggcttcagggccccacaatttcagcttccagagcctcttactgggaaggtttggacattggaagattttgaagcatatcctgctctattggttatgtttatatgtaaccactgtccattcgttaagcacctgaaaaaagacattgtaaagcttacaaaattctatgtggagaaaggacttgcggtgattgccatatcttcaaattccgtagccacacacccccaggatggtccagaattcatggcagaagatgctaaactgtttgactatccttttccatacctatatgatgagtcacaggatgttgcacaagattttggagcagtttgtactccagaattttaccttttcaaaaaggatggtcgaaggccctttgagctggtttatcatggtcaatttgatgattcacgtccaagtaataatgtacccctcactggaagagacttgagcttggcaatagatcgtgttcttagtggccaacctgtaccatcagagcaaaaacctagtttaggactctattactttcacgtgcttaaggtcattgtttttctatgcatgaagtgttggatgcagcataaagtggcacccaaggaagaagttttgattgataaactgtaa

SEQ ID NO: 74137 - DNA, 1300 bp, Glycine max
  Peptide Sequence Number=SeqID_165822
atgccaccaacagtgtcatccacttttaagtcagagagcgacactgagatatgtgcacacactggacactatccaaggaacattccaggtaaattccgcagagattcaggattacaggatggggatttgtctaagactgattttactggtggattttatgattctggcaacaacattaagtttaccatcaccacagcttatactgtgaccttgttgagttggactgttgtggagtatcgaagtaaatatgctgatattggtgagcttgatcatgtgagtgatatcctcagatggggtagtgattacctgctcaaggtgttcattcccccaagttcaacagctggatcaaaccttacactattttcccaggcaaatttagctggtgaaattgtggcagcattatctgcatcatcgatggtattcaaagaagacaaagattactcaaggagacttgtccaagcagcagaaagcctctttgaggcgatcacaagtgaagatccttcaaaacaagggacctacaccgtggctgaatgtgggaaacaagcaagaatgctttacaactcaactagctacaaagatgagttggcttggggagcaacatggttatttcttgccactgaaaacgctgattaccttgcaactgcaactgaaatttttttatcagccaagggttttgcttaccgtattcgatacttccgtgatcctggcttcccacttgaggatgctttgaaactctcatcaaactctaccgatgctctcatgtgttcttatctattcaataaatactttagcaggacatctggtggattgattatccttaaaccagataatgggtcattagtccagtatgctgctacagcatcttttctcagtaaattgtacagtgattaccatgatcatctcaaaatgtctgttcgtggtcatatcctttctaccactccccttccgaattttcaatcagtttatgcaactgtttttgccaaggcaaatcgccaagaggctatgcttgatagtgagtctactatggggattgcctttgctgttaagaagtattctaagaaaggaatccgcaagtgtacccactgcaatagggataatcatgtcatggagacatgttttaaacttcatggccatccggattggcatctaaaaggcaaaactactcccaatgccaaggtagatgctatttccaagagccatatttctactgttgttgtatttgtgaccaagtcaggtatatctaactctgctcttaatctttctgtcgttactaggggtagtgggtggataactgattcag

SEQ ID NO: 74138 - DNA, 441 bp, Glycine max
  Peptide Sequence Number=SeqID_165823
atgcccccgagttcaccatttttttttccgggaccccctgggggcccgcttttgcccccagccaaagggggaaaggacaaaagttccccatttttaggtggggaaaacgaagggccttggtttatcccagatatattggtcaacgtacacagggctggagaggaatctgttggagttataagagaggttctcccggatggctcttacagggtagctcttggatctagtggcaatggtgaagcgattacagcccttcctaatgaaatggaggctgtggtaccaagaaaatcagacaaaataaagattatgggtggggcattgcgtggtgccaccggcaaattgattggtgtagatggtactgatggaattgtaaaggtagatgacacattggatgtgaagattttagacttagttattttggcaaaattagctcaaccatga

SEQ ID NO: 74139 - DNA, 1836 bp, Glycine max
  Peptide Sequence Number=SeqID_165824
atggtggtcacatcctctgcgcgcgattacatcaatcgcatcttgcaggacatctccggcatgaaggttctcatcctcgattctcaaacggtaggtattgtgagtgtcgtgtattcacagtcggagcttcttcagaaagaagtgtttttggtagagttggtagattctatttccaagtcaaacgaatcaatgtcgcatctcaaggctgtttacttccttcgacctacatcggagaatatccagcttttgcgccgccaactggctagtcctagatttggagagtatcatctatttttctccaacatattgaaggacactcagattcacttacttgctgattcagatgaacaggaagttgtccagcaagttcaggagttctatgcagattttgttgccattgatccgtatcatttcactttgcacgtgccttcacattacatatatatgctcccagctatggtagatccttcaacagtgcagcgcttctctgatagggttgttgatggtcttgcagctctttttttggcattaaaacgaaggccagtaattaggtatcaaaggacatctgacattgcaaaaaggatagcacaggaagcagctaaattgatgtaccaagaggaaagtggtctttttgattttaggcgaatggaagtttctccactgctgttagtgattgacaggagggatgatcctgtaaccccactgctaaatcaatggacctatcaggctatggttcatgaattaataggaatccaagacaacaaagtggacttaaaatccattggtaaatttccaaaggatcaggaggaggttgtgttatcatcagaacaagattcatttttcaaagctaacatgtatgagaattttggagatataggtatgaatatcaagcggatggttgatgaatttcagcaagtgtcaaaaagtaaccagaacatccaaacaatagaggacatggccaaatttgttgataattatcctgagtacagaaaaatgcatggaaatgtgaccaaacatgttactttagtaactgaaatgagcaagatagttgaagagcgaaaacttatgtcagtttcgcaaacagaacaggagttggcttgcaatggaggacaaggagctgcttttgaggcagtgacaaatctactaaacaatgaaagcatatcagatgtggaccgactacgtctggtcatgctgtatgctttacgatatgagaaagatagccctgttcaattaatgcagctcttcaacaaattggcttccagatctgccaagtacaaacctgggagggcgagccctggtgcaacggtaaagttgtgccttggtgacttgttggtcatgggttcgaatccggaaacagcctctttgcatatgcaaggaaagttactgatattgatctttgttgtggcgccacagcttgtccagtttcttctgaagcaagcaggtgttgacaagagaactggtgatctttttggaaatcgagatctaatgaatattgcccgtaacatggctcgtggtttgaagggtgttgagaatgtttacacccagcaccagccacttctgtttcaaatcatggaaagcattgtcaaagggaggttgagagatgtggactacccattcattggaaatcactttcaacagggaaggccacaggatgtgatcatcttcattgttggtgggacaacttatgaggagtcacggtctgttgctttacaaaatgccagcaataccggcattcgttttattcttggcggctcttctgttcttaattctaaaaggtttttgagggacttggaagaagctcaaagggtagctcgttctagcaccactgtcatttga

SEQ ID NO: 74140 - DNA, 999 bp, Glycine max
  Peptide Sequence Number=SeqID_165825
atgaaggaactgggcgtggttgcaatcctgttgtcaatagagttctttgacgtgattgtctacactgtaagcaaagcagccatgaagaagggcatgaatgactttgtgtttgtcatgaaaagagctcttcctccactcacatatttcatagttggccaattatttattaatggcttcttaagttgcagtgttcagatgctcaggttttttggaataggttacggctctcccactttggccactgcaatgtctgatttaatccctgcttttaccttcatacttgccatcgtcttcaggatggaaattttggattggaaaactaacagtactcgggccaagtccattggcacattggtatcaatcgctggagccttaataattactctgtacaaaggccaggcagtcataaacaatcatccatcaaataaattgttccccaaaaaacatgtttcatctgagcaatttgactgggtaataggggcagtgttgcttgcgggtcatagctttgttctctcattgttgttcatagttcagacatggataatcagaaattaccctgcagagcttgtgatagtgctcactcgcggtacattagttgctatgctatctatcccaccttcactgatttcagtaacggatccaaaagctttgagattaggatttgatgtgaatttgatagctattgcattgcaagcaatttttggtgtatcccttcgaagtattgttcatatatgggtcatgagcaagaagggccctctctatgttgcaatgtttaagccaattggaatcatctttgcggtcatcatgggaattgcctttcttggtgactctatctatcttggaagtgtgcttggagcagccatagtggttattggtttttatgctgttatttgggggaaaagccaagagcaagcaaaggaagagtgtgaagtttatgatgactcggaatcatactcacccgttgtccctcttttgaagaacaagagaatggaggaatag

SEQ ID NO: 74141 - DNA, 714 bp, Glycine max
  Peptide Sequence Number=SeqID_165826
atggctgatgggtatgccagaataggggagatggaagcagccagggaggtctttgagatgatacctgaaaggaattgctttgtgtggtcatctacgattaatgggctgttttttgactgggttccggttcggaatttggagatttggaattccatgattgctggctatgtccagaatggattcggtgagaaagcactgcaagcttttgagggaatgggagctgaagggtttgagcctgatgagtttactgcagttagtgttttatctgcgtgtgctcagctggggaacctggatgttggtaagcaaatccatcacatgatagaacataaagggatagttgtgaacccgtttgtattgagtggattggttgacatgtatgccaaatgtggtgacttggtcaatgcaatgttggtattcgaagggttccctgagaagaacatattctgctggaatgctatgatttcgggctttgccatcaatggaaaatgcaaagaggctcttgagttttttggcaggatggaagaatcaaatataaggcctgatggtatcacctttcttaccatgctttccgcttgtgctcatgggggtttggtcagtgaagctttggaagtaatatctaaaatggagggatatagaattgaaattggaatcaagcattatggatgcatggttgaccttattgggcagagcagggagattaaaagaggcttatga

SEQ ID NO: 74142 - DNA, 135 bp, Glycine max
  Peptide Sequence Number=SeqID_165827
atgactgagaacagaaatgcacaaattggggaggagtttctgctattaagagtgcaagaacgaaagaagctagaaactggaaattggaggaagatgcactgtggaggagggtctcatcctagggtttttcattag

SEQ ID NO: 74143 - DNA, 255 bp, Glycine max
  Peptide Sequence Number=SeqID_165828
atgtttgtttctccgacggcaggaaatagggatccgttgttatactcttcatcattcttcaattatgattcaacgacccacaatgtggttgctgtggacagaagtggatacaacagctgcaaaacgccagggggtgctaaagtgttcagttcagggaaggaccaaatcaaactagcaagagggcagaactacttcatatgcaactaccctggtcactgcgaatctgggatgaaagttgccattaatgcagtgtga

SEQ ID NO: 74144 - DNA, 1206 bp, Glycine max
  Peptide Sequence Number=SeqID_165829
atggaaattgaagttcctgttgtgattgtgggtgctggccctgctggcttagcaaccgctgcatgccttaacaaatattccatccccaacgttgttttagaaagacatgattgtcatgcatctctttggaggaaaaggacttatgaccgcttgaaacttcacttaggcaaagatttttgcaatctccctcatatgccctttcctctagattttcctacctttgtccctagggttgactttttacgttacttggacaactatgtcacccgttttaagatttccatccggtatacccggaatgtggaatctgcttctgtggatgaagaaaacaatgggaaatggagggttgttgtgaaggacacaacaacaaatgctgatgaggtttatgtggcagactatctggtggttgcaactggggagaatgatgaagggtatgtgccccagattgaagggcttgaagggtttgaaggggaacacatgcattgcagccagtacctgaatggaagacacctgtatggaaaaaatgtccttgttgttggcagtggcaactctggcatggagatagcttatgatctctcaacttggggtgcaaatacctctattgttattaggggccctgttcattattttaccaaagaaatggttttcgtgggaatgtccttgctgaaatacttcaaaatggagaaggtggacaagcttatgttgctcatgagcaaactgaagtatggagacatgtccgagtatggcttggtcaggccaaaggatggacccttctttctgaagataaagggtggaactacccctaccattgatgtgggttgcgttagtaggattaagaaaggcgaagtaaaggttttccctgctatttcaagcatcaaaaaggacaagatggttgagtttgaggatggacaaaatggtcaatttgatgtcatcatctttgctactggatacaatagcactgtgctgaagtggcttaaggattacagagggctgttcaatgagaatggaatgccaaaaccaagttttccaaatcactggaagggaaacaacggtatctactgcgctggattttcaagaaggggattagatggcattgcttttgatgcccagcgtattgctgatgacataaaaaagactctgaatgcaaggaacttacccggtgatgaagaggacaattttgcttccctcaaactcttaggaaaataa

SEQ ID NO: 74145 - DNA, 693 bp, Glycine max
  Peptide Sequence Number=SeqID_165830
atgactgaggattgttccttggacgcttcatttctcgtctcctgcaaccgaacctcgatcttcttcatcacacacccttttctgccacaaaccaacctaagcgtgctaaacatttcactcaacggcgagctgcagatttcatggccagtagccagcgactgctacgctgaaagaggcaaactcgtgagccaaacattccaagacataaacctaacaacttttcaagtctcttcgaaccgaaacaagtttactgtaatcgggtgcgacacgctgggagtagtggtgggaatcgattcaaagggaaggaactacaccacgggatgcgtgtccctgtgcaacaggctccaagacatcgaaacgaacgggtcttgttccggcaccggttgttacgagacttcgatcccgcgcggtttgtcgggtttctcctacggttcagggagcgtggtcgacttcaacttgtgcgggcacgcgttcctcacggacctcgtcaacttcgacaagacaacgttccccgttgggatggattgggtagtgaagaaccaaacgtgccaagaagctatgaagaaggtttcaagttatccgtgtagggcacaaaacagtactagtaaatgctaccattcattggtggctctaacagttcctgtggctatttacaatgttgttttccacgaaactcttaataattcaccttga

SEQ ID NO: 74146 - DNA, 2037 bp, Glycine max
  Peptide Sequence Number=SeqID_165831
atggaattgcatggcctggtacgcacgcttcagtcttggtccacgcttcgtgaagggaggcaactccacgtggcattccttaaaaccggcatcctaaactcctccgtcgccgtagcaaaccggcttctccaactatattctcgctgccgcaatctccaggatgcgtcccacttgttcgacgaaatgccccaaacaaattctttctcttggaacaccctggtccaagcgcacctcaactcaggtcacacccacagtgccctccacttgttcaatgccatgcctcacaagacccacttctcatggaacatggtcgtttccgcatttgccaagtccggacacctccaactagcccactctctcttcaatgccatgccctccaagaaccacctcgtctggaattccataattcatagttattcccgacacgggcatcccgggaaagcgctgttcctcttcaagagcatgaacttggacccttcacaaatagtgtaccgtgatgcctttgtgctggccactgctcttggcgcttgtgctgactcgctggctctcaactgtgggaaacaagtccatgcgcgtgtttttgtcgatggcatggggttggagcttgacagggtcttgtgcagctctctgattaacctgtatgggaagtgtggtgatttggatagtgctgctcgcattgtgagttttgtgagggatgtggatgagttctctttgtcagctttgatatctggttatgccaatgctggcagaatgagggaggcaagaagtgtttttgatagtaaggttgatccgtgtgctgtgctgtggaattcgattatttcaggttatgtgtccaatggtgaggaggtggaagcggtgaatcttttcagtgcaatgcttaggaatggtgttcagggagatgcgtctgctgttgctaatattttgagtgcagccagtggtttgctcgttgttgaacttgttaagcaaatgcatgtgtatgcttgtaaagctggtgtgactcatgatatagtggttgctagttctcttcttgatgcctactccaaatgtcaaagcccttgtgaagcttgcaagttgtttagtgagctcaaagagtatgataccattttgcttaatactatgatcactgtgtattctaattgtggaaggattgaagatgcaaaattgatttttaacacgatgcctagtaaaaccttaatttcatggaattcgatccttgttggcctaactcagaatgcatgtccgagcgaagcattgaatatttttagtcagatgaataagctggacttgaaaatggacaggtttagctttgctagtgttattagtgcttgtgcctgcagatcatcccttgaacttggtgagcaagtatttggtaaagctattaccatcgggcttgaatctgaccagataatttctacctcccttgttgatttttattgtaaatgtggttttgttgagatagggcgaaaagtttttgatggaatggtaaaaactgatgaagtctcttggaacacaatgttgatggggtatgccacaaatggatatggaattgaagcactgacactcttttgtgaaatgacgtatggtggtgtctggccttctgccattacttttactggagttctctcagcctgtgatcatagtggtttggttgaagaaggaagaaatttgttccatacaatgaaacattcatataatataaatccagggattgaacatttctcttgcatggttgacctttttgcccgagctggatactttgaggaagcaatggatcttattgaagagatgccttttcaggctgatgcaaacatgtggttgtcagtattgagaggctgcatagctcatggaaataagactattggcaagatggctgcagagcaaatcattcagcttgaacctgaaaatacaggtgcttatatacaattatctaacatacttgcatcttctggggactgggaaggatcagcactagtaagagaactgatgagagataaacattttcagaagattcctggttgcagttgggcagattgttga

SEQ ID NO: 74147 - DNA, 1692 bp, Glycine max
  Peptide Sequence Number=SeqID_165832
atggctatcttaactgctgctagcccatttctttctcataaagcaacttccaattgttcggtttcattgaaattcttgaaaagggggaaagtgggaccactaataatgcaagcaaaggatgctttgaagatactcaagaagcgtttggccagtaaaaatccaaaaatacagcttctggctctttttgtattggagactcttagtaagaattgtggtgaaagtgtatttcagcagatcattgagcgggatatcttacatgaaatggttaagatagtgaagaagaagccggatttaaatgtgagggaaaagatactgattttaattgatacatggcaagaagcttttggggggccaactggagtttatcctcaatactatgcagcatataatgaattgaagtctgctggagttgaatttccaccacgagatgagaatagtgtaccattcttcactcccgctcaaactcagccaattattcattctgctgcagaatatgatgatgctactattcaggcttctcttcagtcagatgcatctgaccttagtttgctagagattcaaaatgctcaaggactagctgatgtattgatggaaatgcttagcgccttgagtcctaaagaccgtgagctcagtgcaaaactgtcatggcaagttgtcatttttcatttgtttcttaatattctgggcaaaatatgtcagggtgtgaaggaggaagtgattgttgatcttgttgaccagtgccgttcataccaaaagcgtgtcatgcttcttgtgaacaatactacggatgagcaacttttaggtcagggattggcactgaatgacagccttcagcgagtactctgtcgacatgatgacattgtgaaaggaactgctgattctggtgccagagaagcagaaacttcagttctaccacttgtaaatgtaaaccacgaagatgatgaatcagaggatgattttgctcaactagcccataggtcatcacgtgatactcaggcacagaatcaaaaaccagcctatgacaaggcagaaccagggaggataaacccactcattccaccaccaccagcatcaaagaagccggtctactctggcaccggcatggttgactatctcagtggtgatacatacaagacagaaggatctcctgaaaactcagaacccacttcatttacagctccccttcattctagccctaatccaacctcgtcaactattccatctctgtcttcctctcatcctcatgctgtgagtactacctcatcaccaatttttagcagcgagcctgtgtatgatgaacaaccatcttctgaggacaaatcttcggagtgtctgcctgcagctccctgggatgctcaatctcctggcatcattccgcccccaccttcaaagtataatcaaagacaacagttttttgagcaacaaggtgtatctcattcaagtagtggatccagttcctcttatgacagcttggtgggacaaactcaaaatctctccctgaattcatccaccccaaccaaacaacagaagccagaagatgcccttttcaaggatcttgttgattttgccaaatccaaaacctcatcatcttccaaacccaatagattctttaaggatcagagtctcttcaaatttgctggtcgcaaaaagggaataggtgattatagcatgggcaattttaagctcttgtag

SEQ ID NO: 74148 - DNA, 885 bp, Glycine max
  Peptide Sequence Number=SeqID_165833
atggatagccctccagcttctgcatcttacgtagtggttgcatgtgatgccactagggagcgcactgaacacgagatcaaactcgttgttgatcatgttcaggaaaggcatgtctttctcccttctgtggggtaccagacattaacatgtcccgagtcttttgctggaaccaactttcgtgcaagggaggatgaagtcaagaagaaagttgatgcatatgcaactaagcttttgccaagttatgaagattttgaaagtgaaggggattgtcatagtgttgaagacattgaggattctattatctcttgcaaaagttatccccattctatattttcttctgatagctctagtacgattaggagctacacaaagcagtcatcatatggtaacaggtcacgggagaacagttccttatcagattttggatcttcttctaagcaagatagatcagatgctccgcttctttgtactggctgtggtacaagattgtctatcaaggagtcaatgaggttcagctattctgacattcaaagtgcaacaaatgatttttcaaaggataaattattaggtgaaggtggatatggtcacgtatataacggtgttcttaaagatggacagcaaattgccgcaaaggtgtgtcttaagtttttctcgacacaagaacatagtgatgctgttgggtatgccatcgccattgggactgcaaaggaattgcgttttctacatgaggaatgtcgtggtggtcctattattcatcgggacatgcgaccaagcaatagacttctcacccatgattttgttcccatgctaggtgactttggccttgccaaatggaagactggtgatgatactctacaaacaaggataatgggcacattagggtga

SEQ ID NO: 74149 - DNA, 1656 bp, Glycine max
  Peptide Sequence Number=SeqID_165834
atggctgatgctcgcaggatgtttcatgagattccgcagcctaatgctgtcacttggaatgtgatagtgaggcggtatctcgatgccggtgatgcaaaggaggcggttttcatgttctcgcggatgttttccacctcggcggttaggccgatgaattttactttctctaatgctcttgttgcttgttccagcgtgtctgcactccgggagggggtgcagattcatggggtggttgtgaagttgggtctccgtgaggataatgttgtttcaagctcgcttgtgaacatgtatgtcaagtgtggtaggctggaggatggttttcaggtttttgatcagcttgggtttagagatttggtgtgttggacttccattgtgtcggggtatgcgatgagtgggaaaactttggaggcaagagagttctttgatgagatgcctgaacggaatgtgatctcgtggaatgcaatgttggcgggatatactcagtgctctgaatggtccaaggcgttagactttgtgtatctcatgcttgatgtgattaaagatgtggatcatgtgactcttggtttgttgttaaatgtttcggcgggcatttcagatcatgaaatggggaaacaggttcatggatatatctatagacatggcttccactcagaccttaggctcagcaatgcccttcttgacatgtatggcaaatgtgggaacttgaacagcaccagggtttggtttaaccagatgagtgataggcgtgacagggtttcttggaatgctttgttggctagctatgcatgtgcaaatacctttacgctttgtcttggcaaacaaattcatggattcatgattagacatggatttcacatagatactgtaaccagaactgctttggtttacatgtactgtaaatgtcgttgtcttgagtatgctattgaggttctgaagagggcagtttccagggatgtgatcatttggaataccataattatgggatgtgttcacaaccataagggtaaagaagcgcttgaactctttgtgataatggaagctgaaggcatcaagccagaccatgtgacctttaagggtatactgcttgcttgcattgaagaaggccttgttgagtttggcactggatgctttaagtctatgagcagtgaattccatgtcctgccccggatggagcattatgactgcatgattgaactctacagtcggcatagatacatggacgagctcgagaattttatgaggacaatgacaatggagcccacacttcccatgttgaaaagagttcttgatgtctgccatacatcagatggcaaatatatgcaatggaatatgactatgatcaaggtcctgtctgtaatgatgataatcggatcaatccctggatttgctactacaggactactactttctgcagttgcagtgagcaagacattctttgattttgctgaaagaaaaataatcatggtgtctatttttcaaggaactagtgccgtagtgggccttaaggggaagtgtcgtaatttggaactacctgatccttgtttggagaataaattgcagaaggaagctttttttgcaatttgggatttgaactctgatgaaactatagctggtttggaaattgcaaggatagacggtgatgaaataatgtggtag

SEQ ID NO: 74150 - DNA, 198 bp, Glycine max
  Peptide Sequence Number=SeqID_165835
atggggatggatcaaggtgcaggaatgagtactaaaaagtacgagacaaaggtgaagaacaagaagaatgcatttgcatcggtgattcctgctccaaggaaatccgtcaagagaatgttaggacttatatgtagtgcttcttatcccttctgcagcatgatcttggcaccctaccaagatctcggagaatgctcttaa

SEQ ID NO: 74151 - DNA, 4540 bp, Glycine max
  Peptide Sequence Number=SeqID_165836
atggggtcgtgtgggagatctgctgccattgatgatccctcagaaaagtttgtaattgagcagcagcatttgtgctcagaggttcaagagcaggttgtttctgtgcaggagtcttgtttagaagaagaggcttacaatgtggtggactctaatgttgagctctccactgtgactgatggttgtctgcgaggggaccgtgtcagttctgaaggacgtgttgatgttaccgaggggtccggagagggtttgggtttggcgagtgaatgcaaaaatgctgatttgttgccactggagaaatctactcaggatgattgtcagaattgtttgggtgtttcttgtgggagcattgaagttctctgtgtaaacagtggctcagagggaaattttcaggatgagggtatctttgatcagctgtcggggtccttaactgcagatgattcacagaggcgttgtgctcaacaggatgagcagaaggatgatgagtcagggtccttaattacagaggattcacagaggcattgtgctcaacaggatgagcagaaggataataagagtgacgtattgcctgctgcaggagatgatttggatgtcgtggaaggcaaaaatgatgagactggtgttcttgctgatgctttcagtcatgcacttgatttcagggattgcgaagtgtctttggagtcagaatccatggctgacttgctagttgattgcaaccagcaaagtgagcaggagaaaattatgagaaatccagatcccttgttgaatgtagttgaaaaatgtgacgctctaattggggaggaaactgatgcttgcaggaagatatctcctactccggctatggaagtgccatcaggtgcattatgtacagatacagaagtagagagcataaatgatcacccatgtgatcagaaagatggtgaggaaactgatgcttgcaggcagatatctcctactccgactatggaagtgccatcagatgcattatttacagatacagaagtagagagcataagtgatcagccatgtgatcagaaagatggtgaggaaactgatgcttgcaggaagatatctcctactctggctatggaagtgccatcagggccaccatcaggtgcattatgtacagatgcaaaagtagagagcacaaatgatcagccatgtgatcagaaagatattgaggatcagaatagtacttgtgaagaaaagtttaaagcttttgttgatgaagaagtcatcaacattaattcatgtataaaaatatcatcctctctagattgccaggagactgttgcgagctcacctgtagttggttttccttgtgagcctgccctgttggatccagggtgtgaaatgaagaatgacatgctgcaaatagatgatttctgtaaattgaaggactgttcctcagaggaaactaccaactctacctttagaaaaccattttctcctgaatcaggtctgccctctgttgctttaattaccaactgctctgcaaaggatgttcttgatctccattctaagggtgatgatgtttccattaataataataatgctgttaacaatccagggcagatggataatgatggaacaaaagctgttgaagttgattgtatcactgaaagcataccgttaccttctctaagggatagtcgaagaactaaatttggccgtaagacacaaaccaaaaaggcttcaagaaattgcaagaacaaaaccaaggtgacacattcaaatgggggtatgaagctaaacttagaggctgctagaaagaaaagaagttgtttctccaaaccagctcgttcttctgtctggggattgattgggaatattgaacagttttttgagcaagataatgagcttggagttggtgaagctgtgtgccaagaattggggaaggctagaagcaagcgtcaaagtgggaaagcggttaagaatggtgcaagtactacctcattgagttcagtacagaagtgttctgtttcaactactcgtgttcgtctgaagattaaatttgggaaagaagttgatttaagttgctcaaatgtcttgattccagagtcagttgatggtttggcttctgcttcttacttggtgtctgattcaggttctcagaaagtagccggcaatgctgatgataaaatttctgatgcggtggctttgggaaattcagaatctttcagtaatgacctgggcaaggatggtcttgttctaaatgaacaagttgcaaataaccccttagaaactactgaaataacagagaagtcatatggggatgcagaggaaccttgtcttgctgttcctcctgagaaggtggttgaagcattgattgaacctatgagtaataagggtatggatcctggaacctcacctgattctgaagttatcaattcaattcccgaagtccagattggagaaagacatcaagaagatgtacatcatgctgttttaggttcttctaaagaattaaattctaaattgaatgttaccatcagtaagagagggaagaagaaagagaaacttatttgttctggtaattgtatcactgaagatggatcacaaggtccacgtgggaatagtagagctaagcattcaaagaatcacagacgtaagaaaaattgcagggatgcatttagctctttggagttgcccactgagataagcaaatctgtgaccagtaaagaattgtccccagaattattgccccattctggagagaccgaacttggaggctccgtcgaggctttgaaagttaaaaatcatatggacgctaagacaagtaataaaccatctgttgaccatggattttcagattccctggtttctgagaaaatgctgtcatctgcaagacctttggggcgtaaactacctaaaagtcttagacctagtaaagttagcaagaccaaatctaaagcttctgactcatctggcaggaaaaagactactgctggtacatgcaaggagaaacagaaaaatccaattaataagagcaaagtcaagggaaaaggtgcctctcttaaagttacatgtgaagtggaagattgcccacatccagcaaatgctggaaatcataagctggatgctattggaaaaattattgctgatgacaacagagtatcggtcaatgtatctaatttggacatgctgtctggtgttggttttggggagcaaattctatcaccccgtaatgcatgggtgcgttgtgatgattgtcacaagtggcggcgaattccagctgtgcttgcagaccgaattgatgaaactaactgcacctggacatgtaaggacagcagtgataaagcctttgctgattgtgctatccctcaagaaaagtctaatgcagagattaatgcggagttgggattatcagatgcctcgggtgaagaagatgcatatgaaggttccaaaaattttaaggaattagaatattggccacctataggaggaaagttaggctgtggggatgaatgtctaaatcggattcttaatatcgaatgtgtgcaaggaacctgcccatgtggggaccgttgttccaaccagcagttccaaaaacacaagtatgctagcctgaagtggtttaaatgtgggaaaaagggttacggactgaaggcaattgaggatgtagctcaaggccagtttcttattgaatacgttggagaggatgaagaattgacattcgattacaactatgtaagggtttttggtgctgctgccaaaaaatgttattgtggttcgtctaactgtcgaggttatataggtggtggtgatccacttaatgctgaattgatagttcaaagtgattcagaagaagaatttccagaacctgttatgcttaccaaagatggtgaaattgaagatgctgtacctacacccaagtattttaataatgttgatacagaatctgctaaacatatgttgaaagacagggatatattggaaaatcctacaactgctatagattcagatggttctccagagaaagagagttctatgaaccctgcctctgccgtttctctgttgcacagctcagcagaaatggaggattcaaagggcaaattaccatcttctgttagagatgaagaaatttctcaacaaatggaggatgtaacaagcaaacccatgccttctgtacaccaaggatatgaaaaggaatcagagtttgcagacaaaacttcttccattcaaagattagagactacttctccccctacaactgtcagcaaaatgttaccgaattctgctggtagtaatagggagtccaagtctgaaataattggaggcaagaagactcctaagttaaatggttctgttaaaaaggggaaggttcatgctaatcctccaaatggccttaaaactgaggtgacagccaatcgattacaggtgtcatctataaaacacaaaaaagtagaaggttcttccaatggacggtttgaagcagttcaggagaaacttaatgagttgctggatggagatggtggaataagcaaaagaaaagatgccaccaaagggtacttgaagcttttgtttctcactgtggcatcag

SEQ ID NO: 74152 - DNA, 2745 bp, Glycine max
  Peptide Sequence Number=SeqID_165837
atggtgttctccgtcgaccggatcactcccaccttcgtgtctgtgttttctggcaacgccagagtgttggctttccgcttccaattgcggaggaacacacacctcgtcaccgcccaactttccaactctttctccttcaatttcggtttggattctcagagtttgaattccattcagtcccatgctccatcacggttgccatggactggtccagttccaggtgatattgctgaagtggaggcatattgtaggatctttaggagttctgagaggcttcattctgcgttaatggatgccttgtgtaaccctctcactggtgaatgcagtgtttcctacgaggttctctcggatgagaaaccgcttctagaggataaaatagtatctgtccttggatgcattgtggcccttgtgaatggtgggaggcaggatgttctttctggaaggtcttcaattgggactccctttcgttcgacagaggttggcatgatggaggatacgctccccccacttgcccttttcagaagtgagatgaagaagtgttgtgagagcttgcatgttgctcttgagaactattttattcccggtgatgatcggagcttggatgtgtggaggaaacttcagagactgaagaatgtgtgctatgattctggctttcctcgcggggaggattatccgtctcctgagatctttgcgaattggagtcctgtgtatttattcacttcaaaagaggacatggactccaaagaatctgaagcagctttttgcatgggcgggcaggtaacagaggaaggcctaaagtggttactggataaaggatataaaactatcatagatctcagagaagaggatgtaaaagataacttctatcaagcagctgtgtgtgatgctatttcatctggaagtatcaagttggtcagaatccctgttaaagttaggactgcacctacgatggaacaggttgagaggtttgcatcatatgtttcagattgcagcaaaagaccaatgtatcttcatagtaaggagggagtttggagaacatctgccatggtctccagatggaggcagtacatgactcgccctgcatcacagtttttttctaatcaagcagttatttccaatgacatgtcatcatattatacaattggatctggaaagctgcaggactcaatgattgccgagggatcctccctggaaaaagatactaatttgctgcaagagggtttgggtgcaacacatggttctgctagcagatttgactcatgttcctctttaaagaagaataatgaaaaaacacaaagtaatggagccttaagtgaacttagtcctgatgatattgcttcatcacaagccactgctgctactggggaaggatcttttccaattttctccagaaaaactcgccctttagaagctcaagttcctccttttgatatcttttccaaaaaagagatgtccaaatttttgggaagtagacagattccaaagccctcacatttcagtcatcagggtaaaagattggaaggcctgccagattcgaggaatcctgaacctaaacttgtggatcctgaaaaaagttccaatgggtcagctcatgtggattatccatctggtagcaattggaagttagtaaatttgaataattccagttctgttaggacaacagttaatggatttagtgaaggggaaatgtattacaggagtgatgccaatttctctaccattgtgaacaatgatattgataatgtcaatactaactctcaaaggattggagttaataaggataaggctgggttagccttatctgatgaagacttggggctcattgaaggggacatgtgtgcctcatcaacgggggtggtaagggtgcagtcaagaaagaaagcagagatgttcttagtacgaacagatggattttcttgtgccagagagagggtgagtgaatcctcattggcctttactcatcctagcacccagcaacagatgcttatgtggaaaactacgccaaagactgtgttactgttgaaaaagccaggagagcatctcatggaagaagctagagaggttgcttcttttctctattaccaagagaaaatgaatgtttttgtggaacctgatgcgcatgatatatttgctagaattcctgggtttggatttgttcagaccttctatactcaggatacatgtgatctacacgagaaagttgattttgtagcatgtttggggggagatggtgttatactgcatgcttcaaatctgttcagaaatgctattccccctgttgtgtcatttaaccttggttcccttggttttctgacttctcataattttgaagactacaagcaggacttacaacaagttatccatggtaatagtacaagagatggagtgtacatcactctcagaatgcgtctccgatgtgaaatttttcgtaagggtaaagctgtaccagggaaagtatttgatattctcaatgaagttgttgttgatcggggttctaatccatacctttcaaagatcgaatgttatgaacatgctttcaccatctctaaacaccttttggaagcagtgtcattccttctatatgatgatgattatcatgtctttcaggtacaaggtgatggagtcattgtggccacccctactggaagcactgcctattctacagctgctggaggttccatggaatatggccaatatactccttgtaagacttgggcaatccttccctcacgagctaacttttga

SEQ ID NO: 74153 - DNA, 93 bp, Glycine max
  Peptide Sequence Number=SeqID_165838
cctgacttacttgctattcctgtttttcgtgaagagaagcttgccgtattgcactgtaaagagcgttttcatgtcatggatgaaaacatttaa

SEQ ID NO: 74154 - DNA, 2880 bp, Glycine max
  Peptide Sequence Number=SeqID_165839
atggagaacaaactcaatcttataagcgggatgaacaatatttctttcctcagtgcaacagttggattgccgaactcgggagcatatctagagggcagagttgctggcttgcgtagtctgaaagttcaaggcagagatttcactaatcaagcatggggatatcaggttgggttgctaggagaaaaattgcaaatctacacagctagtggatcaagtaaagttaagtgggaaagtttcctaagctctactaagccactcacatggtataagaccacatttgatgcaccagtgggtaacgatccagtagtgcttaaccttggttcaatgggaaagggatatacttgggttaatggtcaaggtatcggtcgatattgggtatctttccacacaccacagggaacaccttcacagaaatgcacgcgcgaaggaagcaaagccgccagaattgaaccccacagctcccgttctgattccgagaaccgaaccagatggaggaagcgcaagagagattcgcaaatcagccggcgccaccagaagcacgaggaggacgacgacgacgacgacgaaaaccccaatgcggaggaagacctcgccgaacgcgactacgattcggaggaccaaacgcaccacaaccaccctaattcgcaacctcacgtggagacggaggtcctctccgaccacggcgttcagatttcgcagttcccggcggtgataaagcgctccgtgaaccgccctcactcctccgtcaccgcaattgttgctctggagcgtgccctcgagtccggagagaataaggctccaagcgctctcgctgctccggttctcgaaaacgtgtctcacggccagcttcaagcgctgtcgtctgttccctctgatagctttgctttcgacggtgattcctcttttgtcatcactccccctcccattttggaaggtcgtggcgttgttaagcgctatggaactaaggctcttgtagttccaatgcattcagcagattggttttcgcctgccacggtgcacaggttggagaggcaagtggtgccgcatttcttttcagggaaatctccggatcatactccggagaagtacatggagtgtaggaactgcattgttgccttgcacatggaggacccagggaagaggattacggtttctgattgcaagggtttgttggctggggttaatgttgaagatttgactcggattgttaggttccttgatcattggggaattattaattactgtgttcggatgccgagtcatgagtctcccaatgctgtgtcttgcctaagggaggagacgagtggagaggtccgtgtaccatcggaggctttgaaatctatagacagtttgatcaaatttgacaagcccaactgtaaactgaaagcagacgaaatttattcgtcgttgtctgcacatagtgccgatgtcttagatctggaggacagaataagagagcatctatcagagaatcactgcaattattgttcttgtcctcttcctgttgtatactatcagtctcaaaaagaggttgatattttactctgcactgattgctttcatgatgggagatttgtcattggtcattcaagtatagattttgtaagggtggattcgactagggattatggtgaactagatggggatagttggactgatcaagaaactttgctgcttcttgaagcaatggagatttacaatgagaattggaatgaaattgctgagcatgttggtaccaagtcaaaagcacaatgcattcttcattttctccgtctacccatggaagatggaaaattggaaaatattaacgttccaagcatgtctttgtcatccaatgcaataaatagagatcatagtggaagactgcattgttactcaaatggagatactgcaggaactgtccatcaaaccagagattctgacaatcggcttccttttgcaaattctggaaatcctgttatggctttggtggattcttacacgtttggttttggttggtgcattccaaaggttgcctttttagcttctgcggttggaccaagagtagctgcttcttgtgctcatgcagcattagcagtattgtcagaggataattctggcagcacgtcacaaatggaagcaccgggacatgataataggacaaattcagaaaacatacattgtcgagatggtggccctcatggagaaacagcagtttcaaataatcataatgaaatgcttcttttgatttcagaggataaggcaaaggtgcgtggttcatggggtctgaatgagggtaggataaccccactctctgctgagaaagttaaagatgcggctaaagcaggcctttctgctgcagcaatgaaagcaaaattatttgccgatcatgaagaacgtgaaattcagaggttatgtgctaatatagttaatcatcagctgaaaagattggaattgaagctgaaacagtttgcagaaattgaaacattgttgatgaaagaatgcgaacaactggagagaacaaagcaaaggtgtgctgctgatcggtcccgcataatgtcagcacgtcttggaactgtaggagccacacccacaatgaatgcatcgggtgttggtccctcaatggctagtaatggcaacaataggcaacagatgatctctgcttcttcttcacagcccagcgtctcagggtatggcaacaaccaaccagttcatccacatatgtcctttgccccacgaccttcaatgtttgggttggggcaaagattgcccctatctatgatacaacaatcacaaccagcttcttcaactgccatgttcaatgcccctagtaatgtgcagcccactaccaatcatccattgttgaggtctgtatcgggaactaactctggtttaggttaa

SEQ ID NO: 74155 - DNA, 522 bp, Glycine max
  Peptide Sequence Number=SeqID_165840
atggtgcaagcgagtggccatgcaacacggctggaaatcatcgttagagaacattaccttgtcaaagaaaccatttactacccacatgaccttatgatactttcttttgagcttccatttgctttaattccactccttaacttcagcagcagcagtaccaagatggaacctcacaagaattccatgattgtcattgtcatcccatggatactaagcttgaggatgattggtatcaatgtgtactacctctgtactgccttcgtgggttggttaattcataacaatctaccaaaggtggcaaatgtgttcattgggatcatagtgtttcctctaatggcagtttatgctgtcgcaataatttacctagccttcagaaaagacactgttcagacgcatattgagacaaagaacgaaccagcaatgcaaacccacacggaaagggggtttacggctaatggtcaattagagttgagtcaagttacctacagagaagatttggctgatatccctccacctcaatag

SEQ ID NO: 74156 - DNA, 903 bp, Glycine max
  Peptide Sequence Number=SeqID_165841
atggcttctggttcagattttgcgttagcggtttcttctgaactcgagtcagttttgaggctggagactgttaactactttgttacgaggaggccatggcttgatctttatggagttaacgtgagacctgttgcgccagttgggagtgctagtaggaggccttatgtggatcctgcacttatacatcgttccttacctgatgagctgctttttgaggtttttgctcgaatgactccatatgacttggggagggcatcttgtgtatgtcgaaaatggaagtacacaattcgtaaccctgtattttggcgcaatgcatgcttgaaggcttggcagctatctggaattgttgaaaactataggatacttcaatcaaaatatgatgggtcttggcggaaaatgtggctgtcacgaccaaggttacggactgatggtctctttgtcttacaatgctcccacatctcaggtctttatgtgagtagaaatacctacattcgagctggagttgctgagtggaaaatcactaatcctgtacatgtggtctgctatttccgatacttgagattttttccatctgggcgattcctttacaagaattcatctcagaaggtcaaggatgtggcaaagtgcatgaatttccgttcatctaaagcagactgtgtttttggtggccactacacattgtcagatgacaaggttgaagctgcagtgttgtatccaggcatgcgacctactgttttgaggatacgcttaaggttgggatttgatgtgccattatactcttaccatttcaccaatatccaatggatacctcaaaataattccctcccctcgcccatgccaaataaaaaaaaagaagctagcaacagtaggggtatatccttttcagcatggattatggaataa

SEQ ID NO: 74157 - DNA, 1081 bp, Glycine max
  Peptide Sequence Number=SeqID_165842
gtattacacggtgagcctcgccattggcaatccccctaaggtttatgatcttgacattgacaccggtagtgatctcacttgggttcagtgtgatgcaccatgcaaaggttgcaccctacctcgcaatcgactttataaaccccatggcgaccttgtgaaatgtgtggatcccttgtgtgctgcaatccagtcagcaccaaaccatcactgtgctggaccaaatgaacaatgtgactatgaggttgagtatgcagaccaaggatcatctctcggtgtgctactccgagataatattccccttaaattcactaacgggtctttagcacgccctatgctggccttcgggtgtggatatgatcaaacgcatcatggtcaaaatcccccaccttccacagctggggttcttggccttggaaatggcagaacaagcattttgtctcagcttcactctcttggcctaattcgcaatgttgtaggccactgcttaagtgggagaggaggaggctttttattctttggagatcaactcattcccccatctggagttgtttggacacccttattgcagagttcctccgcacaacactataaaacaggtccagctgatctgtttttcgatagaaagactacttctgtgaagggtcttgaacttatctttgatagtgggagctcctacacatacttcaattcccaagctcataaagctcttgttaatctgatagctaatgatttaaggggaaagccattgagtagagcaactggggatccatcactaccaatttgttggaagggtccaaagcctttcaaatctctacatgatgtcactagcaattttaagccactactactgagcttcacaaaatcaaagaattctccgctgcagctaccaccagaagcttatctaattgtcactaaacatggcaatgtctgcttgggaattctagatggcactgaaataggactaggaaatactaacataattggagatatctctttacaagataagttagtgatttatgacaacgagaaacaacagattggatgggcctctgccaattgtgatagatcttccaagtcataa

SEQ ID NO: 74158 - DNA, 1224 bp, Glycine max
  Peptide Sequence Number=SeqID_165843
atggatgtgaaaaacagtggcaggggaattccattcatgaccttttatctctttcttcttctcctttctgccatctctgttttgtcccatgcttcctctattgcttttcagattaaaggaaatgtgtatccacttgggtattactcggtgaacctcgccattggcaatccccctaaggcttatgaacttgacattgacacaggtagtgatctcacttgggttcagtgtgatgcgccatgcaaaggttgcaccctacctcgcgatcgacaatataaaccacatggcaaccttgtgaaatgtgtggatcccttgtgtgctgcaatccaatcagcaccaaaccctccctgtgttaacccaaatgagcaatgtgactatgaggttgagtatgcagaccaaggatcttctctcggtgtcttagttcgagatattattccacttaaactcaccaacggaactttaacacattccatgctcgccttcgggtgtggatatgatcaaactcatgttggtcataatccaccaccttccgcagcaggggttcttggccttggaaatggcagagcaagcattttgtctcagcttaattctaaaggcctaattcgtaatgtcgttggccactgcttaagtgggacaggagggggctttttattctttggagatcaactcattccacagtctggagttgtttggacacccatattgcagagttcctcttccttgctaaaacactacaaaacaggtccagcagacatgttttttaatgggaaggctacttctgtgaagggtcttgaacttacctttgatagtgggagctcctacacatacttcaattcccttgctcataaagctcttgttgatctgataactaatgatataaaggggaagcctttgagtagagcaactgaggatccatcactaccaatttgttggaagggtccaaagcctttcaaatctctacatgatgtcactagcaattttaagcccctagtactgagcttcacaaaatcaaagaattcgttgtttcaagtaccaccagaagcttatctaattgtcactaaacatggcaatgtctgcttggggattctagatggcactgaaattggactaggaaatactaacataattggagacatctctttacaagataagttagtgatttatgacaacgagaaacagcggattggatgggcctctgccaattgtgataggtcttctctaatgtaa

SEQ ID NO: 74159 - DNA, 2031 bp, Glycine max
  Peptide Sequence Number=SeqID_165844
atggagaaaaacatatgtaaatcttctgaggacagccctagtgaaactgaaagtttagggtctgaattgtctcattctgagaagcaaccggatgaacagcatcaggcattgaatgaatctcctattggacataaccagtcccctaaagttacctcagaagctgtggccatcgctgaagatattaatgacatgtcatttatcaatgcacaatcagctgaagtcatctcacatacaacacacaagggacatgatggtttattggaggaagatgaaaatggagcaaatgatagtataattaaggatggagatgtaactgatggattgaggaatatgtcaaaaaatctatctgcagaggttgtgaatgtaagtgccaaagaagatttggtcaagcaacatgccaaagtcgctgaagaagctattgcaggctgggagaaggccgaaaatgaagtgacaagtttaaagaagcaagtcgaggcactgactctccgaaattcaacacttgaagatagagtcacccatctagatagtgcacttaaggagtgtgttaggcagctaagacaaacaagggaagagcaggagcaaaatgttcatgatgcagtgctaaagaaaacacaagagttggaatcagccaaaactaaacttgagaagcagctcaaggagctccatagcaaatcagatgcttcaaatgctagttctcattcatcaattgaatttgatatgatccagaaggttgaatatttggagaatgagaacatggctctcaaacatgagctcaaagcccaatctgaaaagctgaaactcaggacaatagagagggatttaagcacccaaacagctgagatggctagcaagcaacatctagaaagcatcaataaagtggctaagcttgaggctgagtgtcggagactgaaaaacatggcttgtagagcttccattacatcatcctcattttgtgctgaatctttcaaagatggtcaatcagaaagtggagagaggactaatgcaacggagattgataccaccaggaagagtggctcagaaccagacatgtgtgagttaagttgttccgattcatgggcatctgcactaattgctgagcctgatcagttcaagaatgaaaagtataaacaaattccgtctggttctgttaacattgatctcatggatgattttcttgaaatggaacgacttgcatcactgcctgatactaagaatgaaagccttatcaaggactcacttgttgccaatcaatgcattcatgaagaaagttcaatggatgaactaaaagagaagttagagaaagccaaagaagagaaagaggaagtgaagatatgtttaatgaaaactgagtctgttattgaggcatcacagctacaaatgagggaggcagaaacaaaattggaggagttgcaaatagagctagagaatgcctacaaatcaaggcaagtgtttgaaaatgaactaatgagcatgcaggctgaggctcaatcaattactgcaaaagttcacttattagaagaagagattgataaggaaaaggctatgtctgttgaaattgaaagtaggtgtaaagaattggaggaagagctagaaagaatgaagcaggaagaaaaacttggatcagtaaccggctcatacacggaaatgaagctaaagcaggaggacctggcactagctgcaggaaagcttgctgagtgccagaaaaccatagcatctttggggaatcaattaagttcactagcaacgctagaagatttcctgattgacactaccagcattccagagttctctgcaagtccatcactaattgcaagagctggtggagatatgctgcagaagttgcattcaaatgacacatacttacctaaaagagattccggttcttcaaggtctggtccacccttaaacaaaaatgaagaaacttcaccaccctcttcaaccaacttgccaaatcatgagagttctaagagtagaaatggttttgcaaaatttttctctcaaactgagagtggaatccaactaggaatctag

SEQ ID NO: 74160 - DNA, 3597 bp, Glycine max
  Peptide Sequence Number=SeqID_165845
atggacgccaccgtcaccgacctcagtccctcctgcaatgccgccgccgaaccgccgcgccgcagtgtccgccggcgactggtccagtcgacgctcttccctcacaagccaccggagcctgatcaaaagaacgacaaagaggacgaacgcgacgaggattactccgactctgagaatcacaagaagaggaagaaacccaaggctaaaacaactcctcgaaaaaaagcttccaagaatgccacgccaaagaaaaatgtgtcggctaatgggactaacaaggggtccacttcgcggcaggtgttagctgattccgatcgggttattgcaccggtgcatgatttgtttttagaagcgaaattggctgctgaggaagattcgaggatattcacaggacggcagatacatccatttttttcactgtggaaggcggggaagaaagttcaggacgtggctgattcaggaagtaatttatcaacaacaaagagtgaggatgaaaggactacctgtggtcctattcatgtatttgaaaatactcaggatgacacctcatcccttgactggagaaactggacgtttttggagaatactacctctatgaactatggttcagaaagtttaaattcatctgttttggaggcttctgttgaatccttgaattttgataagcttcgtagttccttgtatccctcaggcacttcaatttctcagaattccttatcttcagatagactttgtatacatccagaaaatctggaagaactatcaccatcaaactcagcttcactagcaaagcaaacatgtcctccgacatgtgaagatgccaaactggacttggaggtggatgaatctgctactacaacagtgcaagctggcatttttagaaagtcggatactgaaccaccaattagatttcttcaagaaagtatgagatcttattactgtagttgtgtagataaggcagagaacagcttatggacatacaaatacaagccaacaaaggctgttgaggtgtgtggtaatgatgaatcagtgaacttcttgcgtgactggctacatctatggcatgaaagacgttataaaagcaggaaggatatctctgacatggataaaagtgacatgcgagatgttggtgatgacgatgatgattataaatgctcctatagtgattacgattcagaagatataaatgaggaggattccctgcagaatgttcttttaattacgggaccaattgggagtggaaagtctgcagcagtctatgcttgtgccgaagagcaagggtttgagattttagagcttaatgcatcagattgtagaaatggaactgctgtcaggaattattttggagatgctcttggttcacttgggttcaaaaggtcatcagaaaacactgcaagtccacagaagaaaactacgaagttccccttggctttggctttgttcagtggtaaagctgctgatgaggtgaatgatggggtggatgaactgataaccatacctgatgatgaagctcatatccccagtggatcattacagaagttacttggcaaaaacaatgtagttgcatcatgtgataaagtgcaaactttaattctaattgaggatgtggacatcctttctcctgaagatcgtggatgtattgctgccatccaacagattgctgagactgcaaaggggccaattatattgaccagtaatagtgataatcctggcctgccagataattttgatgtgcttcatgtttcattcgtgttgccatcaccaaaggagttgctttgccatttgtatactgtttgtctcactgagggagtcaacatccatcctcttttactggagaagtttatacattcttgtgatggagatatccgaaaatccattatgcatcttcagttctggtttcagggtaaaagatttcaaaaagatggaaaggcacaaacacattatggctcgcttccatttgatcttgagcttggccatcagatactaccgaagattatgccctgggatttcccctcagagatatccaaactaattgagaatgaaatcaccaaatcaacaaataaaatggaagaaacttctagagggttggttacagagcttcttcacacagatgaacagaaaaatgatttaaatgtgcagtgtatggaagctgattatatagaggccaagaaggtggagatgattaagagaaatagttctttgacagattacagcgagcttgaaattcaatataatgctatttctgagtttgccaattcttctgattccccgcttacatcctgtcggcaaaatggtcgaaggaaacttgtagtcatgtcctctgattctgaggatgaggattcaaataatggatatcctgtagacacacatgatgaagctaatacaagacaattgatgaaagaaaataatgaatgtccctctgagcttcaattaaatggaaactaccccagcacaacacttcgcaagctggtttgttctgaatttgagcattcagaggaggaacattttaaatattcagaaacagctgatgatacatgcttaaatgaaacatgtaaatcattagatgcatcctgtgtgccagaatcaacgtttgttcctgagactgaaattgaaaatggaacggagtcaatttctggagcagtgtcttctggccctcttgttggtcctcaggatcaggaagtttctgtgaataatgagttgaaaccattctgtgttcgaaggcgcttaacaaaattgtcgcaaaatccagatttgttggatactgaaatttcagaccattctcctaaaggggttctgcaagatgttctagatgaacatatagaaacaattgttaatgtgatggatgagtgcagtcgtgtggatttcaaagcaaagccaatgtttttgcagtccaatccattaacagagacagaaaaaatacaaaaattgtggaaagatcttcgtgagcgtcgcatggatttaaaacagcatgctacctcggaacagctgggtgcttttcaagttgttaaacttgctagtgggctgaacaatctaatttcagaagctgacttatttcataaacgtgatattatggaaccttcaacgttcctttctggtgaagccacatctagctggtatcatgaacaaataatgacgtccactgttgctgaacatgggttttgcttttacgctaagcttatagcagatgaagcatcaaagttgggttgtgcaaattgtgttgatattacttctgagatgttggcttccgccattaaattatccggacaggatctcacaaaaagcaaagttatctatactggaaaggaagtagagtggaaaagcccaataaatagtacgcagaagagtgaaaacaaaacatctcagttcaaagccatccaatccattgttcctgcaagaatatccttggcattgaaaggtggtgcattcaatgaatatctatcttcattacgcgaaattacgaggtcagaagcttcccgcatttcacaagaagttgaaaagaatagaagaggaagatgtaccacgttgtctcctgaagatatatctttggtgagtgagggtaatctgtacagaaaggattcttcacaacatacaacatag

SEQ ID NO: 74161 - DNA, 1533 bp, Glycine max
  Peptide Sequence Number=SeqID_165846
atggcagaagccagcgaagggacgacgaagaaggaggagattttagagtctcagattgaaacggctatgcgttctcgcgtctctcacttcaaggaacaatctgactccttgacgttcgagggtgttcgtcgattgctcgagaaagacttgggattggaggagtatgctttggatgtgcacaagagatttatcaagcaatgcttgctcaagaaccctataatgtggcatttttcaatccctccgccacaagcagtctgtgaagggaagcccgctatagtgtgcttagaaggggtaggagatgatgatgggccaaagatatcagggaaagaaggggaaaaaggttcaagtatacaagagtcagaagaaccaaaagaagaatgtgaatcaaaagatgcgaaggatctttgccctgaagatgaggagaagatggaagactctccagtcttaggtcttcttaaagaacaaaaaagggctaaacttgaaaccaaggatgataaaggcaatggaaccaaagtagttccaagtgaggctctaattaagaaagctgttagaaaaagatcttcgtacatcaaggctaatgcagagaaaatcactatggctggtcttcgtcgactcttggaggaagatcttaaacttgataaatttactcttgatccctataagaagtttgtaagtcaacagcttgatgaggtattaacatcttcagaagttcccgaacctgcaaagaatgctaagaaaattgttaagaaaaaacctgataccaaagtaactaaaaaggtcagcagtgaagagaactctgatacttcagataaggagaccgatgaggaagagagtgaggaagatgaagttaaacctagaaaaaaaattcttccaaaaggcaaggtgaagacttctgtccaacccaaaaagcgtaaaggagaggagtctgatctatccagtaagaaaagggtcaaacctgctaaagcagcctcagaagacaatagtgatgcagaagataatgggaagaactctgaagatgatcagtcccattcatcaccagagaaaccttccaagaagaaagaagtttcaaatcctgtgtatggtaaacgtgtggagcacttaaagtctgttattaaagcatgtggaatgagtgttcctcccgtaatttacaaaaaagtcaagcaagtgcctgaaaacaaacgagaagggcagctaattaaggagttggaggaaatactgtctagagaagggttgtcttcaaatccatctgaaaaggaaatcaaagaagtaaaaaggaagaaggcgagagccaaagaacttgagggtattgatctaagcaatattgtgtcaagttcacgtagaagatcaacaagtagttatacatctccacctccaaagccaaaggttccagttgaaaccagtggcaatggggctgaaggtagtgataatgacgatgaagataatgataatgaagaggatgaagaagatgaggaagaggatagcggtgacgatgatggaagtcagagtgaagaatttaacgatgtggtcaagtag

SEQ ID NO: 74162 - DNA, 318 bp, Glycine max
  Peptide Sequence Number=SeqID_165847
atgaagaagatcctaggcctacaagctccaatggagcttgcatcagcaaggtttctctctcaaactacatcaaagatgcagagtaacactatgcgactgaagggatccattggctacattgcccgagtcacacttacactttctaatattgggatcctactgctagagatgctcgttgccaaaagaccaactgatgaaatattcaaagaaggattaagcctgagcatatttatctcagccatggatgagaatgaagtactgaaggttgctgatcgaaggcttattgatgattatgaatattcaacacaaagtccatag

SEQ ID NO: 74163 - DNA, 252 bp, Glycine max
  Peptide Sequence Number=SeqID_165848
atgcgtacatggttcagaaatgcaaaactttatctgctgttattggcggttcaatttggctctgcaggaatgttcgtatttgccatggatgccatcaagaagggtatgagccattacgtgttcaccgtctaccgtaatgtcatcgcctctgtaactctcgctccctttgcatttgttcttgaaaggaaagttaggcccaagatgacagtccggatatttgcagagattatggcgctggctttcttcgagtaa

SEQ ID NO: 74164 - DNA, 900 bp, Glycine max
  Peptide Sequence Number=SeqID_165849
atgacgtccaaaaacaataccgggatcctaaggtttattccgacgaattgcaccaaaggtggcagaactggtgttggggaagaagacttgaagtggtggcattctcgccctgtaagtccacgaagtgcccgtgatgaaagaacatcacatgtaatggtgttggagcggtctgacatgagaaggtcggcgaggtgcaaagtttccgatgctaaatcacttgataaggagttcaaactaatttgggccaaatgggtcaggttcgagtcgggtgtgagggttgggtccggggtcgggtcaactagatctatattagggcaattgggatcttcgtcttcagcaaccagaaggaaagcttttagaggcgtagcaatgtcctctagggtggcgccagaaatggcagaagtggcgacggtgtcagcggtggagtccgcggcagaggcggtaatggtacgggacttggttgtatgggtgcggagcatggagactaagaagggtagtggtggccgggtcaccgaggcagtcataggagaaggacatccagacggcctcgaggcagtcctcgctagcaggagaaaagtcatggtgggttggcgattgttgtggatggtagtggttggggctgtaatggcatccatggaaggcagccatagaagctccgtacggcaagtgacagccatggaaggcaaccatgggagctccgtacggcgagtggcagccatggaagctccgtacagcgaggtcagcacctccaaaaacaaagaggaagaaggagaagataagctggtttcgaggttaccagtgcctcaagaggaagaagaaaagcaaagagcagagcaacatcgaatcttccatcctgcacacaacactcctgcacgatcttgctcaaacgaagtcactaag

SEQ ID NO: 74165 - DNA, 471 bp, Glycine max
  Peptide Sequence Number=SeqID_165850
atgcagtttggtgtagactggttactgggtattggttatttccctcttctcgtgcttaatgatttcatggatttggggtatatcctccaccaccaggatatgaaccataagttggtggcaactctccagtttggaaaagttttcgccctgcaccgaatagaagcacttccgagctcaaaggacatgagtagtaagagtattgctaaaagagcagcaaatgacatcaatttggaggcacgtaggatggccatttctatcaaaagctatatatttgtgttgctaattgcaagtttgaggatggaaccatatccctttaagaattgtaacaatgatgatggtggtgataataccgatgatggtaacaatgacgataacactaacattgatagtgatggtaacaatgataatgtcgatagtaatggtggtaataatgacaataataatgatgatagtgataagagtgataatcaa

SEQ ID NO: 74166 - DNA, 300 bp, Glycine max
  Peptide Sequence Number=SeqID_165851
atggggtgggagtgtctcgccagtcctgtggacgagacccaggctgtctcgccagccgtgtgggcgagtcccacgtcgggtgtgtcgccgttcccactggcggcttcagctgggtgtgtcgccgttcccattggcgacaccctcctctctccatcctacgtggccatatctcgccactgctactggcaatacacccttctctcctcctttaccgccactggcaatggcgggttgagccatgccgccagtggcaatggcggtttcctccacaaaacaaaccccctccgttatttgttttga

SEQ ID NO: 74167 - DNA, 1692 bp, Glycine max
  Peptide Sequence Number=SeqID_165852
atgggggatgatggaaagaagattagtggagagggggggttagtgaaggttgagccaaaacccagcaatggtttcacctcaaaagtggttgatttgttggagaaattggtggtgaagttcttgtatgattcttcactgccccatcactacctcactggtaattttgctcccgtgagtgagacccctccaaccaaggaccttcctgtcaaagggtaccttccggattgcttgaatggggagtttgtcagagttgggcctaatccgaagtttgctcctgtagctggatatcactggtttggtattgatatgcatgcttttaagtttatatctattaaaaaatgtgttcttcaactggactttgaagcttaccaggctttacctgactgtttttgtaggtttgatggagatggaatgattcatggcttgcgcatcaaagatggaaaagctacatatgtttcccgttttgtgagaacttctcgccttaaacaagaagaatactttggaggctccaaatttatgaagattggagatctcaaaggtctattcggacttttaatggttaacatacatatgctgagaactaaatggaaagtgctggatgcttcttatggaactggaacagctaatactgctctcgtatatcaccatgggaaacttctagcactctcagaagcagataaaccctatgctattaaagtttttgaagatggtgatttgcagacacttggcatgctagattatgacaagagattgggccactccttcactgctcatccaaaagttgacccatttactggggagatgtttacatttggctatgcgcatacaccaccatatatcacatacagagtaatttcaaaggatggttatatgcatgatcctgccaaaggtattccaggtgtttctgttcttatattctggcaaaagcttatattccaggaaatggtgaagaataagacactgatattctcatttgattcaaccaagaaagctcgttttggtgtgctacctcggtatgctaaggatgaaaagcttattagatggtttgagttacccaactgcttcatattccacaatgccaatgcttgggaggaggaagatgaagttgttctgatcacatgccgccttcagaatccaaatttggatttggtcggtgggactgccaaggaaaagcttgaaaatttctcaaatgagctgtatgaaatgagatttaacatgaaaacgggtgaagcttctcaaaagaaactatcagcatctgctgtagattttcctagggtgaatgagagctacactggaaggaagcagcgatatgtatacggaaccacattagacagcattgcaaaagttactggcattattaaatttgatttgcatgctgaaccggataatggaaaaacaaaacttgaagtaggaggaaatgttcagggtctctatgacttgggaccagggaagtatggctcggaagctgtttatgtccctcgtgtccctggtaccgattctgaagaagatgatggatacttgatttgttttgtacacgatgaaaataccggaaaatcatttgtgcatgtcatcaatgcaaaaacaatgtcagcagatcctgttgcagttgtcgaattgccgcatagagttccatatggtttccatgccttctttgtgacagaggaacaactgcaagagcagggtaaactgtga

SEQ ID NO: 74168 - DNA, 882 bp, Glycine max
  Peptide Sequence Number=SeqID_165853
atgtttctcctaaggtcacattctataattgagaaaaggggttacttagagagagagagagataatgggtctcatttcaatgcaattcaggttctgaaaaccaaagcttttcataggaaaagttgtgctaagatgccggggaaagctgacactgatgattggcgagtagagcggggtgagcagattcagtttcagtcttccatttactctcatcatcagccttggcggtgtggagtgggggaaaatgcctctaaatcatcttcagctgatcagttaaatggttcaatcgtgaatggtatcacgcggtctgagaccaatgataagtcaggtgaaggtgttgccaaagaataccaaaacatcaaacatgccgtgttgtcaaccccatttaccatggacaaacatcttgctccaaatccccagatggaacttgttggtcattcagttgttttaacatctccttattcagatgcacagcatggtcaaatcttgactacttacgggcaacaagttatgtatttctttataagattgattgtttcagaggaggatgccagattggcacttgatgtgacgcagtataagataaaccctcaattgtacggaatgtatcatgctagaatgcctttgccacctgaaatggaagaggagcctgtttatgtcaatgcaaagcagtatcatggtattttgaggcgaagacagtcacgtgctaaggctgagcttgaaaagaaagtaatcaaaaacaggaagggggtttctacatctttgaagacactaaaaaagaaagaaaaatgtgtggtgtatgcttgcaagcctatacaacatctctgctctattcttatgaagtattgcctgccacttgcaggcaaactgctctatagatga

SEQ ID NO: 74169 - DNA, 2106 bp, Glycine max
  Peptide Sequence Number=SeqID_165854
atgaaatcgctaactgttaacactgaagattctttttccagtttactggaacttgcttctaacaatgatattgaaggcttcaaggtccttttagagaaggattcttctacgatcaatgaggttgggctctggtatggccggcaaaacggatcaaagcaatttgttcttgagcacagaacccctttgatggttgctgccacttatggtagcattgatgttatgaagatggtacttttgtgccccgaggcagatgtgaatttcgcgtgtggggcgaacaaaaccactgccctccactgtgctgcttctggtgggtctaccaaggctgttgatgccgtcaagcttcttttatcggccggggccgatgtcaattgcgtggatgcaaatgggaatcgccctattgatgtgattgctgttcctcccaagctgcaaggtgcgaaagccgttcttgaggaacttctttcggacaatgcttctgatgtgtctgttggtgaattctctgtcccggtgtctgttaattcttccagtccgggttctcctgcccattcgtcgaatgggatgccgtacactccttcggtttcaccgccatcccccgtggctgcaaagtttactgatgcagctatttgctctttgtcggagaagaaggaatacccgattgatccatcgctgcctgatataaagaacagtatatatgcgactgatgagtttcggatgttttcgttcaaggtgagaccttgttcccgggcatactctcatgattggactgagtgtccttttgttcatcccggagagaatgctcggaggagagaccccaggaagttccattacagctgtgtgccgtgccctgattttagaaaaggggcttgcaggcgtggagacatgtgtgaatatgctcatggggtgtttgagtgctggctgcacccggctcagtatcggacacgcctctgcaaagatggcaccagttgcaatcgaagggtgtgtttttttgctcacactgcagaggagcttcgtccgctgtatgtgtccactggatctgctgccccttcgccccgttcatctgcttcaggtcctaatgtcatggacatggctgctgccatgagcctttttccaggatcgccttcatcgggctcttccatgtcgccgtcccactttgggcagccaatgtccccatctgcaaatggcatgccactgtcttctgcttgggctcagccaaatgtgccggctcttcatttaccaggaagcaatcttcaatctagtcgattgaggtcttccctaagtgctcgtgacattccaccagaagacttgaacatgatgtctgatcttgatggccagcagcagcaccatctgaatgacttgagctgttacatacagcctcgccccggtgccagttctgtgagtagatctggtcggtccaagaccctaactccatcaaatctggaagagctcttttctgctgagatttctttgtctccccggtattctgatccagcagccggttctgtgttttcccctactcacaaatcagctgttctcaatcagtttcaacagctccaaagtatgttatcacctataaatactaatttgctgtctcctaagaatgttgagcatcctctttttcaggcttcttttggtgtctctccttctggaaggatgtcaccaagaagtgttgaaccaatctctccaatgagtgctcgtttatctgcatttgctcagcgagagaaacagcagcaacagctgcgcagtgttagttcaagagaccttggtgccaacagtcctgcctcacttgttggctcccctgcaaacccttggtcaaagtggggttctcctattgggaaagctgattggtcagtaaatggagactcccttggtcgtcagatgcgaagatcatcctcgtttgagcgcaagaacaatggggaagagcctgatctctcttgggtccaatctctggtgaaggagtccccacctgagatgatcaaagagaagtttgcatctcctatgcctactgcatctgctgatggaccgaattcaaattcccaaattgaatccattgaccattctgttttaggagcctggcttgagcaaatgcagctggatcagcttgtagtctag

SEQ ID NO: 74170 - DNA, 387 bp, Glycine max
  Peptide Sequence Number=SeqID_165855
atgattcctataaaaacccatcacttctctagtgatctttcaaagccaaaaaaggttggttgtttcaagcacttcagtgtagatctctctcgcttgtatgagattcactatccaatggacgagaatagaagttccaacgaacccaacaagtggaagatgcctctcttcgttttcttcaaagatgcaaggaatgttttcaagctggatgctctatctcgggagatattagggattgcactcccctcagcactggccgtttctgctgatccaattgcttctctcatagacacagcattcataggccgtttagccatccgatggctttgtgctatcacaatgagtgatacaccaattgcaacttgcaggccgtacaagttcttgtggtaa

SEQ ID NO: 74171 - DNA, 1017 bp, Glycine max
  Peptide Sequence Number=SeqID_165856
atggctacccttattgctcccagcaaccactctccccaagaagatgctgaagctctcagaaaggcttttgaaggatggggaactgatgagaacactgtcatagtaattttgggtcatagaactgtgtatcagaggcagcaaatcagaagagtttatgaggaaatttaccaggaggatcttgtgaagcgcctagagtctgagatcaaaggagactttgagaaagccgtgtaccgatggatactggaacctgcagatcgtgatgctgttttggccaatgttgccatcaagagtggcaaaaactacaatgtcattgtggaaattgccactatcctctccccggaagagcttttggcggttagacgcgcctatctcaaccgctacaagcactccttggaagaagatgttgcagctcatacctctggccatctacgccaggcaagttcttgtgtgcatttaacacatattaaatctaagagtgagggctatgtagcaagattagatgtgattcagcttttagtggggttggtgaccgcattcaggcatgttggtgatgagatcaatccaaaattggcacaatctgaggctgaaattcttcatgatgctgtaaaagagaagaagggtagctatgaagagaccattagggtcttgactacaaggagcaggacccaacttgttgcaactttcaaccgctacagagagatccatggcacttccatctctaagaaattggtggatgaaggatctgatgagtttcagagggcattgtacactgccattcgtgccatcaatgatcctattaagtactatgaaaaggtggtgcgcaatgcaatcaaaaaggttggaaccgatgaggatgcactcactcgcgtggttgtgagccgggccgagaaggacctgaagataatctcagaggtttactacaagagaaacagcgttcttcttgagcatgctattgccaaggaaatctcaggggactacaagaagttccttctcactctgttggggaaagaagactaa

SEQ ID NO: 74172 - DNA, 648 bp, Glycine max
  Peptide Sequence Number=SeqID_165857
atggctactcttgttgctcctaggaatcattttccacaggaagatgcagaagctctctggaaagccgtcaaagatgaaaagaccatcataaaaatactgggtcatagaaatgcttctcagaggcagcaaattagactagttttccaggacattcacctagaggatctcgtcaaacgccttgagtcggagctctctggagactttgagcagctttgggtaggacttgtgagctcatttaggtatgggggtgatgagatcaatgcaagattggcaaaatctgaagctaatattcttcatgaggccatcaaagacaaagaaagcttcaaagatgaaaataacatttctatcagtaagaaactattggaggaaacatctgacgacttctataaggctgtcaatgttgcaattcattgcatcaatgatcacaagaagtactatgaaaaggttcttcgcaatgcgataaaaggggttggaaataatgaggatggacaaacacgtgtgtttgtcacaagggcggagaaggacctgaaggacatcaaagagctatattataagaaaaacagtgttcaccttgaggatacaatggccaaggaaaactcaggatactacaagaagtttctcctcactttgttggggaaaggaggctaa

SEQ ID NO: 74173 - DNA, 132 bp, Glycine max
  Peptide Sequence Number=SeqID_165858
atgggaagacattacttctctgggaaaacaacaaagattgggaatgtagtgcaactagtgtggatcttgaagaacacctatacgggcttgcaaaagatatgggaatcacggttgttagttcctcacaagtaa

SEQ ID NO: 74174 - DNA, 93 bp, Glycine max
  Peptide Sequence Number=SeqID_165859
atgggttgcatcgcaggggcacatgaggaaaggatgggcatcggagtggagcggagatgctgttctgccaagtcgtggacggatgtgctgtaa

SEQ ID NO: 74175 - DNA, 390 bp, Glycine max
  Peptide Sequence Number=SeqID_165860
atggaaatttttggtggtgaagctccttcttccttggcttattccctagtggatggtgcctcccctctcctcttctccttttccttctgtcgcaacgtgccctcttgggcgagcgagggcgaggctcacgggtgcgctttccaaaggaggaaagatgcgcggattcgccaccaacgtttatttgtggaaaacgtcagaaaaaccgaaggaaaccggtcgacaaaagcggggcttttgctcctacgtaccctcctttggagaggaaatcagacctacgtagttcttcttatgcgtgaatcaagtgattcttttactttgaaaggtgatcattttaaggcgttggaccttaaaaatgatccattttacttgattaagcgagaaatgacttaa

SEQ ID NO: 74176 - DNA, 234 bp, Glycine max
  Peptide Sequence Number=SeqID_165861
atgtcgctgcatgttctttatctttatgcgttttctggatttcccccagggatttcccgtctactgtatctctcgttacaatctttcaaagaaatgaacgggcaggatcatcttgagctaccttctggggtggggaccaaacatggaaagcagaaaccaatcaagtcacaaccgactgatcgttgccccttctctgcgctgaacaagcagagaacatcgctgcaagacagcccc

SEQ ID NO: 74177 - DNA, 59 bp, Glycine max
  Peptide Sequence Number=SeqID_165862
gatcggcgataccataatttggggttttgggagagtctctattgacgttgctgatcagg

SEQ ID NO: 74178 - DNA, 162 bp, Glycine max
  Peptide Sequence Number=SeqID_165863
atgtatattgttgtggtacttaaggatgaacgcaagcggggatggggtcacgaccgaccgatcgttgcccttctctgtgcgaaacaagcagggaatgtcgctgcaaggcagccccgtatcctttttattttgcagctttcttttactatttgtttgttttaa

SEQ ID NO: 74179 - DNA, 354 bp, Glycine max
  Peptide Sequence Number=SeqID_165864
atggccacaatgatggaggccatgatgagcataaaggagataatggaggtcaatgtgactgcaatagcctctaccggaaccattgctgaggtgtacctgaccccccaatatggcctcaacaaaataaatcatccaacctcagatatggtaggtctggaaggcaaagagttgggaggtacgggcggccctcatttagtgcaaaaaataagcgtgccatatggcttgcctcccaactatacaccacctaatgtgacgtacactctcggtgaggatgtcaataactccgctcccatactcgttgaaagacgacaacctcaaactgatcatgcacatgtctctcaacccatggggtag

SEQ ID NO: 74180 - DNA, 1028 bp, Glycine max
  Peptide Sequence Number=SeqID_165865
ccatccgaccatcaccaagctgcgcgtgctgtcgcgcaaccagcaactgatccgtctcgacttcgaagaaggcttctccaacgtcgatccgcagccgatgctggagcgcattcagcaggcgctgccgcagatcggcgcgctggtgctgtccgattacgccaagggcgcgctcagccaggtgcagggcatgatccaactggcgcgcgccgccaaggtgccggtgctgatcgatccaaaaggctctgacttcgaacgctatcgcggcgcgacgctgctgacgccgaacctgtccgagttcgaagcggtggtgggccactgcaaggatgaggcggaactggtggaacgcggcatgaagctggtggcggattttgagctgtcggcgctgttggtcacccgttccgaacacggcatgacgctgctgcagccaggcgttgagccgctgcacctgccgacccaggcgcaggaagtgttcgatgtgaccggcgcgggcgacaccgtgatcggcgtattggccgcttcgctggccgccggcaattcgctggaagagtcctgcttcctggccaacgccgccgccggcgtggtggtgggcaagctcggtacctctaccgtgtcgccaatcgagctggaaaacgcggtgcgcggccgggccgaaaccggctttggcgtgatgaccgaagcgcagttgaaaaccgctgttgctcaggcgcgtcagcgcggcgagaaagtggtgatgaccaacggcattttcgacattctgcacgccggccacgtctcctatctggccaacgcccgcaagctgggcgaccgcctgatcgtggcggtgaacagcgacgcctcgaccaaacgcctgaaaggggaaaaacgcccggtcaacgcgctggagaatcgcatgatcgtgctgggtgcgctggaagcggtggattgggtggtgccgttcgaagaggacacgccgcagcgcttgatcgccgccattctgccggatctgctggtgaaaggcggcgattacaaaccggaagagattgccggca

SEQ ID NO: 74181 - DNA, 343 bp, Glycine max
  Peptide Sequence Number=SeqID_165866
atggataaccacttgggtatctctgcctactacctaacttcatgggttaggattaacttcacgggtcacgatagcaaaaagtggggtggccgacaaaagcaaggcttttgctcctactctctatcgggagatgctgagtcaatcgaacttgcttttgtgaccacattggcctctgcttgtcaatcgaacttggggtctccgaatgacgaggtgcagataaccgaaaggtgtctccgcatgctaccagactcttgggtcatgatagcaaaaggtggggtggtcgacaaaagcgaggcttttgctcctacgtatcctccatttgtgatgaggaactcagacctac

SEQ ID NO: 74182 - DNA, 282 bp, Glycine max
  Peptide Sequence Number=SeqID_165867
atggtgatgcaaagagtccaaccttctcctttagggggaggtgaggcttttgtagcccaagagcctcagccagagctagaggttactcatgaggccattccacaggtttcacatgctactttacctgtcgtggaggtctctgagggcggcgcagagtacctgggatccctggcctacagcacattggagacacctcaaccagcccaggatactccttcttcacctcatggccagcctacgtcagctcaggacgagcctattgttgctcaggatgattgttga

SEQ ID NO: 74183 - DNA, 927 bp, Glycine max
  Peptide Sequence Number=SeqID_165868
gaattagaccgcgggaagcaagtcgaaaatggggtggttggggtaccaaggaaatgcttggaagcaaaggcgagagtcttggcaagtcaaggcgaatgggccccgttcatggacatcctggcacttttgatcttcagggtggtcctctttccaaatgtggatgggttggtggaccgagcagcgattgatgcttttctcaccttttacgaccgcaaggaaagcccggatgtcgctatcttagccgatctatatgacacattcgaccgaagatgtgagaagaacaatgcaaggatcgtttgttgtacgccgactctctacgtatggttggtttcgcacttctttcgccaagagatgagacacgtttgcccgctagaaggccaccgctcatgcatcgagaaaaaagaggcaaattgggaccgactcttagcaagcaaagaagaagcgtctgtcaattggttcccccgatggaaggaaggaagaaccgggattcttatttcgtgtgggaaatttccaaatgttcccttgatggggacgaggggttgcatcaattacaattgtgtccttgctataagacaacttggttaccctatgagaggggcaccatcagaggaaggcctcataccttttattatacgaggtttcaatagcaccaacgcgggggtgtttcagagggtccacaaggcatgggaaatgttgcaaagaaaggacaaggaacttaggggaagtagcaatgggcccatcggcggttactgtaggtggttgaaagcctacgaacaagatctggattggctcccgagtttgaggaccactaaggggatggagattgaaactccaaaagaagacgaagaggtacaggccctcaagacagaacttgagaaaacccaagcagtcaaagaaaagttcaagtcaacagctgttaggttctga

SEQ ID NO: 74184 - DNA, 549 bp, Glycine max
  Peptide Sequence Number=SeqID_165869
atgatgcttggcagctgcaaaggacctacttcatttgaggatatcaagactgttgcgaatatccaatatccaacatatagagaagcatgttttgcaatgggctttctacaagatgacagagaatatgttgaggcaatcagagaggccaagaactggggcacatctaattatctaaggaaattgtttgtattaattctgttaataggtgccatgagcaaacctgaagaaatttggaatcaatgttggcattggctagctgatgacattggatatcaatatactaaatcaacaatcaactcagaaatacagatcaatgatgatactcttagaaatttggcattcattgaaattgaacaactcttgcacataaaccaaagatcactaaaaaactatcctacaatgccatatcctcaggatatcaatctcacatcgtacctacaaaacaacttggtattatcagaactcgactacaaccatgatgaaacgagatcagaatttgaacatctttttgcatccatgacagacaatatacttattcatacattataa

SEQ ID NO: 74185 - DNA, 387 bp, Glycine max
  Peptide Sequence Number=SeqID_165870
atggcacgtttactgcgccagaaactccagaaaaaccccttcagcttctctgcttccaaaaacccttcttcttctaattcgtatccattatctccggcgaaaccttcttattttcagatacttgttattcctttcatcatcaacctcaccgtatctctgaactttgccactgttcttcgtgaatccaagctcttactcactgattccaccaatcaccaaacccttcgcaagaatcaccccttttcagatttcttacaatgtcgcaaggacaagcagttccgtttgttgggaagtggcaacgctttacagtcaggaatgatggagaaaaggtggttccagaaccacatggtgacgccgaacagacagaaacctgggaatcagaggtga

SEQ ID NO: 74186 - DNA, 327 bp, Glycine max
  Peptide Sequence Number=SeqID_165871
atgggatcaagtcaaaagccttcgcttaaaaagaggttctatcaagtcaaaatcaagagcttagaggtcactagtttacgagaggttgggcaattaatgggtcaacttcaacggcaagccttccgcaaagcctatggtaagatttgggacctagctagggtagaagtctccatggaaccgattgcatccctttcccagtattatgaccagcccctaaggtgcttcacattcgaggacttccagctagtgccaactgaagtgtcataccctaatttcgtccggggacctttgcttgatgacatgcgacctttctttggtccttgtgag

SEQ ID NO: 74187 - DNA, 178 bp, Glycine max
  Peptide Sequence Number=SeqID_165872
atggcctcctatggtggtgagcttcttctagactcatcttctccttcaagtggcatctcctctctctcttccttctccattccgttgccatttatcttccaagaagcaaaggaatccattgatgaagaagatcatacgcctacaagctccaatggagcttacatcatggaactcacta

SEQ ID NO: 74188 - DNA, 417 bp, Glycine max
  Peptide Sequence Number=SeqID_165873
atgtcaacgttcaacatgcgtacactttttttgctgctgttcattgtatttaacatcgagtatttagagaaccgatgttgtcatatatatgctaacatcggttttacaaaaccgatgttaacattgatacattcagcatcggcactttcaacatcggttttagaaccgatgtttcacatagacaagaatgtgaaggcaaagtgcaaatcgctaattggtcagaagaatgcctcggactacgtaatggataattggggtaatctggcagattgtccttcggaacaggagttccttgagcaccttcaaaggcttcaagtagtgtgttctctgtggccaatgttcgttgactacgtatgtgagacatggattgtcccacacaaggagaagtttatcacggcctggacaaataagggttga

SEQ ID NO: 74189 - DNA, 333 bp, Glycine max
  Peptide Sequence Number=SeqID_165874
atggctatttataggaaaaggcatttggggcaggggcagctcgcccaggcgagccagttacttatggctaaaggaattagctcacccaggcgagctggttgcttagccctaaaggcatttcatggctcaggcgagccaaatgctagcctgggtgtcaaacaccataattcaactagcaatgatcaaaacatcacagccttcatcaaaaaattctgcttgaatgacacatcaaaagttggtatgccatcattccacaaggtgcataagtcatctatgagtggttacaagtacacatcaatcttgtgcctcggatttgatggacctggaatatag

SEQ ID NO: 74190 - DNA, 874 bp, Glycine max
  Peptide Sequence Number=SeqID_165875
gtcgactctagaggatcccctctctgggttctatccctccatggcaagaatagccaatgtagtcaaaatcttggcacaagaattggaccgagtaaagcaaaatagaaatggggtggtcaaaataccgaggaagcacttggaggagaaagcgaaggctttggcggatcaaggtgaatgggttttgttcattgacgtcttggcactattggtatttggagtcatcctttttccaaatgtggacagattagtagatctagcggcaatcgatgccttccttgcttaccaccatagtaaagaaagcccggtcgttgctgttttggccgatgcctatgacacatttgacctaagatgcgagaagagcggcgcaaggattgtctgttgcacacccgctctttatgtgtggttggggcatctgtcagttggttcccctgatggaaggaaggaagagccagagtcttgtccttgtgcgagggggtcgccatcggaagaaagtaccacgcccttcatcacacggggtttcagtgaccccaatgcaaggatatttcaaagggtccgaaaggcatggagtgcggtgcaaagaaaggataaggaatttaggggaagcagcaatgggatagttggcggatatcacaagtggctgaaggctcgaacacaagagttagattggctcccgaagctgaaggtctcaagtgaggaagaggctgaaacccccgacgagagtgaggaggtgcaagccttaaaggtggaacttgaaagggcgcaagcggtcaaggaaaaattcaagacgacagccatgatggtccgaaaggagtgtgacgaactaggagacatcaatgtggccacagccgaagcattggaatgggaaataaagagg

SEQ ID NO: 74191 - DNA, 318 bp, Glycine max
  Peptide Sequence Number=SeqID_165876
atgcataaggcattacgggccaatgcacctctcccttaccctcaattgagtaaggatcagaatggtcaatggctgaagaaagatgcacttcctccacaagataagcgtactccttctcctcctcctcagcgagatgattcagcccttatgactgaagttcttttcgagttacggggtcttcgtacttatgttggtgaacgttttgactctttggataattgctttgcaggaatggatatctgtctcacacagcttgaagaagatgtgggttatattcgtcagaccttcgatcttccaccaccacctccaccttcttag

SEQ ID NO: 74192 - DNA, 465 bp, Glycine max
  Peptide Sequence Number=SeqID_165877
atggccggaaccgaccgacaggcgttcggcgtggcggatggcttcggtcaggtaggccttggcgcggcgcgcggcctcgggcacgtcctcgacctggggcagcagcgcggccagggcggccgacagggtgcagccggtgccatgggtgttggcggtctcgatgcggtggccgggcagctcgatcatgcggtcgccgtcgtgcagcaggtcgatggtgtcgttgccgggcaggtggccgcccttgaccatgacccagcgctggcccgaatgcgccagcttgttgcgcaggcgttcggccacccgtcgcatttccttgaccgtttccaccggacgttcttccagcagcacgccggcctcgggcaggttgggggtgagcagcgtggcctgcggcagcagcgcttcgcgcatggcgccgacggcgtcgcgttccagcagcaggtcgccgctcttggccaccatgaccgg

SEQ ID NO: 74193 - DNA, 369 bp, Glycine max
  Peptide Sequence Number=SeqID_165878
atggctccgagaaagctttccgcaaagagatctaggaaggacgtcacgactgaagggaccagtgccgctcccgagtttgacagccatcgtttcaggagcgctgagcaccaacagcgtttcgaggccatcaaaggatggtcattccaccgagagagacacgtccagctcagggacgatgagtacacagatttccaggaagagatagctcaccggcgttggacgtcgctggtcactcccatggccaagtttgatccggatatagttctagagttttacgccaatgcttggcccacagaggagggtgtgcgggacatgcggtcatgggtaaggggccagtggattccttttgatgcagacgccctctgctag

SEQ ID NO: 74194 - DNA, 54 bp, Glycine max
  Peptide Sequence Number=SeqID_165879
atgctgcctgtcgcaaagtgcccttttgcgggtgagcgagggcgaggctcacgg

SEQ ID NO: 74195 - DNA, 180 bp, Glycine max
  Peptide Sequence Number=SeqID_165880
actcatcttcttcttgaagtggcgtctcctctctctcctcctgtctccattccgctgccattcatctttcaagaagcaaaggaatccattgatgaagaagatcctaggcctacaagctccaatggagcttacatcagcatcccaataaacagatggtccccagacgatattagggtatga

SEQ ID NO: 74196 - DNA, 339 bp, Glycine max
  Peptide Sequence Number=SeqID_165881
atgaatcgaaaagcttggttcgaggggaggtggttgccgcccagctcgcccaggcgagctcagctcgcccaggcgagcagggttgcttcctccagaagcaaccgccttctggaggaatcttctggagggcccaaatgggcctgggtgctatttgcacccccatttttaccaagttcacccccctctgctgttttttttggtgatcccttttttcgtaaagttacggaaacttacgaatttcgtaacgatacttgttttctttccgtaatgttacggaaccttgcgaattacataatcatcccctttttgacttacggaatgttacggaatctcacttaa

SEQ ID NO: 74197 - DNA, 471 bp, Glycine max
  Peptide Sequence Number=SeqID_165882
atggacgaagatcaatgggcgtatgatagttcgatgtacgaagaatttgatatggattttgaagatgaagaacagtgtggtgtgaatgaaagacatgttgattgttcagacgcttttaatacttctcaggtaatgatgttcattagtttcagtcgtttggttgaatgtatgttttgtataaaaaataatgtgagggttgctttgtctgacacagatactggtcatagaggaagaagttcgtttgtgttaataggctgtgaaggagcggtcagtacaagtgtaggaataaagaatgtgttagaagagacactgctgcgtgggaaaccagtgtgtggaggggaaggttggatggtgaagttgatttgtgggatgcacaatcatgaattggccaagtccttagttggacatccatacgtcgggcgattaacgaaggataagaagaatattcttgacgatatgaccaagtcgatg

SEQ ID NO: 74198 - DNA, 750 bp, Glycine max
  Peptide Sequence Number=SeqID_165883
atggcttggatggggaacatggaatcgaaggctgcagtggaaggggaggaggaacgtaggagtgtggaagcacgggctgccttgggctgtttgggttgccccattcctgaggataaagctgaggaggatcgtaggagtgtggacgaggcggaggagctggcgacggcgctgaagaaggaaacagtggtggcggtgacagcggcggcgatggtggctgggctgaagaaggaaacagtagtggcggcgacagtgacggctgtggtggcggcatcgatgcaggaaacgggaagcgctggcgaaatatcacgatcggaatccattgcggcgaggttggccatggctgcctcgagccggtccaggctggcatcgagaggttcgacatctgccattgaagaacaacagagaagggggcagggagttgagagagggaaaggaaatacgtttgatccttttcatcttgccatgcacattataacaagcaatcaacaaatatctacaatcggacttaagctaattccaaatctaacaatgcatgccaacaaagcaacaccaaacacatcaactaataaaaggtcaaaaccaaaagcagaaacagaggccaccatggaaaacgaattaaatggaaatagacgcataccagatgcaacaacaacaatatgtcctcatgacccccatgacaacaatggcgacttcaacggtgacagagcgatggtgcaggctacaatggcgacactgacagaggcggagtga

SEQ ID NO: 74199 - DNA, 345 bp, Glycine max
  Peptide Sequence Number=SeqID_165884
atgtttcctcctccgtccaaggtcaagactaaaggtgcaccgaagaaatcgatgaaaagaaacgaaagatccacaaagcatgatccatcttattgggagtacgttgatgcatttcattctgttcaaagcagcaacacttcaggtttcattgaggacgttgtggacatcaaagcgaacggtaactgtggatatcgttccattgccgctttattaggtatgggcgaagaatcttggccgatggtctacaacgaattgatcaaagaacttggaaaatggtcgcatgattacatcaacctcttcggtggcacagagagattcgaacaattaaggatgtcgctatgttga

SEQ ID NO: 74200 - DNA, 444 bp, Glycine max
  Peptide Sequence Number=SeqID_165885
atgcctggcctgctgaggctagcaaggatatattctagttattcacttaagagcattactggtcctaaccaagattacattttcaatacaattattctaatgcttctcattctaattgcagtgatcagagtgtgcaatgtttgccatagggatggaaatcaatataaattaaaacacaaaccaaaaatcaaaaatcagattgcaaaggttcttacggaagaaccttcttccaagaaggttcttccatatgaatccacagaagaacgttcttccataagggacattcgttcatacggaagaacgttcttccgtggattcataggaagaaccttcttccgtgcaaacgattttcatacttcaacgaatacgaaagaaggttcttccgtattccaagaacgctccgtcttctacctctcccatggattctcagacaaaaaaccttaa

SEQ ID NO: 74201 - DNA, 1518 bp, Glycine max
  Peptide Sequence Number=SeqID_165886
atgagtggtgatcataacagttctgtttccatggttgggaagaagaaaaagaatggctctcttcggtctattttcatgcatgctgatggcttagactggttcctcatgatttttggtctctttggggccattggtgatggcataggcacccctttggtgttgtttatcaccagcaaaattatgaacaatattggtggtttttctagcaacataggcagcactttcatccacagcatcaatgagaatgccgtggttttgttatatttggctggtgggtctttcattgcttgtttcctagagggttattgttggacaagaacaggagaaaggcaagctgcaagaatgagagttaggtaccttaaagcagttctcaggcaagaagtagcatactttgatttgcatgtcacaagcacatcggaggtcatcaccagcgtctctaatgatagcctcgtaattcaagattgtcttagtgaaaaggtcccaaactttttgatgaatgcgtccatgtttgttgggagctacatagtggcttttgcattattgtggagattggccattgtggggttcccttttgtggccctacttgtgatccccggtttcatgtatgggaggacattaatggggttggctagcaagataagagaagagtacaataaagcaggcacaatagcagaacaagcaatatcctccatcagaaccgtttattcttttgtgggggaaagcaagactattgatgctttctctgaagccctacaagggtctgttgagttgggactgagacaaggcttagcaaaaggtttagctattggaagcaatggtgttgtctttgctatatgggcattcatgtcctattatggtagcagattggtcatgtaccatggagctaaaggtgggactgtatttgcagttggagcagccatagctcttggaggattggcactaggtgctggtttgtcgaacgtgaagtacttctcagaagcaagtaccgcaggagaacgcataatggaagtgataaaaagggttccaaagattgattctgatagcatggctgaggagattctggagaacgtttcaggggaagttgaattcaaccatgtggactttgtgtacccatcaaggccagacagtgttattctgaatgatttctgcctaaagattccagcagggaaaacagtggctttggttggagggagtggctctggaaaatccactgtgatatcacttttgcagaggttttatgacccaattgagggagagatatttcttgatggtgtggccattcacaagttgcaactcaagtggttgaggtctcaaatgggtttggtcagccaagagcctgcactgtttgcaactagcattaaagagaatatactttttggaagagaagatgccactcaagaagaggttgtggaggcagcaaaagcttccaatgctcataatttcatttcacagttgccacaaggatatgatactcagtgtgtgtcacggcatgcaagttttacccttggtggttgttag

SEQ ID NO: 74202 - DNA, 4116 bp, Glycine max
  Peptide Sequence Number=SeqID_165887
atgaagagggcgagggatgatatgtatcctgcctctcaattcaaacgcccctttgcttcgtcacgtgctgattcctatggacaaaaccaagtccctggaagtggaggaggagggggaggcggcggcggagggggaagtggcaatggaggtggtgttggcgggggagcaaatgcttcccagaagctgactaccaatgatgctttatcctatttgaaggaagtcaaagacatgtttcaggaccaaagagagaagtacgacatgtttcttgaggtcatgaaagatttcaaggcccaacggactgacactgctggtgtcataaaaagggtgaaggagttattcaaggggcacaacaatttgatttttggatttaatactttcctaccaaagggttatgagataacgcttgacgaggatgaggctcctccaaagaaaactgttgaatttgaagaagcaatcagctttgtgaacaagataaaggtttttcttctacagaaacgattcctaagtgatgagcatgtttacaaatcattcttggacattttaaatatgtaccgcaaagagcataaggacattggtgaggtttatagtgaggttgctaccctttttaaggaccatcgagatttgctcgaggagttcactagattcttaccagatacttctgctgcaccttccacacagcatgctccatatattcgaaattcattgcagcgctttaatgagcggggttctatggcccctatgatccgccaaatgccagcagacaaggcacaacgctatcgacgagacaggcttccttctcatgatcgtgatatgagtgctgaacgccctgagctggatgatgacaagacaatgatgaacatacacaaggagcagaggaagcgtgaaagtagggagaggagaatgcgtgatcaagatgagagagaacatgatcttgataacaacagggatttgaacttgcaacgctttcctgacaaaaaaaaatctgtcaagaaagctgaaggttttggaatggcttctgactttgcttcttatgaagacaaagataccttaaatagcccaggcatgtatagtcaagcattcagtttctgtgagaaagttaaggggaagttgagcagttcagatgattaccaaacattcttgaagtgccttcatattttcagcaatggaataattaaaaggaatgatttgcaaaatttggtaactgatttacttggaaagcattcggatcttatggatgaattcaatgatttcttggagcgttgtgaaaatattgatggattccttgctggtgtcatgagtaaaaagtcactgtctactgatgctcatttatcaagatcatcaaagttggaggaaaaagacaaagagcacaagcgtgatttggatggagctaaagagaaggaaagatacagggagaaatacatgggaaaatccattcaagaacttgaccttagtgactgtaaacgttgtactcccagctaccggcttctgcctgcagattatccaattcctacagctagtcagagatctgagcttggtgctcaagtcttgaatgaccattgggtatctgtgacttctggaagtgaggattactctttcaaacatatgcgcagaaatcagtatgaagaaagcttgttcagatgtgaagatgacagatatgagctggacatgttattggagtctgtgagctcagctgctaaaaaagcagaggaattgtataatagcatcaatgaaaataaaatcagtgtggagactctgaaccgtattgaagatcactttactgttctaaatttaaggtgtattgaacgtctatatggtgatcatggtctggacgttatagacatcttgcgtaaaaacccaacccatgccctgcctgtaatattgactcgactgaagcagaagcaagaggagtggagtaagtgtcgttcagatttcaataaagtatgggctgagatttatgctaaaaatcactacaaatcacttgatcatcgtagcttctacttcaaacagcaagattcaaagaacttgagcaccaaatctttggttactgagattaaagaaattaaagaaaagcagcagaaagaggacgatattattcagtctattgcagctggaaataaacagcctctaattccacatctggaatttgaatattctgatgttgggattcatgaagacctgtataaacttgttcgttattcatgtgaagagttattctctagtaaagagttgttaaataaaattatgaggctctggagtaccttcttggagcctatgcttggtgttccttcccaatctcatgggacagaaagggctgaggacagaaaaactggacataatgttcgcaattttggtgcaccaaatgtagggggtgatggaagtccccgggaagatactctttcgataaattcaagggtaccaaaatctgataagaatgaagctgatggtagagtaactgaagtgaagaatgttcactggactactgtggcggcatccaatgataaagaaaatgggtctgttggtggtgaaattgttagtagagatgatccattaatggataaaggacagaaaaatgtagaatgcaatgataaagcctctggatttagcaaacaatttgcctctggtgaagaaggagctaaaaacaatgtatcaattgcaattagaggagaaaacagcctgaacagaactaacttagatgcgtcttcaggctgtgctcttactccatcgcaacctactgatgttgatgactctgtatccaagtctcagggtgttaatgtaccttcggtggagggatgcgacatggcaactccagtaccagtggtcaatggtgttctaagtgagagcagtaaagttaaaactcatgatgaatcagctgggccctgcaaaattgaaaaggaagagggtgaattatcaccaattggtgactctgaggaggataactatgttgcttatggagattcaaatgtgcagtcaatggctaagtcaaagcacaacgttgaaaaaaggaaatatcagtctagaaatggagaggatgaatcttgtcccgaggctggaggtgacaatgatgcagatgctgatgatgaggacagtgaaaatgtttctgaagctggtgaagatgtctcaggcagtgaatctgctggtgatgaatgcttccgtgaagatcatgaagaggaggaagatatagaacatgacgatgttgatggtaaggctgagagtgaaggtgaagctgaggggatttgtgatgcacaggtcggaggagatggcacatctttgccattgtcagagaggttcctttcatccgtgaaacccctcacaaagcatgtatcagcagtttcatttgttgaagaaatgaaggattcaagggtgttctatggaaatgatgacttctatgtgctttttagacttcatcaagctctttatgagaggatcttatcagcaaaaacacattcaatgagtgcagaaatgaaatggaaagcaaaagatgctagttcaccagatccttattcaagatttatgaatgcattgtacaacttgcttgatggatctgccgaaaatgccaagtttgaagatgaatgccgagcaattattgggaaccagtcgtatgtgttattcacattggacaagttaatatacaaattggtcagacagcttcaaactgttgcaaccgatgaggtagacaataagcttctccaattatatgaatatgaaaagtctcggaagtctgggaagttaaatgattctgtatatcatgcaaatgctcatgtcatccttcatgaggataatatatatcgtttacaatgttcctctaccccctcgcgactattcatccagctcatggacaatatgaatgaaaagcctgagttgtttgctgtttctattgatccaaatttctctttttatctgcacagtgattttctgtctgtctttcctaacaaaaaggagccccatggcatcatactgcatagaaacaaacgccaatatggaaacttagatgagctttctgcaatatgctctgccatggaaggtgttaaagtagttaacggattggaatgtaagatagcttgcagctcatccaagtgtggttgtgctgcaattgtaaaatcaatggtgtggatttga

SEQ ID NO: 74203 - DNA, 378 bp, Glycine max
  Peptide Sequence Number=SeqID_165888
atgaaatcttcaacaatcaaaaaatttgggaggagtgttatatgtagtttgtacccggtgacgatggaggagaagaggaggcggtggagggggtgtttggagacgcaatccgagcatggtggagatggtctgcttcatggagtctctggcggcgggggacacgcctttggagatggcggagttgtcgaggggctcgatgcggcggagcatggcggcgatcacggtgaagccgcggtcgaagttgcgggtggagacggcgtcgtcggagaggcaggagggaaggaagccgccgcggcgacgcgtgagggggaggagaacggagggaggtggcgaagttggaagagggggaggcttgggtgggaggaactgaaagagtga

SEQ ID NO: 74204 - DNA, 180 bp, Glycine max
  Peptide Sequence Number=SeqID_165889
atgtctgcgatgccaattataataaacttcgtaccccattgcccagaggctcttcgctatgcgaaggctgtttccggattcgaacccatgaccaacaagtcaccaaggcacaactttaccgctgcaccagggctcgccctcaaatacagggaagacagaatattgcaacaaaatatttaa

SEQ ID NO: 74205 - DNA, 947 bp, Glycine max
  Peptide Sequence Number=SeqID_165890
atggaaaactcagatacgaagctgacaacttcatccctgcctccaccacctccagtatctgcggaggagccagagcccaagaagttgaagatgtccaccacaacttctgatgatgaagaatgtgcagctggcacaggcaccaagaaaagatacaagcgccgtaaggttgctattttctttgcttactgtggtgttggttatcagggtatgcagaaaaaccctggtgcaaagactattgaaggtgacctagaagaagtcttgtatgtgtctggagctgtccctgaacaggatcgtggagtccctaaacgatatgactgggctcgctcagctagaactgataaaggagttagtgctgttggtcaggttgtctcaggccggttctatattgatccacctggccttgttgaccgccttaattcaaaccttccttctcagataaggatctttggttacaaacgtgtgacagcttcttttaatgccaagaagttttgcgaccggaggaggtatgtctacctcattcctgtgtttgctcttgatcctagctgtcatcgtgatagagagaccgtcatggctagtttgggatctggaaatgagcttgttaagtgtttggagtgttctgagaggggccgaaaggtgataggattagttggtaatcgtaagaagaatctggaactagaagctgtggatgtcgaggctggtatttcatcaaacagagactctggagttacagaggatgtggaggtttctttgagcaaaggtgatgataatcatttaaatgaggaatatgggaatgataataagggtggcatgaactctaaaactggccttgagactatggttccggttcaggaagagggtactccttttaatggtgaatctgtgaataattcagacattcttgaggatgaaaaagttaatggtgaggataagctaaccaatggaagtgg

SEQ ID NO: 74206 - DNA, 294 bp, Glycine max
  Peptide Sequence Number=SeqID_165891
atgggtgttggtggtgtcattagttgtaaaaagttgcttcttggagccttggtatctttaggagtcatctggtttatgttccttgcaatctcagtgaaccgtcaaaccaagaggacagtgctagttccaatgaatgttatctcaaagcatttgaagttggttagcatgcagaggcatgccctgcattcaaattctggactattcattgtgagcaagagaagagtgccaaatggacctgatccaatacacaacaggagagtggtgaaaactagacggccacctacacaagcctga

SEQ ID NO: 74207 - DNA, 1344 bp, Glycine max
  Peptide Sequence Number=SeqID_165892
atgaagttatccaatagatatacagctgaagcagaaaaggcatcattggagcagcaaagaaaaattgatgagcttgaagctcaattgaatgaagctgaggatatcgtaacagatctaagggcagagttgaagcttgtatatctggagttagagacggcaaggaataaccaggtccagcctttgaatggacagaatgaaaagcaagttgtaacttttcaggagagtgcaaaacctgagatttcaatatcctctcctcataaagaacttgaatgtgtaacgagctgtgatgtggcaaacaaatcactgactatgaacgttttagataataagtgttgtaattcaaaacaacaaactgagcaattgtgcatctataatttggaggattcttgtggtcataactctgactttgcttccatcatcacgagaagcaaggaacctgaacttcgccgaaatggatttactcagagagtccgtgcacttgaaggaaatttgctggatgaaaagctgctcaagcaagatgtacacaatcaacattatggtaaaaaactcgggatcattgctaaagatagtaatgggcaagttgcaaaatatagtgcattgactgagaaaatggaaattaagaagcacgttaagcaccataaaataccaaaacggaagatatattcctattactggtctcgctttctttcttcttgtaaaattcatttaaacgacaactgtaaatccagcaaaggtgtgtgctttctaccttctatcaagcttggtgccattagcaaatggaaaagcaagaggagaagacatagacatttgggaatgaaatcttttgctttcaggagttgtaaaccatcattttttcttaagcagtgctcatctgtctgtaataatgaaaaatgttgtgaagatgaatctggtgcaaagatgaagtcattgccacctttgactgatgtagaacctgtgcataggaccattggtgttacagaaagtatccaggctgtaaataaatttgagcttgtggagaaggcaattgagaaggatagcgagttattaaatttagaagaaaatgctgcgcagaatctaacaggtccaagttctgatatgaaagttgagggttttgattttccatctacagatactgatttggaagatgcaaaagcttttgaaaaaaatgatagatctgccagtcaagtaaatgacagtaggcctctgaagtacacattccaaaggaagcgaaaaaaagaatccttgggaaacgcagaccaaaacattgattctgagaagcgtacagtggagaggagggtggaagacaaacaaaattgtgcaatagaactccaaaatctagcatga

SEQ ID NO: 74208 - DNA, 190 bp, Glycine max
  Peptide Sequence Number=SeqID_165893
tgaaaaacctcgtcggcgcctaggagtacatggcaggacatgcctcacaatggggagaccagtcagggtcacactgttgtgcgagaatgctccaaccatgtgggatcggcaccggcttaaaggagcactcaaaccggatgacccccaaggtctacactcgaaagagtccgtcagggtctctcccttctga

SEQ ID NO: 74209 - DNA, 345 bp, Glycine max
  Peptide Sequence Number=SeqID_165894
atggatgaacgaaatagacagatcgctgagataggtgcctcactgattaagcattgcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataa

SEQ ID NO: 74210 - DNA, 658 bp, Glycine max
  Peptide Sequence Number=SeqID_165895
tgcctactgtagaagaatttgaagaaatccttgggtgcccgctgggaggaaggaagccatatcttttctctgggttctatccttccatggcaagaattgccaaggtagtgaaaatctcggcacaagagttggactgggtgaagcaaaacagaaatggagtagtcggagtaccaaggagttgtcctctttccgaacgtggaatggacctagcggcgattgacactttcctcgcctttcaccatagcaaggaaagcccgatcatcgctattttggccgacatgtatgacacgtcatcgctcgtgcaccgaaaaggaaaggcgaattgggacctactcttggctagcatggaaggagcatctgctaattggttccctcgctggaaggaaggaaggaccgagattataatttcatgtgaaggatttccaaatgttcccttgatgggaacgagggtgaccccaacgcgagggtgcttcgaggaatctgcaaggcatgggatcatcggcggctatcgtaagtggctgagagttcgcacacaaggtttggattggctcccaaagctaagggttgcgagagaggaagaggccgaagctccggaagagagtgaggaggtacaagccctaaaggcagggcttgagaaagcccaagtagtcaaggaaaa

SEQ ID NO: 74211 - DNA, 492 bp, Glycine max
  Peptide Sequence Number=SeqID_165896
atggccggaacaaatttcgaggtgctctgtgggacagtaacagcgagcttaagctccgaagagataaaaaaggaccaatcgagagtagatggcttgattctgaaggatgaattgagggtttgcctaaggtcccagaggagtttgtctcagcagttatgcaagaccaaaacaaacatgttagccttcctcggcaagtaccaagaagaattaaatctagccacggcccacgagcacaaagtggcagacgaatatgcccgagtgtacgcgaaaaaggaggctagaggaagggtgattaactcgttacatcaagaagcaacgatgtggatggaccggtttgctcttactttgaacgggagtcaagaacttccccaattgttggcaaaggccaaagctatggcagacacctactctgcccccgaggagatccacaggctcctccgctattgtcagcacatgatagacttgatgacccatataattaggagtcgttag

SEQ ID NO: 74212 - DNA, 219 bp, Glycine max
  Peptide Sequence Number=SeqID_165897
gctggagccattgtcaatgagaaccttggccatgatgtgatccatgcatttgagagatacatgcagagccctattatgtcctcgtccctcaatgggaatctcctcctcagcaaaggtgagtgtcgcaacctacccttcgacgggagggcgacgcgtgactcgcgaaatgcgtgttccacgaaaggaatacgcgcggagttgccaccaacgtttatttga

SEQ ID NO: 74213 - DNA, 474 bp, Glycine max
  Peptide Sequence Number=SeqID_165898
atgacgacgttagtctctgcatgtcaacgggctcgcttgccttctggttgacaaaaggtgcggataaccactcggaaatcgtctttgtacggataaccggtactccgcctgccacacttcatgggttaggattaatcgtttgtacggataaccacttgggtgcagatgacgacgttagtctctgcatgctaccggactctaagtctgacgaaaagaaaatgagtgtgtgcgggttatcgtatagggcgtctccgcgtaccaacggactcacaggtcacgtagcgaaaggtggggtggtcgacaaaagcgaggcttttgctcctacgtatcctcaatttgtgatgaggaactcagacctacggcaaggatggacattctcaccctcggtcaaggtttatggtgaattgggattttggctcaaggcttgtagaatggctggacatgatttatgtcaggacgttggtttggccagcg

SEQ ID NO: 74214 - DNA, 80 bp, Glycine max
  Peptide Sequence Number=SeqID_165899
atggagcttacatcatcagatccctcttgttggactaaacttgaccagaactgcattaagacatacataccaacaactag

SEQ ID NO: 74215 - DNA, 219 bp, Glycine max
  Peptide Sequence Number=SeqID_165900
atgcccattggttggaccacccaaaactgtggagctgatacagaggaggaggaaccaacaaatttgaggtcaaatcctcttcaaaggggaggagatgatgcaatcctccctagaaagggaccaatcactagagccatgagtaaggggatccaagaggattgggctagagttgctgaagaaggccctagggttctcatgaacctcagggtagatttttga

SEQ ID NO: 74216 - DNA, 344 bp, Glycine max
  Peptide Sequence Number=SeqID_165901
atgaacacgctaagcacacctactgtgcttagcctgttcatcgcagctgttaaatttttggatttccagatgatcgcgctaagcggaccatgtcgcgctaagcgcgctaagcacgtcctatgcgctaagcctaagggtcattctgctaaggctgagttcacttctcctgaggcctgggaaaggtacactgacattgttgtacctaggaagctacttccagaaagaaatgttgtaatctaccacagtgagtttgatgagttcaaggaagaattggagagaagaaaatgggataaggagttgaccagttttgatgaaggcagcattgatgttgccattgtgaaaga

SEQ ID NO: 74217 - DNA, 597 bp, Glycine max
  Peptide Sequence Number=SeqID_165902
atgtcgccacacgggggcgacatggatgggggtgaaaaaaggaaagagagggatggggtttctcttgcttttggcatagcgggccccggcgggaggcccgcacgacgggctattagctcagtggtagagcgcgcccctgataattgcgtcgttgtgcctggactgaggatagatggggcgattcaggtgagatccaatgtagatccaactttctcttcactcgtgggatccgggcgatccgggggggaccaccacggctcctctcttctcgagaattcatacatcccttatcagtatatggacagttatctctcgagcacaggtttaggtttggcctcaatggaaaaaaacggagcacctaacaacgtatcttcacagacaagaactacgagatcgcccctttcattctggggtgacggtttgaaaaaggatcttagagtgtctagggttgtgccaggagggtctcttaatgccttcctttttcttctcatcggagttatttcacaaagacttgccatggtaaagaagaagggggaacaagcacacttggagagcgcagtacaacggatagttgtatgctgcgttcgggaaggatga

SEQ ID NO: 74218 - DNA, 427 bp, Glycine max
  Peptide Sequence Number=SeqID_165903
aacaccctggtcgtgtgcgtgctactggagtcgaaaaagtgactcaacagctgaggagttgtgttgattcctcagcgaccgatccagacacgggtgactcagacaaatgcaaattgtacatcgaagaaaatcctccttgcttggttgccctaggaagagtttatgagggatccacagtcgttcacaacatccctttgttgcatgatcaagtgaaggttggtgttgaggaggttaaagatgcagatgctcccatttctatacccactgacaagggaattgtgggaccagcaaaacctgcagataggctggatcctaagccacagtccatccagaaatttgggcaatcgcagtttgaatcagaaagttacatcaagaactggatgcagagttcaaaacgggatgtctacctgggagtctacctgaatgg

SEQ ID NO: 74219 - DNA, 330 bp, Glycine max
  Peptide Sequence Number=SeqID_165904
atggaatcactaagattaaatcaacatgaagaaactgataagaagaagaagggaatcgctcttaaagcctcatctgcaatccaagaagatagtgataaagaagattcatttgacttggataatgatgaagatattagtctgtttgtaaaaagattcaacaagtttctgagaaaaaagatggagaagtctgaaaagaaaaatattaatgaaaagaaattgaagaaagcatacattacatgggatgaaaacgatatggaatcttctgaagattcagaaaatgaagaaataaacctctgccttatggcaaaaagttatgaaagtgatgaagag

SEQ ID NO: 74220 - DNA, 111 bp, Glycine max
  Peptide Sequence Number=SeqID_165905
atggaggatagggtcacgaccgaccaatcgtcacccctttccggcgctgggccagcggagaacgtcgctgcaaggcagcccagttcaagtaggcaagacgctaacccataa

SEQ ID NO: 74221 - DNA, 579 bp, Glycine max
  Peptide Sequence Number=SeqID_165906
atttcactcattgctcagtccaactcctcgcggctaggatttccaaccctgattactgccttgtgcaaggcccgaggagtcacctcaaattctcttacctttgagtcacttagcccagccattaatttggcctatattaagaagaattgctggaacctggatgaaccttcgattacttttccagggacccaaaaatccagggctagaagatctgaggcctcatcttcttcagctgcccatgctccccctacccttgctccctctacttctgctctcccttcagtaccagcagctccagttcttccaggtccctccgttcagagcttagagcctttcatgtctatgctacagagcttgcatcagggcgagctcttgatcatgcagagtttgcaggatgtggtccagcagcggccagttatgagcctgaaggagtttgttcagaaggtggcctggccaggagtccaaccttctcctttgggagggggtgagtcctccgcagcccagaagcctcagccggacaaggaggatgacattatagaggcctcacagcccactccacctgagtctttcattttttag

SEQ ID NO: 74222 - DNA, 315 bp, Glycine max
  Peptide Sequence Number=SeqID_165907
atgatacatcttggtagcaccagggtggttgctgaggttgctcctatgaccttcctcaaagatcaacttcctaagtttaggcacattgtgtcgcaacctacccttttgcgggcgagcgagacgaggctcacgggtgcgttttccaaaggaggaaaatgcacggagtcgccaccaacgtttatttgtggaaaacgtcggaaaaaccgaaggaaaccggtcaaaaagaatattccaagttcgggagttgtatttacgtttgaggaagatattagcacctctcacgtttgtctcaaaggacaacagccttatttttag

SEQ ID NO: 74223 - DNA, 153 bp, Glycine max
  Peptide Sequence Number=SeqID_165908
atgggtcgcttagcgggtttcacaaaaaacaacattgggcttagcgacataggagtgccgcttagcggaaattactacggcttagcgaacaggaacgctcagctcagcaaatgctgcaaggatttttgcttggcgcaggagattctggcttaa

SEQ ID NO: 74224 - DNA, 108 bp, Glycine max
  Peptide Sequence Number=SeqID_165909
atggccgaccaattggcgaccaagtccaaagccaaaggtagcaagataccttggatatgcatgtatatagcaaaaatacctcacaaaaatatacacatgtttagatag

SEQ ID NO: 74225 - DNA, 324 bp, Glycine max
  Peptide Sequence Number=SeqID_165910
atgcaccacaggccgcgggcgcgccgccacctcatcaaggctggcccagccggattgtttgatacaaagcagtatttgcggcatttggttcgccagcaggcggccaaccatcgggcacatagtcagggctttacttcttttccgtgccatactccggaccagttcagggcagaggtcgcgtggcctggggattggcctgaggcccaggcaggagaggcaccagcaggggcaccagcagaggctcccgacgaggcagatgaggcccgcaaggatgaagagatgatcgatttacttgatttcttaggagggagcggtgccacatga

SEQ ID NO: 74226 - DNA, 255 bp, Glycine max
  Peptide Sequence Number=SeqID_165911
atgaacaggtgtaaagtagctttccatagtaaatatgcagcatggtcagattcagtgttgcaactaaaagatcatcctgggcatactgtttgctggaggcatccttatgattggcacttggataggaagatttgttaccccacctttttccaggaagtattttgtcaattgcctcttccatttatcagtgaagaatttaagattgacttcacttggaaagacatggacgctaagatggagcagccactaccatag

SEQ ID NO: 74227 - DNA, 378 bp, Glycine max
  Peptide Sequence Number=SeqID_165912
atgaagagagaatctcctttatccctgcattacaaattgtttgaggggacacatgtcccagacattgtctcgacatcagggaaagctgctgcttcaggtgttgtgtccaaggatgctctgattgctgaactcaaggacacatgcaaggtgctggaagcaaccatcaaagccaccacagagaagaaaatggagctggaacggctgatcgaaagactcacagacagtggcattgatgatggtgaagcagctgaggaagaagaagatccagctgaggaagaagaagcagttgagcaagaagaagaggcagctgaggaaaaggaagatgcagcagaagagacagaatcagatgatgatgctgattctgaagccaccccatga

SEQ ID NO: 74228 - DNA, 654 bp, Glycine max
  Peptide Sequence Number=SeqID_165913
atggctagcagtggggaagttatagcgactactattgctattgaaacaaccttagatagagggatacgaggtacccatgttgtagggtcttgcaaattgaatggaggggggggaaaggttgttgaagtggttggaggaaattgtgggaaagggaaaggcagagatggtattggtggcattgatggcaaaggtagtgttcttttgaggtggcttgtaactgagaccactcaaggtgtatacacacaggggacactgcaagtggaagtggagctacttatcaaagttgcttggcagagtgacacaattgccgaaccatccatgcagttaactccgtccactgatggtatttccaacttgtacactccatattggtctgtggttctattcactgagaagcttatctgctcgctagtttttggtgaggttgctctaaatctgcacttagctctgtttagagaaagtgctggtggagcaggtatcacaataaacagctcctaccacactgatacgggagataattggacttggagattgagcaatgagcagaaatgggcaactgaggagagattgggaagtggaagggcaacaatattttatagtgagcatagaatagaagaatcatggggtggatttggagagttgatcgacccatag

SEQ ID NO: 74229 - DNA, 567 bp, Glycine max
  Peptide Sequence Number=SeqID_165914
atgtggtttatggtgggtacctggctgtttgctcccttcttgttcaatccttctggttttgaatggcaaaaaattgttgatgattggaccgattggaataaatggattagtaatcgagggggtataggtgtaccgcctgaaaaaagttgggaatcttggtgggaagaggaacaagagcatctccaatattcaggaatgcggggaatcatagtggagatactgttatcgttgcgattttttatctaccagtatggtctggtctatggcatttcgtggttggtgatattcgtaatattgtttgtgatgaagacagtatctgttgggaggcgtaaattcagtgcaaactttcaacttgtcttccgactaatcaagggaatgatattcctcacttttgtctcgattcttgtcattttgattgctcttccgcatatgacagtgctggacattgttgtttgcattctagctttcatgccaactggttggggaatgctgcaggcaaaggttggaagttacatggaagttactaaaacttccatcaacggttggaagttacatggaagttactaa

SEQ ID NO: 74230 - DNA, 2928 bp, Glycine max
  Peptide Sequence Number=SeqID_165915
atgaagaaggttattggtcaaactgttagggaccttaaaagagaagtaaataagaaagtgctgaaagttcctgggattgaacagaaggttcttgatgctaccagcaatgaaccatggggtcctcatggatcacttcttgccgatattgctcaggcaaccagaaaccctcatgaataccagatgatcatgtcagtaatctggaagcgaattaatgacactggcaagaattggcgacatgtctacaaggctttgacagtactagagtacttggtggctcatgggtcagagagagtgatagatgagatcagagaacatgcttatcaaatatcaacattgtccgattttcaatatattgattccagtggaagagatcaaggaaacaatgtcaggaagaaatctcaaagtctggttatccttgtgaatgataaagaaagaatcatagaagttaggcagaaggctgctgctaacagggacaagtttcgcaacaatgcagcaggtggaatgtatagacctggttcacattcaagcagtggagcctatggtgaccgatatgatgatgatcgttatggaagcagggaggaagatagaaatggctatggttatggaagagaaagagaatggggcaatagagatgatgatcaacatagtcgtgatggagatcgttatggcagagattatgaggatcgttatggcagggatggttacagagatgacgactacaggggaagaagccgaagcgttgattaccaatatgacacaagaagcaggagctctgatagagatcgttgtgatgatgatggacaacactcatctcgcggaagcaatgctaaagctgaagaccaatctctggaagcaaggcttgagcggaaactttctgagcaaaatatgggtgctcctcctagctatgaagaagctgttggtgaatctcgcagccctgtacacagtgaaagagatgcggaaacttcagcaccatctgctcctagagactcctctcctcatgtaaatgataatcctagtcaaatctctgctcctacgggatcttttcctgtaaacaataatccaaccgaagcaactactgctgcatctggagcccaggaaactgagacgactgatgacttttttgacccacgtggtccttcatcagctgctcctgccgccccagccaccactaacagcgttgaaatggacttgctcggttccctctcagactcattctcttcaaatgcattatctcttgtaccagctgcatcagcaactgctgcccctgatgcaaattctggatcaacagcttcctttgcagcagcaccatctgggtccaataattttgatcagtcttttgaagatccatttggtgactcgccattcaaggcttttacttccactgaaactgctccatctcaaccccagacatatcagagtattgagccttcccaatcaaatggtcttaatgcagaaacaaactctaactatgggtttggggattcattttctgttgtaccatactctgctcctgtttcctctgacgctcaacctttctctgcaaactctcagtttccgtctcaagatatgtcatcttcacagccagaaacagatattcttgcagacattcttcctcctgcaccattacctgagatgcattcacagcaaaacatttcagcacctgcttttgaccatccttcttcaccttcctttccagcttcatctggtcaaatggcttcacaaccattttctgaaccaacgggccaattcccccagcaaggtttctcagctgcaaccagtcaacccgcacaaacctttccagttcctacagatcaattttctcaacaacacttttctgctcctaatggccaaccaggacaagtacaatcatccttttcatctccctccagtcaatatgcacaacaacccttttcatcccacgctggtcaacctggcttgcatgcattttcatcgcctactggccaacatatgcagtcaccttttgcttctcaaggtggccaacctgcacaatcaggtagtatgtatggtggattgcactcccagggtggatctccaaccatgtctcctcaatcccaaaatggatataatgggcatatgaatagtggaaactttggatcaatggcagcttttccatcacacatggctccccaagctccaacaggacagctgtcacagggcaccaactttccccatcatggaggatctattgctcacactgctccgcatttgtcttctcactctccaactcatcagccatcacagtttaacagccagagctttactggacaacaagggaatgccaccccccatagctcaccaattaccaatcaatcacttgcttcacaatcaaattctttagtttctcaaccatccaaggacaagtttgagacaaaatcaacagtttgggcagatacactaagcaggggattggttaatttgaatatatctggacctaaaacaaatccattagcagatattggggttgactttgaagccattaataggagggaaaagagaatggagaagcccactaccacggctgtaacatcaactgtaactatgggtaaagctatgggatcgggttcaggtatgggtcggtctggtgctggttctctcaggcctcctccaaacccaatgatgggttctggcatgggcatgggcatgggcatgggcatgggcaatggtcctagtgttggtatgggtatgggaggctatggaggcatgaatacatctatgggtatgggaatgggggggatggggggaatgggtatgggacaaggataccataaccagatgcaacccccaactagattgcctcctggctccaacataccaggtaattataataactctatgatgggtccaggtagttatggtcaacagccatatggtagttatggtcaacagccatatggcggctaccgatga

SEQ ID NO: 74231 - DNA, 819 bp, Glycine max
  Peptide Sequence Number=SeqID_165916
atggagggtcatcgtgagaaattgaagatgaaccctgttatcagtgatgtggagaatagttatggtggaagtgagtatgaagatgccaatatggatgttcaagctaactacatgggcatagacaatgaaaggggtcttgagcttttttgcctttgcaagagagaacaggatgatgtgctcggaatgtcgtcgtccagaggaggcgctgggccgtcctcggaggctccgccgccgaggcggatcatgcggactcagactgcggggaacttgggagagtcggtgattgacagtgaggtggtgccttcctctctggtcgagattgcgcccattcttcgtgtcgctaacgaagttgaaaagactcatcccagggttgcttatctctgccgtttttatgcctttgagaaagctcataggttggatcccaattcaagtggtcgtggtgttcgccaattcaaaactgcgcttcttcaacgccttgaaagagaaaacgatccaactctgaagggaagggtaaagaaaagtgatgctcgcgagatgcagagtttttatcagcattactacaaaaaatatatccaagctttacaaaatgctgccgataaagctgaccgtgcacagcttaccaaggcgtataacacagctaatgttctttttgaggttttgaaggctgttaacatgacacaatctatggaagttgatcgcgagattttggagacccaagataaagttgctgagaaaaccgagatcttagtcccttacaatattcttcctcttgatcctgacagtgctaaccaggctataatgagatttcctgaggcatga

SEQ ID NO: 74232 - DNA, 1731 bp, Glycine max
  Peptide Sequence Number=SeqID_165917
atgaagaacaccactgcttgtctcaaaatcttctccacccttattctcttagcctctctcttctacatcatcattgctccctccttctacacttcacctcgtatccatcaaaacttgcatttgcaatcccaacaccactttgacttctgcccaagcaactacaccaaccactgtccatgtcaagaccccataaggcagagacgcttccccaaagccaaaatgttccgcaaagagcgtcattgccctcaaagcaccactgaaaggttgaggtgcctcattccaatcccacctgggtaccaaaccccgtttccttggcctaagagtaaggacactgcttggttcagtaacgtgccttttcccaagcttgtggagtataagaagtcacagaattgggttaggttggaaggtgaccactttgtgttccctggaggtggcacttcgtttcctgaaggggtcaaggcttatgttaatgctctaaaacgtcttcttccggtgcctttggaatctggggacgtcagaacagtgcttgatgttggttgtggggttgcaagctttggagcttctctgatggactatggtatcttgacaatgtcactggcgcctagtgatgaacatcaatctcaagtacagtttgccctagaaagaggactcccagcaatattaggtgtactaagcattcacaggctaacattcccttcaagatcatttgatatggttcattgctctagatgccttgtcccatggactgattatgcgtgggaaacagagcctcatgagttaaaaaaggagcaaaataccttagaagaccttgcaatgcaactgtgctgggaaaaagttgctgagagagaccagattgctgtctggcaaaaacacatagatcatatcagctgcatgcaaaagttgaagactaggagatcccccaagttctgtaactcatctgagtctgaccctgatgctggatgtccaatagaaagacttagaacaatactggagaaagttattaagaagggtctcatggtgaataatatttatgatgatttggtctttaagacactagaagatggaaatctgtatattgctaaggtttctcttttcctgaatccattcaagaactttgaatttactactgttttgctaaggtataccaaaatgactgcatgcatttttcctcttccagacgtgaaagatgtacatgaagtatctggtggtgttcttgagaaatggcctatgaggttggaaactgttccaccaagggtcagaaatgaaaatgatgatggcttcactctcaaaacatatattgaagataatcagacatggaaaaggagagtgtccaattatggggtccttcttaaatccctctcttctggaaaatatcgaaatgttatggatatgaatgctggctttggtggatttgccgctgcaatagtgaaatatcctgtttgggttatgaatgttgttccctttgatgtaaaaagcaacaatcttggcattatctacgaacgaggccttataggaacttacatggattggtgtgatattactgatattcttctggagatgcatcgcattcttcgtcccaaaggagctgttatcgttagagatcacggagatgtaattcttaaagtaaaagaaataactgatagaataagatggaaaggaattgtagtggctggtgaccaggatggaccttttcatccagaaatgattatggttataaacaatgacgactaa

SEQ ID NO: 74233 - DNA, 1434 bp, Glycine max
  Peptide Sequence Number=SeqID_165918
atggcttctgtcacacacctacccagcatcagcagaaccaacaatgatcacatcacattctcgcaaacctttcacccaataaagtctcacccctttgggcagatttcacttcccatgagaaaaaaccatgacttgtctccccttagccactcaattgttgcttcgggttccgtactaggaatcacctcctccgagtctattcataatgtttccaaaacaactacaaagcccacacacacttctactctttccaatttctggagagaggttcaagggtgcaacaactgggaaaaccttttggagcctttgcaccctcttctccgccaagagatcattcgctatggcgagttcgtaacggcctcatacaaggcctttgatctcaacccaaactccaaacgatacttgaactgcaagtatgggaagaagagcatgttgagtgaggtgggaatgtcaaactctggctacaacatcacaaagtacatctatgccacacctgacataaacctccccaacatgacttataacaactcttcttcatcttctgctcggtggattggttacgtggctgtgtcctcagatgaagctgtcaagagacttggcaggagagacatattggtaactttccgcggaacagttaccaatcaagaatggatttcgaacttgatgagttcattgacaccggccatgcttgatccctataatccacgacctgaagtgaaggtggagtcagggtttctctctctttacacctcagatgagagctcagcttccaacaagtttggactcgagagttgcagggaacagcttctctctgaggtgtcgaggttgatgaacaagtacaaaggggagaaagagaaccttagcatatccttggctggtcacagcatggggagtgctttggccatcttgctttcctatgacatagccgagcttggattgaacaaaaaaagtggcactcacgaggtgccagttactgtgttctcctttgggggaccaagagttggtaactccgaattcaagcaccggtgtgaggagttgggagtgaaagtactaagaatagcgaatgttaatgaccccatcacgaaactacccggtgttgtgttcaacgagaattttagggttttgttgggagggaggtacgagtttccttggagttgctcgtgttatgctcacgtgggggttgaactactgcttgatttcttcaacgtgcaaaacccatcttgtgttcatgacttggatagctatattggccttcttaggcgtcccaataaagatgaagtgctaatgaagcgcgaaagggatgaagatggagtgaactctttgttggagaaagcaagagagttgctcttcaactcgcaaagcatgaaaattttggccggagtgttaactgcatacaactaccatgatttgctgaattcagtagtaactagctag

SEQ ID NO: 74234 - DNA, 351 bp, Glycine max
  Peptide Sequence Number=SeqID_165919
atggaagaagcaaaacctatttcttctcctaaggttggaggctgcaaactgactaagacaggttctgaagatgtctctgaccctaccttatatgggtttgttgtaaggaacttcaccggcttccaccaagcatcctttctccattcatgctctgtgatgcagattaggcctctgatcctgatgacaggaggtccacatctgactgttgttgcaagatctagcactgaggctgaatatagaagcatgaccttagttgcaatagaagtcaaggtctctcatgcttctcctgttattctttgtgataacacaagtacagtggctttggctcataaccctgttctccactcttga

SEQ ID NO: 74235 - DNA, 382 bp, Glycine max
  Peptide Sequence Number=SeqID_165920
gaagtatccagctttagtgagcaattcgttcaagacctcaaaattattaattaatgaacatgtattggaaatccaagaatttagggagaggctattagatttaggtgttgaggtcagcccagttttggcacctggcgatcaaggaagttcacaactttcatgggatgttgtttgtgttatggtgggcactattagcaaaatagtcatggatagtcattcatggtgttatccagcttgcattcaatgtcatagaaagactgacatcgaaacaggaccattcacatgcgaatgtgacaaagataatgatcagcctgttctaaggtatagagttgaagtaatgctggtgattggtggatttctcttctttctagcaggatggtga

SEQ ID NO: 74236 - DNA, 1899 bp, Glycine max
  Peptide Sequence Number=SeqID_165921
atggatggaggaatgactttgcaggatatgcaagacatgagggactgctatgacaccttgctttccgccgccgcagcaaccgccagcagtgcttatgaattctccgagtccttgcgggacatgggctcttgtcttcttcagaagactgctttaaatgatcacggagatgaaactggaaaacttctcctcatgcttggcaaaatccagttcaaactccacaaactcattgatcattatcgttctcatatattccagacaattaccattccctcagagtctctcttgaatgaacttcgaattgtcgaggagatgaagcggcaatgtgacgagaaaagagacttgtatgactatatggtaacaagatatagagaaggaggcaggtctaaaggtggcaaaggggagactttttcattgcagcagttgcaaactgctcatgatgaatatgacgaagaggctacattgtttgttttccgattgaaatctctgaagcaaggacaatcgcgtagtcttctaacacaggcagcacgccaccatgctgctcagaaagcagtcaagtcccttgagacagtagaaccacatgttaaatcagtaactgaacagcaacacattgattaccacttcagtggtcttgaagaggaggatggggatgaaggtgattatggagatgatgttggtggtggttatgatgagaatgatgatggggagctgagttttgactatggacaaatcgaacaagaccaagatgtttctacatcacgaaactcaatggaggaaacaaactccatgagcattagagttgtggacaaagatgttttgcagtcttgtgcacagaaactttgcatccttgtttgcttaaatgtgactatctgctctatgcacttggatcaggtggaacttacacttcctagagattctacagctgaagctgctaaggaaaacttagacaaccttgtaaggaatttgttttccttcaaggttagggcagggagccaatctgccccactttttgctgataataaaccagatgcaagtgaaaaactgagacaaatgcgcccatctttatcacggaagttcagttcatatgtgctacccacaccagttgatgctaagagttcaacctcttcagggtcaaataatccaaagccttccaaaatgcaggcaaatttaaatgaacctacaaagaacttgtggcattcatccccattggaacaaaagaaacaagaaaaagatataggagatgagttttctggttcaattgtcagaagtgcacagtcagtactcaaggaaagtaatagcaatactgcctccatgagattgccgcctcctttaatagatagtcttttatcctcaaaccgtgattacatttctgcttactctaaaaagattaaaagacatgccttttctggcccattgacaagtaatcctgggcctaccaagcctgtctccatagaaagtgttcaactgttctctggacctcttttgccggctccaatccctcagcctccgtcatcatctccaaaagcatctcctagtgcttctcctactcttatgacttcacccaaaataagtgagcttcatgaacttcctaggcctccaaccagtttcccctccaattcaaggcttttaggtttagtgggtcattctggtccattggtgtctagaggtcaaaaggtgactgcaaataatttggttgcatcaagtgcagcatctccactgccaatgccacctcaggccatggctcgtagtttctccataccttctagtggcgcaagagtggcagcattacatatgccaagaacactagaatcctctcatagatcatctatatctgagaatattgcttctcctcctctgatgccaatatcattatctagtagtcggccatcattagatggctga

SEQ ID NO: 74237 - DNA, 312 bp, Glycine max
  Peptide Sequence Number=SeqID_165922
atggaagcgcagacacgaactccacaaacgcgaactcgacaatgtggttgcaatcacagaagcgcagcccagtttgcaacaaacacgaactcaggcagaaggagaaacaacaataaagccctgggatgtacctcaatggataagttccaaagacgatctccacaaacacgatctccacaatgtggttgcggtcacggaagcacaggcgactttgacacaaggagaaagaagaagaacgatatggttcaagcgcaaggagaaagaagaagaacgatagggttcaagcgcaaggagaaagaagaagaacgatag

SEQ ID NO: 74238 - DNA, 225 bp, Glycine max
  Peptide Sequence Number=SeqID_165923
atggcagcgcaactaatccatgatcgagtggagatggagtgcctagagggagcttgggataccctcgaaggcaatgcgaggtgccgatttcgtggcacgattcgattcacggctacttcattggtgcatccagaggaaccaacatgcacgcttcagcgcactgtggaatggatattacctacgcctactccatatcgtctagtggagccaatccaagtgatcgag

SEQ ID NO: 74239 - DNA, 861 bp, Glycine max
  Peptide Sequence Number=SeqID_165924
atgggtcaacttcaacggcaagccttccgcaaagcctatggtaagatttgggacctagctagggtagaagtctccatggaaccgattgcatccctttcccagtattatgaccagcccctaaggtgcttcacatttgaggacttccagctagtgccgactgtgaaagagtttgaagaaatcctgggatgcccaatgggaggaaggaagccatatcttttctctgggttctatccctccacgacaagagttgccaagtaccaaggaagtgtttggaggaaagggcaaaggccttggcaaatcaaggcgaatgggctttcttttattgacatcttggcgcttttgatctttggagttgtcctctttccgaatatggaagggttagtggacctagcagcgattgacgctttcctcgcctttcatcatggcaaggaaagcccgatcgtcgccattttggccatgtatgacacgttcgaccggggatgtgaaaagagcggtgcaaggattgtttgctgtactccagctctctatgtggggctggtttcacacctttttctccaagaaggtaggcccgcctacccactacaaggtcaccgctcgtgcgtcgaaaaaggaaaggcgaattgggaccaactcttggctagcatggaggggcgtctgttaattggttccccccgatggaaggaaggaaaagaaggagttcttttctcatgtggaaggtacccaaacattccactggtaggaacgaggggttgtattaattacaatcccacgctcgctataagacaactagggtaccccatgaggggagcaccgacggaagaaagcatgtctcctttccttgtgagggatctcggcgcataa

SEQ ID NO: 74240 - DNA, 660 bp, Glycine max
  Peptide Sequence Number=SeqID_165925
atgggtcaacttcaacggcaagccttccgcaaagcctatggtaagatttgggacctagctagggtagaagtctccatggaaccgattgcatccctttcccagtattatgaccagcccctaaggtgcttcacatttgaggacttccagctagtgccgactgtgaaagagtttgaagaaatcctgggatgcccactgggaggaaggaagccatatcttttctctgggttctatccctccacgacaagagttgccaagtaccaaggaagtgtttggaggaaagggcaaaggccttggcaaatcaaggcaaatgggctttcttttattgacatcttggcgcttttgatctttggaggtgtcctctttccgaatatggaagggttagtggacctagcagcgattgacgctttcctcgcctttcatcatggcaaggaaagcccggtcgtcgccattttggccatgtatgacacgttcgactggggatgcccgtctatccgctacaaggtcaccgctcgtgcgtcgaaaagggaaagggagtcaagaacttccccgattgctagccaaggccaaagcagtgccctatacctactccgcccccgaggagatccacggacttctcagctattgtcagcatatgatagacttaatggaccatatgattag

SEQ ID NO: 74241 - DNA, 681 bp, Glycine max
  Peptide Sequence Number=SeqID_165926
atgactactctgactcagatatggatgacgctgctactcagcaacatcctgcccaacgaccataattttgacctccctgtgcctaagtgccagatggtgtacaccatcttgacacggatgactgttcacgtggcccagataattgctgacgccatttatttgtttgcagggacggtgcccactaggcaccctttggacccggagaggtccaacagggccttgggattttcggccttgatcacgggcctctgccagttctacggtgtacttgtcatccccagcaaggtaatccggacgtcgatcactcaagctttcatcgagaaatattgcacccctaggcaagtgaagggtgacgcacaacaggctgcggatgcaccaccacctcagcagcccgatccggttataccactaagtgtggagcggtatctatggcatttggttcgccagcaaacggccaaccaccacgggcaggggcagggctcccctccttttgtatgccctaccccagagcagttcagggctgaggtcacatggcctggagattggccaactgaggagggaaccggacccgcagcatccccgggcgaagcggaggaagcccacatggatgaggatatgaccgacctgctcggttacctgggagggggcggagctacacgaccaaggtcgccgcacttgtga

SEQ ID NO: 74242 - DNA, 189 bp, Glycine max
  Peptide Sequence Number=SeqID_165927
agaaaatattcctggagagagaaaaaggaatcgcacgaagacagtaaaaatgaaggcttcaatcccttctccgtctctatgacgtttaggaattctatcggagcagtcggaggaaaagctggagaaatcaatagagatgctattatcgctgttagaagacacgtgatcccgcttagaggtatggaatga

SEQ ID NO: 74243 - DNA, 267 bp, Glycine max
  Peptide Sequence Number=SeqID_165928
atgccaagcatgcacgcgcctagcgcgcaatcagctcgcccagcgagtcattggcgagcctttgaggacaaaaagtccttaaaagttgaagttggcaaaaggaggaaagagttttttgaagaaagaaatagaggaatacgtgagagacgcaacagaggaaaaacaagacaacaaagcaccaaagatcttagctttcaagaggattctaggtttaggagtgattattacgttcttagaggtggaggagacatgcccaccactgtgtaa

SEQ ID NO: 74244 - DNA, 351 bp, Glycine max
  Peptide Sequence Number=SeqID_165929
atgggcagaagtatgattgatgcaaccggtggaggcgctttaatggaaaagactcttattgttgccggacaattgatttcccacatttgccattggtcaacaatagaatgtgatggtagccaatcaaccaaggctgtgtggtatatttgtgctcttgatcatccaacagattgtggaagcaatgtcttccaagattattttgatgatgccaaagaatctagagtcaaacaagtttcaagaatcaagatcaagattcaagattcaagaataatcaagatcaagattcaagattcaagaataatcaagatcaagatacaagtcaagagaagactcaatcaagataagtattaa

SEQ ID NO: 74245 - DNA, 495 bp, Glycine max
  Peptide Sequence Number=SeqID_165930
atggataacgaagagggagtgcaagaacagatgaaggctgacatgatggccttaaaagatcagatggcttctatcacggaagccatgctaaaaattaaaaaatcaatagaagataatgctacggcaaccgcttccaatacaactagggaagcagaaccggtgctacaacccgcgaggaacttggtccgggatagaagcgcgacgggtttcaatcggaggtatagtcctcaagcctacccttatggtttacctccagacttcagtcctcgtaccgctccagacgatttgagccaagcccctaccttcgaggggcaactccctcctcatgcggactatcctctacaggaagatgatgaaggagatgcccatttaggccctctacttcccctcaaggaaccggccccccatgagttgccccaaccaaacataatccgccatgccccgtctcaatccacacccgttatggaactcgttcccatttcaaaagacaattga

SEQ ID NO: 74246 - DNA, 240 bp, Glycine max
  Peptide Sequence Number=SeqID_165931
gaacgagcggaatcaatgtgttccaatttctggccttgcatcgaccatctaatggaccatggactaaacggccactgcctgaaaggactatgtcccgtggaccgccgccccccacaagccaaggtcgcgggtggccaagagggcccacttggagacttgggatctcagcaggaaatgcgaagggaatactctaaccctgggaacctaggactactaaggtgggtggaaaagcctggatga

SEQ ID NO: 74247 - DNA, 351 bp, Glycine max
  Peptide Sequence Number=SeqID_165932
atggcttctcgtaagagaaaagcactagcttcagtgtcccaggctaggtgtgatagatcaatatttgtatcccaatatgcctgggactgctatgcaaacaatgtcctttgctggaagatccttctggaaaggaatgtgaagttgtacattacaaaatttgatgaattcaggagagaaattgagaggaggaattggtataaggagctcactaacttctttggagggagcattgacgtggcattagtgaaggaattctatgccaacctttatgaccttgaagataaatcaccaaagcagtggtcatcgaggaaagggagagcttgccctcttactccaggttctgcaggttga

SEQ ID NO: 74248 - DNA, 390 bp, Glycine max
  Peptide Sequence Number=SeqID_165933
atgcataaggcattacgggccaatgcacctctgccttatctccaccttgttactctttttcttcatcatttcaatgttcctttggatgatgaaccatttgtcaaggtcaaaaggtcgttttccattggtgtcggtgcggttacctcctttggttaccgaaaggatgttgatggtcagtgggttcgcaaacaagacttgccttcgcctattcctgacaagtgtaccccatctcctccaccacaatggggtgattccacttctcttctaactgaagtcctcacagaactccgcggtcttcgagcttttgtgggtgaatgctttaatgtaatggatactccccttgatgcgatggatactcgctttgatgagatggatacgaggatcacttga

SEQ ID NO: 74249 - DNA, 501 bp, Glycine max
  Peptide Sequence Number=SeqID_165934
gaatggcacccacaagacacccagtggacccggagaagtccaacaaggccctggggtttccagctctggttacgggcctctgtacggtgcctgttccccccggcaagggatcgcgcccacatgacgcctagtggacccggagaagtccaacagggccctagggttttcagctctggttacgggcctctgtcagtcctacagggtgcccgtccccccggcaagggatcgcgcccgcaagacacccagtggacccaaagaagtccaacagggtcttggagttgtcaatctctaattacgggtctctgtcagttctacggagtgcctgtcacctccagcaagggcatcaggccccccactaatcgagctttcatcaagaagtactgcgtccccaggcaggcgcagggcgaaacaccacagcagcctagggatggccggcagcgggcaatagacgcaccgccatcacctctagagttcacctcagctcatccacaaaaaggttag

SEQ ID NO: 74250 - DNA, 225 bp, Glycine max
  Peptide Sequence Number=SeqID_165935
atgacaaaggtgatgacaaaaagctcaaagatcaatcaaagaacaactcaagagaatccaagaccaatcaagaacaattcaagagttcaagataagaatcaagaagaattcaagactcaagaagaaagtctagagacaaggatcaagattcaaggttcaagatctcaagaatcaagatcaagattcaagactcaagattcaagaatgaagagaagactcaattga

SEQ ID NO: 74251 - DNA, 387 bp, Glycine max
  misc_feature (9)..(9): n is a, c, g, or t
  Peptide Sequence Number=SeqID_165936
agttgattngcaccatcgcccgatcgccacctagtaccacatgtgacggagtggtacctggagatatgtcgcgggagttaggagaccttggggacgtcaggcgagctcctggtagtcaaccgataaaagaacaaagaccacaaagcaaggaggcttgtgtggtggctggccagctatggattctgagtgatatctggaatatggcctctgggagtttgggagaccctcgaaggcaatgcgagatgttgattccatggcacgatccgacttatggctacttcattggtacatccagaagaaccagcacgcacgcttcagcgcaccgtggagtggatattacctacacctactccatatcgactagtggagccagtccaagtgatagag

SEQ ID NO: 74252 - DNA, 165 bp, Glycine max
  Peptide Sequence Number=SeqID_165937
atggcagaaatcaaccaagggacggatgtgagtggggctagggtcacgaccgaccgatcgttgccccttcccggtgctaaacaagtagagaacgtcgctgcaaggcagcccagtatcctttgcgttcgtagtttcttttactactgtttgtcttttttaaaataa

SEQ ID NO: 74253 - DNA, 834 bp, Glycine max
  Peptide Sequence Number=SeqID_165938
gggcttttgctcatggagctatattttttattagagattataatccagaacagaatgaagataatgtcttagcaagaatgttagaccataaagaagctatcatatcccacttaagttgggctagcctctttctggggttccatactctgggactttatgtccataatgatgtcatgcttgcttttggtactccggagaaacaaatcttgattgaacctatatttgcccaatggatacaatctgctcatggtaaaacttcctatgggttcgatatacttttatcttcaacgaacagtccggcgttcaatgcaggacgaagcatatggttgcctggttggttaaacgctgttaatgagaatagtaattctctattcttaacaatagggcctggagacttcttggttcatcatgctattgctcttggtttacatacaactacattgatcttagtaaagggtaatgtttcacagtttaatgaatcttctacctatttgatgggatggttaagagattatctatggttgaactcttcacaacttatcaacggatataacccttttggtatgaatagtttatcagtctgggcatggatgttcttgtttggacatcttgtttgggctactggatttatgttcttaatttcctggcgcggatattggcaggaattgattgaaactttagcatgggctcatgaacgcacacctttggctaatttgattcgatggagagataaaccagtggctctttccattgtgcaagcaagattggaaatgaaccactatggcaaggaaaagtgtgattcagagggagaagaagagacaaaaattggaacag

SEQ ID NO: 74254 - DNA, 695 bp, Glycine max
  Peptide Sequence Number=SeqID_165939
ctagagtaatgggtgaagtagaggaggtgcaagagaagatgaaggccgacatggaggccatgaaagagcaaatggccacaatgatggaggccatgatgagcatgaagaagataatggaagccaatgcggttatagttgccgctactagcgctgtcgctaaggtgaacccgatgctcccatctggcctcaagcaaatgaatcatccaacctcaaatatggtaggcaaagatttaggaagtacggatgaccccatgatgtgcaaattcaaaacaagcacgccttcccgccatatggcttgcctcccaaactatacaccacccaatgtggcgtacattcccaatgaggatgtcaataactccactcccatactcattaagagccaacaacctcaatctgatcatgcacatgtctctcgacccatggaggagacacatggaatgccccaccacaatctagccgacttcgagccttgcctcggatatgccactgaagggcaagcagttggtggtatacccctgcaaaacactttggagggccctcaggccattgaaggaggtaaagattatgcctttgctaacctagaagagttgttcctagtacctaatatcatcacccctcccaagttcaaagtgctggactctgacaagtacaaggagactacttgtcccaagaaccatctaaagatgtattgttag

SEQ ID NO: 74255 - DNA, 246 bp, Glycine max
  Peptide Sequence Number=SeqID_165940
atggaggacttgctgaaaccatctaaaggaatagaagagccgaatctggttgttcttttgatcatgctaatgcttatggtgactattgtgaggagacaacagataaggatactgccatcttcacttccagtaacatttttcagaaaaaacattcctacgaaggctgctatcagtgaaatagaactccacctttatctaactatggcttcaccatttattaaatgggaatcaaaagaatgcgagtga

SEQ ID NO: 74256 - DNA, 960 bp, Glycine max
  Peptide Sequence Number=SeqID_165941
atgggtgaaatcgtgagagagatgaacttcaacccattgcgttgcactttgccttctaaagttctaattcaatttgcgacagggttgtcatcttcaacttcatgtctgctacaaggtgtcgttttggacaaaacaaatggtgtgaaatcacccctaaactcaatagctttagcaagcctgaccgagcctgcacagaaacaattctggaagtgtcaagagggtctagctcaattggttgagcagccgtcatcgtcgaaaatcgtaatagcttgtaagcgaagactgttctcttccccgtttgtgacgttcccttcaatctcctccaagatcgatcagcgtcggagtttaccagattccgatccatcttccgaattagtgagaaatgagatgaagagggccttccgacgaactgcttttgttctgatgagggagttgtcatggcgttgctttgggcacaaaatcgattggcgaagattcttcgttctggtggctattttgactgtatctgctttcgtgtttcagacgcttgttcatgcttatttagctctgccaaacagaccgttacattctcctcatcaatctaatagctccctacaaggggggaggcttcaaaaggttcacctcactcttactgactctgttatttcacctaatgcgtctaacaagttgatccaatcattctcagttcagctagagaatgcagaactagaagccccaatccaaaggaagaattccgtatctgcgagaaaaaaggacaaaaatcttgctggtacaacgaaagtcgcaacatctttatctcctccaagacatgttcctaaacagagacacatacagttgttgccacctaacaaggcccttgtgcaagcaaagaaagagattgatcgtgcaccttcagttaatgaggatcctgatatttatgctcctatttttaggaacatttcggttttcaaaaggtactaa

SEQ ID NO: 74257 - DNA, 258 bp, Glycine max
  Peptide Sequence Number=SeqID_165942
atggcgccgcggagggagaagacaacgatggagaacggagagttgccaacgatggagaagaaggaggaagaagaaacgaacaatggcaccgcggatcaacttgttgggtcgcacacggtcgcaaaagaaggaggaagaaggagtcacgggaagaagaaaagtcaattgctgggtgcaaatgttattaaatgggcggctgcaaagcgagttgaaccggtgaaatctgcagcggttggaccggccggccaaggcttataa

SEQ ID NO: 74258 - DNA, 288 bp, Glycine max
  Peptide Sequence Number=SeqID_165943
atgatgattcatttattccgttacagaagaagagagcagaagcttcttcttggttataccttgacagacaaatcagcgagtgggaacattttcattttgtgtttggtggagatgcctattaggagcttggtagaggtggagccaccaagcccactgagatacttgatcggtgccgccgttatgatgatcggagtagtgttacccgtcggttacatgatgttccgtaacaagcgcgtcccctcctcttcctcctactccaaacagacgaacaaggaattagaaacttga

SEQ ID NO: 74259 - DNA, 2493 bp, Glycine max
  Peptide Sequence Number=SeqID_165944
atgccctctcactcctcctccaccttcgattccctctccaaatcccaggacctatcatccgccatccaatccgccaccaccccttcccaaatctcatccgcgtgcgcctccatcgagactttcctgcactcgcactcacccgatcagtcccgccacttcttctccctcgcattcccaaccctaatctccaagctcttcggcttcgacgattcttccaatgcctggatcctccaccgccactcttccgccgacggcgacctctcccaaaccctattctccctcctctccccctccggcaacctcgccgccgccatcgccgccgtcgatcgcctctccctcgtcaaatacgtcttccccgctgaacgcctccctcactggacacgctccttcctctccgacaccgattctcgctccctctccgatctctgcccttccctcttcaaaccctcgccttccccttcccaaatccaattcaacgtcttcgaatacttcttcttctggttcgcatactaccccgtttcgaaaggcaaaaacgacaacaacgaatgcgtttcggttaacaaaagagttaagaaatttaggttagaagattggactaatacttggacttcctccattcccggcttctccgcctcctcctcctccaagcgctgttcctccgagggaaaacctcagtgcgacttgtacacgcgcctcctctgcgcgtatctacgcgcttttgtcccttcctatgattttcacgcgcaccagccttaccggacttcgattctgcactacggctccggctacgacagttctgtttcggcgcgggccgagttcgtggtcaacgcgcttatccacttctggctcgtggacaatgatttctcgccgctgccggcgagtgtttgccggagcctccgagtttcgtttccggcgggggagacgcctcccccgccggggctcggggaggtggtgaggctgtttgtgaggtacttgaatttaagtactgtggcgacgtttcgcgaaaatgggggtggtggtgagtgtggaactccttggtggagagctttggagggtgcaaagagcaaggatttggggtctttgagttctgttcgttcgcttgggtgttggaacttctgcttgcagaggcctctgtataggtatctgttgagaacgttcttgttttgccctatggcggcttcggttaagaatgtgtcccaggtgttgtcggtttgggttggttacttggagccttggacgatgaatgcggatgagttttcgaatatggatggatttaacggcgagaagaaggaagattctgtgcctgcaagtgccggtgatgggttttcaccgcagtggcaggactatgttctctctaattatctatactacagttccttggtcatgcatttcattgggtttgctcacaggtttcttcatagtgatgttgaagttgtagtccagatggtgctcaaggtgttagacaccttgacatcatctaaagagctcattgaccttctgaagactgtggattcccttttccattccaaacaagtagggtcaggcaaagcaatgctgaataacttgtacagatatgttcctattattcatgaacagttgcaggactgggaggatggcttatgtgagactgatgctgatgggtcttttttgcatgagaattggaataaagatttgcgactttatgctgatggggaggatggtggacaacaactacttcagttatttatattgcgtgctgaagctgagttgcaagctatatctggtgataatcttgtacccagccttcgatgtatagattcattgaaggcaaaattagggtgtttatttgatggacacgctattataaagtcattatcaacctgtactgaaccaatgccacatcaacaatcccgtgatgagatattcaagcctagaagaggagctggcaattatgcatttgcagatgttaaatacaaaggcgactggatgagacgtcccatttccaatgatgaaattgcatggcttgcaaaaattctcattcggttgtctgattggttgaatgagagtcttggactgaatcaggcagaaagcaatcaagtaagctctacagtctcttatgtggaggtatcggctgatgttgctgcccacatatggggaccttacaaagccctgaaggtcttcttatgtaccattggttcttggtttctcttcttgggtgctgcttctctgggttgcatgcgaaaacatggtctgagggtgaacttaaggttactggcctccaagaagtttgtgatgcgcgagggagaaacgaaaaacgatgttattgatggacaacagagggtggtggtggaggactggccaacggtgaaggagcggtgggaatctgccgagacgccggtgccggaggaggtgatattggtggaggagttggacggcgataataaaaaggcaagaaaaacagatttgatgaagagagtgttagtgttttacacgtttcagtttatgattggataa

SEQ ID NO: 74260 - DNA, 312 bp, Glycine max
  Peptide Sequence Number=SeqID_165945
atggttctcaatatggaccaagaggatgggtatgaggaaaacaacatagaagaactggaaccagagccacaacttcatctccagccagttgatccaaattttggggctctgttagtggaacccactcaaccttatcaagtgagattgggagatggagttgatgacgtgatattgggagtggcttggctggctacctttggggaagtgaaagtaaattggaggactttgagcatgacttttgtgcatcaagggactcgccagtggggttggcgagttggacacgtggcagcgcctggtggactcgccagtgga

SEQ ID NO: 74261 - DNA, 906 bp, Glycine max
  Peptide Sequence Number=SeqID_165946
atgatgaatggaggaatgttggaagatattgccataattggaggattgataggggtgcaatttgtttacgcagggaatgctgtgttgcttagttatctcatgtctttgggcgtcgaatctcttacccttgtcatttttacttcctttgctaccttccttattctcctaccccttgccttctattatgaaaggtgtaaatggccaaggagagttagtttcaagttgcttatacagcttctctcgctttcattaggaggtttccattttttaaaattcgggcatggaagtggttttgaatatcaccctctgggtaacattgttccagtctctattcctccaaggaatcaatctaacctctccaacaatgggaacagccatgccaaaccttgcaccagacacaagataatcggttgtctctatctcttggctgcaatcttcatattgtcaagcaacattgtcctacaggcctttactctaggagattttcctgcaccgatgtctttgtgtgcaataacttcgttttttgggacgttcatgactgccgcagttcaattagttgaagatcacgaattcaaaccaggttggccaattgtgagtgttggagacatgattgcctattctcttctggcaggtgcagtgagtggaatatgcttgagcgtcaatggttgggcgcttgagaagagaggcccagtgttggtctccatgttcagccctattggcacagtctgctctgtccttttctcagttgttactctagggcaaaccattaatattggaagctttgcgggtatgttcctcatgttcactgggttctactttgtgctttgggccaaagggacagaaggctatgcaaaaggaggtggcttagagagtgagtatgatgcagagaagcctctattaagttga

SEQ ID NO: 74262 - DNA, 636 bp, Glycine max
  Peptide Sequence Number=SeqID_165947
atggtgggagatcgttggaattgtttggatcaagaacaagatcttgataccatattggaaatttatttctaccttgccaggaaggaagggcaggacacacaggatgaattaaagagaagaaacctacgtgatgaactggaagatcgtgaaaggaggcatttctcatcaaaaaataaatcttatgatgacagggatcatggaaagggtagccatctgtttttggaaggatcgaagagagaaatggaagatcacattgttccacgtagtgttgatgcagatgattctgatgttgaagtcaaaagtgatgatgacagtgatgatgacgaggatgacgaggatgatactgaagcattgctggctgagcttgaacaaataaagaaggaaagaacagaggaaaagctacgcaaggaacgacaacaacaagaggaggagctcaaagtaaaggaggcagagcttctgcgcggaaacccactgctaaataatccaacagcatctttcaatgtgaaaagaaggtgggatgatgatgtggtgtttaagaaccaagcccgtggtgaaaccaaaacagctaagcgattcattaatgacaccatcaggaatgatttccatagaaaattcctgcaaaaatacatgaagtaa

SEQ ID NO: 74263 - DNA, 1248 bp, Glycine max
  Peptide Sequence Number=SeqID_165948
atggctcctctcttcatctcaatgcaaatgcttcttctggttttcacttgcatattattgcatgtcacatgcacaacttaccacgacagcacccccaaaacagtgccttctacaaactcctctaagtgggtggggcccatcggacaccgagtaatcaccgttgacgttaacggcggagcccatttccgctcagtcaaagccgccgtcaatgctgtcccggagaacaacagaatgaacgtccttattcaaataagcgccggatattacatagagaaggtggtagtgcccgtgacgaagccgtacattacgtttcaaggtgcgggaagggatgtgacggtgatagaatggcatgatagggctagtgaccctggtcccaacggccaacaactgcgtacttacagaactgcttctgttactgtttttgccaattatttctctgccaggaatatcagcttcaagaacacagcaccggcacccatgccgggaatggaggggtggcaagcggcggcgtttcgcatatccggagacaaagcctatttctccggctgtggattctacggtgcacaagacactctttgcgacgacgctggccgccattatttcaaagaatgttacatcgagggctccatagatttcatctttggcaatggcaggtccatgtacaagatttctaacttctacagctttactgttttggcttttggtttcataatgtctgtggcttttgatatttggaatgctccatcgcccttggctctttgggaaagagtcttgctacactcaattgcgacgaggtttgggtcaatagcagcccaagacaggcaattcccatacgagaagacgggcttctcattcgtacggtgcaaggtgacaggaacaggcccaatttacgtgggccgtgcaatgggccagtactccaggattgtctatgcctacacttactttgacggcatagttgcacatggtggttgggatgatattgattggaacacttccaacaataacaagactgtgttctttggagtgtacaaatgctggggaccaggagcagcggctatacgtggagtcccattggcccaagagctagatttcgaatctgcacatccattccttgtcaagagttttgtcaatggaagacactggattgcaccctctgatgcttatgtagaacctgcatcactctctattgctggttcttgggaagaaccattcttgtgtgcaagaacccactccaagatcatacagtaa

SEQ ID NO: 74264 - DNA, 237 bp, Glycine max
  Peptide Sequence Number=SeqID_165949
atgtgttcttaccaaaatctggagctagtaccgttaggggggatgaggctgaaatgggctcctggacttcacacactagtttcgagaggtgcctttgtcaagaggacaagatgtgggacatgcagaacgagaccgaaatgggctcctggacttcacacactagtttcgagaggtgcctttgtcaagaggacaagatgtgggacatgcagaacaaatgattctgatgctcaagagtga

SEQ ID NO: 74265 - DNA, 2283 bp, Glycine max
  Peptide Sequence Number=SeqID_165950
atggcaataatcggttgcagcagtgatggacacatggatgacacaaagttcagcaaaccgatgccatggattggcatatacatagcagcagcatctcttgcctgtctcatagcaatggcagcagatctcatacacggaattcgcggtcgcaaactttggttcccttgcaaattcttctgcctaaacgccacttccttggccataatagctgttgcagtgaagttatcagtggatctcaacacccccatgcctcaccgccacgatcagctatcgaaactcagcagcagcgccttgatctgcacaataatggccaattccatgccaactcttggcatcacagagaacaaggacaccatgatgaacttcatggccatggccatacttgtgatcaccatgattgtgaacatctgcatacagtttgtcactggtgttatttatttgttctgggtggaacatgctgtcatcatgctcatcatgctaattttgttgatgaccatggcctcctcagccataagtcttccaaagatgaaacactactttgagctgaagtataagatgaatgaagaggcacttaaagagggttcaaaactacttggtgaggaagggaatcaaatggtcaacagactcagagatcagctcatgaaaatttggatgatggctcacacaagtagtcctcaatttgttcttggaaggtcagtgactggtactgcttctggtgccttttgtcttctcagtaccttaactttagtagaggctatgcttcgatcttacttgatgccatggtcgtttgatttttgcactggtgacactgactacaagtggtccataatcttaattctcatagttcaggttgctgcagtggtggtgggtactatagctcctgcttttagatggttcattgccataacttataagtgtcccaatgtgaggaaaaagagatgcaagagaaggttccatgtagaagggtactggactaccaagctattgttgattaaagaaagccctcttggttttcgaattcataataggcagtacagaaaacttgcccatgatgcaaaacttgttctattgtgtttctgtgttaaactgcaggtggggattgtgctaatgtgtaaagtcacccaatacgtttcaatatacctcatgtacttgatcttgacatgttgtgatcattgcaagaaggtgaaatccaagtttgtttctagcgcctcaagcgttagcagctcggcaactacagaatcaaggcctggaccaaagctagacctgagacgttttgtcttgcatcttgaaggtgaggaagagttagttgaggtgatgttgaaacagaaccgtgatgccactattcactgggttcaagtgggagaaaagaagcagccaaaacttctcattgagttattggagcagaaatgttctttcttgcaaggattcaagggagtggagacatttgacagtgaccaagttctttctctacattgtgtagaagctgcatatagttggtcacttcctttggtgacactagctagcgttgtagtatcgcttccaaacatcaatagggattcagtcaaaaaattgataagtactctaaatgaaggactccactttgtaaagttcatagaaaataacttggacaaagaacgagaattgtttagactcaggactgctgcagaaattgtgtggcttggagttgatctatatgataagtggctagatgtggatcttcatgagctatcgcttcaagacaagagccccaaagagacacttgagaaactagctgatgctgcaaaaatcaggtatgagaaatttagagccaaatataaccacatatgcataaaggaaagcccttccttatggcccatcaaagtgtccgcatctcacactatgtacagaatatgtaaaactgctctcttaaatcatgaactcttaagagacaattcaagtgagaggttgtttgaagcgcttacagtgatgatttctgatatattgggtgcatgtctcaccaacttgccccttgttatatccaacaagtgtttgaatagcaccattgaagagagggaggatactgtcagacatgcagtttacattcttggtaagaccaagaagattatagaaatgctagaaaagagagcgtttccccgcgtgaatttctgccaagggaccttcattgaagattggcgttcaatgcataagcaaaacagttttttgcactttgttccatcttcactggagaatgacactcatacagatcctctcaaatcaaatgatctttacctaaatgttgactaa

SEQ ID NO: 74266 - DNA, 174 bp, Glycine max
  misc_feature (83)..(83): n is a, c, g, or t
  Peptide Sequence Number=SeqID_165951
atggcttccatcatcgtggccatttgctctttcatggcctccatgtcggccttcatcttctcttgtacctcctctacttcacncattactctagctctagcacagaaatgggtttatgatcccaacatggttggctcatggtacctaacacatgcaactaagaatgcatcatga

SEQ ID NO: 74267 - DNA, 198 bp, Glycine max
  Peptide Sequence Number=SeqID_165952
atgtctgcttatagtcatttcgctaagcgcaagcctcgcgctaaacgcatctctattcatgtgctaagccgcgagtctcaagagcttagcgcccaacccttgcatctaaggctgattcattccactaagctaggcaaggccaagctgagcctaatcgaattcgatctgaatttgactaagcgacagccaaaccgctaa

SEQ ID NO: 74268 - DNA, 567 bp, Glycine max
  Peptide Sequence Number=SeqID_165953
atgcgatcagagaagaaatcatgttcgccactcctctgtgatgaactcatcaaggaaatcttgtctcgtcttcccgtgaaacctttgatccaattcaagtgtgtgtacaagggatggaactccctgatgtcagatccctatttcatcaaattgcaccttaacaaatctgctgcgaaggatgatttggaacaccttcaactgatgaaaaatgtctgcgtcggatccatccctgaaatccacttggaatcgtgtgatgagacaagggtgatatccagagaattgccaacgctgtctttttccccgggcattggtcgtagaacaatgtttgggtttggctatgatccgtcaagtgacaaatacaaggttgtagcaattgcattgactatgctttcacttggcgtatctcaaaagactgagatgaaagtttatagcgcgggtgacagtagttggagaaaccttaaaggttttcctgttctttggactttacccaaagttggtggagtgtatctgagtggaacccttaattgcattgttattaagggaaaagaaaccattcattctgaaatc

SEQ ID NO: 74269 - DNA, 279 bp, Glycine max
  Peptide Sequence Number=SeqID_165954
atggatagagctaggttggtatatggcttggtgactaacatggacatgaatatcggagcccttatctcaggtcagatttcttctattgctcagattaacttcagaggggcgaggaaggcaagggtgagaccagctgatgttccttcttcttctactctaccagctccttccaattctactactcctacaccggctcatctaggctcatctactcaggactctcagtgctttgaagccatgcttcagagtattcatcagggacaaattttattactgtag

SEQ ID NO: 74270 - DNA, 300 bp, Glycine max
  Peptide Sequence Number=SeqID_165955
atggctactccacctgccttgcctcctcctcctccttctcctcctcctccttctacagtagcatcacagtctccatctaccttgaagcggacacgcaaagccacacagctacgatctttggccactagaccacccagggcagagagaccggttgtcaacatcgatcctgcgaccgggaaggccaacggtccccacaagaagaaattaagaacatatttagggattgccgctcgtgataaggtcgatgtgacatacgagacatggaaggaagtccctactgctcagaaggatttgatatga

SEQ ID NO: 74271 - DNA, 309 bp, Glycine max
  Peptide Sequence Number=SeqID_165956
atggaggccatgatgagcatgaaaaagataatggaagtcaatgcggttacaattgccgctactagcactgttgctaagacacatgaaattccccaccacaatctagcctacttcgagccttgcctcggatatgccagtgaagggcaagcagttggtggtataaccctacaaaaccctttggagggccctctgtatcacccacaactacacctcttgcattccacgacaagtaaaaaccctcatgctatggcaaaaatgggaaagctggatcatctagaggaaaggctcagggccattgaaggaggttaa

SEQ ID NO: 74272 - DNA, 237 bp, Glycine max
  Peptide Sequence Number=SeqID_165957
atgactagcattccacaacctgttgttgataatctagtagatcaagttgatcatcaaattcctgaaaatgatgaacaaccagctgaacaacataatcccaagaaaatgttatgcagcattaaagaggatgagacgaattccatgcagagtaacaaagtttcaaaccttgtagagttgcctaatagggtaaaggtcattggttgtaaatgggtctttaagaccaaagggattcattag

SEQ ID NO: 74273 - DNA, 429 bp, Glycine max
  Peptide Sequence Number=SeqID_165958
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtcgactctagaggatccccataatcttgttctacgacggttgtctcctaaggaccatcgtagaatggtccacaattctaacacggctgccggacaaccccgtcgtagaagtaacaaaagactacgacgaccatggggacatcaccgtcgtagacataatcttgatctacgacggttgtctcctaagagccgtcgtagaatggtcctattactacaacggtgttttgttgcggacgaccgtcgtaagagacggtgttaa

SEQ ID NO: 74274 - DNA, 324 bp, Glycine max
  Peptide Sequence Number=SeqID_165959
atggaggatgagtcatctgaggccaccatcccagagccatttgatataggagaagaggcagaggagacacaggtgagacaggtagctactgccactcctgagcgatcccttaaggctacttcaaagccttttgcaccagtggtaaacctaccctcacctcagcctgcagcaaaccccttcactcctctcctagagatgccagaggacccgactacaccattcctagctatggacacttctcctccaactactccagtgcttcagctgatagatgaggaggatggtcagacacaggacacccaggaccagtcatatgaattttga

SEQ ID NO: 74275 - DNA, 405 bp, Glycine max
  Peptide Sequence Number=SeqID_165960
atgggtgacctagagaaagtacaggaacagatgaaagccgacatgtcggctttgaaagaacaaatgacttccacgatggatgccatgcggggaatgaaacaactaatggagagtaacgcggccaccgccaccactattagtttggctgccgaagcagacccgactctcccaactgtcgtgcaccaccctattccaaacatggtggggcgagagagaagcacaccggggcacatcagcaacccccatccggggtacaaccaaggagcttacccttatggtttaccacctaattatacagcaccagtcatacgtgacgatgcgggtcacgttcctcccctcatcctcaaaagggagcctcctcgacatcctgacgaggtccacaaggatcatcgggagcatgcttag

SEQ ID NO: 74276 - DNA, 720 bp, Glycine max
  Peptide Sequence Number=SeqID_165961
atggataaattggacatccttgtctctctcatcctcttgcaaacacatatttgcttattcaacttccaccggaatgtgagtggtgaacccttgggtactagtaccctagccttcggagggctgggcgccctcgcctttagaggactacacgtcctcgcctttagaggactgcacgtcctcgccttcagagggctacatgccctttcagaacatctcttcagaggactacacgtcctcgccttcagaggactacacgtcctcgcctttagagggctacacaccctcgccattcagaggactacacgtacccaccttcagggatacaagtcctcaccttcagagggctacacgccctcacttcagaggactacacgtcctctgccttcagagggctacacgctcactttagaggactacacgtcctcgaccttcagagaggctacatccactaccttcaaaggactacacgtcctcgccttcagagggctacacgccctcgccttagagggtgcacgtcctcaccttcaaaggactacacgtcctcaccttcagagggctacacatcctcgccttcagaggactacacgtcctcaccttcaaaagaatacacgtcctcgccttcagagggctacacgccctcgatatcagaggactacaagtcctcaccttcagagggctgcacgccctcaccttcagaggactacaattcttcgcctttag

SEQ ID NO: 74277 - DNA, 411 bp, Glycine max
  Peptide Sequence Number=SeqID_165962
atggaaaccgaggaggacgagctggtcatggaaatcgaggaggacgagctggaagaggaggtcgccctcaatgttcttactgctgactatgaagagtatctccagctaaaagctgccaaggaatctctaacatcacctactataagtggtcataactccactgcctgcatttcccaatctggtaataatcaaagtccatggataattgatttaggtgcttctgatcacattgctggtaatagttctttattttcatccctctctcctcttaaaattcctcatttcattactttagccgatggttctagagttgcggcaacaggaattggccatgaacgtggtacgggtcggacgattgacgtaggacatgaatctcatggtctttactacctcaagcctaatctttcttgg

SEQ ID NO: 74278 - DNA, 1113 bp, Glycine max
  Peptide Sequence Number=SeqID_165963
atgggcgaatcggcgccgctgcgcggccatgtcgagagcatcgccgccggcatcgaggatcgctaccgcagcaacggcagcaccctgctgccgaacgtgaccccggccttcgactgggtgcgcctggcgcagcgcattccgcaccaagcatgcagacaaggtcggcaccgcgccgacacaggcgggcctgtgaacgccaccctgccccgtctcggcctgatcgtcgcgctggccagcctggccgcgtgcaggaccgtcggcccggactacgcgctgccggaaggctcggcgttcaagcgcccggaggccaatgcggccttcatcgatacgcagaacccgcaggtggccgccaaccaggcgctgcccgaccgctggtggtcgttgtacaacgacccggtgctggatgggctgatcacccaggcgctgcgtgacaacgtggaactgaaggccgccgatgcgcacctgcgccgcgccgccgccgtgtacgaacaggcgctggacgccggtggcttcgagtacgaggccgaggccggcgtcagccgcgcgcagctgtcggccgaatcgttcctgcaggagcacgagctgccgctaccagttcgacctgttcggcaagctcaagcgcggcgccgaagcggcgcgtgccgacgagcagtcggtggcggcggcacgcgatctggcccaggtcagtgtggtcgcccaggtggccgacagctacctggaaatctgccatgccaaccacgaactgcacgtggccgagcattcgctgcagctgcaacaacgcagccgcaccgttaccgagcgcctgatcgcggctggccgtggcacgccgccggagctggcccgcgccaatgcccaggtagcgctgctggaagctgcactgccgccgctgcaggcccagcggtcggcagccgcctattcgctggccgcactgctgggccagaccccgggccagttgccagccggccgccgcccggacgtgcgccagccgaacgcaagctggcctcggccaccgcgcgcattggcgtgccaccgccgagctgtatccggacatccgcctgggtgcctcggtggggtgccgccggcctgctggaagaacttcggcaccgccgatga

SEQ ID NO: 74279 - DNA, 511 bp, Glycine max
  Peptide Sequence Number=SeqID_165964
gtgggcaactagggatggtgtgcttatgcctgggcttgtggaaatgggatgttttttttgcgccatcgcccaatcgccacctagtaccacatatgacggagtggtacctggggatatgtcgcgggggtcaggagaccttggggatgccagtgtagctttcagtttccaatgtgcaaaggctgttgtaattcgtttttgggcactgatcgcgatggcagcgcagttgatccatgatcatgttgtgatggagttcctagagggtgtttgggagaccctcgaaggcaatgagaggtgccgatttcgtggcacaattcgactcactgctacttcgctaccggtccaagtgatagaggtgtcatcctctaaagaggatcttgaagaggaccaagaggagttatcttttgcacctgttatggatgcccctgacttaccagaggatgatgaggacccgctccttgatgttgattctccagaggatattatgtcagcatctaaggcagactctacatag

SEQ ID NO: 74280 - DNA, 744 bp, Glycine max
  Peptide Sequence Number=SeqID_165965
gccctcaccatcagagggcagcacgtcctcgccttaagagggctacaccctttagccttcagaggactgcatgttctcaccttaagaggaccgcacgtcctcaccttcagagggcagcacgccttcgccttcagaggactgcacatcctcgcttccagaggacaacacgtcctctccctcagaggactgtacatcctcgccttcagaggactccacgtcttggcttttagaggattgcacgtcctcgccttaagagggctacacgtcctctccatcagaggactgtacgtcttcgccatcagaggactgcacgtcctcgctttcagaggactacacctcctcgactttagagggttgcatgatcgggccttcagagagctacacttcctctccatcagaggactgcacgtcctcgccatcagaggactgcacgtcctcgctttcagaggactacacctcctcgactttagagggttgcacgtcctcactttcacagggctgtacctcctagcctttagagggctacacgttctcgccatcagagggctgcaagtccttgcctttagaaggctacacgtcctcgccttcagagggctacacggttgtacctcctggccttcagaggactacacgtcctcaccttcagaggacttcaagtccttgcattcagaggactgcatgtcctcgccttcagaggtctacacgtgctcgactttagagggctgcacgttctcgccttcatag

SEQ ID NO: 74281 - DNA, 318 bp, Glycine max
  Peptide Sequence Number=SeqID_165966
atggaaagagagatgataatcgtgaaagtagacacattaccagtgttctaccgtgaaaagatggtgggctacacaccttcaagctttgttgatttagttttcgccgatgaaaggatcaaagcaagtctgaaaagggccaaatttaatcatcctgcctggacgaatgagaaaactggggcaaatgaagagggtgagaatgagggagaaaccctagctatgactgccattcctatacggccaggtttcccaccaaaccaacaatgtcattactcagccaataccagccattctcattacccaccacccatttatccataa

SEQ ID NO: 74282 - DNA, 150 bp, Glycine max
  Peptide Sequence Number=SeqID_165967
atggcagaaatcaaccaaggtaagacgatgatcggtcacgattggccgcatattgttgtctcctacttgcagggtcacgaccgaccgtcgtctcttcccggcactagacaagcagaggacatcactgcaaggcagcccagtatcctttga

SEQ ID NO: 74283 - DNA, 336 bp, Glycine max
  Peptide Sequence Number=SeqID_165968
atgttgtgcaaaaagcggttagctccttcggtctccgatcgtgtcagaagtaagtgccgcagtgtatcactcatggttatggcagcactgcataattctcttactgtcatgccatccgtaagatgcttttctgtgactggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactga

SEQ ID NO: 74284 - DNA, 330 bp, Glycine max
  Peptide Sequence Number=SeqID_165969
gtggccttgttggtgcttgcgcgcttagcgcgcattagtgaatttcgacttagtgctcgtcttttcgctctgcctcaagcggtgtgcttagcgggatttgcccttgctcagcgaacatgcacagctcatccttcttccagattcttcctcgcgctcagccaaaggagtgttgtgctcagcagatggctcgctaagccagaagattggcttagcgagcggatgaaaatcaacacttcacaaacttgcctaattaacctgaaattgagaggaaatgattattatgttagacaagtggcctcagatatcttaagaaggggggggttgaattaa

SEQ ID NO: 74285 - DNA, 516 bp, Glycine max
  misc_feature (409)..(409): n is a, c, g, or t
  Peptide Sequence Number=SeqID_165970
atggctaagtttgaccctgaggtagttctggagttttatgctaatgcttggcccacagaggagggagtgcgagacatgcgttcatgggtgaggggtcagtggattccatttgatgcagatgccctcagccaattcctgggtgtcctgctagtgttggaggaaggccagcagtgcgagttcagccagagaaggaacagggctgacgggttcggcgaggaggccattgcccagatgttatgcacaccggggaaggatttcgctcggaccgctgcagggaggcgggtgcggatcatgcgcaccagcatgaccaccttgacccagacgtggatgacattgctgctcagcaatgtcttgcctagcaatcataactccgtctccctctgccgaagtgtcagttggtgtatgccanccaccaggcaccctctaaacccggataagtctaacagggccctggggtttccggcattgatcaccggcctctgccagtcattcggggttcccgtcacccctagtaag

SEQ ID NO: 74286 - DNA, 225 bp, Glycine max
  Peptide Sequence Number=SeqID_165971
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggtgtatgaggaaattgcaggaagaaatccctttgcgagaacacctgtcggcccaactaatcagcacaagctgtga

SEQ ID NO: 74287 - DNA, 945 bp, Glycine max
  Peptide Sequence Number=SeqID_165972
atggcgctggccggctcggtcgccgccgggctgatgctggcggcggtgccgatcccgctggcgatggtggcggcactggcggtcggggcgctgttcggcctggccaacggcgcctgcatcgcctacctgcgcatgccgccgatcatcgtcaccctggcgtcgatgggcatcgcccgcggcctggcgctgctctataccggcggctacccgatctccggcctgcccgacgtcttcgcgttctttggccgcggcacggtgctgggcatccaggtgccgatcctgatcatgctcggcgtgtacgtgctggcctggctgatgctcaaccaactgccgttcggccgctacgtctacgcgatgggcggcaacgaagaggcggcgcggctgagcggcatccgccggcctgaccgccgcgctggccgggctggtgctgacctcgcgcctgatgagcgggcagcccaacgccggcgaaggcttcgagctggacgccatcgccgcggtggtgctgggcggggcggcgatctccggcgggcgcggcgccatcgtcggcacgctggtgggggcgatgatgctcggggtgctcaacaacggcctcaatctgatgaacgtgtcgccgtatatccagaacgtggtgaagggcggcatcatcctggccgccatctacctcagctccgtgcggcgcaaataggaggcgcgatggcagtctttcttggcatagacgtcggcggcacggtgatcaaggccgggctgtaccgggcaagcggcgaagagctggcgatcgccgagcgcgacggcgcggcgattgccgcccagccgggcttcagcgaacgcaatatggacgcgctgtgggatgacgtttgcgcggcgatccgccagacgctgcacgcggcggggctggaggccgggcaggtgcgcgggcgtcagcttctcggcgcacggcaaagggct

SEQ ID NO: 74288 - DNA, 841 bp, Glycine max
  Peptide Sequence Number=SeqID_165973
atgtcaccattctcaggggaaaacatgagcaaatcgataatggcaatagcgctgctgtttactgtcctcatggtgcaaggatgcaacaaaagcatggaatatgaaccacaggatttttttgaaggccggcagctggacatcgcacagctgatttatgatggcgatgaagtgaaactgaaagagaagcttccctctataagcaaggaagaactgaatcgaccggttaaggcggacatggccctgctgttttggtcggtgctaaacgcaatctatgataaaaatacgccggaaaggctgaaaataataaccgacctggttaaagctggcgcagacccgttgcagcccagaccggaagggggaagcagcccggcggaatttgtcctgaaagccgacaagggaatttggatcaaggccatgctcgacggaggtttaccgccaaacgcaaaagacaagagaattgagactcccttaaggtcagcgtcgaagacatggaatatgccgctcagaggcagaatggcaaccgccatccagcccctgcttgcccagccgacgttaacgcaattccttcgctatcgcactaaacatcagcgatgcctccagcggttgcgcgctgaaggacggctccgcctgcggccaggtagaccactggacgatcaccagattctccgcctgattgaccataatcatctggccgaagatccccagcgcccacagagaatgcttgagggaagcctgcggggcgggttccacgttggccgcattcaccggcacttcgttgttccaccactggtagccgtagatgccgtcaggatgcgccgccgacaccgagcccgccgccagc

SEQ ID NO: 74289 - DNA, 427 bp, Glycine max
  Peptide Sequence Number=SeqID_165974
atgtggatggatcggtttgctcttaccttgaacgggagtcaagaacttccccgcttgttagccaaggccaaggcgatggcagacacctactccgcccccgaagagattcatgggcttctcggctattggaaaaacaccataactaaacgcgccacaaggcatccctatcgcaccagatccaaatctagaacgatgggtgatcaagaggagacacaggaacagatgaaagccgacatgtcggctctgaaagaacaaatggcctccatgatggaggccatgttaggtatgaggcagctcatggagaagaacgcggccaccgctgccgttgtcagttcggctgccgaagcagacccgactctcttggcaactgcgcaccatccttcctcaaacatagtaggacggggaagggacacactggggcacgatg

SEQ ID NO: 74290 - DNA, 603 bp, Glycine max
  Peptide Sequence Number=SeqID_165975
atggctttgaagaaactctccacaaagaggtctggaagggacgccactggagaaggctctagtgctgcctcagaggagaggcgtgtccagctcagggaagacgagtaccctaacttccagggagagatagctcgtaggcattgggcacgactattgacccctatggctaaatttgacccggagatagtcatagaattttatgccaatgcctggcccactaaggagggggtttgggacatgcgttcatgggtgaggggtcactgggtcccctttgatgcagatgccatcagccagttcttgggcgacccactgattttggaggaagaccagcagtgtgaattcagccagaggaggagccagacagacggtttcgatgaggaagccatcacccagctgttgtgcataccggggcaggatttcacccagaccgctgcagggaggcgggtgcggatcacatgcactagcatgactaccttgacccagatatggatgacactgctgctcagcaatgtcttgcctagcgaccacaactccgacctccctctgcctaagtgccagttggtgtatgccatcctgacacagatgagcgttcatgtggcccag

SEQ ID NO: 74291 - DNA, 272 bp, Glycine max
  Peptide Sequence Number=SeqID_165976
atggcccacataaagaaaactggccagatgacgtctgaggcagcaaagcaaattgctgacaagattgattcctttgtcacccatggtcgtcaggatgtattgactactgtcattgggcaaccagaataccccagtcgtgtgcgtgctgttggagctagtgtgacgatcaagcaatactttgaactggctccaaggacctcccgcacttcttcctccatggctcccgaagacctagagcagctgactcaacaaataagggaccagctggagga

SEQ ID NO: 74292 - DNA, 228 bp, Glycine max
  Peptide Sequence Number=SeqID_165977
atgggatcaagtcaaaagccttcacttaaaaagaggttctatcaagtcaaggttaagagcctaggaatcaccagcctaaaagagcaagggcagttgatgggaattagaccgccaaaagcaagtcgaaaatggggtggtcgggataccgagaaaatgttggaggcaaaagcaagaatcttggcagctagaagcgaatgggccccgttcatagacgttctcgcactgtga

SEQ ID NO: 74293 - DNA, 852 bp, Glycine max
  Peptide Sequence Number=SeqID_165978
atgaatgtgttcataacaggtgcaagcgggtttatcggtatggcgatcgccgcagagctgattcaggcgggtcatcatgtcaccggactggctcgttcggagcagactgttcagcgtctcaatcgtattggcgcggacgcgcaccggggtgaactgaagaatcttctgagtctgaccgtgggtgcccgcgccgctgacgcggtgatccactgcgcttatgaccacgctttttctcacccgcaggacacggcaatgcaggaaatgcaggcaattgcagccttaggtaagggttgcggccatgggcagtcccgcaccgggtcagcttgccagcgaggatttttacgacccgtcgacgcaaatccgcgcaaatcgaccgaaatcgcggcagcccaggtcgcagacagtggcgtcaatgtttccatcatccggttgcctcaagtgcacaacgaggtaaaacaggggttcgtctcagcgttaatccagctggcgcgagaaaaaggcgtttcagcctatgtggaagagggaaccaatcaatgggctgcggcgcatgttgctgatgttgcctcactttatcggacagtacttgagaaagcgctgcctgggcagcgttaccatgccgttgcggaacagggcatctcattgcgcaacattgccgaagacatcggagcgggcctgggtgttcctgtcgtgcaactgacccgcgaagaagccagtgcccactttggctggctggcgctgttcgttaccatggatatgcgtgcatcagcagaattaacccggcagcgtaccggctggcaaccttcgcatccgggtttactgcaggatctggaacgctacttcagattagcgtaa

SEQ ID NO: 74294 - DNA, 747 bp, Glycine max
  Peptide Sequence Number=SeqID_165979
atgattttcgtggcggtgctgatgatcgcctggggatgctggaatctgttccgtcgcccggcctcacgcgagctgaaggagatccactgtctgcgcggtacgccgaagcgctggggcctgttcggcgaatccggccaggggcagatcagcaacatttcgctcggcatcatcgatcttatctacccgccgcattggcagccttacctgacgcaggacctgggcaagaccaccgacgtggacgtctacctcaatcggcaggtggtgcgccaggggcgcttcctctcgctgcatgacgaagtgaagaacttcccgctgcagcagtggggccgcaacgcggtgctggtcgccagctcggcgctggtgctgctgttgctgctgatctatatcccgctcaacctgccgctgaccctcagcatggcctggctgcagggcgcgcaaaaagtggaagtgaccagcgtacaggcgctggaggccacgccgctgcgcatcggcgacacgctgaaagtgcgcggcagcggcatgtgctatgtgccgccgccggccaacggtggcggcgccgccaatttcgcgccgttcgactgctccggcatctattggaacaacgccgccccgctgccgcagccggaatcggaagtcatagacaaagcgacggccctgctggctacggtcaacagccagctgcatccgagcggcgccgatcagaaggtcaacccgcagttggccagcgccatcgagaatccggcatga

SEQ ID NO: 74295 - DNA, 875 bp, Glycine max
  Peptide Sequence Number=SeqID_165980
atggccaagttcgaccctgagatagtcctagagttctatgctaatgcctggcccacggaggagggagctcgggacatgcgctcgtgggaaggccagcagtgtgagttcagccagaggaggagaagggccaacgatttcgatgaggaagccatcgcccaactgttgtgcataccagggcaggatttcgcctggaccgctgcagggaggcgggtgcggatcatgcgcaccagcatgaccactttgacccagacatggatgacactgttgctcagcaatgtctttcctagcgatcacaactccgacctccctctacctaagtgccagttggtgtatgccatcttgacaaggatgagcgtccatgtggcccaggtgattgttgatgccatttatttgtttgtaggtatggcgcctactaggcaccctctggacccagataagtccaacagggccctggggtttccgacgctgattataggtctctgccagtcctacggagttcccgtcacccccagtgcaggtgatgcacatcaggccgcagacgcaccgccaccacctcgacaggccgatcgagctgggtcactgggtgtggagcgttatctacaacatttggttcgccagcaggcagcctaccaccgtgggcaggtgcagatacatgagtgtctctaccgattcagccttagtcagcaagggcaaggtttcgccccttttgtatgccttaccccagagcagtttggggctgaggtcgcatggcctagagactggcccgatgcccaggcaagggaggagcatgcaggatccctcggtgaggcggatgaatcccatatcgatgaagatatgactgacctgctcagtttcttgggagggaggggagccac

SEQ ID NO: 74296 - DNA, 768 bp, Glycine max
  Peptide Sequence Number=SeqID_165981
atgtgtgagctgcctggtcgcacagacaacgaaataaagaacttttggaacacaagacaaaagaaaaggaaacgtgctggtttgccactctacccagaagacatagaagtgttgaatgttgacaacccacaaagtattaatcaaaatgattccacccagcatgctaatgactcacaaccaggcacatcatctcataatgtaccagaattggtattcaacaattacaaacttgtcaatggaaagcatccatcctgtgttccacccatttcagtgatgcctgaaaacagcacctttgagcaacaagataattcagataagcaagttatgcatccgccacatttgcaaattatgcatcgttcccacgagcagcttcaagactcgctaccaaatgattatataaagtttcagggtgattacatgtcttgtgatgataaatgttcaagtggcatttccctgccatcatttgacgatgacttattgagaatgggagaggatcctccgactcagactcatgatcaatactatgaaccacgttctccacgcagcaatggctatttggaatccatattttgcccaccaccaaagattgtggaaggatcagatgattgttccatgcaaggagagtcaagtttaggaaacggagaaaatttagaccccattatgaatcaagatactttaggtgacacttgggtagagaattatgacaaggatcaatacgctcttaaggatactttattcagcattatctaccccttttttccacactaa

SEQ ID NO: 74297 - DNA, 231 bp, Glycine max
  Peptide Sequence Number=SeqID_165982
atgtggcaaaaagtactacttcagaaacagacaagaggacaagggaacacaagacaccaaattgcacaagatggggatataagccacaacaccaaggttttaggggtctctggctctgcaaccacatcacaagttcacaaccacaattgcagctgcattagccacatatgtctacaatttcccacaatatcaatgatcgccattgaaaccgtaaccatgaatgcaatttaa

SEQ ID NO: 74298 - DNA, 453 bp, Glycine max
  Peptide Sequence Number=SeqID_165983
atggagaaactagcaaattcattttcagtgttagaactcgacgccgacgatagccatgttcccaccactgccgatattagtgacaagagggttaatgccgacgttgacattgtaccagtaaaaagcgagaaacaaaatcaagaaaatccagtgactccttcgtgtgaatacaagttacctcttgtgtggattgacttggaaatgactggcttaaatattgaagtggacagaatattggagattgcttgtataattacagatggaaatttaaccaaaacagtggagggtcctgatttggtcatccatcaaaccaaggagtgccttgacaggatgggagaatggtgtcaaagtcatcatgcagctagtgggttgacaaaaaaggtgctaaaaagtacaataagtgaaggagaagctgaagagcagacatatcaaatagttaaacttgtctattag

SEQ ID NO: 74299 - DNA, 2467 bp, Glycine max
  Peptide Sequence Number=SeqID_165984
ggttcttgtgctcaatatcactgattcaactggcaaggggaaatcttgggagttgggtggattgcagagagagaaaaaagcagttatggtgattgctgagaatgagattggtgaggatcagaaggagattggtgctcctaagtctccatggaagactcctactgttgatggaaagggaggtgatgtgtctgtgatgatgggcactgagtcttggccacgtctctctgatgcacagagaccacccaagaatcttgagactgctgctgctgctgcttctgtgacaagtgctggtgagattgctcctagacctccttctatgcagaaggtgaatggtgctggaaacgttaacccagtgcataagctgccactatcacgccatcaaaagccaggtgctaagcgcaactcaaatggtggacctccctttcctgtgccaatcccttatcatcaaccagttcctccattttttcatcctatggtaccgcctccgcatgttgctgttcctggttatgctttcccacttggtccaggaccttttccaggtgcagaaaaccctttagtgaagcctgtttctcaggcacccggacaagcttttgctccacctgctcatgctgttgatggcaaaaatgttcagcctctggtgcggggagatccaaatgcctatgttggcaatttttctaatggaagaacaaatatccaagaacaaggtgaccatctaaatcatgcttggcatcatcaaagaccttttccttccagagtaaacattcctatgcaacagggtttgggcccaaggccatttatacgacccccattttatggtccacctccagggtacatggttggtccaagcttcccaggacctgcacccgtttggtgtgtccccatgccacctcctggctccattagaggaccccatcctaggcactttgtcccatatcctgtcaaccccacacctcagccaccgcctccagaaactgtatcgttgaggactagtattgtaaaacagatagactattattttagtgatgaaaatctgcagaatgaccattaccttatttccttgatggatgaccaaggatgggttcccatatccactgttgctgattttaaaagggtcaagaagatgagcacagacataccttttatccttgatgcacttcagagctctaatactgtggaagtgcagggtgataaaataaggcaacgcgatagttggtcgaaatggattggagcttcctcaggaaattcaggatcatcaacagctcaggttcaacagggccaacttgtagatggtgctttcaattctcttgagaatagtgatgctgttggagataagatgaaggagatttccgaagaaaatcctaaagatgctgttcatgactcaatttttgaagagcataatcagccaaacagagatatgttacaagtttcacttatgaaccaagaaaaaaataatgagggccatcgttctaatgataaatcacatgaaggtgtcaaattctgtgattttgaaacaactaataataatttatgtagccaacaagaagttgagcccaaagtatttgacaataatgaggctggaaacatggatgtattgactgaaatggatgtccgagacctttccaatgattttggcaatacttttatgctcgatgaagagatagagcttgagcaaaagatgctaaggaagactgaactttcttctagtggaaggaatgatgatgaagatgatgagatggctgtcattgaacaggatgttcagagactagtaattgttacccagaatggtgatcctaaacaaagatctagagggggtggtaaagaatcaatatccatttccaatgagcttgcttccgcaataaatgatggtctttacttctacgagcaggagctgaaacataggcggtctaatcgtagaaagaataactctgatagcagagatcaaaacataaaatctccaagccgtaattcgggtgcatcaaatataaaggcagttgagaatattggtggaaactgtgttgaagagtctggaagctataattctcgaaggaaacaaaaagtttttcacaagcaaccatcttcccttaagcagcggtttttctcaagtaattttagaaatcatggaactggtcggaactctcatggaatcatatctgaaagcccgcctagcaattcggttgggtttttctttgcttctacgcctcctgaaaatcacggttttaagccttccaaattgagtagttcaccacatggggggttttctggtagtccacgtggggggttcgctggtagtccacatggggggttcgctggtagtccacctgtgggttcaatgccaaagtcttttccactatttcagcatccaagtcaccaacttttagaagaaaatggtttcaaacaacagaaatacttgaagtatcacaaacggtgcttgaatgatagaaagaaacttggaattggttgcagcgag

SEQ ID NO: 74300 - DNA, 2379 bp, Glycine max
  Peptide Sequence Number=SeqID_165985
atgggagcctcaagctccaaaatggaggatgataaggcactgcagctatgtcgtgaaaggaagaagtttgtgaggcaagcacttgatgggcgttgctcattagcagctgctcatgtttcatacattcaatcactgaaaaatacaggaacagctctgagaaaatttacagaacctgaaggaccaattgagccttctctgtacactactgcaacaccagaacaaccacttgctttaactgaaaggaccctctcattctcttcagcatctgtgtcacatcacatagatgcagctgaacacgaaaatttctctccaactccctcccttcctagttcttctagcaagttcagagcaaatcatatgaaacatagcactatttcttccaagaaagttgaggaaaaaccacctgtacctgttataggaatagtaacatcatcaggtactactacacagaataccagtgtaatgtctggaacagcagcatttgaagattcttctcttccagctggaactccacagtgggatttctttggtctctttcaccccattgaccatcaattttcttttcaagatgggaagggtatgcatcaagatatagggaatgctgatgacatacaaagactaagggaggaggagggaattcctgagttggaagacgacgaagagaaggcttcatctcatggaagggaacactctagggactctgaagacgaatttgatgaagagcctgccgcagaaactctagtccaaagatttgaaaatctaaatagatctaacagtcatgttcaagccaattttgaacctgccacaactaagcctctcagagggcattcagcttctgaagttgaattagtgaatggagaaaaggggaactctgcttatttatctccattaaagacagcacctatgccagctttgcctccacctgaaacaaataaaccaatggagaaggaaagtcgtaatgaaaataaagtcacccctaagaatttcttttcaagcgtgagagatattgaattgctctttattaaagcttcagaatctggccaagaggttccaaagatgcttgaagcaaacaaagttcactttcgtccaatattccaaggaaaagaaagtaatctttctgatggttctctggtgtcctcgtttttgaaggtatgtttctcatgtggggaggacccaagccaagttccagaagaacctgctcaaaactcggttaagtacttaacttggcataggacggcgtcatctcgatcctcctcatccagaaaccctttaggagcaaactcaattgacaatgctgaggaccatgcaaataatctctttgataattcttgcatgatctccggaagtcatgcatcaaccttggataggctatatgcttgggaaaggaaactctatgatgaagtgaaggctagtgagatagtcagaaaggaatatgacatgaagtgtaaattcttaaggcaactggaatcaaaaggagaaaagacctctacagttgataaaactcgtgctaaagtcaaggatctgcactcaagaatcatagtttcaattcataggataaactctatatcaaagaggattgcggagttacgagacaaagagcttcagccacaacttgaggagttgattgaagggtatgctcctggatggatggttcacacctcaacttatgttgattgctatgagcttctagcttttgtatttcatctgtttctgttatgctttgatgtcaggttgaatcggatgtgggaagtgatgcatgaatgccacaaacttcagtttcagataatgtcggcagcatataacaacagccatgctagaatcaccatgcattcagaattacgtagacagattacttcctatcttgaaaatgaactccaatttctatcatcaagctttaccaagtggattggagctcagaaatgctatctggaggctataaatgggtggcttcacaaatgtgttcgtcatgaagaaaaatcatccaagagaaaaaggaggcttcaatctgaccttagcttttatgatcctccaatatatgtcacatgtgcgctctggttggataaacttagtgccttacctgtaaaggatgtagctgattcgattaagagtttggcgacagatactgcccagttcttaccacaccaggacaagaaccaaggaaaaggtgctcatcctcatatgtcaacatggaaggctgatattggtggcgaatcagcagatggtttattgagagatgacatatcagaggactgggttgcagaacttcgacaagccattcagaaagtaaaaaattaccagcgtttgaattctcagtctcaaaatggtcatttgaattctcagtctcaagatggtcatccgaattccgaatctcaaagttga

SEQ ID NO: 74301 - DNA, 576 bp, Glycine max
  Peptide Sequence Number=SeqID_165986
atggaacacaaagtagccacaacaactgaaggacaacccataagatgtaaagcggcggtttgtcgcgaagctggtgagccactgagtattgaggagatcattgtggcaccaccaatgcctggtgaagctcgcattcgtattacatgctccactctctgtcaaaccgatatcagtttttggaacatgcaggttatcttagagatgactgatgggggagcagattattgctttgaatgtgttggtatggcatcattgatgcaggaagcctatgtttcttgtagaaagggttggggaaaaacaatagttttgggagtggacaagccaggatccaagttaaaccttagctgtagtgaggtccacgtttgtgggaagagcctcaggggatacttatttggaggactcaaacccaagtctgatgtacccattctccttaaacgctacatggacaagggacacgtggctcaggatccgcaacacaagggaggagttaggcatagcacacggttgaggagagagaatattaagctgaaggattacacattttcggggacgggagatgattctgttgctggttga

SEQ ID NO: 74302 - DNA, 159 bp, Glycine max
  Peptide Sequence Number=SeqID_165987
atgtctattgcaagcaaatctatcataaggccttccagaaacattaaaagtcaagtacaagggccaaccaagcgtgagggtgacggcaagagtgaggactctgcctggtggattgttaaggcatttagagtaccacatgatactggacttctgctttga

SEQ ID NO: 74303 - DNA, 213 bp, Glycine max
  Peptide Sequence Number=SeqID_165988
atgatcaatcaatggaacaatcggactgattttagggtcgatgtttatccacgacaagaaggtctactgagttttaactccgactacatggtgtggtatagacgtaaaacaaagatgtttgttgaccctaaaaactcaaacatggcgacactgagacgttacagtacatggtgtcaccacaagggagaaatacatgaacggttgacgatctaa

SEQ ID NO: 74304 - DNA, 144 bp, Glycine max
  Peptide Sequence Number=SeqID_165989
atgattgaagcacgtcaaaagggggggaggagcttgccacccagctcgcctaggcgagctcagctcgcccaggcgagcaaggttgcttcctccagaagcaacagccttctggaggaagaatctggaaggcccaagtgggcctga

SEQ ID NO: 74305 - DNA, 354 bp, Glycine max
  Peptide Sequence Number=SeqID_165990
atgaggatgtatgcctgttgttccgcactccgggatactacttgtttgtgtggatgcgaaatctacctgcaagtgcaccgggtcatcaaggaacttgttcatttggtaaaggtttgttcaataagcaggcatttgcaaacagaaatcatgattgtgaatgaaagtaaaagtatgttctattctaattacaaagcaataaatgtgagcaagtgcgaaaatagatatctaaaggcgttaggtcctcttactgagcaaatcgatgcaattaaggatgtttctctaattaaagatgtttctgtgttctatgttgaaggctcaagtactaaacaccgatgtctcgtgagtttagcctaa

SEQ ID NO: 74306 - DNA, 414 bp, Glycine max
  Peptide Sequence Number=SeqID_165991
gttgtaccatatgtggtggtactcatgaatccggtctttgcattcctttggaagagcaaacgcaagaggttagctacacagggaatcaacaaaggcagggatacaatcaaggtggattctcaggtttctagcagggtccatacaaccaacaaggacagtggagatcacaccctgaagacaaccaagctggaggagactttgactcaattcatgcaagtgaccatgtcaaatcacaaaagcactgagtcagcattgaagaaccttgagatccaagtgggccaactagacaaacaattagctgaaaagtcatccaatagcttcaaggcaaacacagaaaagaatctcaaagaggaatgtaatgctgtgatgacaagaaacaagaagcgtttggtagttgaggataaggatagggtg

SEQ ID NO: 74307 - DNA, 228 bp, Glycine max
  Peptide Sequence Number=SeqID_165992
atgaggaaaggcaagagtgaggtaaacactgacaagaagaaggatactactccaaatgaaggcaaggaagtaccttatccgttggaaaagctctcatcgacttgtgatgcaatcctccctaggaagggaccagtcactagattcatgagcaagaggctccaagaggattgggctaaagctactgaagaaggccctagggttctcatgaacctcagggtagatttttga

SEQ ID NO: 74308 - DNA, 1219 bp, Glycine max
  Peptide Sequence Number=SeqID_165993
atgccagaactcggtgaagtagtgctggccgagcacgttggccatcacttccgctgccagctttttccagatctcatcgccgggttttgcgttacccgcatcatagagcaggtcagccgaggtgatctcatccatcgtccagcgcattttcagaccgctcagctgcgtgccgtcggtgaccagctcggttttaaggccaataaaactgtgaggcgccgctgccaggtgcttttgatgctttacctgcccgatgctgccgtcaccgcacagagcataatcgctgccaacggcgtggacgacgcgatggcacggcaagatatagccgagacgcgcgatgaaatccagcgctatcaccggctggatatcgtcacgcaccaggacggcagttaccggcttgaaggcacagccctgaatcagcgtttatgcctgctgcactggttgcgccgggcgctgcggctttgcccgcagtttgtctcgcaccagtttacccctgcattaaaaaccgcgcttaaacagcacggcattgcacggccgctttacgacgacgcgaacctgcgggcgctgatcaacttctgttcgcgcaaactccagcgccagtttgaatgccgcgacgtgcagtttttacagctctatctgcaatactgccttattcagcatcagctgggaaacacgccccagttttcccattctcagcgcagctggacccagtcgagaggggagtatttcacggcgcaggagatcgtgcggcactggaaacggcgcgtcccgcagggggctcacggggatgaacagctgtttctggcgctgttgtttatgatgctccgcacgcccgatccggtgctcgataaacaccagcaggatcaacgtttgcgccgggccatcgtgcgcatggtggcccgtttccgctcccagaccgggatgaacttcagcgatgagcaaggcctgaccgatcagctctatatccatcttgcacaggcgctggaccgttcgctgtttgagatcggcatcgacaatagcctgccggaggagatccaccgtctctaccctcgcctgttacgtaccaccaaagaagcgctgtttgagctggaagcggagtttgggctgcgtttttccgatgaagagatgagccttgttgcggtgattttcggtgcctggctgatgcaggagaccgatctgcacgaaaagcaggtgatcctgctgacgggtgacgataaagcca

SEQ ID NO: 74309 - DNA, 168 bp, Glycine max
  Peptide Sequence Number=SeqID_165994
atgtcgggtgttcaaggaagacaggctgtccaagtgggtctaatgatcctgaaaagcacaaggatgatgacgttgcttggtggtttgattcaggagcaacaagccatgtgtgcaaagatcgtcgttggttcaaggaatttagaccaatcgatgatggctctattgtga

SEQ ID NO: 74310 - DNA, 504 bp, Glycine max
  Peptide Sequence Number=SeqID_165995
atgaaaacatccttggcaaatgctttcgcagtgttcgtctttcataaatccaagaatttcacctctgactatgaaatacgaatgcccccgactgtccctgttaatcattactccgatcccgaaggccaacacaataggatcagaatcctgtggtgttatcccatgctaatgtatacagagcgtaggcttgctttgagcactctaatttcttcaaagagcgcatcgccggcagaagggacgagccgaccggtgcacaccggaggcggaccgatcgacccaacccaagctggaattaccgcggctgctggcaccagacttgccctccaatggatcctcgttaagggatttagattgtactcattccaattaccagactcaatgagcccggtattgttatttattgtcactacctccccgtgtcaggattgggtaatttgcgcgcctgctgccttccttggatgtggtagccgtttctcaggctccctctccggaatcgaaccctaa

SEQ ID NO: 74311 - DNA, 93 bp, Glycine max
  Peptide Sequence Number=SeqID_165996
ggaaaaggatccctcgggtgttcagaagttgtaaaacggatttttacaaagttagtggaaatctcaagtgggttgcttaaggactggatgtag

SEQ ID NO: 74312 - DNA, 298 bp, Glycine max
  Peptide Sequence Number=SeqID_165997
atgcgagataaatctactatcgtttccatagacttagaaatcgaagctacctgtcggcgtaataacgccgcaagaagacgaagagagcaagacatagatacttcacctcctctatctccaaatcacgttcaaatggacagagaaccagtacgaagggttacattagaagatttctgtcaaactactactcctgaattcttcacaagtatcacaccgccaaaggttcaagcacctaatatttcgtaccctcattctctcattcagctgattcaggggaacctcttccacggtctcccaa

SEQ ID NO: 74313 - DNA, 192 bp, Glycine max
  Peptide Sequence Number=SeqID_165998
atgtccaaatggtcacctcggtcctctgtaacctccactaagtgtactcaatgcatgttgtatgcggtctatcagctggcactacgtggactcgagtatggcagtatgaagtatgacacatgggcaccatcaatgcacaaaccatggataattaaagattctaagccaccccttcactccagagatgcttaa

SEQ ID NO: 74314 - DNA, 315 bp, Glycine max
  Peptide Sequence Number=SeqID_165999
atgcaggcagttatcgcattgctcgcaggcgccgggatggctttcgccaaagtagcgcaaaatggtttggtggcggcaggcggtggattcgcagtagccgagcaaggcatcaagcttcaggcgttccagccgtttgcgttcttcggaggcttcgccgctatcgagcatttgccgcatggagacgacatcgcccatgccgtccaaatgtgcgacaaaacgcacgttgggtttatcaatgcccatgccaaacgcaatcgtcgccaccatgatgatgccttcttcacgcaggaagcggcgctggtgatgttcgcgtaa

SEQ ID NO: 74315 - DNA, 894 bp, Glycine max
  Peptide Sequence Number=SeqID_166000
gtcgactctagaggatcccccaccttcaaaggactacacgtcctcgccttcagaggactgcacatcctcaccttcagaggactacatgtcctcgccttcagagggcagcacgtcctcacctttagaggactacacgtcctcgccataagaggactatacatcctcacctttagaaggctacacgccctcaccttcagagggctgcacgccctcgccgtcagaggactacacgtccttgcctttagagggattcacgtcctcctcttcagaggactacacgccctcgccttcagaggactacacatcctcgccattagagggctgcacgccctcaccttcagaggactacacgtccttgccattagagggctgcacgccttcacctttagaggactacacgtccttgccatcagagggctgcacgccctcacctttagaggactacacgtcctcgccatcagagggctgcatgccctcaccttcagaggactatacgtcctcgccataagagggctgcacgctctcaccgtcggagggctacacgccctcgccttcagaggactacacgtcctcacctttagagggctacacgccctcgcctttagaggcctacacgtcctcgccttcagagggctgcacgccctcgcctttagaggactacacgtcctcctctttagaggactggacgtcctcacctttagagggctacacgccctccccttgagagaactacatgtcctcgccttcagaggcctgcacgctgtcgccttcagagacctgcacgccgtcgtcttcaaagggcgacacgtcctcgacttcgaagggctgcacgccccttcgcctttagagggctacgcgtcctcattttcagtgggctccatatccacaccttaa

SEQ ID NO: 74316 - DNA, 267 bp, Glycine max
  Peptide Sequence Number=SeqID_166001
atggttgcagaaggagaaacagctgatggagatttgaccacatttttgtctcttataaatacctgggagaacacccctcctaattgggtgggttcagatccttgtgatgattgggttggaatcaagtgcaagaattcacacattacatcaataacattatcaagcaccggtttggctggtcagctttctggagatattggatcactatctgaattagagactttggatacagaaaacaaggatcaggaatcctcagaatccatgtaa

SEQ ID NO: 74317 - DNA, 1103 bp, Glycine max
  Peptide Sequence Number=SeqID_166002
gggagggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattctcacgttccctattggtgggtgaacaatccaacacttggtgaattctgcttcacaatgataggaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacggttcgtattcgtactggaaatcagaatcaaacgagcttttacccttttgttccacacgagatttctgttctcgtgagctcatctaggacacctgcgtatcttttaacagatgtgccgccccagccaaactccccacctgacaatgtcttccgcccggatcgaccggccgaagccgaccttgggtccaaaaagaggggcagtgccccgcttccgattcacggaataactcccacttatcctacacctctcaagtcatttcacaaagtcggactagagtcaagctcaacagggtcttctttccccgctgattccgccaagcccgttcccttggctgtggtttcgctggatagtagacagggacagtgggaatctcttgactgttcgacgcccggggaagaggccccgaagggcccgttcccaatccgtcccccgaccggcacgcgacgacccgctctcgccgcggaagcagctcgagcagtccaccgacagccgacgggttcgggactgggacccccgtgcccagccctcagagccaatccttttcccgag

SEQ ID NO: 74318 - DNA, 141 bp, Glycine max
  Peptide Sequence Number=SeqID_166003
atgggagaaaacttgttcgccccgcgtcaaacaaaaacagaaaaggaaaaagccaaaaaaatcaaaagccgaaaaactcaccaaaagaacccattcccaagggaagtcctattgatccatgatcacgcatgtaatttttga

SEQ ID NO: 74319 - DNA, 807 bp, Glycine max
  Peptide Sequence Number=SeqID_166004
atggctccgaaaaagctttctgcgaagagatctaggagggacgccgcggctgaagggaccagtgccgcccccgagtttgatagccaacgtttcaggagcgccgagcaccaacagcgcttcgaggccatcaaaggatggtcgttccacagagagagacgtgtccagctcagggacgatgagtacacagattttcaaggaggagatagctcgccgacattggacgtcgctgatgccctcagccagttcctgggtgacccgctagtgttggaggaaggccaggagtgcgagttcagtcagaggaggaacagggccgacgggttcgacgaggaggccattgcccagctgttatgcataccgaggctgggtttcaccccaaccgctgcagggaggcgggtgcggatcatgcgcaccagcatgaccaccttgacccagatatggatgacattgctgctcagtaatgtcttgcctaatgaccataactccgatctccctatgccgaagtgtcagctggtgtatgccatcctgacacgggtgagcgtccatgtggctcagttgattgctgacgccatctatttgtttacaggtatgccacccaccaggcaccctctagacccggataagtctaacagggccctggggtttctggcattgatcatgggcctctgccagtcgttcggggttcccgtcacccccagcaaagtgatccgaccaccgatcacccgagccttcattgagaagtactgcacgcctaggcaggcacagggtgatgcacctcagggcgcgggcgcaccaccaccaactccttag

SEQ ID NO: 74320 - DNA, 552 bp, Glycine max
  Peptide Sequence Number=SeqID_166005
atgatgattgatacctcaaagcactacactagggcactaaggggcaccgtgcatgggcctcaagcgaacctaggggtagatcaaaagttttcacccgtcgatgtttttaaacaaaaaaaggggagtgaaaaaccctgggatttcagtggattgattaaatggctccatcaccgtcactccaaaattatcaataccctcgccttgagagggcggcaggccctcgccttgaaagggctacacgtcctcaccctcaaagggctacacgcccttgccttcagaggactacacgtcctcgtctttagagggctgcacgccctcgccttcagaggattgcataggactacacgccctcgccttaagaggtcgcacgtcctcgccttcatagggctacacgcgctcgccttcaaaggactgcacgtcctccacttcagagggctacacgccctcgtctttagaggactacacgtcctcgccatcaaagggttacgcatgctcgctttcagagggctccacatctacgcctttagagaactcaaggtcctctacccttaa

SEQ ID NO: 74321 - DNA, 606 bp, Glycine max
  Peptide Sequence Number=SeqID_166006
gttcccagctacaaggtcatgatgaaagataacaattggtacctcaaagccttaacttgggcaatgaggggcatcatgcatgagcctcaagtgaacataggggcagatcaaaagttcttacccgtcgatgatggacccttgcgtactagtaccctcacccttagagggctacatgctctcaccttcagaggactacacctcctcaccttcagagggctgcacgccctcgccatcagaggactatacgtcctcacctctagaggactacacgtcttcacctttagaggactacacgtcctcaccttcagaggactacgcatccacgccatcagaggactatacgtcctcacctccagaggactgcacgttcttgcctttagagggctatacgtcctcaccttcagaggaccacacgtcctcacctttagagggctacatgctctcaccttcagaggactacacgccctcgcctttagatggctgcatgccctctccgtcagaggactatacgtcctcacctctagaggactacacgtcctcacctttagaggactacacgtcctcacctttagaggactacacgtcctcaccttcagagggcttcac

SEQ ID NO: 74322 - DNA, 168 bp, Glycine max
  Peptide Sequence Number=SeqID_166007
atggaggccatgaaagagaaaatggccacaaggatggaggccatgatgagcatgaagaagataacggaagccaatgcggttacaattgctgctaccagcgctattgctaaggtgaactcgatgcccctatctggccttaaccaaatgaatcatccaacctccgatatg

SEQ ID NO: 74323 - DNA, 231 bp, Glycine max
  Peptide Sequence Number=SeqID_166008
atggattcaacaagcgattctcctcaaattccagccagcccgcatcaattagactttgcaccttacgcttcgaggtcatacagtgctcaatggaatgccccggggctcctccatgataagcacacgttgtgtttgagtcgtattctcggagaaatggaggttgaggaaccttggttgggattatggctacctattgaattatcgagtagatatgggagcaagtcagcatag

SEQ ID NO: 74324 - DNA, 153 bp, Glycine max
  Peptide Sequence Number=SeqID_166009
atggagatgcagcggaagacaaaggaaaagagattacccgtggataagaagcttggagaggatgcttcaatggaggaaaagaaagagggagagaaagagagaggggggagcacggaattgaaggaagaaaaagggagagaagttgaactttga

SEQ ID NO: 74325 - DNA, 207 bp, Glycine max
  Peptide Sequence Number=SeqID_166010
atggacccaccactggtaaccctagaggccttcattcagcaggtttcttggccaggagtccatccctctattgatgggggtgggggggggggggtgagccatctgaggcaagagagtctaccgaggttagagctggggatgacatcatggcagacctggcagctgctgattggggcccatatccagacttgggttgaagaagcatga

SEQ ID NO: 74326 - DNA, 375 bp, Glycine max
  Peptide Sequence Number=SeqID_166011
atggcccagcccaagacatgctcaacgcacggggtgccctcagcgcgaaaacaagcactaatgctaagtgcaaatacatgcacccacgctaagcgagcagcacgcactaagtgttcgacagagggtatcgcaaggatggaggttcaagcggccaacatattgtatccccactctctcattcagttgatacaaagaaacctcttccacagtctaccgaatgaggatccttatgctcatctcaccacctacataaaaatatacaacacggggaagcaaaaaggtggctacactcctttaaaggaaatagtttgtggacctggaggaagttgtcgaaaagttcttgaagaaatacttcccatagtcaaagactgctga

SEQ ID NO: 74327 - DNA, 320 bp, Glycine max
  Peptide Sequence Number=SeqID_166012
gcactaaatttcgtgctcttctcttcctctcccttcattcatcttcttctaccttcaagctcttatccatggcttcctatggtggcctacaagctccacatggagctacatcatgtgcttatagcactgctatagctgggttttgtcgggagcgtgagctggggaaagcgtttcaaatgaagaaggagatggttgaggagggtttcttgcctgatgtgggtctcctgcttgatgaggttacttatgttaaaccttgtggcctcaaaaatcttaagaggaataggcttagaatgcagaagaagcaacaacaatcaatttaa

SEQ ID NO: 74328 - DNA, 273 bp, Glycine max
  Peptide Sequence Number=SeqID_166013
atggtgttgagggtgtatgcttttggggctttgatgttggagatccagtgcatcgaggttgatgtgcaccctcagatctgtgtcgtggtggaggtggcagtctgtggaggaggtaggtggtgcttgtggctggaggtggggatgatagtggaggaagataggttggaggttgtggcaacggaagaggggttggggaagaggattagggaggtatggcaagacacagtcagaaggaaattggtgttagggttatgctttgtacttgctctctag

SEQ ID NO: 74329 - DNA, 555 bp, Glycine max
  Peptide Sequence Number=SeqID_166014
atggctaagttagacctagagatagtcatggaattttatgccaacgcctggccaaccgaggagggagctcaggatatgcgctcctgggtgaggggccagtggatcccctttgatgcagacgccctcaaccagttcttgggccacccactgattttggaagagggtcaacagtgtgaattcagccagaggaagagtcagccagaggttttgacgaggaggccattgctcagcttttgtgcataccggggcaggattttgcctggatcgctgcagggagataggctcagggtgaggcaccacagcagcctagagacgcccagccgcaggcagccgatgcacctccgtctcccccggagtccacctcagctcacttgcggaggttggagagctatatacaacacgtggctgaccagtaggcggccaatcatagaggacagttcgacaccacggtggcatggctttgagattggcccaatgctcagacaggggcagggcccacaggcacctttggagatggatacagagctgaggaagacgatgacatggctgatgtga

SEQ ID NO: 74330 - DNA, 177 bp, Glycine max
  Peptide Sequence Number=SeqID_166015
atgcagtattgtggaggccacccagtcgtgcaccgtaactccctccccttggtgatcagcctacgccacaagggagttcccttaccagggacatccgacaaggtcaatgcaccccccatgaacatgcacaacatacaacatatgaacgtgagcaccatcaagtacaaagaccattga

SEQ ID NO: 74331 - DNA, 249 bp, Glycine max
  Peptide Sequence Number=SeqID_166016
atgtacaaagtgtgtgcttatgtgctttgccttccactttacatcctggttaactcccccaaatttgggacaaattgccttgaaccatctgctctcctagaatctaagcaaggagtggaagggtcagctgcaggctgtggtgaggagaggtctaccactggtgcaggaggctttgatgtgccctcaagagatctctcaggggtagcagcagtctctggtctctcctattcttcccctgcctcaggatga

SEQ ID NO: 74332 - DNA, 401 bp, Glycine max
  Peptide Sequence Number=SeqID_166017
aacaaaagcttttggctgagaagacaaagaaaaaattggaggaagctgctcaatttggaagtactgaggccatgattgaccctccatctccaattaaatggcacgtaaagtggaagatggcccgcatgaagaaaacaagccagatgacgtctgatgcagcaaaggaaattgctaagaagattgtaagtcactttcaattaacaattgtaattgtcgcaacctacccttcggcgggagggcgacgcagggctcacgagtgtgtcttccaagaaaggaaaatgagtggagtcaccaccaatgtttattcgaggaaaacgtcggaaaaaccgaaaaaggtgtggtcaacaaactttaagtgtgaaaggttcgggagttatttttacgcacggggaaggtattag

SEQ ID NO: 74333 - DNA, 225 bp, Glycine max
  Peptide Sequence Number=SeqID_166018
atgggcccagttttgtcagacccgcagagacccctcgtgggagaacaaaagcttttggctgagaagacaaagaaaaaattggaggaagctgctcaatttggaagtactgaggccatgattgaccctccatctccaattaaatggcacgtaaagtggaagatggcccgcatgaagaaaacaagccagatgacgtctgatgcagcaaaggaaattgctaagaagatt

SEQ ID NO: 74334 - DNA, 240 bp, Glycine max
  Peptide Sequence Number=SeqID_166019
atgcacaattgccctaagtttggggtatcatggtacaaagtgaaggatgacaatgagtgtagcagtgatgaaagcaccatgaaaggccccccaacaaagattacgcaaaataccttacatggcatgcagataggagaaattgcgatggaatgctccggcatccggctgattcctctcagtggaagaagattaatagtctatatccagaagttggcaaagaggcaaggaatcttaggttga

SEQ ID NO: 74335 - DNA, 327 bp, Glycine max
  Peptide Sequence Number=SeqID_166020
atgactagtatatatgtgaggggtagagggtgtcacagtttacgcatggggaagtttttggggtcgacaagagtgttgcccttactcctacgtatcctcaagtgcgatgagggattcagacctaagcaaagaggtcactttggggcagttgcagctcacccaggtgagctgaaacttagtgttgaagcaatgagcttgcccaggcgagctggtttcttcaccatgaagctatttggtggcccaggcgagccaaagttgtttcgtattgtaactggtgttcaacaccgtaagtcgactagcaaggatcaaaagatcaatgaacgatag

SEQ ID NO: 74336 - DNA, 204 bp, Glycine max
  Peptide Sequence Number=SeqID_166021
atgggtgaggttcagggtcaggttcagggacacaatgtgggtgaggttgagggacatgcacaatgtaaaaagcttgaggaacaaatgtgggtgaggttcgaagaaaatggttgtggaacaaatgaaactgaatcacttccttatagctcaagaagtagagatgtgtcagagttcaatttgagagaatgggcagtgaaagcttga

SEQ ID NO: 74337 - DNA, 1021 bp, Glycine max
  Peptide Sequence Number=SeqID_166022
tccttctaaggaatttgctcctaagagaggcttaaggcaaggtgatcctcttgcacctctgctcttcaatatagtagtggaaggtctcacaggtttgatgaggtcaactgtgtccaagaatcgtttcagcagctatcaagtgggatctcaaaaagaggaagtttctggccttaagataaattattctaaaagacatttcggctgcctaggaaaaacagaaggggtgtcttctaagagctggagtgtttggcagcctattataaggaagtttgaagccaagcttgcaaaatggaagcaaagaagtcatcatgaggccgacaagattccttgggtgaagtgggacacagtttgccttcctaaaaataaagggggcctagggattaaagatttgtctaaatttaatgaggctttacttaacaaatggggaaaattttcctctcattggtggcaagacctaaaggctgtctttcagcagcaacaccgcaatagttttattgataacctcaagtggagggatagatgggagtggaagctaatatggaggaggaattttttttaccatgaaattgacatggtagcagctttcttggctgagattgagatcgcccacatccttcaatccagcagggattttctattttggaaggctgaccctaatggtctttattctacaaaatctgcctataaagtgttgcaggaagctgataataatgttaatgaggacagggcatccaagatcttatggagtctgaaaatacccccaagagaaagtgcttttttatgcaccacaagtccacaaggggttctgtgggttctagcgaggacaatgtgggtgtcgagggagcggttttcgacagatttcaggcgggaggagaaagagaagagcgatttcaggcaggaggatgacaaagagaagagggagagcaaggttttcgagcacgcgcggtttgtgaaatctcaattttttttaacttataaacataacaacattggttttttatggataaccgatgttaactga

SEQ ID NO: 74338 - DNA, 144 bp, Glycine max
  Peptide Sequence Number=SeqID_166023
atgtctcgggagaaaaaggaatcacatgaagatagtacaaatggaggcttcaatcccttctcattttttctaacgtttgggaacccctatcagagcaaccagaggaatctcaggaacttgtcagagatgtctctattgctgtag

SEQ ID NO: 74339 - DNA, 701 bp, Glycine max
  Peptide Sequence Number=SeqID_166024
atggaagggaaaaagtttattatgtttatcgctttagcacaaaagcataaagcaaagagggtggagagtgtcaatgttgatgcagaagcctttggtgatcactgggaaagttcagattgctctatgcattctgaagctgaagcactagaacatatgaagaaaagaaatagaggccatcaaagtttgttattggagaataagacaggagattcaactgtggtcaagatgagtcagaaaaataataatgttgatgccggcaactgcatgactcttgaagaccatgaaggagaagagcattgttgtggcaaaggaacaaatgcgaggagatcatggcttctccacctgcctcccctcctcctcctccttcatcctcctcctcctcctcctactcctgttccttccgacacatcggcttcgccatctaccgtgaagcagacacgcaaagcctcatgtctacgatcgttgtctactagaccacctggtgctgagagaccagtggtccatgttgatcctgctaccggcaaggccgacggtccccacaggaagaaattaagaacatatttggggattatggcgcgtgataaggtggacgtcacctacgagaactggaacaaggttcctactgctcagaaggacttgatttgggaggatattcaggaagaatttgaaatcccagaggcttctgatagtaggacaaaaag

SEQ ID NO: 74340 - DNA, 357 bp, Glycine max
  Peptide Sequence Number=SeqID_166025
atgaatataaatatagctatattggaagagaagcctgctactattactgatgctagtagcaatgaagagaaatcccattataaagcttgggaaagatctaaccaattcaatctaatattcatgagaatgaatgttacaaacagtattaagacaactctccctaagaccgatagtgctaaagagtttatgaggttagtgggagagcactttcaaactgctgataagtctcttgctaggacattaatgagtacactgacaaccataaagtttgatggttcacgtactatgcatgagcatatcattgagatgacaaacattacagcaagacgtaagaccttgggaatggggatcctctag

SEQ ID NO: 74341 - DNA, 648 bp, Glycine max
  Peptide Sequence Number=SeqID_166026
atggagttctgccctagtggggacctgcatgcacttaggcaaagacaaccagggaagtatttttcggagcatgctgtcagctgtatgctatttaacattgatggtcatcaagtccctcaacacattatgatggaagttggagacacttacaagagaattctggcagagacagcaaaagtgagggatgagcatcctgatgacatgcctattctccaagcaatttcaattgtgttaaatagacatccagaactaagaatggaagcttggtttgcttttgatgcgattatcataccactgaaaacctgggatcaggcaagtgccattatattagttgaaggacacaagatcctatttcgcctaagcttctacacatggcgctacctgacaatgcttcctatggaacccatacttggcaagatgctaatattaggttctattttgaattgcttggatcccatattaattgttgttgctgggcttagcgtgagagatccttttctaacaccattggataaaaaagatgatgatttgacagatattgagaaagaagacattgaccgtgcaattgcactttctttgtcagaggatgatcataaagggaaaaaagttgttgagtttcccggaggattcctttctcccgataggtaa

SEQ ID NO: 74342 - DNA, 183 bp, Glycine max
  Peptide Sequence Number=SeqID_166027
atgtcactcattgatgcaatcctcactaggaaggcaccagtcactagagccatgagcaagaggctccaagaggattgggctagagctgctgaagaaggccctagggttctcatgaacctcagggtagggtaccctagaaatatagcatttttcagcccttgtattttagggcacctagactag

SEQ ID NO: 74343 - DNA, 507 bp, Glycine max
  Peptide Sequence Number=SeqID_166028
atgttggaagtttttaatagttacagttttgtacaaagacgatttaaacacaaaaactgtcgtggtttgtgctaccatttctcaaaggcactcactcactcagtccttcattcactctctaaagccgtcactcactcaccgtacacgttgtgccctcactcagatcgtgcccttcgtcagtcgctggccgtcaaaggtgtctcccatgccaccccgcagtcattgtcatcgttgaaggaagttgtgcatcaaactatcagtgtgacatttgaagatcctgtggtccaggagttactgctgaagctataccagaaagtcttggtgccaacatggccaaaggaagcagcaagcttcttcatgccactggtctttcctccagtcactattagaaaatacactttcaacatcggttatttagaacattctacatcggttttaaaaccgatgttgaaagtgccgatgttgaatgtatcaatgttaacatcggttctacaaaaccgatgttaa

SEQ ID NO: 74344 - DNA, 525 bp, Glycine max
  Peptide Sequence Number=SeqID_166029
atgcgggggtaccgtatggttatccgcaccattcgtcaaccaggggcaaacgagactgttgatgcgcagagactaacgtcgtcttctgtaccctttgtcaatcaggggcaagcaaactcgttgacacgcggagacttacatcgtcttctgtgcctttgtcgtcctaacccgcggaggtaccgtatggttatcctcatctttcgtcaacaaggggcaaacgagcccgttgatgcgcagagactaacgtcgtcttctgcacgttttgtcatccagggacagggagtcaggtggcaggcggagataccttatggtcgtctgcacctttcgtcaaccaaggcgaacgagttcgacggtatcaggatgatgtcttttactctcatcgtctggagacattcaagcccgatgacgcatgagattcttctctgctgggcggggacaatcaagtttgattgcgtgtggaaacgttgtggtcccgctggttgggatattggttggccaaatgatgttccgcttgaacgaaattag

SEQ ID NO: 74345 - DNA, 107 bp, Glycine max
  Peptide Sequence Number=SeqID_166030
cgttctttgaagaactggctaagcgcgcttactgcgctaagcgagttcatcctttgaggatgaacactcatcctcttgctgaactacatgcggctaagcgaggctga

SEQ ID NO: 74346 - DNA, 447 bp, Glycine max
  Peptide Sequence Number=SeqID_166031
atgatagcacctccagattctattccttccgttgaacagtttaatgagatggtagcctggcctgggacccaaccttctcttcataaggaagataaaggtcccacagctcaggtacctcagcatatggaggatgagtcatctgaggccaccatcccagagccatttgatataggagaagaggcagaggagacacaggtgagacaggtagctcctaccactcttgagcgatcccttgaggctacttcagagccttctgcaccagtggtaaacctacccttacctcagcctgtagcacacccctccactcctcttctacagatgcctgaggatccaactataccagtcctagctatagacacttctcctcccactactccagttcttcagctaacagatgaggaggatggtcagacacaggacacacaggaccagtcacaggaattttaa

SEQ ID NO: 74347 - DNA, 982 bp, Glycine max
  Peptide Sequence Number=SeqID_166032
atggccggatttgcccatgcccatcaccaccactttgccacggcaggcaaagatcatttcgcaggcgcggctgaagtcggcgttaatatactggtcgagctgttccagcccttcgcgttcaatgcgcagtaccgctttacctgcctgctggaagcacagcagggcgaacagcacgctgacgcccagcataatccagtaatcccgcgcaaaggcatgcgcatcgatcgcgccgggatgcaccagcgccggcaggcccagcacaatcgccagattgaagatattggcgccaatcaggttgccgatggcgatatcgtcttcgcctttcaacgcgccggccagcaccgtggccagttccggcaggctggtaccgacagcaatcagcgtcagtcccatcaccagttcgctaacgccgaagtaatccgcaaacaccgtggcgttgtcgatcaccatgcgcgtcgacatcggcagaataatcagcgccaccgccagccagagaaacgccaccgtattgccgctttcgtcgcgcggcagttccgccagttgttcacgcgtcagggtgtcattattatcgcgctcggcccgccgggcgatgcggatcgccaccagcagataacccagcgccagcagcagcagtgctacgccatccagccggctgagctggttatcaaacagcatgatgccgctgagcaggtgcagcagcgcagcgccaccaaggatcagcagaatattggtgatgttcgagcccagcgcgagaacgagacgatcagttccggcagtgaagtgccaatgctcaccaccgtcatgccaatgatcaacgggggaatgccaagggatcgacacaggatcgcggcgctgaacaccaggcgtggctacgaacatgaaaaatccttgatggataacggtgccggcaaaccttgtccgacaggtaaaagcagtgcgcgtgcggaatcaggcgctgattttgactgtctgagaggcaaaa

SEQ ID NO: 74348 - DNA, 438 bp, Glycine max
  Peptide Sequence Number=SeqID_166033
atgagaggccctctcaaagagtcaacctcttgctttcttgtaagaggactgcatgtcctcaccttcgtagggctacaggccctcaccatcagaggaccacacgtcttcaccttcagagggctacacgccctcgccatcagaggactgcatgtcctcaccttcagaggactgcatgtcctcaccttcagaggattgcacgtcctcaccttcgcagggctacacgccctcacctttagaggaccacacgtcctcaccttcagagggctacacgccctcgccataagaggactgcatgtcctcaccttcaaagggctactcgccctcgccatcagaggactgcatgtcctcaccttcagagggctacacgccctcgccatcagaggactacacgtcctcaccatcagagcgctgtacgccctcacctctagaggactacat

SEQ ID NO: 74349 - DNA, 412 bp, Glycine max
  Peptide Sequence Number=SeqID_166034
gacaagaagaatgtagattgttacaactatggaaagaagggacactatgctgttgattgctggtacaaggataaaaatcttgttgataaggctcaacttgcagaaggagcagattcagtttttgaacctgtcctgttgatggtaacaaacaagacaatgcctgatgacaagggcataagcagcaatcttctaagccttggtcagttacttcagaaaggctttaagataactatgaaggacatgatgatgctggttggaacgcaagcacttgagcacaaatgtcttagtgctgtaagtaacagagaagaatggttttggcactataggcttggacacctgaatttcagagatcttgctcaaatgcacaagtttgcacaaggaattcctcaactacagcaaccacaggagaaat

SEQ ID NO: 74350 - DNA, 180 bp, Glycine max
  Peptide Sequence Number=SeqID_166035
atggagaaagccccacgcttcccgaagggagaaaggcggacaggggggcggagcctatggaaaaacgccagcaacgcggcctttttacggttcctggccttttgctggccttttgctcacatgttctttcctgcgttatcccctgattctgtggataaccgtattaccgcctttgagtga

SEQ ID NO: 74351 - DNA, 117 bp, Glycine max
  Peptide Sequence Number=SeqID_166036
atggcagcactgggtggctttaccgacatcaccggagcacagaacagcatcgatatcgaaaatctcgctcgctttgctgttgatgaacacaacaaaaaagaggggtctcacaaataa

SEQ ID NO: 74352 - DNA, 582 bp, Glycine max
  Peptide Sequence Number=SeqID_166037
atggaattcggcgtcgccgacgcgggcgatgccgcggccttccaccacgctgtagacggtggaatcggtgctgcgatagaccttgccctggaagccggccggcagcagctgcatgaaggtggccatggtgggcatggggtagccgcccgtggccgggttcaggtagcgcagcttgacgccgtcccaggggtccagctcgccatggcggtagagcgcgtccagcgcctcgcggctgcgctcgtagggatagttgaagatcggcgaggtgccgctggtggcgcggtggcgcaccggcgccatgttgtggccgtagcgcgccatgctgtcgccttcgggacgcgtgaccggctgggtggcggacggatagttctcggcgaagccggcgtccaggaagcgcagcagcgggatgtccaggccatccagccagaccaccggttcgccaccgtcgacggtctcggcgttgccgtggtcgtgccaggtccaggacggcgtgatgatgaagtcgcccggatgcatggtggtgcgctcgccattgacggcggtgtaggcgccgcggccttcgacgatgaaacgcagggctga

SEQ ID NO: 74353 - DNA, 450 bp, Glycine max
  Peptide Sequence Number=SeqID_166038
atgttaagattccctaaatctaatgtgcaaaattttaagtttgggatgagaggccctctcgatgagtcaatctcttgctttctcataagggtggacccttgggtaatagtacctattgcctttagaggactacacgtcctcgcctttagagggctacacgtcctcgccttcagaggactacaggtcctcgcttccagaggactgcacgtcctcgccttcagaggactgcatgtcctcgccttcagagggctacacacccttgccttgcctttagagggctacacgccctcgccttcagaggactacacgtcctcgccttcagagagctacacgcccttgccttcagaggactacacgtcctcgccttcgaaggactacacgtcctccccttcagagggctacacgccatcgcctttagaggactacatgccatcgcctttagaggattaa

SEQ ID NO: 74354 - DNA, 279 bp, Glycine max
  Peptide Sequence Number=SeqID_166039
atggaagagtcagtcttccaacttttattagttgaccacagagtggtacctgaggatatgtcccgggggtcaggagaccttggggacgtcaggtggggtgctattgcccaaaaccaaggttggccaatcccaacccaacccgggcatagtcagtcaatgagaacctatgatgtacctcaacaggcgagctcctggcagtcaaccaataaaggaacaaaagtccacgaagcaggaggcttgtgtggcgactggccaactatctatctgtgttttatctga

SEQ ID NO: 74355 - DNA, 552 bp, Glycine max
  Peptide Sequence Number=SeqID_166040
atggaagagggatttttccatggttcagttccaattattttaggcaggccatttatcaaaacaacccgaaccaagatagatgtttatgctggcacattgtctatggaatttggtgagatagttgatcagattgttgatgattatatgtttgatttcgattctgttcttcatggtaggaaacatccatttttatctgatctgcatacttgtcattccttatgcattgaatctgaatctgagtttgaatttgatcctacatctgatttttatgctgagagtgaatttgaatttgagtctggtgttgtacctcttgatattgattttttagagtcagaatgcactaaccatgttgcaggaagtacatatacttttgacttgctttatgaggtacaggctgaggaaccttcttcatctcctaccatggagttcaatattcacttaggatcaacatttcagccagcaattcaatcaccaaaactcaaattcacaatagacacaatcataaggaaacctaaaagttcaagaaaaggttcacaatcaaagactctctaa

SEQ ID NO: 74356 - DNA, 576 bp, Glycine max
  Peptide Sequence Number=SeqID_166041
atggcctcgggatctgcggttggtgtctgccaatactgtcacaagaaaattgtctcctttgtgaggcaagacatagcagaaaagcttcaagttgaggaagacacacatgtggaggacagccaaaaagcaagagagaaccccttaggttgctcctcaaatgcttatgaatctcttttaaggcagaaatctagagctaagtggttaaaagaaggggacaacaactcagcttatttccataaacttataaatttcagaagacattataatggtcttgaaggaattctcattcatggtgtatggattcagaaccccaatgaagtttttgataaagacattgggcaagataagcgattgggaatagtaaaattgccacttaatgacttggaaccagaaactgaaaaggagtttgaattggggctgctgtcatcacttgatacacagaaagtaaaagacaagaaggatcaaggaaccataaccataaagatcttttatcaccaatttaacaaggaagaacagttggttgcactagaagcagagaaaaatatagtagaagaaaggaagaaacttaaagaatag

SEQ ID NO: 74357 - DNA, 471 bp, Glycine max
  Peptide Sequence Number=SeqID_166042
atgccgctcaactccgtgatatttgttactttggccgacaacaagctgatgtcggtgactccttcattcctttcgcttggaggcgcatacccccacggaattgcgtggctgtttttgtatggaaatggaataggtctaactaccgagggttgtcggggcgtttggggagctgcgtctctggtgaaatgtatcaccaaagatttaggctttctaagaccttcctcatctgcggattgcatgcatatgtgctgctcttcacccccctcgtcgccgacttccagccggccttggtctatcatttgttgcaataggtctcccactgctgaacatgcttccatgttatgtgacacgtcgggatgcatcaaacaggaatctttctcgtgcccaccatggggaattacgctcagagctcatgttatggacctgcgcggcctacccgactcgacgacattaaccgctcctcctccatga

SEQ ID NO: 74358 - DNA, 90 bp, Glycine max
  Peptide Sequence Number=SeqID_166043
atgaagaacggagaaaagagggaggtggttgccgcccagctcgcccaggagagctgggttgcttccactagaaggcccaagtgggcctga

SEQ ID NO: 74359 - DNA, 825 bp, Glycine max
  Peptide Sequence Number=SeqID_166044
atgagtttgactaaattcccaaaaataattaaaaaatcttgggcagacattgcctcagaatctaacgatgattctgaaacaaatttacaaaacataatccaagatgtttcaatatccaaaacagtcaccaatcctaaagggaaacaaaccctagccaaaacccaaacaccaatcaccaaacaaactaacaattatatttacaaaaacaaattttcaactgttttgcagatggaacatgaattctgggatatgaacccattcaaggcaacagtcaaggcgttctcgacaggatttcactttaaaccatctgccatcaacaagtcaagaatcttttatgaactgatattggtagactcgaattcaatgtctatcaagcacttcaaagacccaaaggatcaaacgttgaacactcactcaacaatacaaatcctaaaggttcttcaaccaagacactttggtttagacttaaacaaagggaaaaaattttcagtaccatttgatcttgtaggttatacctattgggattatgttgatgtttggacaaaagttttttggcaccaaaatacccgcttcaagcactcatgtaagactgagaaaactaatcaatatccatctctacaaaggcatgcatttgtaaaatggtgggcacaatttgatacatccaaagctaatccagaacaagtgaagctttggttccaatcgcatccagaatttcttaaggcagctgacccagaaacttctgtattcctaaaccagaagtctcatcttgctgcatttttagcaggttcaaaatccaaagaaagcctgactaaaaatcttaaagag

SEQ ID NO: 74360 - DNA, 321 bp, Glycine max
  Peptide Sequence Number=SeqID_166045
atgcaagatgccagcggaatgatcggccggacagaggctagggctgcttccttcccaccgcgtccttccttgtgtgtcggagatataaagcgagtgcaccggaaaagaacgggaactgggtcgatctattctatggcgaagcatccgaagcataactgcacactcacacgatctttgccgagagataggagcattcgatgtgtgggacagagggctcgtggtacctgctgcccacccttcctcctctgctttgagaaccgtgtgaacggagagtgggcagaagggaaggaggtcctcatacggagtcgcacacttacttga

SEQ ID NO: 74361 - DNA, 747 bp, Glycine max
  Peptide Sequence Number=SeqID_166046
atggttgtgatatctcccgggaagatctaccagcctcctttcccaaagtggtatgaccctgacgcaacctgcgcataccatgggaaaaccccgggccactccaccgaacgttgtctggcccttaaatacaaggaccagcccaacatgaaaacgaacccgctcgctaatcatggagggggagtagttaatgtcgtcaagtcgggtaggccacgcattgttcaagcctttgaaggacgtgacgacccccaggagtccgtagatgagggaagttttggaaagcctaagcctttggtggtatatttcaccagagacgcagctccccaaacgccccgatacccctcggtagttaaacctatttcgttttcataccaaaacagccatgcagttccgtggaggtatgtgcctccaagcgaaaggaaggaagaagccaccgacatcagctcattgtcagccaaggtaactaatatcacggggctgagcggcgtgacccgcagcggtcgcgtgttcgcaccccctgacctaccgacacaacccgcaaatgttaaagggaaggcaaagatagcggaagaacaaaatgacaaaatgatccccactccgaatgagaatattccagtgaaaggtctttcggagaaaaaggatggatgtggcaagaaagaagtattgctagaggaggcaggcgagttcctccgcattattcaacaaagcgagttcaagatcattgagcagctcaacaaaacgccggccaga

SEQ ID NO: 74362 - DNA, 272 bp, Glycine max
  Peptide Sequence Number=SeqID_166047
accaagaagaagttggaggaatctgcacagtaagaagcgttgatggcgtcatcgaccctccatccccggattcctttaaggagcaggtgacacagggatccttcatcccctatggacgtcaggatgttctcactgctgctattggacgtccagagcaccctggacgtgtccgttctgctggagccggtgtcaccatcaagaaatactttggatcggctccacggacgtcctgcagctcttcctccttgcctcctgaagaattgcagagctga

SEQ ID NO: 74363 - DNA, 252 bp, Glycine max
  Peptide Sequence Number=SeqID_166048
acttatcaaggtaatccttgtggcgtctaccctgacttatcttccttcaccggaagtggcgtctacccagacttatcttctttaaccggaagtggcgtctacccagacttatctttcttcactggaagtagcgtctaccctgacttatcttccctctttggaagtggcgtcatccaaatatctgtaacctgtatcaaacgatccactcctactcaggttcacatcatctggtatcagagcttcggctcttga

SEQ ID NO: 74364 - DNA, 351 bp, Glycine max
  Peptide Sequence Number=SeqID_166049
atgaagaacagtggaaaaccttcgcgaaatcgcccacggaaacgtctcgaaagcgttacgaaagagcctcggcttgaattttcttcacggaaacaatttttctcactaattttaagggaaaacgggaggtcgttgccgtccagctcgcccaggcgagctgggttgcttccaccagaaggcggtgccttctgttggaaaatcctagaaggcccaagtggacctaattgctatttgtacacccataactttacggattgcgcattaacgcttcctttcgactcccgacatgtcacaaaacttcacggattgcctaacaatgggtgtcaagtacctcgaagtggtcaagcgaag

SEQ ID NO: 74365 - DNA, 477 bp, Glycine max
  Peptide Sequence Number=SeqID_166050
ggccatcctgggaagattctcaagaaggatctgactacactagctcgggtgtggagtgtcctctcatactacaacttggccgccacatcacacacttctgacttgacagtggatagagctaggctgatctttggcctagtctcttgcatggatatgaacataggagcgttgatctctggccagatgacctctataccccaatctaacacttctagacttgggtttccagctctgatcaccgcattatgtagagccagaggggttgtctctgatagcctcacttttgagcgcctaaggctggtcattaacttgtcctacatcaggaagaactattggaaccccgaggatctaacaatttctatccgaggggttatgagggcgagggctaggctagctgagctcccttccacgtctgcggctcaaactccaacatccacatcagcagctccttctgtcccagcccagacagattcttag

SEQ ID NO: 74366 - DNA, 231 bp, Glycine max
  Peptide Sequence Number=SeqID_166051
atgacgggtatgaagaggatggggcaggatggaggaattagaggtaggcaaagagaggaagggattgatggagtagaggtgaatatccgtacttttaaagggactcgcaatccgaaagtgtatcttgagtgggagatgaagggtgagctagtctttgcttgctcaaactacaatgaagagataaagtctcaagagtccgccggggggaggtatttgcttggggctctatag

SEQ ID NO: 74367 - DNA, 144 bp, Glycine max
  Peptide Sequence Number=SeqID_166052
atgaatagtttaggatcgtcatctagtgtctcgtgtttgtacaaacttttctacagtgcgtggaagattttcagtgtgaggaatggttggtattatcctcctggggcttggatgaatgctacgtgtgaaggtgttgatgtttga

SEQ ID NO: 74368 - DNA, 942 bp, Glycine max
  Peptide Sequence Number=SeqID_166053
atggccaaggttgctgatctaatggtttttgtggcctcggcaaggtcttcatgtgaagaaactgattcctactacattgactcatttggaaatcaatgcctttctgtatttagatctcttggtttaccaagcactgctgtgtttattcgtgatctatctactgatcttaaacaaagaaatgaactaaagaagatgtgcacatctagtcttgcctcggaatttcctgaggattgtaaattttatccagctgatacaaaggatgagctacacaagttcttgtggctctttaaagagcaaaggcttaaagttcctcattggagaactcaacgatcatacctcttgtctcaaaaggttgatgcagaatatgatggcaactctgaaaaatgcaccctgtttctcactggttaccttcgttctcgtaacctctcagtcaatcaactggttcatgtttcaggtgcaggagatttccaattgtctaaaattgaagttcttaaagatccttgtcctttgaattcaaggaaaaatcaggacctaatggatgctgatgaaatgcatgatgcagaggtcattggttctctagctcctgatcctcaaaaccaggaagccttagtggttgagaatatacctgatcctcttgctggagagcagacatggccaacagaggctgaaattgctaaggctgatgaagataaaaagaaaaagaagataaaaaagaggagtcttcctcatggcacttcagaatatcaggctgcttggattgtggacgattctgatgaggaggagtcggattgtgacaatgaaaacgatgatggtatggtgttggatgaaggggaggatggatttcctggtcaagaaaacaggtattcagactttgatggtgatggggcttctcttagattgggagattctgatgaagaaactgacattgattcagtgatgatg

SEQ ID NO: 74369 - DNA, 2652 bp, Glycine max
  Peptide Sequence Number=SeqID_166054
atggctgaatcacttactataattgtgagaagtaagcagtatcttgcgacacaaaagccagtaaatctggctctcggctatcggaatccacatggatatgggttcagttttggatcgagaagatcaatacacgagagggtgagctctcatttcaagggcatagctgttatgacagatgacaaatcaacaatgtcatccaccgaggaagacttagaaaacattggcatctttcatattgatccatccctaaagccatataaagatcacttcaaatatagactgaagagatatgtagatcagaaaaagcttattgaagaatatgaaggaggtcttgaagaattttctcaaggttatttgaaatttggatttaacagagaagaaggtggtattgtttactgtgagtgggcacctgctgcacaggaagcacaaattattggagactttaatggatgggatggttccaaccaccagatggaaaaaaatcagtttggtgtttggagtattaggatccctgatactgatggaaattctgccataccacacaattcaagagtgaagtttagatttagacacggggatggagtttgggttgatcgcatccctgcttggatcaaatatgccactgttgatcctaccagatttgccgcaccatatgatggtgtctactgggatccaccactttcagagaggtatcagtttaaatatcctcgtccaccaaagccaaaggccccgcggatatatgaggctcatgtggggatgagtagctttgaaccccgcataaactcttacagggaatttgcagatgagattttgccccgtattcgggcaaataactataatacagtccagctgatggctgtgatggagcattcttattatgcatcatttggatatcatgtaacaaattttttcgctgtgagcagtagatctggaacccctgaagatcttaaatatctgatagataaggcccatagcctaggtttgcaggttttgatggatgttatccatagtcatgctagtaataatgttactgatggactcaatggctttgatgttggccaaacctcacaagattcttacttccatactggagatagaggctatcataaattgtgggacagtagactcttcaactatgctaactgggaagttcttcgtttccttttatcaaatttaaggtggtggcttgaagagtttaaatttgatggatttcgatttgatggagtaacatcaatgctgtatcatcaccatggaatcaacattgcatttacaggggattataatgaatattttagtgaagcaacagatgtggatgctgttgtctatctgatgctggctaattgtctgatccatagtattttgccagatgcaactgtcattgctgaagatgtttctggcatgcctggacttggtcaaccagtttctgatggtggaattggttttgactatcgtctagccatggcaatccctgataaatggattgattacttgaagaacaagaacgactatgcatggtcaatgaaggaaatctcttggagtttgacaaataggagatacactgagaaatgtgtttcctatgctgaaagccatgatcaggccattgttggagacaagactgttgcatttctcctaatggatgaagaaatgtattctggcatgtctagcttggttgatgcttctcctattgttgagagagggattgctcttcagaagatgatacacttcataacaatggcattaggtggagagggctaccttaatttcatgggcaatgagtttggccatccagagtggattgatttcccaagagaaggcaatggatggagttatgagaagtgcaggcgtcagtggaatctggtggatacagatcacttgagatataagttcatgaatgcatttgacagagcaatgaacttgcttgatgataaattctcattccttgcatcaacaaaacagattgtgagcagtgcagatgatgatgacaaggttatagtctttgagcgaggagatctgatatttgtattcaattttcatccagagaatacatatgaagggtataaagttggatgtgacttacctggaaagtatagagttgcattggatagtgatgcttgggaatttggaggacgtggaagagtggggcatgatgtagaccacttcacatccccagaaggcataccaggagtccctgaaacaaattttaataatcgccccaattcattcaaggtcctctcccctgctcgtacttgtgtggcatattatagagtggaagaaagtcaagaagacgacgataataacagtttggttggggtagaagagacttctgctgcagcagatgttgcaaaaattcctgatgaatccgcttctacagaaagtgaagatatcaaattggatggggtgaaagagacattagctgcagcagatgttgcaaaaattcctgatgaatctgcccctttagaaagtgaagatagcaatttggatgtggtgaaagagccgttagctgcagcaaatgctgaagttacaaaaatttctggtgaattggtttctgtagaaactgaaggtatcaatttggataagttggaagagacaatagtagcagcttctgttgaaagtgaggtagttcgagacaaaccagaagatgcagccaactga

SEQ ID NO: 74370 - DNA, 531 bp, Glycine max
  Peptide Sequence Number=SeqID_166055
atggccaccgtcacttctgcagccgttgctattccctcattcactggcctcaaggcaagcgcaggcaaagtgagtgccgcagttaaagtctcagctccccaagccacaaggttgggcatcaaggcttcgctgaaagacgttggagtcgctgttgtggccactgccgcgagtgcagtgctggctagcaacgccatggccattgaagtgttgctgggtggtgatgacgggtctctggctttcgttcccaacaatttctccgtggcctctggggagaagatcgtgttcaagaacaacgcaggtttcccccacaacgttgtgttcgacgaggacgagattcctagcggcgtggatgcagggaaaatctccatgagcgatgaagaccttctcaatgcgcctggtgagacttacagcgttactttggatgctaagggaacctacagtttcttctgttcgcctcaccaaggagctggtatggtgggaaaagtcactagcttggttgatctttcttgttatggcctatgggatgaatga

SEQ ID NO: 74371 - DNA, 1224 bp, Glycine max
  Peptide Sequence Number=SeqID_166056
atggtcatagctggaaggcagccgtacggtgttgggcacggtcttggactctggtctgccagcgacacaataattaacgtgaaagtttctgatcttgaagggaaagtagtgggtctattattcgctgcgaattggtacccaccttgccgtggattcacccaagtcctagctggaatctacgaggagctaaaaagcagagtccctcaatttgagattgtgtatgtgtcctcagatgaggacttgaatgcctttaatagcttctatggaagcatgccctggattgcaattccgttctctgatttggaaacaaagaagtctttgaccagaaagtttgacgtggaagccgttccatgcttaattttgttgcaacctgacgatcgtaaagagcacgcaacagttcgtgatggggttgaacttatttaccgctatggaatccaagcttatccattcagtaaggacaggttggagcagctgcaaaaggaagacaaagtgaagcgtgataaccagactctcactaatttactagcaaaccaccatagagactacgttttgagtcacactcacacgggactcaaaaaggtacctgtagcttccctagtgggtaaaacaattggactctacttctcagcggaatggtgcgtcccatgcgccaagttcactcccaagctgatttccgtttacgagaagataaagcacgagctagccgaaaagggagaggaggacttcgaagttgtgctaatatccagcgaccgcgaccaagcatcctttgactcctactacagcaccatgccttggttggccttgcctttcggtgacccagagatcaagaacctcgttagacactacaacgtgcaaggaattccttggttggtgattataggtcctgatggtaaaacaataaccgtacacgggaggagtttgataaacttgtaccaagagaatgcgtaccctttcaccaaggccaaagtggaggagctggagaaacagctggaggaagaggccaagggtcttccagcattggtgtatcaccaagggcatcgacatgatctgaatttggtgtctgatggaaatggtggagggccctttatctgctgcgtgtgtgatgaacaagggtctagctgggcctaccagtgtctccaatgtggctatgaagtgcacccaaagtgcgtcagaactgtggaacgcgatgacaatgtcttggtggacaccactggttgcttctag

SEQ ID NO: 74372 - DNA, 417 bp, Glycine max
  Peptide Sequence Number=SeqID_166057
atgggagatcatacagaatcttgcaatagcggaattttcaattctggatggaacctaagtccaaaacagaggcagaaggttggagtttataacgaggttctatgtagacttagggaattgaatgtcccagaggctatggttcctggttttgaggatgagctttgggcacacttctatcgccttccttctaggtatgcattggacatgaatgtggagagggcacaagatgttcttatgcataaaaggttactggacatcgcacgagccccaactacagcattcgggcctgcagttgaagtccgtcttgtacaggttttaaaattgggcccgctaactactccatttgtttgcggtctaaatgacgagggattttcttcctacattaaaagaaaatcttctacacctaatattttttga

SEQ ID NO: 74373 - DNA, 192 bp, Glycine max
  Peptide Sequence Number=SeqID_166058
atgtctttaagcaaatttttaaataaactcgtacatcaaactaaacttttatctctgacagttattcagcaggccaactgttatgtacctcacagactaattaaaacggagatgagacatcttagaccaagaaaaaggtcatcgtcatcggttgcagtagatgtgtatgttcctgggaacaacggagcctga

SEQ ID NO: 74374 - DNA, 454 bp, Glycine max
  Peptide Sequence Number=SeqID_166059
atggaagaagtggtggaagtaaaggtgagtggtagaccgagagagactcagagctctccggggatttcaactcccaaaagcccatttgcaactcgttttatgagcacccctttagccagccccatgaagaaggccattgaaaacatgcaaggttacttgggagaagttggtcgcttcaccaagcttgacccacaagatgattggcttcccatcaccgagtcaaggaagggaaacgcatactacgctgcgtttcacgttctttcttcagggattggatttcaggctcttgttcttccattagccttcaccagtcttggctggacttggggaatcatatgtctctgtgtggcttttacatggcagctctacacgttgtggttactgattcagcttcacgaatcggactcaggggtgcgccatagcaggtacctcagacttgctatggcagcattcg

SEQ ID NO: 74375 - DNA, 945 bp, Glycine max
  Peptide Sequence Number=SeqID_166060
atggtaggcgttttccggcgctccctttctttcccaaacaaaaatcccaaccgtccatcacaacagaaaccgcacatatcacaccacatcaggtccatcagtcttccgtgcagatctcaccctctgatctcagagatcaaagacgagatcaacgacctcaccagctgggcctccacctcaaagtccaatccacaaacacacacaaccatttcccacggtttaacccttctcaaagacacacacgaaacccttcaacacatcctccaactccctcagactctagaaaccctccgaagccaccctctctgggtcgagaagcttctagaagacttcctccgcttcgtcgacgccttcggaatgttccaaacttccatcatgtctctcaaggaagaacactcttccgctcagatggccatacgaaaacgcgacgagtccagggttgtcgcctacgtaaaggctaagaagaaaatttccaaggaaatggaaaagctcgtgtctgtcctccgatgtgttcacgtcacacaacatcagcaacattccacgctgcaggttccatcttccgttgtggacgctcaactgagacacgtcatcgcggatgttatgagcgtgactgtgtccgtttccgttgcgctgttcaacgggattggagtgtcgtttgcgtcacgaaggttgtcgtggacgcagatggtgaggttgtcgagaaacggtgggagggagaataataataaggagcatgaaggcattgaagagcttcgaaatggggtgggaatggaaaggcttcagaatctgaagaagaagggtgatgaagaggtgaggttggttctgaagaagatgcgggatttggaggaatgtgtatgtggcatcgaaactgttaccgagaaagttttcagagctttgataaactctcgggtggcgctgcttaacattcttacccttacacagtag

SEQ ID NO: 74376 - DNA, 1578 bp, Glycine max
  Peptide Sequence Number=SeqID_166061
atggcacatcagcgccggcgccaccactattaccaacgcttccgtcacatgattccagtgttttccgccgtcgccgccgcgctattctttctcttcgctctcctttcgtttttagctccttctcccgtcgaaaccgatcgtatccaccggagacgccaacacacttcggttaacgttcaaaaggatgatgcgattgacaatcctgcgttccgcgttccgggtgatggaggaaagttgggacgcgatatctggagttctctaaattcggaacacttctttggatgtagcaattccagcaacaagtttcaaaaagctcaagtgattacacaaccgaatcggtatttgatgattgcaacaagtggaggcttgaatcaacaaagaactgggattacggatgctgttgttgctgcacgaattttgaatgctactcttgtggttccaaaattggatcaacgatctttctggaaagattctagtaacttctcagagatctttgatgttgattggtttatatcatttctgtcaaaagatgtcaaaattatcaagcaacttcccactaagggtaggaaagcattatctgcatacaatatgcgggctgttcagctcagcaagtttgactacaggcttgctaacagatttgaacctgatatgcttgcattttctggatgtgattatggtggaggggagaaggagcagaaggaactgggtgcaataagaaggaggtggaagacattacatagaagcaatcctgatagggcaaggaggcaggggagatgcccattaacccccgaagaagttggtctcatgctaagagcattgggatatggttctgacattcatatttacgttgcatcaggggaggtatatggaggggaaagaacattggcacctctcaaagcattatttcctaatttccattcaaaagagaccattgctaccaaggaagaattagaaccgttttcttcattttcttctcgcatggctgcactcgacttcattgtttgtgatgaaagtgatgtttttgtaaccaataataatggaaatatggcaaaaatattggctggacgaaggagatactttggccataaaccaaccattcgtccaaatgctaaaaaactttatcgattgttcttgaatagaagtaattcgacttgggaagcttttgcttctagtgtccgaactttccagaaaggcttcatgggagagccaaaggaggttagaccaggtagaggcgggtttcatgagaatccatcatcatgcatatgtgaagattctgcagcagccaaagtggacaaaaattcacaatctagaaaatatgggaaggataatacaacgaagaaaaatgtagcaaatgatgaactggatgttgacaatgtgtctgagtggccagacatggatgatgatgacgatgatcagaatgatctagcagagaagggtacattcaatgaaacaatttcggattatgatgctctgaacttcgaggatcccgaaggttatcagaagcgagcaatggaagtagagttagaggacatccattcgaatatagctgcacacaaaattgagtttgctaggaagtag

SEQ ID NO: 74377 - DNA, 456 bp, Glycine max
  Peptide Sequence Number=SeqID_166062
atgctttcagcagttatccgctccgcacttggctacccagcgtttaccgtgggcacgataactggcacaccagaggtgcgtccttcccggtcctctcgtactagggaaaggtcctctcaatgctctaacgccccacaccggatatggtccgaactgtctcacgacgttctgaaccccagctcacgtaccgctttaatgggcgaacagcccaacccttggaacatactacagccccaggtggcgaagagccgacatcgaggtgccaaaccttcccgtcgatcgacggcccttccactcggcaccgtcggatcactaaggccgactttcgtccctgctcgacgggtgggtcttgcagtcaagctcccttctgcctttgcactcgagggccaatctccgtctggcccgaggaaacctttgcacgcctccgttaccttttgggaggcctacgccccatag

SEQ ID NO: 74378 - DNA, 189 bp, Glycine max
  Peptide Sequence Number=SeqID_166063
atgtcacgaaacttcacgtattgtgcaacaaagggtgccaagtacctcgaagcggtcaaacaaatgttgcctgccatcaaacaatggtccccagacgaaattaggataagattcgttggtggaggatgcacgaacaacgctaggcaatcaattcgtggggctccggacttgaaggtggaggatgcatga

SEQ ID NO: 74379 - DNA, 417 bp, Glycine max
  Peptide Sequence Number=SeqID_166064
atgactaggggcaatccaggtgatttacaaccctttgatcctgaaatagatagaacctttcatagattacttaggcatagtgtgcatcctgatcattctatgcattttgagcattctgagtattatgttgctggtgattctgaacattttgattttgagcattcgactactaattttcatactgagaacatggctcaacctccacctcgtgaaaggactcttagggagatggctgcacttgatttcacttatgaaagcttgtgcattcaatatcctgatgaggatgttccatatgttctcaagactggactaatacatttgctgcccaagtttcatggtcttgcagatgaagatcctcataagcatcttaaggagttccatattgtctattccaccacgaaaccccctgatgtctaa

SEQ ID NO: 74380 - DNA, 555 bp, Glycine max
  Peptide Sequence Number=SeqID_166065
atgtgttctacttttaaaaagtttgatatgttaaaatctgttctacttctaaaggctttactaagaggatttgaattagcttctggtgtaaacattaattttggcaaaactcagtttgggattataggtggtggagtcaattgggctctagaagcagctaatatcctgcatcgcagacaactggattatccatttttttttggaggcaaaaatatgtatattaatattaaacagaagaagattgcatgggtatcttggacacaatgttgtgcttctagagatgcaggaggattggggatcaaagatttgagaattttaaataattctctactaatcaagtggaaatggtacatgtttcaccaaccagaacagctgtggaataggatcctgatttctaaatatcagggctgtagaggattggatcaggggcctcacaaacagcatttctccacctggtgggctgacctaaaggcactcaatcaagatcacaatatgactgctatctctaaacaattctgctggaagatgggtaggggtgatcaaattttgttctag

SEQ ID NO: 74381 - DNA, 396 bp, Glycine max
  Peptide Sequence Number=SeqID_166066
atggatcattgccatacttccgatctcatttccctggagcaagcgctggaaaaaatgctcgggcagatcgccccactgcagcagagcgaatccgtcgccctgaccgccgccgccggccgcatcaccgccgcgccagtggtctcaccgctcgacgtgccgccgttcgccaactcggcgatggacggctatgcggtgcgcctcgccgatctggcggccaatgcgccgctgccggtcgccgggaaagccttcgccggtgcgccgttcgacggccaatggccggccaacagctgcgtgcgcatcatgaccggcgcgccgatccccgccggggcggacgcggtagtgatgcagagcagccgaggtgagcgaccagggcgtgcgttttaccgcgccggttga

SEQ ID NO: 74382 - DNA, 462 bp, Glycine max
  Peptide Sequence Number=SeqID_166067
atgggaaatcaacaacgacaaggatatactcaaggaggattttcaggcttccaacagggtccctataatcaacaaggacagtggaggacacaccctggtaaccagttcaaccaagaccatagtgggccttcaaacaggccaatccaacaaggacctaacatattcaagaggactactaagctagaggagaccttgactcagtttatgcaggtaacaatgtcaaatcataaaaacactgagtcagcacagaagaaccttgaggtccttgtgggagaactggccaagcagatagctgacaagtcatccaacaattttgtggcaaataaaaaacataatcgcaaggaggaatacaaagttgtgatgacaaggagtaaaaggtttgtggaggtagaggatgaggaaagtgttgtgcataagaagaaaactgctgacaagaaaggtactgattgcaagaaaaatgag

SEQ ID NO: 74383 - DNA, 153 bp, Glycine max
  Peptide Sequence Number=SeqID_166068
atgagagaaagtgaaggtaggagtgatggcttggaggttccttcaaaggctgtgagtgagtatagagaaagagaagtaggaaaaaaagtggcatcattttcgaaagtcgcctctaatgatagcgcatgccaaaaagcaatgaaggcaccatag

SEQ ID NO: 74384 - DNA, 576 bp, Glycine max
  Peptide Sequence Number=SeqID_166069
tgggttgtacatcgaagaaaatcatcaccgcctggttgccctagaaagactttatgagagattcacaaccgttcacaacattcctttgttgcacgatcaagttaaggttggttttgatgaggttagagatgcaaatgctcctattcctgtacccactgaagaggttaagttagtggggcagacacttaacaccttccttgcttggccgacatatcttgtcaagcgtttatcagaacaggttatgtgggatgctaccgtgtttggggtgtataataacaacttccccttgtacaaaaagcatgaagatctatcagaaattgcacatgatgcggagaatgccgatgtgtatggattccctgagccacagtctatacaaagatctgggcaatcgcaatttgaatcagaaagttatattaagaactggatgcagaattcaaggagggatgtgtacttaggagcctacttgaatggtgcatattggaaaatggtcatcattttgcctaaggaaaatgttgtcatctggttttgttccttgcataatagaccagaaaactacctcaaaggaataatgaacaa

SEQ ID NO: 74385 - DNA, 201 bp, Glycine max
  Peptide Sequence Number=SeqID_166070
atggaggaaacaaatggacaagaatgtgaagaacaaggaattaaagccttggatcttcttcatcaatggagtcctttgcttcttgaagatcaatggcagcagaattggagaaggaagaaagatgataagagatgccacttcaaggagaagatgagtcaaaaacaagctcgctaccataggaagccatggataagagcttga

SEQ ID NO: 74386 - DNA, 1252 bp, Glycine max
  Peptide Sequence Number=SeqID_166071
atgagtgggaatgtgcaatgttttgcattattttcgctttacccaaaggattatgaatttcgtagttttgaggtagttaggctttggggtgcacttggtgtccttgcatcacccagaaaaaatgagacactggaagatgttgtcaaacagtatctggatgaattactctcaagatctttccttcaagattttatcgattgtggcactttttatcaatttagaattcatgatttggtgcatgatcttgctgtatttgttacaaaagaggagtgtctacttgtaaattcccacattcaaaatattcctgagaatattcggcatctgtcttttgctgaatacagttgtcttggaaattcattcacctcaaaatcggtagttgtgagaaccataatgtttccaaatggtgcagaaggaggcaacgttgaatctttgctaaatacctgtgtgtcaaagttcaaattattgcgagttttggatttaagttattcgacatgcaagactttgccccgttccattggtaagttgaaacacttgagatatttcagcattgagaataatcgcaatatcaagagactccccaattctatttgcaaactccaaaatttgcaattgttgagtgttcggggatgcaagaagctgaaagcattgcccaaagcattaagaaaattgattagtcttcggcatttgaagataactacaaagcaacctgttttgccttacagtgagattaccaacttgatctcgcttgcacatctgtctattgaatcaagtcataatatggagtctatctttggaggggtgaagttcccagctcttaaaacattgtatgttgctgactgtcatagtctgaagtctttgccactggatgttacaaattttcctgaattagaaactctgattgttcatgactgtgttaatctggacttggatctgtggaaggaccaccatgaagaacaaagccccatgttgaagttaaaatgtgttggattggggggtttaccacagctggtggccttacctcaatggcttcaagaaactgccaactccttacagtccttgggtattataaactgcgacaatcttgaaatgcttccggagtggctgtcaactatgactaatctgaaatcacttgttatatcagattgtccagagcttatatctctcccggataacatccatcacctcaccgcacttgaaaggttgagaattgcctattgtcctgaactatgtagaaaataccagccccatgtcg

SEQ ID NO: 74387 - DNA, 633 bp, Glycine max
  misc_feature (613)..(613): n is a, c, g, or t
  Peptide Sequence Number=SeqID_166072
atgttattgtataaaagatcatgggctctccacctgcctccactcctcctcctcctcctcctcctcctcctcctcctcctgtccactagaccacctggtgctaagagaccagtggtgcatgtagatcctgctaccgggaaggccaacagtccccacaggaagaaattaagaacatatttggggattgtggcgcgtgataaggtggacgtcacctacgagaactggaaggaggtccctactgctcagaagtacctgatttgggaggatattcaggcggaatttgatatcccagaggcttctgacaccgatcaggacggtgtcgaggacactgtctgtgagaaatatgacatcagcaaggaaaagtgggcccagttttgccagactcgcagagacctttcttgggagaagcagaatactgccccccacattttgtctcgtgggggttatgattatttggagcagaagctcctggctgagaagacaaagaagaagctagaggaagctgcacagttaggaagcgttgatggcgtcatcgaccttccatccccggtcagacgccacgtgaagtggaagatggcccgcacgaagaagacaggggagatgacgactgagnccgcaaaggaaatacgttga

SEQ ID NO: 74388 - DNA, 468 bp, Glycine max
  Peptide Sequence Number=SeqID_166073
atggtgaggagtatgattgatactgctagtggtggaactcttggtgatatgactcttgttgaggctaggaatttgattgagaagatggcttccaactcccaacaattcagtgcaagaaatgatgctattgtccttagaggagtccatgagcttgccatgaatcaaaaatctgcaactgcacctgttgcaagagtctatggtctatgttcttctgcagatcaccatacaaatctttgttcttctttgcaacaatctggagtcaatgagcaacctgaagctcatgctgcaaacatttataatagatcccctcagcagaaaaaccaacaacaacaaaataattataacctttcaagcaacaaatacaatccaggttggaggaatcatccaaatctgagatggacaagtcctccacaacaacatcagcttgtccctcccttccagaatgctactggtccaagcaagccatat

SEQ ID NO: 74389 - DNA, 288 bp, Glycine max
  Peptide Sequence Number=SeqID_166074
atgttttccaagaaggagggaatgatgagaatcatgaaactggccaaatacaagctaaaggcccaagtggagaaggacgaaggcccaagtggagaaggacaaagcccccgagtggagaaggatgaaggcccaagtaatccttgtggcgtctaccctgacttatcttccttcaccggaagtggcgtctaccctgacttatcttccttcaccggaagtggcgtcatccaaaacctccgtagcctgtatcaaacgatccgctcctactcaggttcacatcaagaatcctag

SEQ ID NO: 74390 - DNA, 107 bp, Glycine max
  Peptide Sequence Number=SeqID_166075
atggcgaagaacatccacggatttgatcacgaaaacgtcacggaagcgttacggaagcgcctcggcttggatttttccttctttcttcttctcctcactaattttaa

SEQ ID NO: 74391 - DNA, 294 bp, Glycine max
  Peptide Sequence Number=SeqID_166076
atgtaccctctcttgttcttagtcacaacaacccaagtagatgtaccctctacttgtaccacaaaggatgtaccctccaatgtgttaagacaaagttctcaggcgggagaagggagacacaaaagaattcaggtgcttagtcctttgttcttttggaaaagggagaagagagacacaaaaagaattcaggcggttagtcctttgttcttttggaaaagggagaagagagacacaaaaagaattcaggtggttagtccttggcaaattcattttggcaaagggagaagggaatga

SEQ ID NO: 74392 - DNA, 324 bp, Glycine max
  Peptide Sequence Number=SeqID_166077
atggcctgcaacctttgcttgaccgcttcgaggtacttaacacccattgttagggtgttccaacagaaggcggtgccttctggtggaagcaacccagctcgcctgggcgagctaggcggcaaccacctccctcttttcccctataaattggggaaagagggcagagtaatttcgttcagcccttctggtgtcgcaacctacccttttgccgggcgagcgaggcaaggctcacgggtgtgtcttccaaaggaggaaaatgcgcggagtcgccaccaacgtttatttatggaaaacgtcagaaaaaccgaaggaaaccggtcctga

SEQ ID NO: 74393 - DNA, 129 bp, Glycine max
  Peptide Sequence Number=SeqID_166078
atggctttttccgaaggggccctagtgcttaccaacatggatggcgaggagctacctttacccgtgaattctgatattgtcaagggtagaatcgtcttaggcagtggtcagatgccgggacgaagctga

SEQ ID NO: 74394 - DNA, 429 bp, Glycine max
  Peptide Sequence Number=SeqID_166079
tacaatctaaatcccttaacgaggatccattggagggcaagtctggtgccagcagccgcgttaaaaagctcgtagttggaccttgggttgggtcgatcggtccgcctccggtgtgcaccggtcggctcgtcccttctgccggcgatgcgctcctgtccttaactggccgggtcgtgcctccggattctgatcctattgtgttggccttcgggatcggagtaatgattaacagggacagtcgggggcattcgtatttcatagtcagagataccgtcctagtctcaaccataaacgatgccgaccagggatcagcggatgttgcttttaggactccgctggcaccttatgagaaatcaaagtctttgggttccggggggagtatggtcgcaaggctgaaacttaaaggaattgacggagggcaccaccaga

SEQ ID NO: 74395 - DNA, 405 bp, Glycine max
  Peptide Sequence Number=SeqID_166080
atgggtttaggagaagaagtattagctcaagaagatgagaggggtagatgttttgagcctgaaacctctgaggatgagtggcagaagtctcgaactagatctcttaggagaaaagcaatgactgcttcaaccagactcgcttatagtctcaggaagcgtaatacacgtgtagcaaatagtgactttgcttcaattttcatagaagatgtccgcgatgctaacgaggaaaaagctgtgaattcatttcgtcaggtgctacttacaagagatctgcttccagattcccatgatgattatcatgaaatgctgagaaagttcgacattgaaaaaaaagtccagatgtgggcagatatgttgcattggaggaaggagtatggagtagattctattttacagaaagattga

SEQ ID NO: 74396 - DNA, 279 bp, Glycine max
  Peptide Sequence Number=SeqID_166081
atgggaggggccacttgtgctgccagatctctccaccgctatgcgtactctttaaagttgtcgcaacctacccttttgcgggcgagcgaggcgaggctctcgggtgcgttttccaaaggaggaaaatgcgcggagtcgccaccaacgtttatttgtggaaaacgtcggaataaccgaaggaaaccggtcataaagaatattccaaattcgggagttgtatttacgtttgaggaaggtattagcacctctcacgtttgtcccaaaggacaacaaccttag

SEQ ID NO: 74397 - DNA, 216 bp, Glycine max
  Peptide Sequence Number=SeqID_166082
atgggtgccaagtacctcgaagtggccaaacgagggtcgcatcccaacaacggatggtccccggacgaaattaggattatatgtcatcatcacgacatttgtattagtgtgtcccatgtaactgcatccccgtactcgttgtcgtttacactgagcatctttcgagaaaagacgaaacatggatcgaagttggatgaaagcaaaacgcatcagtga

SEQ ID NO: 74398 - DNA, 675 bp, Glycine max
  Peptide Sequence Number=SeqID_166083
atggacaatggagatggaatagccgtcggttggttaggacatcctgtctttagagataaagaggggcatgaactttttgtacgtcgtatgcctactttttttgaaacatttccggttgttttggtagatggggatggaattgttagggccgatgttccttttcgaagggcagaatctaaatatagtgtggaacaagtaggtgtaattgttgagttctatggtggcgagcttaatggagtcagttatagcgatcccgctactgtgaaaaaatatgctagacgtgctcaattgggtgaaatttttgaattagatcgtgctactttgaaatcagatggtgtttttcgtagcagtccgaggggttggtttacttttggacatgcttcttttgctctgctattctttttcgggcacatttggcatggtgctagaactttattcagagatgtttttgctggtatcgacccagatttagacgctcaagtagaatttggagcattccaaaaacttggagatccaactacaaaaaacagttgttgcgagggttgcccaaaggcaatatataaggcatacccagtaaaacttacaagtaaaccagatatagagatggcaattagggttgctgtttccattattagaattctaaagtttcaagatcacaatagatctataggataa

SEQ ID NO: 74399 - DNA, 369 bp, Glycine max
  Peptide Sequence Number=SeqID_166084
atggatgctatccttcatctccatcaagaacaccaagctaatgttcatagctccttagaaaacattacaactaggcttgagaacatagaaactaggctatcccttagtaacctcttgaacctaaatgaggatgaagcatatctcttcttaagtgttaaggaattgttcaggataagactaaggatcatgtcttcaatccaatctcaagactttccaaatgcactcaatgtcgtattcaagtttagcatcatcaaagccaaaaagggggagattgttagagatagggggagcaacatggtgaacaacctaaggctaaagcttgtgaagcttgaagaagttttgaataagttttggcttttacatgcctaa

SEQ ID NO: 74400 - DNA, 63 bp, Glycine max
  Peptide Sequence Number=SeqID_166085
atggcgaccctacaagggtgcgcattgatgcgcaccggcattaacagggtatttttgaactga

SEQ ID NO: 74401 - DNA, 675 bp, Glycine max
  Peptide Sequence Number=SeqID_166086
gctgaatttgatgtccctgaagcatctgacacacttgcagcctacaaggataatgtggatgacactatttgtgaaaaatatggccctccatctcccatcagacaacacgtgaagtggaagatggcccgcaccaagaaaactaggcagatgatgtctgaggcagcaaacaaaaatgctgagaagattgcatcacagggttcctttgtcccccatggacgtgaggatgtcctcactgctgccattgggcgaccagaacaccctggtcatgtgcgtgttgctggagtcggtgtaaccatcaagcaatactttggatcagctacatggacctcccacacttcttcctccatgactccagaagaactaaagcagctaactcaacaaattagggaccagctggaggagtcgatcacaaaaaaacctaaggttggtccctcagctgctcgtgtcagcacaaaggggagttgtgttgatccctcaccaactgatcatgacacgggtgactcagacaaatgcgggttgtacatcgaagaaaatccttcccgtctagttgccttaggaagaatttatgagggatcaatagcggttcacaacatccctttgttgcatggccaagtgaaggttggtgttgaggaggttaaagatgcagaggctctcgttcctgtacccactgacgag

SEQ ID NO: 74402 - DNA, 60 bp, Glycine max
  Peptide Sequence Number=SeqID_166087
gttggttgagtctatttttcagccgatgttggctagatttttttaccaacgtgggctagg

SEQ ID NO: 74403 - DNA, 438 bp, Glycine max
  Peptide Sequence Number=SeqID_166088
cagaagaagggcatggaggagcaccagaaggggaagctgcagggcaaggaggaggtgcggttccgcggcgtgaggcggcggccgtgggggaagtacgcggcggagataagggatccatcgaagcaagggtcgaggctgtggttggggacatttgacactgctgaagaagctgctagagcttatgatcgtgcagcttttaacctaagaggtcatcttgcgattctgaattttcctagtgagtactattctcagataaggggttcaccaccatatccaccacatttagcaacaccctcttcctcttctcatgccagtgaaagcacttcttctgctgcacaacaaaggcatgtttttgagattccgtgtttggatgataaggtgttggaggatcttcttggtctatcagaggaacacaagaagaaaaagaagggagattga

SEQ ID NO: 74404 - DNA, 831 bp, Glycine max
  Peptide Sequence Number=SeqID_166089
atggcagtcgcaatagcgctcatcccaccatccgtcatattgtttatggggggtggctgctccgcgccgctatctaggattgactacttagcatatgacatgaatcacatgatgaatattagtattgatttttttgacttaatcatagtttggtctgtggcagatacattgcatcgattttggaagaaggagcatgactggggatggaaaaagtttatggaactgtctaaggtgtatgatggatttgttgactcttcggacaatctaataataaaggctcaagttcaagtcataagggagaaatcagacaggcctttccgttgccttgattgtcagtataggagggaacttgttagagtatatttgacaaatgtagaacaaatttgtcggcgttttgtggaggagagaagaagcaagcttgggaagttgatagaggataaagctaggtggtcaagcttctttactttctggcgggaaattgaccaaacttctaggcaccacatgtctagggagaagacagatgtaattttgaaagtagttgtaaaacacttctttatagagaaagaagttacttctactttggtaatggattccttgtttagtggattgaaggctcttgagggccagaccaagagtaaaaaaggtagggtgaagttgttggatgctgaagaaataccagcaccaatagttcatgtcgagaaagatatgtttgtattggtggatgatgttttactgctacttgaaagggctgcaatagaaccactgtctcctaaagatgagaagtgtcctcaaaaccgtacaaaggatgtcacttggagtcaaattacatag

SEQ ID NO: 74405 - DNA, 228 bp, Glycine max
  Peptide Sequence Number=SeqID_166090
atgtggtcgcaagggacagaattttggttgatggcacgaataaataggaaaagtcagtatgacctcggtaatagttgtcccaagtcaataatgcttaaaataagcaatgttaacttgagagtgttaagattaagcaatgctaacttaagatttaagcctaagacactcatcaaatgggctatacacgatgattttgtgacagagatagggaaagaaaggagaaaataa

SEQ ID NO: 74406 - DNA, 1620 bp, Glycine max
  Peptide Sequence Number=SeqID_166091
atggagttgtggaagctcttcgtaactgcattaatgccagttcttaaggtgctcctcattactgctgttggcacatttcttgctctgcaccgctttaatatactgagggagagtgctaggaagcacttgaatacaatagtatactttgtattcactccggctcttgtttgcagcatcctggctaaaactacaacatttaagagcctggttgcggtgtggttcatgccattgaatattcttctcacatttatcattggaacaacactaggatggttgtttatgaaaataactaaagcacctcctgatatgcaaggccttgtgttgggatgttgtgctgcagtctgtaaagaaagcagtagtccttttggagcagtggatgtttgtaacaagaaagggatggcatatgcctctttgtccatggcagtaggacacatctacatttggactttcgtgtacaacattatccgcgtatattcatgccggatttttaatgtgaacaaggttgatgattccacagtaggtccagcagcaatagaaacagatcttgaaaactattcaactagaccagtggttactgcagaggatctctcacagaccaatgatcatgtgagtcaatttggaagtgaatgtgcattgcctggtggaagagataggatgagtctgtgtcctaatatatttggaaatgtggatacattatgtgcacttgtacttcaaattcttggtctaataattggtgtagttcctccgttccaaaagatgtttgttggagatgatgctcctttacgtgtgattgaagactctgcatccatgctaggggacgcatctattccggcaatcactttgttggttggggcaaatcttctggatgggttaaaacggtcaggaatgaagctttcacttgttgtgggaatcattgtggttagatacattgctttaccaattttaggtgtgggcattgtaaaaggagaaactcactctgcttcggcaccagaaaagcaaccgctttggaaacccctctccccttttggagcaaatttccggagttcttcgtttcatggtgcggaagaatgtgcagtatgtaaagaatgcagtagtccttttggagctgtggatgtttgtaatgaaaaagggatggcatatgcatctgtccttggcagtccagtgtcagcaatagaaacagatctcgaaagccattcaactgtaccagtggttgcttcagaggttctctcagagaccaatgatcatgtgactacgctgcctggtggaagagctaagattcttggtctgataattggtgtagttcctccattccgaaagatgtttgttggcgataatgctcctttaagtgtggttgaagactctgcatccatgctgggggaggcatccattccagcaatgactttgctacttggagcaaatcttctgaatgggttaaaacggtcaggaatgaaattttcacttcttatggggatcactgtgattagatacattgccttaccaattttaggtgtggtcattgtaaaaggtgcaatccattttggcattatccatcacgatcccttataccagtttgttttattgcttcaatacgtccttccacctgcaacaaggcgtcaatga

SEQ ID NO: 74407 - DNA, 303 bp, Glycine max
  Peptide Sequence Number=SeqID_166092
atggatactaagaagtcaaccaaggatactaatggttgcgtcaacaagcctatggctctgactatgactctgactgtggcttctttagagggtagaaaggttgaagatcgcaataaagaagatgatagtgattccaattctttgttgccactgagaaaaggaggaatttcacggaaatcggataagacttataggaaaaggaaagtgcagtggaacgataggataggaaacaagcttgttgaggttttggaatatgagccaagagcctcagatacatcacagtcacatgttgtaaataaataa

SEQ ID NO: 74408 - DNA, 1544 bp, Glycine max
  Peptide Sequence Number=SeqID_166093
ttgaggccaggcgagttttcgataagatgccggtgaaagatcttgtttcgtggaatgcaattttgtctgggtgtgtcaatgcccgacgcattgaggaagctaactccattttcagggagatgccggtgaggagcctgttaacgtggactgtgatgatatcgggcttggcacaaaatggttttggagaagaaggtttgaagctattcaaccagatgaagttagagggactggaaccgtgtgattatgcatatgctggagcaattgcctcttgttctgttcttggatcattagacaatgggcaacaactacactctcagataatccaattaggtcatgattcaagcctctcagttggcaatgcactgattacaatgtattcaaggtgtggtcttgttgaagctgccgatacagtgtttctcacaatgccgtatgtggattcagtatcctggaatgccatgattgcagctcttgcacagcatggacatggtgtccaagcgattcaactttatgaaaagatgttgaaggaagatatattacctgataggataacttttctcacaattctttctgcttgtagccatgcaggtttggtcaaagagggacgccattattttgatacaatgcgtgtttgttatggtataaccccagaagaggatcactattctcgtttgattgatttgttatgtcgtgctggtatgttctcagaagccaagaatgtcactgaatcaatgccttttgagcccggtgcaccaatttgggaggctcttcttgctggttgttggattcatgggaacatggaattaggtattcaagctgctgatcgactcctagagcttatgccacagcaagatggaacctacataagcctttccaatatgtatgctgctttaggtcagtgggatgaagttgccagggtgagaaaattaatgagggagcgaggggttaagaaggaacctggttgtagttggattgaggttgaaaacatggtccatgtctttttggttgatgatgctgtgcaccctgaggtgcatgcagtgtacagatatctggagcaactggtacatgaaatgaggaaattgggttatgttcctgatacaaagtttgtattacatgatatggaatctgaacaaaaggaatatgctttgtctactcatagtgaaaaacttgctgttgtttatggaattatgaaactccctttgggagctacaattcgggttttcaaaaatttgaggatatgcggggactgccataatgcattcaagtatatttctaaagtagtggaccgagagataattgtgagagataggaagcggtttcaccattttagaaatggtgaatgttcttgtagcaactactgtctaaaggatggaaatttgccttctactaatccacctctattgcacatggacgacagagttcattattgctatatcaagtcattaaccattttcaacttttgcttcaagcgtttgttagctttaacaattgcatcaggcactgtaattcaattcagtggtgctcagtttaaatgcccaggcagatga

SEQ ID NO: 74409 - DNA, 309 bp, Glycine max
  Peptide Sequence Number=SeqID_166094
atgtccatgttcgtggagcgtaacagtgacagtgcctcctcctcattcaaaccaagggtcgaagggactcacttggattcaactttggagaagctgtcaacagtcaaactactaactcatcggacgcgctgtcggtgtccacgcttgggtcacgccaggcctacaggcgcattgggtcgcgctctgcgtgcaggcgcattgacccgcgctcttggtgtaggcgtcttggctcgcattgcggtgacagacacatcgttattttataataatataaaattgttaattgttgttgaagataattatagataa

SEQ ID NO: 74410 - DNA, 522 bp, Glycine max
  Peptide Sequence Number=SeqID_166095
atggcaagaggaagaaggcaaacatctggtgactggaaagacaaccgtgtgcactgctctagcagaagccacccagctccgccacatcaatatatattgagcttagaattggagattatgtcagggttcctttcattggtatcaaaggtctgtgatgaacttgaggatgttatggaagcggggggaaacattgtggactaccatggctgcgttttctttcctgagcgatggtttaattgtgtggttgtacttcaaactgataacaccattttgtatgatcgtttgagtaggagtggtttcattatcatagcttactttccccgtatatgtgacagagggtacaaagattcaaagctttcaaacaatattgaatgtgaaatcttccaagttctgcttaaagaaagttactcggaggagaaagtgattgcaatgaagagtgataatattgaagacattagtagaaacgatgcaactctgacagattgggtcagaaattggtccttaccctcacaaacttcttaa

SEQ ID NO: 74411 - DNA, 1722 bp, Glycine max
  Peptide Sequence Number=SeqID_166096
atggttgctgaagcttggattgtgaagatgggtaaccaggtaagcgccaatctcaagcacgctcttcttctcgaaccttccgcaaagagaaaacacaaccccaaaagccaagataataaagaattaattgggattctttcctttgaagtcgcaaatgtaatgtctaaaatcgttcacctccacagatccttgtcagagcccgagatcgtgaagctcaaaaacgagatctcgaactcacagggtgttcaaaaccttgtttcctcccaagagggttatctcctcgggctggctcgagcagagaagcttgaggagttaaaccgcgtcgctaacgtggtttctaggttgggaaaaaagtgttctttgcccgctttgcaaggctttgagcatgtttatggggacattgttagtggagtcatagatgtgagggaattggggttcctagttaagcacatggaaggaatggtgaggaaaatggataggtatgttagtgctaccaggagtttgcacagtgaaatgggggttctgaatgatttggagcaagcggtgaagaagtttcagcataacctgcatgaggagagtagaagggcgtttgagcagaaacttacatggcagaagcaagatgtgaggcatctaaaggagatttcactttggaatcagaattttgataaggttgttgagttgttggccaggacagtttgtaccatttatgctagaatatgtatgatctttggtgattctacatggagaaaaagtaatagtcttgggcttagtggaggttctccaagtccaacattgcagaatgagtgtgggttagtgtctggccagattagtgttcctgtgagttctgagaagttgaaaagcaatcatggcaagagaaatggaagaactgctgtggagacaagggaaactattagtaggcctatgaggagaggtgaattagcatatcttcaaatcgaagattttggttttccttgtggaacaagtccggggagacttttcatggattgtctgagtttaagcagctcggaccaacacgatcgtggatcaatcagtcagagtatcggtgttgggaataaggccaagaaaagggatcacttgtaccattctggttgtccaaatcatgttcaaagtggtgttcctttcactgaagatctgagttgctcaacctttggtccccaaagtagattatctgtttatgctcctccttctactctaggaggatgtgctctggcattgcactatgccaatgtcataaccgtcatggagaaactcctaaggtatccacatttagttggcgaggaagctcggaataatctatatcagatgctaccgacgagcttaaggttgtctctgaaaggcaaacttaagagctatgtgaagaacttggccatatatgatgcgcctcttgctcatgactggaaggtgactcttgatgggatactcaagtggcttgctccacttgcccataacatgatcaggtggcaaagtgagaggaattttgagcagcaccaaattgttagcaggacaaatgtgctgctatttcagacattatactttgctgataaggacaagacagaggaagctatatgccagcttcttatgggactcaattacatatgccgttatgaacaacaacaaaacgcgttgttgggttgtgcaagtagttttgattttgaagattgcatggaatggcaactgcaatgtggagcttttcccagttga

SEQ ID NO: 74412 - DNA, 705 bp, Glycine max
  Peptide Sequence Number=SeqID_166097
atggcatccaggaaaagaaaaagcaccacttacaagcctcaagctcagaatgttaagatttatcatactgaatttgacgagtttaaggcagagttggagaggcataacttacacaaacgcctcaccaatttccaagatggaagcatagatgtaattgtggtgaaggagttttatgccaacttatacagcccgaaagaccagagccctaagcaagtgagggtaagaggacatttaatcaagattgatgctaacagcctgaataccttcttagagaccccagtagttttggagaagggtgagacactgcctacctattccagatttacaaggatgaggattgatcctcaagagttttctggtcatctttgcatccctgacatggagtgtcctctcctacagcaacctgactcccacttccccacctctgatcttaatatggacaaagccaggttggtttacaatttagtcacaggcatggacatgaatatcatagccctaatctcaggtcagatttctaccattgcccagagtaactcctctaggctcgaattcacaaccttgatcactgctctatgtggagctagaggagttacctctaacagtctgacctatgagagcctgatcctggccattaacttggcttacattaagaaaaattgttggaatgtggatgatctgacaattaacttcagaggggctaggaag

SEQ ID NO: 74413 - DNA, 372 bp, Glycine max
  Peptide Sequence Number=SeqID_166098
atggctgcaagtgacattgctattctcagagataaaactcacataccaacaaagaaaagtcttctggaacttacatctcaagatgtgttgttggcacagaacaagtttttgtccaagcaattagaagcattgaccaaaacactaaggtgtgccatctgtggtagagctcacaattttggctgctgtatccccaatgaagaaccagctcataaagtcaattatatggggaaccagccaacacaaaatttcaatgcaggtggatattctggatttcagcatggcaaaccatataattcacagcagagacaatggaaaattcaccttggtaaccaattcaacaaagaccagggtggtccatctacaaggccataa

SEQ ID NO: 74414 - DNA, 426 bp, Glycine max
  Peptide Sequence Number=SeqID_166099
atgatggcacatcaaaaccccccatacttagccttttgcactcctgggcaaaatgaaacaaagaacaaaatccaaggatatcaaagggagacaaacaaaaacattcacatatttctcaatgaacatcagggaatgaaaggaatggaaaaagtgaaaaccaagggtgctccaaaaaaaccgcttgccaaacaacaaaagtcaacaaaacgcgattcttcttattgggagattctatttgtcgcaacctacccttcggcgggagggcgacgcgagactcgcgggatgcgtgttccacgaaaggaatacgcgcggagtcgccaccaacgtttatttgaggaaaacgtcggaaaaactggaaaagacgcgatctacgaacttttaagtgaaaggttcgggagttgtatttacgcgcggggaaggtattag

SEQ ID NO: 74415 - DNA, 705 bp, Glycine max
  Peptide Sequence Number=SeqID_166100
atggtgcaaaagaaggacaaggaactcagaggcagtaacaatgagcccatcggcgactaccgtagatggttgaaagcccacatgcaaggtctggattggctcccgagtttgagaaccacgaaagggatggaagttgaagggctggaggaagacgaagaggtggaggccctcagggcagaacttgagaaagcccaaacactaccaccaaggccttggaacgagagaccaaaagggcctgtagggaagaacatggccggaacaaattctgaggggctctgtgggggcaataacagcgagcttaagctctggagagaggaaagggaccaatcacgagtagacaatttgatcttgaaggatgagttaaaggtttgcctaaggtccaagagaagcttgtctcagcggttatgcgagacagagaccaacatgttagccatcatcagcaagtaccaagaagaattaaatctagccacggcccacgagcacaaagtggcggacgagtatgcccgagtgtacgtagaaaaggaggctagaggaagggtaattgactcgttacatcaagaggcaacaatatggatggaccgatttgctcttactatgaacaggagtcaagaacttccccgatggctggccaaggccaaagcaatggcggaaacctactccgcccctgaggagatccacatcttctcagctattgccataatatga

SEQ ID NO: 74416 - DNA, 621 bp, Glycine max
  Peptide Sequence Number=SeqID_166101
atggcatccatgatggaagccatgctaagcatgaaaagactgatagaaagtaacatggccatggttgcctccaccagcaccgtcgccaaggcagaccctactcatctatctaccacgaatgatgcgcatcaacccgcctcggacatggggggacgaggaggagagatattggggagcaccgacagcctacatctggggtataacataaatgcctacccttacggcttaccccccaatttcacactgcccaccatgcatgagaacgtggatcatgccgttcctataaccttcaagggtcagcttccccaacccatagggggcacccgtaaagagccacaggagcgtgcccaagttgacatcgactcatacccctcgttcaccaccaagggaccgacattccatgccatgcctcagcctaatactgtgggagcctttcaaccacgcccgatacaaccactacatttctccgtagggggaccacctctgacaacggaaggaaaaggaaaacttgatctcatcgaggagagattaagagcggtcgatgggttcagtgattacctttttgctaatatgaccaatttatgtttggtatcggatgttgtcatccctcccaaattcaag

SEQ ID NO: 74417 - DNA, 237 bp, Glycine max
  Peptide Sequence Number=SeqID_166102
ggtgaggaattttgctacacccgattggatgaaattgtggatgttgtcgccgtcgacgaggatgacaacctgatggacagggtccaaggagaactcaaggtcctcgtttgcgatgagaagcacaacccctattcacggcagactgacatctcctccgctgtgagtctcttgacgggaagcttagacgaaggggtagaaaaaaaggtcgagggtttaggcaacaagggtgaatggtga

SEQ ID NO: 74418 - DNA, 54 bp, Glycine max
  Peptide Sequence Number=SeqID_166103
atggaatttcctttaggaaacaaagaatttgaagaggccatgaatcttgaagtg

SEQ ID NO: 74419 - DNA, 151 bp, Glycine max
  Peptide Sequence Number=SeqID_166104
caaagatgatgacaaaggtgatgacaaaaagctcaaaggtcaatcaaagaatgtcaaggatcaagcttccaagaatcaagatcaagattcaagactcaacagaagacttaatcaagataagtatgaaaaggttttttcagaaactgagtag

SEQ ID NO: 74420 - DNA, 51 bp, Glycine max
  Peptide Sequence Number=SeqID_166105
atggagatcaaaattacaaaggagcaaatcaagggtcttgttgtcgtttaa

SEQ ID NO: 74421 - DNA, 336 bp, Glycine max
  Peptide Sequence Number=SeqID_166106
atgtcttcagtcattgcatgccttcaaaggcgacaatgtcctcatttacatttcgaagacaaaaatgtcttcagtcattgcatgccttcaaaagcgacaatgtcctcatctacatttcgaagacgacaatgtcttcattcattgcatgtcttcaaaggcgacaatatcctcatctacatttcaaagacgaaaatttcttcagtcattgcatgccttcaaaggcgacaatatcctcatctacatttcgaagacgacaatgtcttcagtcattgcatgccttcaaaaggtgacaatttcttcatttgcattttgaagacgacaatgtcttcaccttaa

SEQ ID NO: 74422 - DNA, 273 bp, Glycine max
  Peptide Sequence Number=SeqID_166107
atgcagagaaactcgcttgcttcctctagcgacacttccttcttgccgcagccatcccttttctctggaagacctttcactggtgtcgcaacctacccttcggtgggagggcgacgcgtgactcgcgggatgcgtgttccacgaaaggaatacgcgcggagtcgccaccaacgtttatttgaggaaaacgtcggaaaaaccggaaaggacgcgatctacgatcttttaagtgaaaggttcgggagtcgtatttacgcacggggaaggtattag

SEQ ID NO: 74423 - DNA, 765 bp, Glycine max
  Peptide Sequence Number=SeqID_166108
atgccttatcatctggttaaagagtacggcggctgggctaatcgcaaagtggtcgatttctttgtgcgcttcagtgacgtggtgatgacgcgctatcgccacaaggtgaagtactggatgaccttcaatgaaatcaataaccagcgcaactggcagtatccgctgttcggctactgctgctccggcgtcgtattcacagagcatgaaaagccggagcagacgatgtatcaggtgatgcatcaccagttcgttgccagtgccaaagtggtgaaacgcggccacgaaatcaacccggatttccagattggctgcatgatcgccatggtaccggtctatccgttctcctgccatccggatgacgtgatgcgcgcacaggagtcgatgcatcagcgctacgtgttcagcgacgtgcagatgcgcggcgcgtacccggcttatacgctgaaagagtgggcgcgcaagggctatcacattgcgatggaagccgatgacgccgaaacgctgcgtcagggctgctgcgattacatcggtttcagctactacatgagcaacgcggtggacaccaaagccagcggcgtcgacgacccgatcaccggcttcgacggcgtagtgcctaacccgcatgtgaaagcgtccgactggggctggcagattgatccggtcggcctgcgctacgtgctcaacgcgctgtatgagcgctatcagaagccgctgtttatcgttgagaacggctttggtgccattgataaacacaatgctgagggc

SEQ ID NO: 74424 - DNA, 406 bp, Glycine max
  Peptide Sequence Number=SeqID_166109
aggactacacgtcctcgccatcagaggaccacgcgtcctcgcctttagagggctgcacgccctcgccatcagaggactacacgtcctcgccatcagagggctgcacgccctcgccttcagagggctacatgccctcgccatcagaggactacacgtcctcaccttcagagggctacactccctcaccttcagaggactactcgtcctcgccttcagagggctacacgccctcgccttcagaggactacacgccctcgccttcaaagggctacacgcccttgccttcagagggctacacgccctcaccttcagaggactacacgtcctcgccttcagagggctacacgccctcgtcttcagaggactacacgtccacatggttgcgtgcatgaccagttttgtataa

SEQ ID NO: 74425 - DNA, 712 bp, Glycine max
  Peptide Sequence Number=SeqID_166110
gaaaggcaagactcgccaaagaaaagttcaagtcacccgctacacacatccggaaagaagtgcactgagttacaagaggaaaacgcggccactgcaagagcccttgaacaagaaaccaaaagggcccgcaaggaggaacatggccgagataaattttgaggagctttgtagggaagagttagctgcttacgcaagatccaagaggagtttggctcaacacttggaagccacggagcaaagcatgctagctatcatagggcagtacaaggaagagttaaaccagtctgtgacccacgaagaaaagctagtagaggatttcgcacaagcgtacgccgaaaaagaagcaagagggagggtgattgatgcattgcatcaagaagcgactatgtggatggataggttcgccttgaccttaagtcaagacctcccgcgactgctagccaaagtaaaagccatcgctgaagccgacctattggccttaaaagatcaaatggcttctatcacggaggccatgctaaaactccagaaaactttagaggataatgccacggtgaccgcctccaatacagttagggaagcggaaccggtgctacagcccgccataaacttgggccgagatagaaacacaacggtgttcggtcggaggtacagtccgcaagcttacccttatggcttgcctcccgacttcactccccgtgccgctctggaagat

SEQ ID NO: 74426 - DNA, 213 bp, Glycine max
  Peptide Sequence Number=SeqID_166111
atgccttccaagattattttgatgatgccaaagaatcaagagttaagaaaattccaaagattcaagaatcaagtttcaagaatcaagattcaagaatcaagtttcaagattcaagaacaatcaagatcaagattcaagactcaagattctagaatcaagagaagacttaattcagataagtaccaaaaaaaggtttttcaaaacattgagtag

SEQ ID NO: 74427 - DNA, 123 bp, Glycine max
  Peptide Sequence Number=SeqID_166112
atggtgaatgtgggaagtgttgctgatcgctccaaggcaaaaagaaattgcttcactgatcaaaaagagcaatatggatttcacttaaaggagcccaagaatagtaataataatttaacctaa

SEQ ID NO: 74428 - DNA, 408 bp, Glycine max
  Peptide Sequence Number=SeqID_166113
atggcatccttcagccagatgcagtcccaacttcaatcacagatgcaatcacaagaacttgcactgcctccagagcctgaggttggtccctcagctgctcgtgttagcacaaagaggagttgtgttgatccctcaccggccgatccagagacgggtgactcagacaaatgcaggttgtacatcaaagaaaatccttcccacttggttgccctaggaagattttatgagggatccacagttgttcacaacatccctttgttgcatggccaggtaaaggttggtgttgaggaggttaaagatgtagaggctcccgttcctgtacccactaacgaggttcaactagtggggcaggcactgaacaccttccttgcttggcagacacatctcgtgaagcgtgtatcagaacat

SEQ ID NO: 74429 - DNA, 297 bp, Glycine max
  Peptide Sequence Number=SeqID_166114
atgcagaaacgatatgttcattatgatgccgtgaagagaggcatgatgcaatcaaggaatatgctagaagatatcatccccttcgaaaaacatattacgacagtagggactaccagcaacaatatgttatcaaagagaaaaactctagatgagggttcactgttatcaagcaagtcggagacccagcatgaccacagattcacctccactccttatgttcccatggacccgggtatagggccccttttcaactcaccctgtgtacaaaaaggtgtggatgttgtgtgcatcaaatga

SEQ ID NO: 74430 - DNA, 285 bp, Glycine max
  Peptide Sequence Number=SeqID_166115
atgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattatgcgtaaggagaaaataccgcatcaggcgccattcgccattcaggctgcgcaactgttgggaagggcgatcggtgcgggcctcttcgctattacgccagctggcgaaagggggatgtgctgcaaggcgataa

SEQ ID NO: 74431 - DNA, 342 bp, Glycine max
  Peptide Sequence Number=SeqID_166116
atggtgcggtgccttccaaatgctggcccaaagggaagcttcacctatcatgctcctactttcatgtactcttacacccaaaagcaaactttggttcctaggcctaagcaagggaatgggggcaatgcggcatgcccacccttttcagaacacaacttaggcctaaggccattgcctacaaccctccaactcaacaaaaacaagcaacaatccaaggataaaatgcctcgtggttttgagcatgcatgggcaaatgaagcatcaaaatacaccaatggaaagctagggagccaaagaatgaggtacttacttgttggagtgagtatgagtaccaaaaaatga

SEQ ID NO: 74432 - DNA, 519 bp, Glycine max
  Peptide Sequence Number=SeqID_166117
atgcggttgcgaattgccgctaccagcgttgttgctaaggtgaacccgacgtccccatccggcctcaagcaaatgaatcatccaacctcaaatatggtaggcaaagatttaggaaagacccatgaaattccccatcacaatctagccaacttcgagccttggctcggatataccactgaagggcaagcagttggtggtatacccctacaaaaccctttggagggccctcagtatcacccacaactgcacctcttgcattccacagcggttaaaaccccttatgactatggcaggaatgggaaagttggatcatctagaggaaaggctcagggcattgaaggaggtgaagattatgcctttgctaacctagaagagttgttcctaatacccaaacatggtcattcccaagttcaaggtgccggactttggcaagtacaaggggactactcgctccaagaaccatcccttctatgtactgtcggaagatgggggcatacgcaaaagatgagaaactgctga

SEQ ID NO: 74433 - DNA, 214 bp, Glycine max
  Peptide Sequence Number=SeqID_166118
cggagttgccatctttcgcaacctaccctccagtgggggcacgaaaaggcctctcggatgggccaaaaatgtgtcttctattgaaggaaaatgcgtggggtcaccaccaacgcacggcgaaggtattagcacccctcgtgcccatcacaagggacgacaacctctaatcgagtgggtcgacaagggtgttgtccttactcctatgtatcctcag

SEQ ID NO: 74434 - DNA, 432 bp, Glycine max
  Peptide Sequence Number=SeqID_166119
atgcctttcaaggttattttgatgatgccaaagaatcaagagttaagcaaagtttcaagcaaagatccaagaatcaagtttcaagaatcaagattcaataataatcaagatcaagattcaagactcaagattctagaatcaagaagaagactcaatcaagataacacaagaagttttcacaaaatcattaccaaagagttttactctctgctaatcgattaccagaagagggtacatctacttggggattgctatgctgagaacaagagagggtacatctcttgtggatcagttcacgtggaaggtacatccacttgggttttcaaagagaacaagggagggtacagcccttgtggatctttggcttgtaaaggattttacatggttgaaagaaatcttaagaaccataggttgcttggggactggatatag

SEQ ID NO: 74435 - DNA, 84 bp, Glycine max
  Peptide Sequence Number=SeqID_166120
ggagtgatggctggacgaaatgatcatgcgatagcggatgcccttcaagccttagcccaggctatagggaatccgaatagatga

SEQ ID NO: 74436 - DNA, 1275 bp, Glycine max
  Peptide Sequence Number=SeqID_166121
atgaaaggagcagccctctcgttcagagaaaaactgggatacggcatgggtgacgccggatgcaacatgatcggcggtgccatcatgctgttcctcaactacttctacaccgatgtatttggcctggctccggcgctggtcggcacgctgttgctgtcggtacgggtgctggatgcagtgaccgacccgataatgggcgcgattgccgatcgcacgcagagccgctggggacgctttcgcccgtggctgctgtggatatcgctgccctacgtgctgttcagcgtgctgatgtttaccaccccggactggagctacgacaacaaggtgatctgggcatttgtcacctatttcctgatgtcgctgacctacaccgccatcaatattccttactgctcgctgggcggcgtcatcactaacgatcccggtgaacgcgtctcctgccagtcataccgctttgtcatggtgggcatcgccacgctgatcctctcgctgtcgctgctgccgatggccgagtggtttggcggcgacaacaaagcgcgcggctatcagctggcaatgagcgtgctggcgctgattggcctggtgatgtttctgttctgttttgccacggtgcgcgagcgtattcgcccggcggtaccgagcaacgatgatctgaagaaagatttgcgcgatgtatggaagaacgatcagtgggtgcgcattctgctgctgacgttctgtaatgtctgtcccggttttattcgcatggccgccaccatgtattacgtcacctgggtgatgggccagtcgacgcactttgcgacgctgtttatcagcctgggcgtcatcggcatgatgctgggcagcacactggcgaaagtcctcaccgatcgctggtgcaagctcaaggtgtttttctggaccaacattgcgctggcgctgttctccagcggcttttactggatcgatccgcacgccaccgtcaccgtggtgatcgcttatttcctgctgaacatcctgcaccaaatcccgtcaccgctgcactggtcgctgatggctgatgtcgatgactacggcgaatggaaaaccggtaaacgcatcaccgggatcagcttctccggcaacctgtttttcctcaaggtcggactggcggtagcgggtgccatggtcgggtttttattgtcgatgtatggctatgacgcagcggcgaagcagcagtctgccagcgcgcttaacggcattgtgctgctgtttaccctgatccccggcgtcggctatctgatcaccgccggcgtg

SEQ ID NO: 74437 - DNA, 300 bp, Glycine max
  Peptide Sequence Number=SeqID_166122
atgtgggcattatccctatctctccaagttgctggtgtcgcaacctacccttcggcgggagggcgacgcggggctcacgggtgcatcttccatgggaggaaaatgcgtggagtcgccaccaacgtttatttgaggaaaacgtcagaaaaaccagaaaggtgtggtctacgaactttaagtgtgaaaggttcgggagttgtttttacgcacggggaagggtgtttccctcgctcctacgtatcctcaattgcgatgaggaaatcagacctacatagttcttttagaactaaacgtggttaa

SEQ ID NO: 74438 - DNA, 603 bp, Glycine max
  Peptide Sequence Number=SeqID_166123
atgtgttggaaaggaagcattgttgcctacatatttgggaagccaaagcatgaaccagtagagtgtgatagcatgtattggctgagaaagtttgaacaatacaaacccgaaggggcttatgttttgcattgtgcagaagatccaacagggtacgttgtgctggaatttggtacagaatggactgggttcatgcaaatgatgaagttagatagagattttcttgttgatcatcatggaaaaaaggattattatgagtcaaggaaaatgggttattcttcaggcttatttggttggtgtgcacaagcagaagattacaactcagaagggcttgttggaaattttctccgtcagaaagctgagctgaaaacaaccttaatggttgcacaagagtcattgaatgaaaaaactgaaactctggatcatttgtatggggaaataggctctgtaaacaaaaagattagtgagatggaatcaaagtacattaaggattacatgtcattggataaaatgatgaaagagattgagaagaagagagacttgcttcaccagactcgtgctgaagaactagctgtaactataggtggattcaaatgcgcaatgtag

SEQ ID NO: 74439 - DNA, 261 bp, Glycine max
  Peptide Sequence Number=SeqID_166124
atgttggtggcgactccgcgcacctttcctcctttggaaagcgcacccgtgagccttgccttcgctcgcccgcaaaagggcacgctgcgacagttggcgactccactggggacctttttgttcccaaataggggcaaagagcaaacgcgctccgtgccattcgttctcatgcattttttgggaagccggaagatccatctcgtcttcttaactgcacacatggggcactgcgctccccaaatgcgcaataaggagagataa

SEQ ID NO: 74440 - DNA, 81 bp, Glycine max
  Peptide Sequence Number=SeqID_166125
atgtctcgccttttcaatggtaattcaacatttaacatcggtgctgatgtcaggaacgatgtggaaatatgtagtttctaa

SEQ ID NO: 74441 - DNA, 339 bp, Glycine max
  Peptide Sequence Number=SeqID_166126
gaactactcttgctgccaggaataggtcctaagattgctcatctgggacaatgtccaagggatatgtgtagatactcatgtgcaccgcatttgcaatcgtcttgggagggaactgatgaggcaaaagctacttgggagaatgttgctgaattccaagctaactttcctaacttcaaccttgaggacaaggttgttttaaaaggggatggcattgtaatgctctcagataaaagaaagcttctagaaggaaaaaatgactcaattgagacaactcaacagaggggaatatttgccaaatctcacgtatccactatgggtaacagaaagagtgtgaaatag

SEQ ID NO: 74442 - DNA, 165 bp, Glycine max
  Peptide Sequence Number=SeqID_166127
atgacatttagtaggggatatgagataggtcatgaattttgtcttacaggatatgagatagatagcctgaaagctaaatatctgcctatgcacgcggttgatttcagtaatatattcaagatgacattgcctgggctaaagttgaatttgaagacaacaaagtga

SEQ ID NO: 74443 - DNA, 937 bp, Glycine max
  Peptide Sequence Number=SeqID_166128
atggaaggaagaaccagagttcttatttcatgcggaggatttccaaatgttcccttgatggggacgaggggttgcatcagctacaatcccgttcttgctataagacaacttggctaccctatgagaggggcgccactagaggatgagctcacgcctatcatttcacgtggtttcaataagaccaacgtggagacacttcagaaggtccgcaaggcatgggaggtgttgcaaaagaaggacaaggaactcaggggcaacaacaatgggcccatcagtggctaccgtaagtggttgagagcccacgtgcaaggtttggattggctcctgagtttgagaaccgcaaaaagggaggaagttaaggcaccggaggaagacgaagaggtgcaggtccttagggcagaactcgagcaagcccaaacagtcaaagaaaggttcaaatcagcagctctgaagatccgaaaggagaatgccgaaataagagatatgaatgtagctaccaccaaagccttggaacaagaaaccaagagggctcgtaaggaagagcacggtcggaacaagttccgaggggctctgtggggcagtaacagcgagcttaagctctggagagaggaaagggaccaatcacgagtagacagtttgatcttgaaagatgagttgaagaccagcatgttagctattgtaagcaaataccaagaagaactaaatttagccacggcccacgagcatagactggcggacgagtatgcccaagtatacgcggaaaaggaggctagaggaagggtgatcgactcgttacatcaagaaacaacaatgtggattgaccgatttgctcttaccttgaacgagagtcaagaacttccccgattgctagccaaggccaaagtaatggcggacacctactccgcccccgaggagatccatggacttctcagctatt

SEQ ID NO: 74444 - DNA, 375 bp, Glycine max
  Peptide Sequence Number=SeqID_166129
atggcttattcgcccaccagtaaggcaaaaccaacactggatgcgagttcagatgaagacgattctcatcctgaagacactgttaactcttatgatgaagaggtaatattcgaatctagagaagacttaattaaatggtataatcaactcttatttgcctctactcgtgtctctaaatcttacaacaaattaaataaatgttttcaacaacttggaagagagcatgaggatccgaagaaagctcatcaagttcacttagtggatttcatcctggaagccaccttgcccaatagtgtacaagatgcctttgtttgtgaggaagtcaaagcactattggatgaaaaaggtatccagtggacgaaaaactcttcgtaa

SEQ ID NO: 74445 - DNA, 1143 bp, Glycine max
  Peptide Sequence Number=SeqID_166130
atggaatcactaattttagcaacagagaagcagatgaaggccagaagtgatgttctcagtttgcttgaaaagcatcagatggagaaaaaagctgtcagtgatgcactgttgaagcttgaaaaagagatgggaaatgaacaaaagttgaatttagaaattgctgaactagaggaacaactcaaggttttgaagtgtgtgaacttggaggaagctgatcatgagaataaaagaaagatagaaatagaagagatagaagaaaaattggaggacatgatttttgatatgtccgtaaaagatgatgaaaatcaagctttgaagaagaaggtacaagaagctaaaatcgagctagaagatgctaggcaacaaattattaagctattggctgttggtactgttttatcacaattaatgttttccgtgcaaaagctaattgaatgcatttgcttgacaattcaggaattaccacagttcttgaaaggggttactaagattcaaataaaaaaaattggggaggtcagtgctaggtcatttaaaaaagtgtgcatgaataggtataaaaataacaaaaaagcatcatcggagtctgtcaaactgtgcgcaaagtggcaaaaagaaattctggattcaacatggcacccttttaagattgttgatgtcgaagggaaggaaatacaggaagaaattgatgaaaatgatcctaaattattatctttaaaaaatgatttgggagaggaggcatacgttgctgtggtgacagctctaaaggaattgcatgagtatcataattctgatgatgctgagaacacccataattcaagtgagaaacaagtgatacctgagatatgggactccgaaaatggacgtagagccaccgtaactgaagctttgaagtacataagcaatagggttatcaagatgcgcaaaatttatagtgttggaaatggagtcggaatcgcctgcatgaaggaagaaacaaaaagaataaaaggaaaagagaagaagattcagatgagaaaaatggagaaagagaagattgagggagaaaacacagagggagaaaacacaacaacagataaaactcaggagagagaagaaagagtaatggataagatacacacaattatgagtattaagcggaattaa

SEQ ID NO: 74446 - DNA, 231 bp, Glycine max
  Peptide Sequence Number=SeqID_166131
atgaacatttttgctgtggagtactctccatctgctttttccctaaatgagtttgggactattggtttatctcttgatctgggaaaatccttctcatcattcttggagtttgtgggaagaagtcaagggcacaggaagcacaatggacagagaagtggaattccagcaggcacgagaagcacaatggaaggagaagtggaatttgagcaaccactagcaataaaaatttaa

SEQ ID NO: 74447 - DNA, 774 bp, Glycine max
  Peptide Sequence Number=SeqID_166132
atggaatcactaattttagcaacagagaagcagatgaaggccagaagtgatgttctcagtttgcttgaaaagcaggagatggagaaaaaagctgtcagtgatgcactgttgaagcttgaaaaagagatgggaaatgaacaaaatttgaatttagaaattgctgaactagaggaacaactcaaggttttgaagtgtgtgaactcggaggaagctaatcatgagaataaaagaaagatagaaatagaagagatagaagaaaaattggaggacatgatttttgatatgtccgtaaaagatgatgaaaatcaagctttgaagaagaaggtacaagaagctaaaaccgagttagaagatgctaggcaacaaattattaagctattggctgttggtattgttttatcacaattaatgctttctgtgcaaaagctaattgaatgcatttgcttgacaattcaggaattaccacggttcctgaaaggggttactaagattcaaattaaaaaatttggggaggttagtgctaggtcatttaaaaaagtgtgcatgaataggtataaaaataacaaaaaagcatcatcggagtctgtcaaactgtgcgcaaagtggcaaaaagaaattctggattcaacatggcacccttttaagattgttgaagtcgaagggaaggaaatacagaacatctacattggttctaaaaccgatgttgaaagtgacgatgttgaatgtatgaatgttaacatcggttttggagatccgatgttaacatacatatga

SEQ ID NO: 74448 - DNA, 110 bp, Glycine max
  Peptide Sequence Number=SeqID_166133
ggaggattgcatcatctggcaaatgcctttatgtaattagaaagggaatgtactggctgagacctcttccaagaggtgcaacacatatgtacttaagtcaggggttgtag

SEQ ID NO: 74449 - DNA, 477 bp, Glycine max
  Peptide Sequence Number=SeqID_166134
atggagaagagagcgcgaaaagggttcacagaaaagaagaaagcgagagaggctagggtaaacggagaagaagggagtgcgagcgaaataggtcgtttcaaatctttttctagtagtgctcgttcaaatgtaataatgtccctttattatagatcccataaacacatgatcatagtttgttacaaccaaactggcataatctgtaaaacatggcatgttatctgcagggaagtaattgatgaaaatgatcctaaattattatctttaaaaaatgatttgggagaggaggcatacgttgctgtggtgacagctctaaaggaattgcatgagtatcataattctgatgatgctaagaacacccataattcaagtgagaaacaagtgatacctaagatatgggacccccaaaatggacgtagagccaccgtaactgaagctttgaagtacataagcaatagggttatcaagatgcggtga

SEQ ID NO: 74450 - DNA, 135 bp, Glycine max
  Peptide Sequence Number=SeqID_166135
atggcctccactgtctatggaaaatgggaaaatagttggtatagtgaatgccgaccttgccaacacgaaatgccgctaaaaatcgggtttttgccatccaatgggaggggccctatagcacaatatataacgtaa

SEQ ID NO: 74451 - DNA, 468 bp, Glycine max
  Peptide Sequence Number=SeqID_166136
atgccgcctaaggcatccagtacctcctttcagggaggaaggagttgcagaaaagatttcaagttggctctactagagccatcctcaaataaaatttcaccctcaaagactaggtcattaacccaatctgggtcatcaacccagaaatgtaaacaacaagatgggtcatttaccctactcgttgaaatcaaacctaagtcatcaactcaagaaccttcaaagaaccaaacatcaaaacaagccaaggctgactatgcctttccaatcaagacacttttggcccttcaagaaattggcctaacaaaaatcccaaagaaaacatgggctgacatagcctctgagtcagatgatgagtctgaaattgatctaaaaaccttaatccaaaaagccaaaggcacaaaaattatctgcaattctccaaaagaaaaacaaataataaatggcaacaccagccccaaaacccactaa

SEQ ID NO: 74452 - DNA, 216 bp, Glycine max
  Peptide Sequence Number=SeqID_166137
atgattgagttgcagcacaaaggtttcacgcccatgcctaggaaaggtaaatctgcagaaccccaagttgttggggcaaatgaagatcaaccagatgactgtggaatgaaaaaagacattgaacacatgggtacttaccttttgtcggaaaacttctcttccgctgcttcgcaaagattgaagacacagaggcacagtgcacttcaagggctgtaa

SEQ ID NO: 74453 - DNA, 321 bp, Glycine max
  Peptide Sequence Number=SeqID_166138
atgagagtgacacctagaccaacagtgagagtgagaccgaaagtgatagtgctgatactgcgtcacaagagtgagagtgagagtgaaagtgacaaagggtttgaggttgccagaagccctaagttcctggtaagattatcgttggggtctccttcgtgtcctcctccatcaactcccaaacttcctctaggacctcctcctgcaactcgtatgcctaaagcattgcctcatacgacgtcgcctcctttacatcagtctcgagcaatggaggacatccagtccctcaaaggaaggtctgagttgccctcaatacaatcctaa

SEQ ID NO: 74454 - DNA, 180 bp, Glycine max
  Peptide Sequence Number=SeqID_166139
atgattataaaatcctctaatatcttcgccctcatttggttccatagaaatatttccgaagaagaagaagaaccccccaagaaggaagccgaatcatccgaaaataatgatgaccaagaagatgacccattctaccagaatgaggatgactgttttggtatatcgttagatgatgattag

SEQ ID NO: 74455 - DNA, 315 bp, Glycine max
  Peptide Sequence Number=SeqID_166140
atgcagcagatctattccctaaaccaggagtgcgctcagtgcctgcttcactttgcgaatccgagcccgctacatttcctattcttgttaaacctacttggacttgctccgctagctgaacgtgttagcttcctgactgattggaggacttctgaatgcaacatgtgcaaatgcaaccgagatgatcatagcatgattagcacttcaccagaacaaagttcatgttgtgaagttgtccctgttgggttccattctctaaaaccttctcttggttcttggcagtgcactcctctatggtggtttagccaatcttaa

SEQ ID NO: 74456 - DNA, 921 bp, Glycine max
  Peptide Sequence Number=SeqID_166141
atggaatcactaattttagcaacagagaagcagatgaaggccagaagtgatgttctcagtttgcttgaaaagcatcagatggagaaaaaagctgtcagtgatgcactgttgaagcttgaaaaagagatgggaaatgaacaaaagttgaatttagaaattgctgaactagaggaacaactcaaggttttgaagtgtgtgaactcggaggaagctgatcatgagaataaaagaaagatagaaatagaagagatagaagaaaaattggaggacatgaatttttatatgttcgtaaaagatgatgaaaatcaagctttgaagaaggtacaagaagctaaaaccgagctagaagatgctaggcaacaaattattaatctattggctgttggtactgttttatcacaattaatgctttccgtgcaaaagctaattgaatgcatttacttgacaattcaggaattaccacagttcttgaaaggggttactaagattcaaataaaaaaatttggggaggtcagtgctaggtcatttaaaaaagtgtgcatgaataggtataaaaataacaaaaaagcatcatcggagtctgtcaaactctgcgcaaagtggcaaaaagaaattctggattcaacatggcacccttttaagattgttgaagtcgaagggaaggaaatacaggaagtaattgatgaaaatgatcctaaattattatctttaaaaaatgatttgggagaggaggcatacgttgctgtggtgacagatctaaaggaattgcatgagtatgataattctaatgatgctgagaacacccataattcaattgagaaacaagtgatacctgagatatgggactcccaaaatggacgtagagccaccgtaactgaagctttgaagtacataagcaatagggttatcaagatgcggtga

SEQ ID NO: 74457 - DNA, 624 bp, Glycine max
  Peptide Sequence Number=SeqID_166142
atgagtacctccgcatctacctctattgctagaattcttccttacatgtatagcatccacttttcccaaacttacacatatcctttttacaccccaggcataactgcacccaatgttttatcatttacccagttttggagggcccctcccattggatggcgaaaacccaatttagcggcatttcgtgttggcaagaacattattgaggtccctttgtcctaccatagacaatggaggccatattatccaacttatgttttattttactacaatggaagcacacattttgttagggtacgaaaatatggcaaccactatttttttgctgatggtctcaaagagtttaggagaacccacagcattaacgacggtgtcattatccggttttttgctcccgacaaaaatacatcttttgaggttgatgtcatggggcctatccatgggcaaccaacgggaagttattgtagacgtaaccagtggcaaatcaccattcatgatggtctgccatcccttgcggaaccatggtttctgtaccagtctgaaaataacttaatgcttggagatgaagttgtcttcttcttcaagtttgacgagcatgcgtgggaattgttatttaggaaataa

SEQ ID NO: 74458 - DNA, 560 bp, Glycine max
  Peptide Sequence Number=SeqID_166143
atgactgttgtcaagcaaaactatggagaaaaagttcttattgagtttgaatattttgcaaaccacaattcttttgaattgcttgcaaaatatggcacaactcatcttgttcaggggaccgcatctgtcgttcttgctggggtcgtggcagccttgaagctcattaacggtaatttggctaaccacacattcttgttccttggggctggagaggcaggaactggaatagcagaactaatagctcttgagatgtcaaagcagacaaaaacacctatagaggagactcgcaagaacatatggcttgtagactcaaaggaagtaattaatggaaatgatcctaaattattatctttaaagaatgatttgggagaggaggcatacgttgctgtggtgacagctctaaaggaattgcatgagtatcaaaattctgatgatgctgagaacacccataattcaagtgagaaacaagtgatacctgagatatgggacacccaaaatggacgtagagccaccgtaactgaagctttgaagtacataagcaatagggttatcaagatgcg

SEQ ID NO: 74459 - DNA, 156 bp, Glycine max
  Peptide Sequence Number=SeqID_166144
atgagagtgacacctagaccatcaatgagagtgagactgagagtgatagtgtcgatactgcgtcacaagagtgagagtgagagtgacaaagggtttgaggttgccagaagcgtgagggagatgagtgaattgccaaaagcacgaaaaatattataa

SEQ ID NO: 74460 - DNA, 402 bp, Glycine max
  Peptide Sequence Number=SeqID_166145
atgtattggctgagaaggtttgaacaatacaaacccgaagaggcttatgttttgcattgtgcagaagatccaacagggcttatttggttggtgtgcgcacaagcagaagattacaactcagaagggcttgttggaaattttctccgtcagaaagttgagctgaaaacaacctctatggttgcacaagagtcattgaatgaaaaaaatgaaactctggatcatttgtatggggaaataggccctgtaaacaaaaagattagtgagatggaatcgaagtacattgaggactacatgtcattggataaaatgatgaaagagattgagaagaagagagacttgcttcaccagactcgtgctgaagaactagctgtaactataggtggatccaaatgcgcaatgtag

SEQ ID NO: 74461 - DNA, 642 bp, Glycine max
  Peptide Sequence Number=SeqID_166146
atggctttgcgaagttctaaaggaactttttcaaaaatttctattaattgtgtttgcgtaaagggcagaaaagtggaatcgaaagggctccactctgttcctgtttcaggagctctggtgattcttcaatctgggattccattgcctgataagaggactctggaattgatacttgacaagcttcagaagaaagacgcttatggtgtgtttgcagaccctgttgatccagaagagcttcctgattatcacgatgtgatcaagcatcccatggactttgccactgtgaggaagaagttgggaaatgaatcttcttatactaccttagaacaatttgagggacctaaaaaagaggatccttctgtgaattatggtcttttcctttccaccccacaatctccttgccattggtctctccacagtagtaccacttctgttggtcttggtttgaacttggaagtttccaattttgaaccaataatggtggtgacaatgatgagttggcctccatggccacctctctcatctaagaaatttgaagtagttttcatagtgcgcaggcttgaagggtcaacaagtatggagaaagctgaggaggtgaagtccaaggtggttgaaattaagtggaaggaaccactttgttaa

SEQ ID NO: 74462 - DNA, 126 bp, Glycine max
  Peptide Sequence Number=SeqID_166147
atgagtgatgcaatcctccctatgaaaggaccattcactagagccatgagcaagaggctccaagaggattgggctagagctgctgaagaaggccctagggttctcatgaacctcaggggcacctag

SEQ ID NO: 74463 - DNA, 474 bp, Glycine max
  Peptide Sequence Number=SeqID_166148
atgcaaaaacgaagcagactaagggagcacctcctgcattgctttataggccaaaaaaatttttttgaaaaagggcaaatcgccaccatgactggcgatttctctgcgcctgctgcaactgctcctgcaccactgcaccgtagttgcaccgctagcctacgcctgaacctccccctgcaaagccaacccgctagtcaaactagcgatttccgaaacgaagcacagactcgccagaagagttggcgacttgcaggtggcatgaaatcaccatcaccactggcgttttccttgccacgtgggagatgctcagcaaactcgtcattggcaatggcggtttgctatgtttcccatgcagtttacgtagaaaacaaccccccccccccccatgtaaaatatttcaaaagaaccccatttggagaaatactttgtaaaagcaccccatctggggaaatttgccactgggataccatatag

SEQ ID NO: 74464 - DNA, 243 bp, Glycine max
  Peptide Sequence Number=SeqID_166149
atggcagaggtctccacagaggccattacctgcctcgcccaatattatgaccagccgttgaggatcttggcaagtagaggcgaatgggcctcattcatagacatcctcgcacttttgatctttggaggattccactttccaaatgtggatggggtggtggacctagcagcgatcgacgcttttctcgcctttcatgaccgcaaggaaagcccggttgtcgctatcctagccgatctatatgat

SEQ ID NO: 74465 - DNA, 387 bp, Glycine max
  Peptide Sequence Number=SeqID_166150
atgaagcttttcttccacactcatgagacaagccaatgcatccccactgaagaaaacactcaagaaattcatttcatggggaatcagcagaggcaagggtatactcaaggaggatttttaggcttccagcaaggtccttataatcagcaaggacagtggaggacacaccctggaaaccagttcaataaagaccaggctgacaggtcatccaacagttttggagcaaatacgaaaaataatcctaaggaggaatgcaaggctgtgatgactaggagtaaaaggtttgtggaagctgaggatgaagagagtgtggtgtacaaggagcaaatgggtgaaaagacaggtgctgaggctaaggaaaatgatgttaagggtaaagagaattag

SEQ ID NO: 74466 - DNA, 588 bp, Glycine max
  Peptide Sequence Number=SeqID_166151
atggtctggtataggcgaaagacaaagatgtttgttgacccacaaaatgcaaagacggctacattggctgaagttgcggagacattacaatacatggtgtctcctcaagggaggaatacatggacagttgatgatctccgccaatttcccgcacaacagtttcacatacttcagtcaagtgttgaaactcagggcatagacagacgaagggagactattgaagcagaagaatattcccaacaaatgtcggagtgtggccatggaatgtattacacgccacaaacatttgctcagtatccaacacagatgtatcagtatccttttcagggtcatcaaactgatacttctgcaagccagcaatcgttcggtggtgttgcggaaacacaagctcatttttcatggcccacaatgaccccttcacagcaatatcatgacccaattccaacacctaatgccccgctgacgaagaagaagcgaggaggcatcggggcagaagaaatcctgatcgccaagcacgaagatgggatcgaccatgtggcacatcctcacggcatcacgaacaccaaaatgaatgatttgcatgtctcc

SEQ ID NO: 74467 - DNA, 174 bp, Glycine max
  Peptide Sequence Number=SeqID_166152
atgaacgatttcgtgaagattattcaccgttcttcatcgttcttcgttcgttcttcgtcgttcttcggtcttcaaccgttaaacatggactgttcaaaaaacataaaatcaatatgtaactttaccgctttttgtcaaacaccccaagagatcgttaatggtccaacgccttaa

SEQ ID NO: 74468 - DNA, 209 bp, Glycine max
  Peptide Sequence Number=SeqID_166153
aggatcccacgatgctcgaccttagacaaaatgatggtcagatggagaacatacagcttcaagagagaaggagaagacaacgcgaaggagacgaaacataccttggtatggtggcgaaggagaagaagcagagacttgtgatgatgctcgagtgcgacgaacacgatgctcagatgcagacagggacggtttcgctagacggagattag

SEQ ID NO: 74469 - DNA, 216 bp, Glycine max
  Peptide Sequence Number=SeqID_166154
atgatacgcggagataccttagggttatccgcacccttttgtcatccagaggcggcgggcccgatgacaagcagagaccaagtttggtcattctgcacccttgtatcatccagaggcggcgggcccgatgatacgcggaaatacccggttatccgtataaacattcccttttgctatccagaacgctccgatgatagcatgcagaggctgacatag

SEQ ID NO: 74470 - DNA, 1090 bp, Glycine max
  Peptide Sequence Number=SeqID_166155
atgcctaatatttacaacgctctgatagttaagggtcgagatactgttggtcaacaaattaatgtgacttgtgaagtacagcaattattaggaaataatcgaattagagctgtagctatgagtgcgacagaaggtctaatgagaggaatggaagtgattgacacaggagctgccctaagtgttccagtaggtggagcaactctaggacgaattttcaacgtgcttggagagcccattgataatttaggtcctgtagatactcgcacaacatctcccattcatagatctgcgcctgcctttatacaattagatacaaaattagccatttttgaaacaggaataaaagtagtagatcttttagctccttatcgtcgtggaggaaaaataggacttttcggtggagctggagtgggtgaacgtactcgtgagggaaatgatctttatatggaaatgaaagaatctggagtaattaatgaacaaaatattgcagaatcaaaagtagctctagtatatggtcaaatgaatgaaccgcccggagctcgtatgagagttggtttaactgccctgactatggcggaatattttcgagatgtcaatgaacaagatgtacttctatttatcgacaatatctttcgcttcgtccaagcaggatctgaagtatctgccttattgggtcgaatgccttctgctgtgggttatcaacccactcttagtactgaaatgggttctttacaagaaagaatcacttctaccaaagaggggtccataacttctattcaagcagtttatgtacccgcagacgatttaaccgatcctgcgcctgctacgacatttgcacatttagatgctactactgtactatcaagaggattagcggccaaaggtatctatccagcagtagatcctttagattcaacctcaactatgctccaacctcgaatcgttggtgaagaacattatgagactgcgcaaagagttaaacaaactttacaacgttacaaagaacttcaagacattatagctatccttggcttggacgaattatccgaagaagatcgcttaaccgtagcaagagcacgaaaaattgagc

SEQ ID NO: 74471 - DNA, 477 bp, Glycine max
  Peptide Sequence Number=SeqID_166156
atgttgaaaattcttatgaaattgctagaggaccaatacttgggttattttgtagaagacttgttacaacttaacattaaacggaaactacagagtggcagagataaagcttggcattcccattggtggaaggaccttagaagactttataatcagcctgatttccacaatatccaccagaatatggtatggaaggttgattgtggggacaaaatcaaattttggcaagattctttgctgagtgagggctgtaagcatttcaaaaaacgattcttggaaatatggaaggaagtctttaagcatttcaaagaaagactctcagagcagaacccttgcagaccaaccctggatgggattcagttttcttctcttggccaagggcaaaaggaaagccttgttgctagattctctgaagtggaaatcaagtctgcagttggggttttggtggagataaaagccctggcccagatggtttga

SEQ ID NO: 74472 - DNA, 270 bp, Glycine max
  Peptide Sequence Number=SeqID_166157
atgaggatcaaaaggtcttttaaggttgtaatggggccaaggacaagaaaggggaacataggctcaaaggggctatcaaaggaattaattcaaggtaggctcatttggctagaggcttataagaacaaaatgcctaaatcatctcccaacatgcctgtgaagcaagaagtatcaacaagagtcaagccaaggctattgtgcaagcaatcaatggggcaaaacacaccgaataaaatagatgatgatggctcaaattctcaccaagggtaa

SEQ ID NO: 74473 - DNA, 171 bp, Glycine max
  Peptide Sequence Number=SeqID_166158
atgactatgaggggtcaagacatttatagtagtcaagaggagactacttcttcctcttcctctagtggaagtgaagatgaagtaaatggtgaagagtctagtgaagaagtctaccctcgtgaagaaggtgacctcttaatggttagaaggctccttggagcacaagattag

SEQ ID NO: 74474 - DNA, 502 bp, Glycine max
  Peptide Sequence Number=SeqID_166159
ggatgacattctctgctggtttcacatatctagagggtgaatgtgttaataatgtggtgtgggctttagaacggtttcgaggtatatttctaagacgtgatgccctccctagagttattgtgactgacagagacctagcattgatgaatgcagtgtatgttttaaatcatattgctgctgagtttgagcgtatacattatgcggctaagaatccttcttcttgtggttgtgtcatgagaactacacacggtcttccttatgcataccaagggttatctgagccccaagtgaccataaaggaagagatgaaaaccatatgtaaaagatttgaggaacttgatgcttgtggtaaagtaactctaaagagtaaactttgggaaattgcataccttgatcaaaactctatgtgtcctcctccagaaaaggtcaacactaaaggtgcacagaagagactgacgaacaaaaaccaaagatcaacaaagcgtgatccgtcttactggga

SEQ ID NO: 74475 - DNA, 240 bp, Glycine max
  Peptide Sequence Number=SeqID_166160
atgacgtcaggaggagaagaagaagaagaagctcgaattgcacagccagggcagggaaaagcgaagaagctccttccaactgggccaaaaaccctatgccccctaccccaccccccacccccacacgggatcagaaaaacatttcattgtgtagctgagaaagaatgtgtttcgttaaaattctgcgacaactccatgtttaggtgtgtgttgggtcattctatcgtccaaaactcgtaa

SEQ ID NO: 74476 - DNA, 699 bp, Glycine max
  Peptide Sequence Number=SeqID_166161
atgaaggccgatatggaggccatgaaggaacaaatgacaacgatgatggaagcaatgatgagcatgaggaagatgatgaaggataacactgctacagttgttgttgcgagtactactactgagatggacccgattcacccggccggtttcattcaagtgaatcatctagtctcagatgtagtaggtcaagaaggcgaggcagcgaaaagtgcatgtgagccccatcatgttaaggttcagagcaagcattccttcccaccatatgggttgcctcctaattatacaccgcccactattgtatacgcttctagtgagaatatcaacaattttgcacccgtactcattgagaatcagcaaccccaatctgatcatgcacatttctctcaacccatgggggaaacacatgaagtcccccaagaccacactctggctgggttcacggtttatccaggatataccactgaaaggcaggcattttcgggcatccctgtgctgaatgctcctgaaatatctcaatatcgtccgttatcacaacccttgcattttgtaatgggagaggggccttccacaatacttgagaaggagaggtttgagcatatggaggagaggctacacgccattagaggaggaaattatgtctttactgacatggcagagttgtgcttggtacccgacgtggttattcctccaaagttcaag

SEQ ID NO: 74477 - DNA, 453 bp, Glycine max
  Peptide Sequence Number=SeqID_166162
atggaacttcaacatctcaatcaaaatgaagagatcgacaaaaggaaaagaagcatagcactcaaagcctcttcctcaatacaagaagaaaaagaagaagaagaagaatctgatgatgaagaagacttctcactctctgtgaagaagtttcataaattcgtcaaaaatagaataatggagagaagccaaaacttcaacaatgggaagaaatcccaagaagtttctcctacacttaaatgcaacaagtgtaatcaactcggtcacataaaggcaaactgtccctcaaatgagtcatggcctgagaagaatgagaagaaaagctataaagaaagaagatccaagaaggcgtatattgtttgggacgacaatgactcattcgatggttcggagaaggagatcaaccttctatccaaagactatgaaagtgatgagaacatctctcaagaagattaa

SEQ ID NO: 74478 - DNA, 304 bp, Glycine max
  Peptide Sequence Number=SeqID_166163
aagagtatattggagattggatcgacttttggtcgtcctcttgttcttgattatatgttgttcttggtatctaatccttggaggtttacaataggaaactggttgtgtgattcagatctggttaatcctattggaattgatcggattcttactgaaaagaaccttctagctgactcatatttggatctagaggcttctattcttgatgagaaagaatttctcctatcaaaggaagagttacctcatcctatttatggttcttggaagagaaacattgacctttgttatatcagtgataaacaag

SEQ ID NO: 74479 - DNA, 1386 bp, Glycine max
  Peptide Sequence Number=SeqID_166164
atgagtcctgccctgcccgcccccctggttgccgaactgtccgtcctgctgggcgcggagggctggcgcatggatgacggcgcgctggaggccaacgcgcaggacaactcgtggcgccaccagcgtccggcggcggtggcgctgcctgccgacatcgaacaggtgcaggcactggtgcgcgcctgccgcgcgcatggcgtggccctggtcgcacgaggcgccggaaccggcaccaccggcgcagcggtcccgcagccgggcagcatcgtattgtcgttcactcgcatggaccgcatcgtcgaaatccgcgccggtgatcgctgcgcggtcgtgcagccgggtgtgctcaacgggaccctgcagcaggcactggccccgcacggcctgttctgggcgccggatccatccagcgccgagatctgcagcatcggtggcaacctcgcctgcaacgccggcggcccgcgcgcggtgaagtacggcaccagccgcgacaatgtgctgggcctggtggcggtgactggcaccggcgacgtgatccgctgcggtggcgcctacaccaaggacgccaccggctatgacctcacgcatctgctggtgggcagcgaaggcacgctggcactgatcgtggaagccacgctgaagctgaccccgttgccggtcagccaggccgggctgcgcgtgttgtaccgcgatgccgatgccgccgccgctgccgtgtcgcggttgatgtcgcaaccggtggtacccacccgcctggaattcatggacgcgcgcagcctggagctgctgcggctgaatggtgccgacgtgccggaggccggtgcgatgctgctggtcgaagccgatggtgaccacgacaccctgccctacctgctgcaggcattggccagcgccgccgaaggcgacggcatgatcgagctggacgtggcgatggaaggccgtgcacgcgaccagctgtgggccgcacgcaaggcactgtcgcctgcgctgcgcagcgttgcaccgggaaagatcaatgaagacgtggtggtcccggtatcgcgcatcccggaactggtgggcggcgtgcaggcattggcacgcgactacgcgctgaccatcgtcaccttcggccatgccggcaacggcaacctgcacgtcaacattctctatcacccggaggatcccgacgagaacgcacgcgcgcatgccgcgctgccgaagatcttcgagctgacgctggcgctgggtggaacgctgtccggcgaacacggcattggcctggccaagcgcgatttcatggtgcaggcattcactgcggaaacgctggcgacgatgcgcgcgatcaaggccgcactggacccggacggcatcctcaatccgggcaaggtgctgccgccggtttag

SEQ ID NO: 74480 - DNA, 189 bp, Glycine max
  Peptide Sequence Number=SeqID_166165
atgccacagaaacaacatgttgaagctaatagccctggtgaggattatggagaggatattggtcttgagaatatgcaagaggtccctgttgagatggaatcatcttttcagaaagagcttttgaaatgggagaagatgaaaacaaagcaagaaatttgctcccaaagggaatggcaaggcaccccttag

SEQ ID NO: 74481 - DNA, 871 bp, Glycine max
  Peptide Sequence Number=SeqID_166166
tagtaccctcaccttcaaaggactacacgtccttgccatcagagggctgcatgccctcgccttcaaaagactactcgtccttgccttcagaggactacccgtcctcatcttcagagggctacgcgccctcacctttagaggactacacgtcctcgccttcagaggactacccgccctcgccttcagaggactacacgtcctcgcctttagagggctacatgccctcgccttcaaagaactacatgtcctctccttcagagggctacattccctcacctttagagggctgcacgccctcactttcagacgactagacgtcctcgccttgaaagggctagccctcgccttcagaggactacatgtcctctccttcacagggctaaatgccctcacttttagagggctggacgccctcaccttcagaggactagacgtcctcgccttcagagggctacaagttctcgccttcagaggactacccgtcctcaccttcagagggctatgggccctcgccttcagaggactacacggctacgcgccctcgccttcagagaactacacgtcccctccttcagagggttacacgccctcgccttcagaggactacatgtccttaccttcagagggctacatgccctcaccttcagaggactgcacgtcctctccttcagagggctacacttcctcgccatcagagcgctgcacgcccttaccttcagaggactacatgtcctcttctacagagggctacattccctcacctttagagggctccacgccctcacctatagtggactacacgtcctcgctatcagagggctgcacgccctcaccttcagaggagtacatgtcctacgcgggatcgctctag

SEQ ID NO: 74482 - DNA, 168 bp, Glycine max
  Peptide Sequence Number=SeqID_166167
atgatagaggaggcaaaagaacatcacatggatgaagatgctctgataccacataatgtagctccattggaatggagaagaaggaaaggtgattggagatgccacttcaaggagaagatgagtcaagaacaagcttaccaccataggaagccatggatgagagcttga

SEQ ID NO: 74483 - DNA, 180 bp, Glycine max
  Peptide Sequence Number=SeqID_166168
atgcgttttcagccgaactcgctaagcacgcctaccacgctaagcgagttcatcttttggggaagaacattcatcttcctgaggagatacctgtggctaagcggggctgatttgctaagcccagggccgctaagcgcaaccctgctgagcttagcgcatatatgttgtgactatcattag

SEQ ID NO: 74484 - DNA, 195 bp, Glycine max
  Peptide Sequence Number=SeqID_166169
atggactggttcttccgcatcttgcatcctttcatgacaccaggtcatgcatcagatcctctgcctcatggtcacgccccgcaaccccgaatcgtccctcaggccccgcagacagatatccctcacgtgccgaagccaggagcatcgtccacatctgtggaggagcctagacatgcggtggtaaaaagtttatga

SEQ ID NO: 74485 - DNA, 426 bp, Glycine max
  Peptide Sequence Number=SeqID_166170
atgtcacgaaaccttatagattacgcaatcgtcccttctttggcttccggaatgttacggaactttatggattgcgcattaacacttccttttaactcccgacatgtcgcggaacttcacggattgcctaacgaagggtgtcaagtacctcgaagtggtcaagcgagggtcgcatcccaacaaacagatggtccccagacgaaattaggtggcgtctcctctctctcttccttctccattccgctaccattcatcttccaagaagcaaaggaatccattgatgaagaagatcctaggcctacaagctccaatgaaggttttttttccaagtgtgtaagtggcgacttactaagcagttcgggaattgtggagcattcaatgctgggtctaaagattggacgtgaggatgcagctgaatcattctga

SEQ ID NO: 74486 - DNA, 459 bp, Glycine max
  Peptide Sequence Number=SeqID_166171
atgacgatccttagaagatttggacctccattgcagtggcattttgtcatgcttgacattggaattggggagacatatgtcgttcaaccttggtatcaatttcttgcggacattgatttctcacatggcgatgagtctaacaccagtttggaagggcttgaggtagtggaattggaaggcagtggtggcgataccggtggaaactatggttttgttgatgctgatgttggagccctagatggggaagataggagtgatagaggtgcaaccagcccgtctaatgatcctttacgtgggattagagatcctatgaaaaggttcaagactaagaggataaagcaagcattgcaaggcctgattcaaaatatcaaagagaaagaagaccaatgtgaattaaggaatgcacctaattgggtcactttcctacaaattgatgaagatgctttgaggccaacttga

SEQ ID NO: 74487 - DNA, 534 bp, Glycine max
  Peptide Sequence Number=SeqID_166172
atggcatccaagaagaggaagagcactgcttctagacccacagctcagtatgataccaggcgattccaatctttgaaagcttggaatagatacactgacaacattctcggccgaaatatccttccggagagaaatgtgaagctttatcatattgagttcgatgagttcaaggtggagttggagaggcataatctacacaaatgcctcactaacctccaagatggaagcatagatgtatctatggtgaaggagttttatgttaatctatacagcccagaggaccaagctcctaaacaagctagagtaagaggacatctgattaagatcgatgcaaacaacctgaatgaatttcttcagactccagtggtgttagaggagggggaatctttacccacctaccctagattttgcaagttgaggactaaccaccaggagattgaagctaggctttgtattccccgcaaggggtttgttttgaatgctgaaggccagccatggaaacttctcagaaaagatctgatgacactggcctag

SEQ ID NO: 74488 - DNA, 171 bp, Glycine max
  Peptide Sequence Number=SeqID_166173
atgtccagacggtggctatcaacaaacctcttcatcttctcatgggcgcgctcaagttttctcctgaagagtatgaacatatctagtcgaaaagtattgttccaccacatggctaagcacctcggtctggttgtcactcagggggtgataggtcgtgctcatgtgcaatag

SEQ ID NO: 74489 - DNA, 603 bp, Glycine max
  Peptide Sequence Number=SeqID_166174
atgtgggacttcacctcacacttgtactccaactcatctccccctcaagtccattatggccacctatggtacttgcaccactgctccatttgcggggcacaatgcgtcggtcaccaagtcaaaccatcggctctaataccaattgttggggagattcaagggagacaactgtggaccacgagccaccacataaggaaacctgacactggggatctggcccatgggacctgtgaagctcacaggtttctgaggcatgtactcccgtgccgacaaagatggggacgtcgtcatcaacaaccccttcattatcatgcacgccattaccaccatggccctaaccaccctgccccatctcctccacattgtggcactacttggaccacctcctccaccacgtgtgctgcaccaaccagtcccatcactattcacacctctgcattatcatcgcatgtcgtcgaccctgatgctaccagattcatatgcgacctccactcctttgcactaactagattccctctttattgttttgttctgctttatgtgtgtttgttctgggtatcaacattggtggttgagaacttcaaagaagatgaagaatgttag

SEQ ID NO: 74490 - DNA, 390 bp, Glycine max
  Peptide Sequence Number=SeqID_166175
atggcctcggaccagtcattaccaccaacagctttggacaatcagcccatcatcgagcctctcattatcttgtaccataagtgggacaattcagacccacctcagttgcatgtccttgtccaatggttgggcttgctgccagaagatttggcttgggaaagttggactgagttacaagccaactaccaccttgaggacaaggtgattctagaagaagtagggaatgatagcaaccctgaatcagaggctaattgtaggcccaaaagaattaccaaaaggccacaagggtgggaagagtttattcactatatgttatcagatcatcaccagaattttgtatttcttgacctcaagtacaagaagccattatccatagaactccatcagtag

SEQ ID NO: 74491 - DNA, 140 bp, Glycine max
  Peptide Sequence Number=SeqID_166176
ttgagatcaaaagtgaatccacagataagagcttcaaggtcaatggacaccggctgaaaccattcctcacaaattcctccttggtggatgtagtggtggaggagacctcttcaccctacttctcttccaccatgacttag

SEQ ID NO: 74492 - DNA, 273 bp, Glycine max
  Peptide Sequence Number=SeqID_166177
atgcatcaccaaaataggaaaactttagataaggcttcactgtcatcaagcgagtcagagacccaacatggccatagatcgacctccactccctatggctcagatagacccgggtatagggcccaatatctcaaagtgtgtgcaaaaagtgtaggtaatagatacaaggatacacaccaagaagtaacaacgtgtcaaaggttatatacaagcatgatccaaacaaagaataaaagaaacgagatcgaagcaaaaccacaaaaagaacggtag

SEQ ID NO: 74493 - DNA, 384 bp, Glycine max
  Peptide Sequence Number=SeqID_166178
atggtgtttgttggtgagagaattaaagcaggtgtaaggaaagggaaatttaattatgttgcttctatgaatcctagtaatgggggatccgcaaggagtggtgagaggaagaaggagggagaacctcatgttgtagttgcacttcctgcgtggccaaactttccactagccccttataataccatgtaccaatatcctccccaacaatatcactactcatccaaaatcagtcattcccattacccaccaccctaccaaccaagaacacctaatcagccacaaagccataagcccaacaaagattcctcaacctccatttccccgaggatacaactcaaatgcgacatgtgcttatcatgggggagttccggggcattcctttga

SEQ ID NO: 74494 - DNA, 1149 bp, Glycine max
  Peptide Sequence Number=SeqID_166179
atggaacgtgtattggctgatgtacttagagatcaaaggaatttgggcaacaagggtaatggaggttggaagaggtcagcattgaatgctgcagccacaatgttgtctacaagcttcaatgttaatgtcacatcagataatgtcaaaaaccgtatcaaattatggagatcgtggtatggtatttcgcataaatcggctaaaccgtttcgattcaaggtgcttcaaaattgggatgatatagtggatttgtgtgctaaagatagatccaccggtcatgaagctgaaactgctatggatgctgatgaagcgatgagtagagaaacaaatgaagtggaattcatggggttagacaacaaatgggctaaagctattaaatggttagctgacgatccaaagcagttagctatagtggattttgaatttgaagagcaggaagaagtgttgcagcattaccctcaagggtatcatggagttgacaaggaaggtaggccagtttacattgaaaggcttgggaaagctcatccaagccgcttgatgcgtataaccacaatagatgggtatttgaaataccatgttcaagagttcgagaaggctctggaggagaaatttccagcatgttccattgcagcgaagagacaaatttcttcaaccacgacaatactgaatgtacagggcttggaaattaaaaggctacaatgcgaagagttttcctataagcacagacatgattttgacattcccaacggcgagaatgctcggaattggattgtaaacctggtgtttaaatttcacgacgatccaacggtgaatgagtccgagatcattgtttttctgaggatgctttggcctgctgcacagaagtttcttgatgccaaaactattgcaaagatacaggttcttgaacctaatctttatgtaaattactggatatcattgactctagactttttgggtggaacatgtacatgtcctggacaaggtggatgtcttaggtctagcaaaggtccatggaatgatcctgatatcatgaaggcaacttttgagagacaaatcgcccgaatgtccaatgaacaagagaatttagactctttatggatagcaagtctcaatcttcttgaatttgaaaagtatgatttcacaaacaattga

SEQ ID NO: 74495 - DNA, 402 bp, Glycine max
  Peptide Sequence Number=SeqID_166180
atgtcatggggcatacgttgcactcttttttctaacaagaatgcaacacatgttcatgctggttttttagacgctttccgggactttagtcagagtggaagctatgcatgggtagctatcaccctagttcatatgtatgataatttgaatgatgcttgtaagagcagcaaccgacagcttgctggttacatcaccctattgcagtgttggacgtatgagcattttccctctgttgctgagtctttgactgatccagactatgctgagatgtcaccacgtgcctgccgatggatttttatgaaggcttcttcgaagtcattaccagcatctacgtactggaaacgtctagatggactaacgattgctgatgtttgttggatgttttacggtgaccaccattag

SEQ ID NO: 74496 - DNA, 399 bp, Glycine max
  Peptide Sequence Number=SeqID_166181
atggaccaattaaagcacctaagcatcccctcaggaaagtttagattctctaaccacgctagttacccacgtctgggccatccgacaagaaaaatcagcatgcaacagggacagacagatatcctcatagctaggttccctgaccctaactatggtgttacaatgggttttcgttctctaccgaaaccgcaagccaagttggaaattctgcttcggttgaagggttcctctcggtgtgggttttcaatggagaacaatgatggtttgtggtggctaatggtggatgtgggtgatggagaaagtactttgaactttagaaatggctttggaagaaagaaagaagaagaaatgacgtttttcctaagctacgcgagagcaaaggctgaaatgcttaaataa

SEQ ID NO: 74497 - DNA, 336 bp, Glycine max
  Peptide Sequence Number=SeqID_166182
atggaggagcgagcgtctttccgaagcaagaaacacttaatctgctttgggggagtggacgacgtaggtacggtttgcggagaggaaggggttgctttggattccggcggcgaagacggtggcggttctggttcacagagccatgcaattcacgccatgttcgaagagctcactgacgttgacttcgtcaagatcgatgtcaacgaattgccgtttccgatgatgtcgacgttcgtgttggtgaagaaagggaaggaagttgacaaggttgtgggcgcaaagaaggatgaacttgagagaagagtgagaaacatgattgcaatcttagttttataa

SEQ ID NO: 74498 - DNA, 387 bp, Glycine max
  Peptide Sequence Number=SeqID_166183
atggaaatcaagaaaaccacaaaggagaaaagaaaaagaaaagaatgtctcaccaaagaaaacaagaatgccattgagttccttgatgaacacgttttctattatgacgaggaagatgagcagtggtttaaggaaaaagatgatcagtgggtaaagaacataccatgctacaaagaagacacaaccaaagtagtcttgaattcagttgacttcaactttgacatgcaaaacaaagatttagatgagttcttgaaggttccttcccctcccagagttcatgctcttgccgctcctgcacctcatagggtttatacctttgccgatttggtttctgttccatctgcccgtatagcttgggttcctgatcctgctgctcctacaccttag

SEQ ID NO: 74499 - DNA, 102 bp, Glycine max
  Peptide Sequence Number=SeqID_166184
ctaagctctagcttctcaaggaagcttctcaaggaggaagttttctcaaagaagcttctcaaggaagttttcttaagaaagcttctcaaggaagctacctag

SEQ ID NO: 74500 - DNA, 663 bp, Glycine max
  Peptide Sequence Number=SeqID_166185
atggtactagatagactgcccactagaggaaatctccttcgaagaaatgtgcagatgcaggacacttcttgccctctgtgtgggaatgctcaagaggaggtggatcacttgttcttcaattgtgaaatgaccatagggctgtggtgggaatctatgagctggaatcagatggttggccccattgcatcatctccagcagcacactttattcaattctgtgagggctatgcagtagggcaaaatcaatctcgtcgatatggatggtgggtagctctgactaactctatatggaagcatagaaatcagctggttttcgagggacttgttgaattcgatcctgcaaaacgctggtcaccctttcaggcttcaaaacacccttttgtaactggggaaccttttacacacccttacaagcctcctcctgagactcctcatatgaacaactttgttttggctggcataagtcataagcgaggcctttctaagggggagctaggaggccacaagggtagagtgatgttcaagagcttgttggatcagactcatcagagcatgtttctgcttttgcctctgattctgcaattttcattccactatctctctgtccccactagattcttctccaggggaatatgtgctattttgcaagtatcatactattag

SEQ ID NO: 74501 - DNA, 402 bp, Glycine max
  Peptide Sequence Number=SeqID_166186
atggtgttggtgatgtcaaccatggtagtcaaaatcgagattttattcaagatcggaaaggggagtatggattgtaaatcgggggatcgtaacacggatcattacgattttgactaccatgatgtcaacagtagcggtgacgaagagataccaatgatggtcgtgttggtagtggcggtggtggtggcggcggcggcagcgatgccaatggtggtggcagtgacaaaggtggtattagtggtggtagtagcaatgtcggtgtcgatggtggtcgatggtggtggtggcaacaagtgttggcggtgcggtgttggtggtggttgtggtgacagtgatagaggtggtattgttggtagtagtggtggtggtggtgccagtgacgatggtgcatggtggcaatga

SEQ ID NO: 74502 - DNA, 168 bp, Glycine max
  Peptide Sequence Number=SeqID_166187
atggggggggggggtttggttgtttggataactggtgaagggaaaactgccaggaaaccacattacaaacgaaacctcaaagagagttgggcttcgtcctcaaaaggaaacaacaccagaaaatctagccttccatggattcaaacagaaaacgcaaatgaagcatga

SEQ ID NO: 74503 - DNA, 702 bp, Glycine max
  Peptide Sequence Number=SeqID_166188
atgacttccatttgcggtttcgatcattcttcttcccctcctccaccttgtcatgcagaaccagtttcatcttttcctccgactgctgggattatgttctctcacaccatattggaaaaaatggacaccaagaactatcgtctgtggggtcagaaggttgaacttgatatcaaggggcattgtctccaccattatcttgatggttcagatgaaagcagtttgacaactgagtttggcagaagtatgaatcttggtgctactgaaacatgggctggatttggaaggttcaaccatgtttcgagcacaaacactcctccaataatcatgcaaagactgaatggaccaagtcaagcattcactaatgttgagatgggtagccttccaatgcatgatcttcaagcaacatatgtaccctctatgtctaagcattttcatctcatgcctcatattttacaaaattctccaagtcgttttggataccaatctgttcaaagattcacacatggtagacccccccatggtgctgagtggaatcaaattaagattcaggctccttcttctggttttagcagtgtggaccctcgttctccccggaataactcattcaccaacagtatgacatgggggcgaagaatgaatcctcctgtctcaagcatgcctccaacatccggcacaagaaaagattatgcaaggatagactag

SEQ ID NO: 74504 - DNA, 639 bp, Glycine max
  Peptide Sequence Number=SeqID_166189
tctctagaaggttttccaatacatgatatcggtggaactgcactagtcgataaggaccctaaacaccatgaagtttgcaatgataatggagacaaccacggggtcgtcctagttgacaggtttgatacccttgaagttgtctctcacgccattattgatggtgtctttatttacctcattcttccgcttttcttctatcttcttcatggttcctatgcagctcctcttggtgtcctctgtgacttgctcttgcttggtggttgggtgtgtaacgctcgtacttgggccctttggggagaggctggcgcttctattcatacttcattccttcttgaatctggacatttcctccatctgaatggcaaggagtatggaatgcaatactaccttgaggttaagatttcggatctggacgattctgcacctaaatccatccatgaattttctaagagactcgtcgtctgcttatcgcagactggtagaggcagccaaggtcatgcgatgagacctgttggtggtatactgcacactgaattgtcgaacaagggtgtcgaagttgtctatggacctaggtgggagtccaccatactaggcatccagatgcttgtttggatctattgtcccatcataccgctcaag

SEQ ID NO: 74505 - DNA, 467 bp, Glycine max
  Peptide Sequence Number=SeqID_166190
atggcttctagaaaaagaaagagtattgctacaaggcccacaacacagtatgatacaaggagatttcactcctttgaggcctggaatcgatacatggataacattttaggaagacacatcttacctgagaggaaggtggaaatataccacactgagctggacaagtttaaggctgaattggagaggcgtaacttccataaacgcctcaccaatttagttgacaacaacatagacttagctttagtgaaggagttttatgctaacctttacaggtctgaagaccctccaccaaagcatgccaaggtcagaggccacctggtgaagattgatgcagacaacctcaacacattcttggagacacctgtgatattagttgagggtgagactttaccagcatattctagatattgtaggttgctcacaaattataaagagattgaggctgccttatgtataccaggccgagg

SEQ ID NO: 74506 - DNA, 372 bp, Glycine max
  Peptide Sequence Number=SeqID_166191
atggctggcagaattactctaatcaatgctgtcctaacagcattgcctatgttcaatttgtcttttttcagggcctctacagcactgattaataggctaactgccattcaaaggcaatttctttggggtggtagctttgaagggaagaagatagcttcggtagcttggagacaggtgtctgcctctagagatttgggagccaaagcatctgaagttgtagccttagggaagctgaaaactcttactgagagtaccattagagaaagagctttaacagcacaacatagttccatgatcactatctcaaaatttgagtatgagtatctaacaaatcatgcagcctcagtagaagaaattgctgataaaaagtag

SEQ ID NO: 74507 - DNA, 729 bp, Glycine max
  Peptide Sequence Number=SeqID_166192
atggggactgacgcgagttttggtgccttagactggaagggcaaaggcgtccatgatgatagccttgatcagatggcatccaaacgaatcaacaaggaattgaaggacctgcagaaagatcctcctacgtcatgcagtgctggcccagtggctgatgacatgttccattggcaagctacaattatgggtcctgcagatagtccatttgctggaggtgtatttcttgtgtcaattcactttcctcctgattatcctttcaaaccacccaaggtttcattctgcacaaaggtttttcaccctaacatcaacagtaatggaagtatctgccttgacatcctcaaagagcaatggagccctgccctcacaatatctaagatcccaacccagatgatcctctggtgcccgagattgctcacatgtataagactgacagagccaattgctggaactgtagtgaacttctgcatatttgcttattttcataggactacggctgaaaccattgggaaaccttatgattgcatttatgttggtctgcaggagcaagcccgtaaagagaaagaagatcctgaaaggatgcttgaggagaaccgaaggaaggttgaagaagctcagagaacggaagctttagagaaaaaagaaggaaggaagaaagatatgaagagatgcaaagacagaagcaagaagccatgcgaaggaagaaataggaggaggagcaagaacgtctaa

SEQ ID NO: 74508 - DNA, 639 bp, Glycine max
  Peptide Sequence Number=SeqID_166193
atggcttctaggaaatataatgtcttggggagaaacattttaccagagaggaaagtagagatatatcactctgagctagatgagtttaaggctaaattggaaaggcgtaatttccataaacgcctcaccaatttagttgatgggagcatagacctagctttggtgaaagaattctatgcaaatttatacagttctgaggaccatccaccaaagcagtccaaagtcagaggtcatttggtgaaaattaatgctgatagtctcaacacattcttagagacacctgtggtattagctgagggggagaccttactcgcttactccagatactgcaagttgcctacagactacagagagatagaggctgccttatgcatacctggtcgagggttcatcttgaactcagagggccatcctgggaagattctcaggaaggatatgactacactagctcaggtgtggagtgtcctctcatactccaacttggccccaacatcacatacttctgacttgacagtggatagagctaggctgatctttggcctagtctctcgcttggatatgaacataggagcactgatctctggccagatgacctctatagcccagtctaacacttctagacttggattgaatgcatga

SEQ ID NO: 74509 - DNA, 203 bp, Glycine max
  Peptide Sequence Number=SeqID_166194
tgtccgctaagcactacacttctgggctaagcgcgaggaagactctggaagaagatgagttgtacatgttcgctaagcgcaccgcttcagttcatccgctaagggagaaaggcgcgctaagccaaaaatcactaatgtgcgctaagcggtccatacatctgcagagtccagagcttaaagcaggagccagtttgagagcttga

SEQ ID NO: 74510 - DNA, 246 bp, Glycine max
  Peptide Sequence Number=SeqID_166195
atgtcaggaaaagctataagagaaatcttaattaggtggttggatgaccttgcagaacaacaaggaggaggtgaagcaaaagctaaggagaatgaaacccgagacgtcgttgaagatcaaggaggagttgaaaaagcaattcgatgtcaatttcttggcggtagctcgataccccgagctcaacaacgccggggcacctcgtcaacttgcggaggttgttcgagaggcttaggaggtatcaattga

SEQ ID NO: 74511 - DNA, 240 bp, Glycine max
  Peptide Sequence Number=SeqID_166196
atgaaggtagctgctgccacacctgagcgatcccttgaggctacttcagagccttctgcacaaggggaggatataccttcaactcaacacgcagcagacccctccactccttttctagagatgctagaggacctgactacatcagtcctggctatggacacttctcctccagctactctagtattgcatctgatagatgaggaggatgttcagacacaggacacccaagaccagccatag

SEQ ID NO: 74512 - DNA, 219 bp, Glycine max
  Peptide Sequence Number=SeqID_166197
atgcatttcgactattttgtgaaaaaaattgtttccgtgaagaaaatccaagccgaggcgcttccgagacgtttccgtaagcaaatccgtgaaggttttccgtcgttcttcaccgttcttcattcgttcttcgttcgttcttcgttcttcaacgggtctgatttcctcttcgatagaggatacgtaggagaaaaagccccgcttttgtcgacctcgtga

SEQ ID NO: 74513 - DNA, 677 bp, Glycine max
  Peptide Sequence Number=SeqID_166198
aggtgccgcaaaataaggacaaagaactcaggggcataaccaatgggcctgtcggtggctaccgtaagtggttaaaagcccacatgcaaggtttggattggctcccgagtttgagaatcgctaaaagggaggaagttgaggtaccggaggaagacgaagaggtgcaggcccttagggcagaactcgagcaagcccaaacagtcaaagaaagggctcgcaaggaagagcatggccgtgaaaaatttcgtggagctttgtggggtagcaacagtgagctcaagcttcgaagggaagagagagaccaatcacgagcacatggcatggtcttaaaagaggagttagctgcttgctcaaggtccaaaagaaacttgtctcagcgtttatgtgagacagagtccaacatgttagccatcgtcagcaaataccaagaagagctaaatctagccacggcccatgggcataaagtggcagacgagtatgcccaagtgtacaaggaaaaagaggctagaggaagggtgatcgactcgttacatcaagaggcagcaatgtggatggaccgatttgctcttactttgaacgggagtcaagagcttccccgattgctagccaaggccaaagcaatggcggacacctactccgcccccgacgagatccacggatttctcatctattgttag

SEQ ID NO: 74514 - DNA, 432 bp, Glycine max
  Peptide Sequence Number=SeqID_166199
atgggttctccacctgcctccactactcctcctcctccttcttctcctcctcgtcctcctcctacttcggacgcatcggcttcgacatttgccgtgaagcgggcacgcaaagcctcacgtctactatcattgtccactagaccacctggttttgagagaccagtggtacatgttgatcctgctacagggaaggccgacggtccccacaagaagaaattaagaacatatttgtggattgtggcacgtgataaggtggacatcacctataagaactggaaggaggtccctactgctcagaaggacttgatttgggaggatattcaggcgaaatttgatatcccagaggcttctgacagtagaacgaaaaagaagttattacagaccgtgggggagagatggatgcagtttaaattagacctcattaggaaatga

SEQ ID NO: 74515 - DNA, 207 bp, Glycine max
  Peptide Sequence Number=SeqID_166200
atgagtcttcattcttcatctagtgttaatggtgagggttctactcctaaggaccccttggaacgaaggattcatgggtatcctccagtagagtattggaatgatcttaagagtgctcttaggaagaggcacattccctcctactatgaaagggagtttatggacaagttccacaggcttagacacgggactatgagtgttgaataa

SEQ ID NO: 74516 - DNA, 536 bp, Glycine max
  Peptide Sequence Number=SeqID_166201
cccgctttacagcagcagcgcagcgcgtggccggcattctcgactattatgccattggtcgcagcaccgcgctggcgctgcacaccgtcagtaatctgaaagttgactatccgcatgcgcgggaaaccagcgaagagctggtgcgactgaatcgcctgcagcaggtcagcggcaagcgtgcgctgattctgcgcggcagtccgggccgagaactgctggcggagacgctgatcgcccgcggcgcggacgtgcaatactgtgagtgctatcagcgctgtgaaaagcagtacgacggcgcgattgaaggccgtcgctggcgcgatcgcggtattaccacgctggtggtgaccagcggtgaaatgttacaacaactgtttgcgctgtttccgccaatcgatcggcgggaatggctgctgcactgtcggctactggtcgtcagtgaacgtttggctacccaggccgccgaattaggctggcaggagattgaggtagccgatggtgcggataacgacgcgctgctgcgtgcgttacgctga

SEQ ID NO: 74517 - DNA, 458 bp, Glycine max
  Peptide Sequence Number=SeqID_166202
ttcgccgtcaaatcccagggctcaaccctggacaggcggtggaaactaccaagctggagtacgagacgaaagctaggggagcgaatgggattagataccccagtagtcctagccgtaaacgatggatactaggcgctgtgcgtatcgacccgtgcaatgctgtagctaacgcgttaagtatcccgcctggggagtaccgaagaaccttaccagggcttgacatgccgcgaatcctcttgaaagagaggggtgccttcgggaacgcggacacaggtggtgcatggctgtcgtcagctcgtgccactgccggtgataagccggaggaaggtgaggatgacgtcaagtcatcatgccccttatgccctgggcgacacacgtgctacaatggacgggacaaaggatcgcgatcccgcgagggtgagctaactccaaaaacccgtcctcagttcggattgtag

SEQ ID NO: 74518 - DNA, 660 bp, Glycine max
  Peptide Sequence Number=SeqID_166203
atgggttcttcacctgccaccacttcttctcctcctcctcctcctcctccttctcctcctcctccttctcctcctcctcctcctcctcctacttcgaacgcatcggcttcgctgtctgccgtgaagcggacatgcaaagcctcacgtctacgatcgttgtccactagaccacctggtgctgagagaccagtggtgcatgttgatcctgttaccgggaaggccgacggtccccacaggaagaaattaagaacatatttggggattgtggtgcgtgataaggtggacatcacctacgagaactggaaggaggtccctactactcagaaggacctaatttgggaggatattcaggcagaatttgatatccttgggcttctgacagtaggacgaaaaggaagttcgtgggggagagatggaggcagtttaaatcagacctcacgagcaaatgggcccttgcagccgatcaggacggtgtcgaggacactgtctgatgtgcgcatgaaggcacaggccatccagaagcagaatactgccccccacgttttgtctcgtgggggttatgattatttggagcagaagctcctgactgagaagacgaagaagttgcaggaagctgcacagtcaggaagcgttgatggcgtcatcgaccctccttccccg

SEQ ID NO: 74519 - DNA, 443 bp, Glycine max
  Peptide Sequence Number=SeqID_166204
ttagccacacttcaagaactctgtagcacgcctacatacctcgctctgctaatcctgttaccagtggctgctgccagtggcgataagtcgtgtcttaccggcgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaat

SEQ ID NO: 74520 - DNA, 249 bp, Glycine max
  Peptide Sequence Number=SeqID_166205
atggtgtttttccaaagctacttggactacaaggctcaaaatgcacaaatgactaatgctctcggaaacggaaacgttgcgcacactccagatgtctgctcaaagatcccaatgcgccagaccacatttcgagaagatccaatggttaacaaaggatgggcagcgtttttaccgagacagattcatgtagcttccttgagaagcttcattaaaaggcttcctcgagaagcttcctcgtggcttctttga

SEQ ID NO: 74521 - DNA, 135 bp, Glycine max
  Peptide Sequence Number=SeqID_166206
atggcctccatcattgtggccatttgctctttcatggcctccatgttggccttcatctgctcttgcacatcctctacttcacccattactctagttctagcacgggttcgaggaaaacgcaagggtcacgcatga

SEQ ID NO: 74522 - DNA, 400 bp, Glycine max
  Peptide Sequence Number=SeqID_166207
ccccaccaacggtcttggaagtcccaaactcaggagcataggtcgctcgagcaaactgaccaatggcttgcacccacttccggtgaaagttgaaaatcctgatgagtcatcagagacatctaacaacagctttcaaaattgccccatcccatatcaattagaccttgcaccttacgcttcagagccctacaatgctcaatggaacgccccggggcttctccgtgacaagcacacgttgcgttcgagtcgtattctcggaaaaatggaggttgatgaaccttggttagggttatggctaccattgaattatcaagtagacatgggagcaagtcagcataagacactggaattgggggtggtgtttgtcattggaagtgcggtaggtaggctttgtggttga

SEQ ID NO: 74523 - DNA, 507 bp, Glycine max
  Peptide Sequence Number=SeqID_166208
atgtcaagttcgctaagtgcactgctccaggtcatcaagcacgccacttcaactcatccgctaagcgaaacaagggcactccaaagtgtagaaatccaggtaggtgagctggcagaagcagtgactcaatttatggtcagacaagaaaaatcctttgtagaggttgaagctcaaaagaaaagccctgtaaaagagcatgagtcaagagaaaaagatgaggagaaagatgaggaacaagcacaacaacaatgggagaaatactcaacagtagaaaaccaacaagaaaatattctccaaagcaataaccttcctcatcaactgattgacaagaaaggaaggcaaagagagcatgaggaaatcttaagtgccattctttctttaataactaacacctttcttgaaatgatttggaatgtccttccagattatatgaaggtcatgaaatttctagctaaaaggcgaaacttcaaggaagatgtgttctttgtgactttcatgccaccttga

SEQ ID NO: 74524 - DNA, 279 bp, Glycine max
  Peptide Sequence Number=SeqID_166209
atggagagacgccataacttcaacaatgggaagatatctcaagaaggttccctaacacttaaattctataagtgtaatcgacccggtcacataaaggcacactgccccacaaatgaatcatggccagagaagaatgagaagaaaagtcatgaagaaaaaagatccaacaaggcgtatattgcatgggatgacaatgactcatccgatggttcagagaaggagatcaaccttctatccaaggactatgagagcgatgagaacatctctcgagaagattaa

SEQ ID NO: 74525 - DNA, 866 bp, Glycine max
  Peptide Sequence Number=SeqID_166210
atggccgaaatcgccgtcgccgagcgaatgatgcacgcagtcgccctgctgctgggcgtggctggcgggagcgccgacgatgtgaatcaccggcacatattcggcgtaactgccggcgatgccgttaatcgcgctgagttcaccgacgccaaaggtggtcagcagcgcggccgcgccgttgcagcgaccgtaaccatcggccgcataggctgcattgagttcattagcgcagccgacccaggtaataccgggatggtcaatgacgctgtcgagaaattgcaggttgtagtcgccgggtacgccgaacagatggcggatacccgcctggtgcaaacgatgcagagtattagcgatgtggctgaactggcgagattttcgccatcatcgcgctgtcatgcatggcaagcattcgttacgacgacagaaaattctgtaagttgcgatctttgccgcgttacggcgcagtgtaaacgcatacactgctatgctgatgccactttctcccacctgagacaggaacgctgcatgagtacttttccccacgccgaacgttatcaccagatgcagtatcgccgcagcggccgcagcggcctgaagctgccggcgatttcgctgggtctatggcacaactttggcgacagcacgcgcgtcgacaacagccgcacgctgctgcgtcacgcgttcgatcgcggtataacccattttgatctggccaataactacgggccgccgcccggttctgcggagagcaactttggccgcattctgcgcgaagattttcacggcctgcgcgacgagctggtgatctccaccaaagcgggttataccatgtgggacggtccgtacggcgactggggctcacgcaa

SEQ ID NO: 74526 - DNA, 351 bp, Glycine max
  Peptide Sequence Number=SeqID_166211
gagtacatcctttgtggtacaagtagagggtacatctacttgggtttgactgagaacaagagagggtacatctcttgtggatcagttctagtggagggtacatccactaggttcaaagagaacaaggaagggttactccaagatcatgataaagaccaagtcaacttgtgtctcatgacaaaatctgatgagaataacaaagaagattttgtaaggaaaagtggtacatcgacagtggatgttaccaagcatatgacgggagatgtatccaagtttacaaccttttccccaagaaaagtggacatgttacatacggcgacaacaatattagtaaaatctcaaaagaggtaa

SEQ ID NO: 74527 - DNA, 623 bp, Glycine max
  Peptide Sequence Number=SeqID_166212
gactacacgtcctcaccttcaaaggactacacgtcctaacctttagagggctacacgccctcgcctttagaggactagacgtcctcgcctacagaggactgcatgcccttgccttcatagggctacacgccctcgccttcagagggctacatgccctcgccttcagaggactatacgtcctcgccttcagaggactgcacgtccaaaccttcagagggctacacgccctcaccttcaaaggactacacgtcctcgcctttagaggctgcacaccctcgcttttagagggctacatcccctcgccttcagaggactacacgttctcaccttcagaggactacacgtcctcaccttcagagggctacgcgtcctcgccttcagagggctacacgccttctccttcagagggctacatgtcgtcacctccagaggactacacgacctcaccttcagaggactacacatcctcaccttcagaggactactatgactggagcgttgcctacatcccgtggccggccagcaagcgaccaagtccaaagccaagggtaagcaaaggtactatgtccgtgaccgacaagtcatcacgcgcccagctcaagacgttaaagaagcgctactag

SEQ ID NO: 74528 - DNA, 303 bp, Glycine max
  Peptide Sequence Number=SeqID_166213
atggctccgaaaaagcttttcgcgaagagatctgggagggacgccgcggctgaagggaccagtgctgcccccgagtttgatagccaccatttcaggagcgctgagcaccagcagcgcttcgaggccatcaaaggatggtcgttccacagagagagacgcgtccagctcaaggacgatgaatacatggattttcaggaagagatagctcgccgacattggacgtcgctggtcactcccatggctaagtttgacccagatatagtcctggagttttatgctaatgtttggcccacagaagaggga

SEQ ID NO: 74529 - DNA, 63 bp, Glycine max
  Peptide Sequence Number=SeqID_166214
atggtggcaactgccaagtttgacttggaaggatgctcacaaataaaaattaaagaggaataa

SEQ ID NO: 74530 - DNA, 1386 bp, Glycine max
  Peptide Sequence Number=SeqID_166215
atgatgcgaagaactaatgccaatgatgccagagctgataacaacactttggatactataaacgctgctgcttttgccatagcctctgcccagaaccgcgtttctcaaccttctacccagaagaaaagatggggaagctggttgggcaaaattgggtgttttggatataaaaaaacccgaaagcgcattgggcatgctgtcctagttccagaaccaaccaccaatggagctgatcctgctgcagctgctagttcaattcaagcacctagtataacgcttcctttcgtagcacctccctcatctcctgcatctttctttcaatcagaacctccatcaactgcacagtcaccaattgggaaagtatctcacacttgtgtgtctgccagcatctactctcctggtggccccgcctcaatctttgccattggaccttatgcccatgaaacccaattagtctcaccacctgttttctcggcatcatccactgctcctttcactccacctcctgaatccgtccacatgactacaccttcctcgcccgaggttccatttgctcagctacttgaccccaacaataagaacagtgaaacctttcagaggttccaaatatctcactatgacttccaatcctatcagtttcatcctggaagccctgttggtcaactcatatcaccaagatctgccatctcagtttccggcacctcatcgccactccctgactctgaatttaatgccactttcgcccatatccttgatttccaaagagcagaccctccgaagcttctcaacttagataataaactgtcttcttgtgaaaaccagaagtcaaatcatggttccgggtctctgaccccagatgctgcaaggtccacaactcaatctggttttctatcaaatcattgggtttctgagatcaaaatgtccccacatcctagcaataatcgcctcaatgagattagtataaatcatagagtttcatttgaattatccgctcaaaaagtgttgaaatctctggaaaacaagccagcagcatcagcgtggactaatgtcctgccaaaattgaaaaatgatgctccaacaacagacaaagaagaaaaatcagaagaaagtgcgcttgatgacaaacaagtagtttctgaagctcacaatgatcaaccactggaaaccactttgggtggagataaggcaacaacagttcatgagaaggatcagtccttaactctttcttccgctaaagaattcaattttgataatgcagatggaggagattctcttgctcccaatatagttgctgactggtgggctaatgagaaagttgcagggaaggagagagaggcatccaaggattggtcctttttcccaatgattcaacctggtgtcagctaa

SEQ ID NO: 74531 - DNA, 81 bp, Glycine max
  Peptide Sequence Number=SeqID_166216
ccacgaacaggagaggatgaagatgcgcagaggagagaagacgacaacggaggagaagaaaaacgcagaagaggaagctga

SEQ ID NO: 74532 - DNA, 1623 bp, Glycine max
  Peptide Sequence Number=SeqID_166217
atgaagattgttgtatgggaaaggggatcgcctgcatatcaggagattcaggaattggtaaaccagaacttggttcttgagtttgcttacagatttcaccagagatacaagatggtcttatggataggtggggagagtaggcatataaggcaaaactatctaaaactcaggtccgttttagaggttgatgcgagtgttgagaatagtttggaaaaaactaggataaaggggtttgaagaacaagaagaagcagctgtttctggaattcgcaaagagctaatgagaaacattccgtatcttgtgatcattgatgacttggaaagtgaaaaggattggtgggatcacaaacttgtgatggatctcctccctcgttttggtggagagacccatgtaattatatcaacacgccttcctcgtgtcatgaacttggaacctcaaaaactttcatacttatctggagttgaagcaatgtctctaatgctaggaagtggcaaggactatccagttgcagaggttgatgctctgagaactattgaggagaagcttggaaggttaactttgggccttgccattgttagtggaattttgtctgagatacctataaccccaagcaggctcttagatacaataaacagaatgcccttgaaggacatgtcatggagtggtaaagaagctcgctcattcaggcagaacactttcctcctgcaactctttgatgtttgtttctcaatatttgatcatgcagacggcccaaggagcttggcaaccagaatggtactggtaagtggatggtttgcaccttgtgcaattccagtttccttattggcacttgctgctcagaagataccagaaaagcaaaaggggacttgtttctggagaaaattactgcaatccataacatgtgggttcacatcctcaaacaccaaaaaatcagaattagaagcatcttccctactgcttagattcaatattgcaaggagtagtactaagcaaggtcgtatccatttcaatgaaatcatcaaacaatatgctcggaaaagagaagttaccggatctgcgcaagcaatggttcaagctgttatcagtcaagggtcaatatctgaaagcatagagcatttatgggcggcatgttttctgctatttgcatttggtcataatcctccggctgttgaacttgaggtttcagagctcttatatcttgttaaaaaagtggttctgcctcttgcaattcacactttcattacatactctagatgcactgctgctatagaacttctgcacctttgcaccaatgccttggaagctgcagaccaagcattcgttaccccggttgacaagtggttcgacaaatcactttgctggaggtccatccagactaatgctcagttgaatccttgcctttggcaagagttggctttgtgtagagctactgtgcttgagactaggggcaaactaatgctaagaggtgcacaatttgacataggggatgatctaatcaggaaggctgtttatatcaggacttcaatttgtggtgaagatcatcctgataccatatcggctcgtgaaacattaagcaaactcgcccgactaattgcaaatgtccaaatccgcgcatctatatag

SEQ ID NO: 74533 - DNA, 465 bp, Glycine max
  Peptide Sequence Number=SeqID_166218
atgcagctcccggagacggtcacagcttgtctatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatcctcaatactttcaaagaaaacaagaagaaacttggtgagctattacttcaatgcatttcttattcaactaagaacctatcagaatcgggtgtctccaaagagcgttgatagtgatgatgatgaagtagaatttggatcttttagcgatggttttgggatggaagccgtcaagggtcctgatgatgatttcctggaatgttctctgaacaagcagtgcacagatttcgaatag

SEQ ID NO: 74534 - DNA, 736 bp, Glycine max
  Peptide Sequence Number=SeqID_166219
atggaagaatggccgacattctcaaatgggtcttccttagattgccttggaggagttgaaactgttggtgcatttcctggaaatgtttgttgccctggaaaggaccacgtggataatggtgctgaccatggcaaacttaaacagaagtacttgttctaccaacttttccctgcttacctgaaggatagttgttccatggatggtgttcgacctctgccggttttagtcgacggtcaacagctggatttgtacaaactgttctccctggtgaaggaaagaggtgggtatgcccgagtgtcgaagaaaggattgtggggttctgtgaccaaggaattgggcttgaaccctgtggtttgctggtctgtaaaattagtttttgacaagtatctgaatgatttcgagaggtggctcaagaaaacttttgaagagaagaatttaaaaaatgggaaccatgggtgtgattggggtttaaagtggttgcctttggatattgagaaagagtttagagccctgttatgttcaaatctaaaggacaaagatgatgatagacttgtcaagtcaaaatcaattaaaaaaaagaaaaatgctgatttggttaaccacaagaatggtaataatctgttggacaccaacgaccaaaataataaatccaaggatgtccaacgcattgaaggtgataatgatgaaaaatccgccaatggcattaagggcaatcctgctaccttgggtgcagaag

SEQ ID NO: 74535 - DNA, 618 bp, Glycine max
  Peptide Sequence Number=SeqID_166220
atgtccattttaatacttcgacttcgtaaaaggatgcgtagggataacaaaagaggccgtgttgccttaattagcatactacaaaggatcagcgatcccagaggcagcccagagtctctgaataaaagcaccttgcatttcgtccggtataaaggccgttctgcaaagagggcaggttctctgatcgtaccccatccaacggtccaaacatcctcggtggaatatgtgacgacaattcgccagccgtctgatctcatcgttttcctcgaactcgctcagacacaccgcgcacgtctccgggggatccaccagctcccggaacttcaccaccggcaggatttcccggatgagcgtggccgacacggattcgaactcttcgggcactcgggtctgggtttcggcccaggcaatgtcgggctcgaggaagtcgtggaggcccatgaagcggaggaggctgcaaatcagcttcctgaggaggcccaggagggagaggatgtgaaggagaagcttcgggaagaggagctccgagtaccccactgggaaacccatcagaattcagatgttgtttctttccgtgtcaagagaaaaagtgagagagagagagagagagagaagtga

SEQ ID NO: 74536 - DNA, 225 bp, Glycine max
  Peptide Sequence Number=SeqID_166221
atgttaagcttggatgaagacattcctcgtgtctccaaagttaagtggcggctaagctgcaatgaaaaagacttttcacgtttggttgaccccttcgtgccctacaagatccctgccaaccgaactctaatgtctgcatgcactctcttctttccaaggaatacaagccatcaatggttacaaatccactgcaaaacccaacgattatttctacgctcttattaa

SEQ ID NO: 74537 - DNA, 423 bp, Glycine max
  Peptide Sequence Number=SeqID_166222
atggcgaagagcgtatgggttcatccctggccccagcatgttggtgtcaagagtattggtggcggttttgttggttatgttgatgtactcgtacttgaagaactgatttcagagaaggagaacgaaactgtgttggcggcagagaaggcagaggcgaagatagtgaagaggacgccggtggtgggtgatgtggagcacacaaaaatggaggcattgagaagcatggatttttggaccttgttcgtgtcgtttctgtgcggagttggaacgaatttggtcgtggtgaacaatatggttcaagggacttttaatttggaggaaaagatgttgttggatttgttcaacgatgatctatctcgatgcatgatggcggtggtgtcagaacaaattatggttttgagaggaaagaaaaatattttttaa

SEQ ID NO: 74538 - DNA, 204 bp, Glycine max
  Peptide Sequence Number=SeqID_166223
atgttgggttcacccatttgcaaagctgtggagatagcagcgaagaagagtcatcggtgcttcctcgtcacaccaaagtggttgaatgctcttagggtgattgagcaccgaccagtaatgaggaagatgatgaccttgaattttaaaatatgtcgtggaatggatcagatatggattctttcagtttgcctaaaagatgtttga

SEQ ID NO: 74539 - DNA, 831 bp, Glycine max
  Peptide Sequence Number=SeqID_166224
atggaccttgggcttgacgagcttataagccttatcaagggtggaccttcagtttgggcagcgcatgctcttgcatacgtgtcacttcctgaagtggcatgtattgaaaacatagtgcatgtgggagagacttggattatcttgagtgttgattgtgcatcggggcctccaattgatcatgtaccgatgtctagcatggctactgaaggaggattggagcttttaaaaggaatctcgcttccgaggctagatcatgtgctaactatgggtgaaagagagatatggcaagagacttcaggtgcaaaggcaattgaacttaccagtattgcacaccacactggcatgtatttggtgagggatgggagtagaaagccacggaaaactatctcctcccacactggagcacagactgacactactgttgcatacaaaagcattgccacaggatccctcgccattattgactgttcaacacttgaaagggtgacaggtgtggagggcaaaaggggtaggaggtccaggttgaactgtgagagccgattgacaagtggaaacatgagacatcccgtgatgacatctaattgccaataccctttcaggctaaacttgaaccagtcaggtggaagggggcgaaatcgagaaagacagcgaagaagaattgcaactccagcaagtccttctgttacgtcagtaacaaggctgaatagtgcctgccctctaaatgtcaaagattccttgctaaagccagttatgtgggcggcaaaagggatcatccaagatcctataaaccaaaatgccgtcgtccaaagaagcataacctgcatcgtataa

SEQ ID NO: 74540 - DNA, 234 bp, Glycine max
  Peptide Sequence Number=SeqID_166225
atggactattatgttcctttggtagtgttttactccactgccaccagagatggcactgttgtgatgcagccagtggaagggagacacacgatgcttgtaggtcacaatgatgcacgtggtggtggggtggtggatttggtgtggtatgatgtttgggtgctgcaccaaatggtgatgaaggggatgaaggtggagagaactgggtatagaaaatactgcaaagatgagcattag

SEQ ID NO: 74541 - DNA, 894 bp, Glycine max
  Peptide Sequence Number=SeqID_166226
atgggatccaaaattgactgggatttcatctgggtgttgcttctcaccttgtgttgctgcggctccttggtgcacagcttggacaacactgctgctgcatgtgaatcattgaattccttggttcaagattttgctttcaggtcactggtcaaacacaggcctcaaactggtgctctatatgatgctcttcttccaaggaacctgtccggtatggatgtttcagtagtacgtctcagaagcagaaggctctggaacaaaggtgccaactttagttactttcagatcccaccaagaaccatgtccattccccatgtgaggaggttggctattgtctaccaaaacttgggcaactggtcttcccactacttcaatttgccaggttactcactcatctcttctgttgtcggcttcatggtttttgatgcctcaaatgtaacagacacgagtgagagaaacatcactctcaacacaatggggcagcccatatctgttcaatttcccaacgttacatttatgggtaggggtagcatcaacacaagggtgagatgtgtagctttcaatgccaatggaacatttcaacttactgagatgagttcccctggagtgtgtaactccagagaccagggccacttttcagttgtactcccattggagaagaagcggggaacatggtatctgtgggtgattggctttgttgttggattttttgggttgatcatagcgggctatgcggttttttcttctatgagacttctcaagaccaagaggattcaagccatggaaaaacaagctggtgaagatcaggttctagaaagtagatgggttggcaacagtaaaatgccctccgcagcagtgacaagaactcagccagttcttgagagcggtgttctttag

SEQ ID NO: 74542 - DNA, 1038 bp, Glycine max
  Peptide Sequence Number=SeqID_166227
atgggaagctgcagtgtggataggcttgaggtgttcgaagttggaccatgcaaagatggttaccaaatgggtctcttaattggccaaagattctccgaaaccataaggagtagagtggcctcagacctcattctacaaaaccagcttcgaccctttgcccactcccctcattcacagtcacttctcaaaccacttttttataacaatcaaaccaaattcccaaggtattgggatgaacttttggggacagcagcaggaagcggtgtgccatttcttgatatattgcttatcaacttaaggaaggagattctggcgtttattcaaaaagaaggagcaaaaagtgccaactccgatacctcggatgattgctccgatgttcttgttgtcagtgaatctatggctattgcggcgcacaacgaagatgcaaatgttgcccttgttggccacacctacataatcaaaggaatcttgccggatggactcttctttgtaggttatacatatgccggggagcttccaagctgtgcatttgggttcaatagccatggactggcattcactctggattctgtaccccccgctgaagatgagattgtggctggtggcattgggcgcaacttcatttcgcgagaccttcttgaagctacaagcatggatgatgcaatgaataggatcaaatcgtcagaaatttctgtggggcattcttataacttgtttgaaacaagcacgcgcaggattgttaatgttgaaaccgcatctaggaagcggatttcagtttatgaagtacaagatgagaattcaatcagcagacataaaagggcagctgtcttgacaaaagaatcaaaaggggatttcctgtcacttctaggagatatggatgacaaaaaataccctatctacatgactggtccattacttcacaccctttgtactgcccttatcgatctggacaaacagacactatcaattattgaagggaatccaaaaaaaggagatgtttcacatgttttctctatcgcccctcaaaagtcaccatga

SEQ ID NO: 74543 - DNA, 606 bp, Glycine max
  Peptide Sequence Number=SeqID_166228
atggttagaaccagaagtttgggtcgaactttaggcaaggttataagaagagtcctagggagagaagtcagccatgatgcagatgaagcccccaaacgacaaagacccatagcattcgcatatgggcaacgagaagttgcacttgttggtgaggatattcaccatatggatcatgcagatgacgaggatcatgaacagcctgaagaagcagctgttgatgatgaatgtcctgagctgaaattatgctcccatggaaagaatgttgataaatttagtaggcctgccccagagatcgaagggtcagtggctgtcacaggattaattcctttgatcgcatgttcactggacattggtgatcgcggacttatgtctgcttttgtggagaggtggcatacgaaaatcagtagtttccatctgccggtaggagaggtgactatcaccttggatgatgcggcgtcgttgctgcatttgcccattacaggcacattccatagttttgagcctcttcatgtggatcatgtcgtgttgctcttagttgaattgcttgaagtaagtgttgaagaggcaagagctaagacagtacaatgccatgaggcatatgtttaa

SEQ ID NO: 74544 - DNA, 603 bp, Glycine max
  Peptide Sequence Number=SeqID_166229
atgtatgcatggagtccagatgtgaaggacataataattattgtttgggggtggggaaaaggatgggtcaatgtcatggatgacggtcctgcaaaattaaatatcatccctgatcattttcaagttccaacagcaagtatagaatctcctgagagcagaacatcatctattgccgaacctggaaccgatcaatcttcaagcggctgtcatggggttccagtactggaggtcaggaaaaggtctgatttgagcagcttttatgctgtgcatcttttgtcgttggtgaaggttgagctaacagctgcagaattagagtcacttcgatcggagcttgctgatatagcagagagggaagctcactcgaaagctcagttggaacatattgatgaagttttgcggtctgctcgtctatctggatatttatacattcgaactgtactgactgcccaccctacaccaagatgggcaacactaccaggagaacctccacctttagatgatactgaagtagatgattggcttcctcgttttgtcgttctccatggagcatgtatatttttatatttgttgtgtacaggaattgctatttcatcacaaaagtga

SEQ ID NO: 74545 - DNA, 1803 bp, Glycine max
  Peptide Sequence Number=SeqID_166230
atggcggatgcagagccgcagtctcgatcgcttgccttctcatctcgccgactctctcctccgccgcctcatcgcccgccgcctcctttacccctctctcctcgagttagtactctcatcttcaccgttgctgaagaggttgatgtgagaggggacaactccgtggacgcagaatggatggcgtatttgggagcatatcgtcacttgcgctacttgaacctctccgattgtcatcgagtctccacttcagctctttggccaattacaggaatgagtagccttcaggagttggatctatctagatgcttcaaggtcaacgatgctggaattaaccatattctttccattcctaatctggagaggctacgtatttcagaaacaagcgtcactgcaaaaggagtcaagcttctcgcctcgcttaaaaacttgtctcttcttgacttgggtggtttgcctgttgatgacgtcgcattaacttcattgcagtttagcactgcctctgatgttgcggctgtaaaggactgctttatgagtctgtacagttctcaggtactgaaaaggctacattatattgatctctggggtagtaaaatatcaaacaaaggtgcttctgttctcaatacattcccaaagttgacctatctcaatcttgcttggaccagtgtcacaaaattgcctaaattatcatttcttgaatacctgaacatgagtaactgtactattgattctatacttgaagatgataaagctcctttggcaaagcttattctctctggggccatgttcatgaatgaagctgaagctttgttatatgcaaatacaaatttcctatcctttttggacgtggccaattccagctttcacagattcttcttcttaagtaaaatgaaagtgatagaacatctcaatctcagctcatgcatgatgggggatgattcagttgagatggttgcgtgcgctggtggaaacttgaaaagtctgaatttgagtggtaccagggttagttctgctggattagggattttagctggacatgttccccatcttgaaattctgtcattatctcagacaccagtggatgacactgccatctcatttatcagtatgatgccttcattaaaggatgttgacctgagcaatacaaatattaaagcttcttatccagttatccgtattttcaactcaggttttctgcaccaaggaaggactgatgtgaactccctgctctctctaatggctctgcaaaatcttaaattagaaaggttgaatttggagcatacgcaagttagggatgaagcgttataccctttgtcaagcttccaagagctgagatatttatctcttaaaagtgcttcacttgcagacatctcactttactatttatcatcaattcctaaattgacaaatcttagtatttgtgatgcggtattgacaaattatgggcttgatatgtttaaggctcctgaaactctgaaactgctggacctcaaaggttgttggctcttaactgaagacactatcttgtcattctgtagaaatcatccacaagttgaagtcaggcatgaacttggtaccttatttcctgtcaatcaaaacggacttaatcattcctctccatctcgatcaacttccaagactatgcaaatgactaagaagaaagatcaaattcccttatctccatattttgttgatcaaagattgaagtatagcagggacgagttacttgcattgcagtttacatctttgccccttgcatctagtagtgagagtggcaattcaatatttgagaaacaattgggttga

SEQ ID NO: 74546 - DNA, 1596 bp, Glycine max
  Peptide Sequence Number=SeqID_166231
atggcagaaaagaggttcatcgttgaggtggagaaagccacagagggcggagaaggaaggccatccatgggccctgtctaccgcagcattttcgccgacgatctacttcctcctcccattgaaggtcttaatacctgctgggatattttcaggatgtctgttgagaaatacccagcaaggaaaatgcttggtgtccgtgaaatcgtgaatgggaatcctggcaagtacaagtggcaaacttacaaagaagtgtatgacttggtgatgaatgttggcaattccatccgtgcttgtggttacggggagggtgtaaaatgtggtatttatggtgccaattgccccgaatggattgtgagcatggaggttactcctgaacaaaagcaagaagttgaagagtttgggttagcaatgtattcatgggatgaatttttgcaagtgggtcataatcagagttttgatcttcctgttaaaaaaaaaagtgatgtgtgtacaataatgtatacaagtggaactactggtgatcccaagggagttttgatctccaatgagagcattattacactcttagctgggattcagcaattgctgaagagttgcaatgaaaagttgaatgaaaaagatgtatacatatcataccttcctcttgcacatatctttgatagggtcattgaggaggcaatgataatgcatggtgcctcaataggtttctggcgtggagatgtcagactgttactggaagatattggagagctaaggccaaccattttcgttgcagttccccgtgtgcttgatagagtgtacaatggtcttactgaaacctgtgctggaacctttgtttcattaccaaatgaaaaggacatgcttggtacggtggggcctcctgtaccatatgtggatgtgcgtcttgaatctattcctgaaatgggatatgatgcacttgcaaccactccaagaggagaaatctgtgtgaggggaagtactgtgtttaccggctactacaaacgtgaagacctcaccaaagaggttatgattgatggatggttccacacaggggatattggagagtggctacccaatggaaccatgaaaattattgatcggaagaagaatatatttaagctttcacaaggagaatatgttgctgttgaaaacctggagaatatttatgttcaagcttcttctgttgaatctgtatgtcttgtgaacccttctcttttaatcaacttatctgccttcattatgaatgatatcaaaagttttgagtcatacctcgttgctattgtcaaccccagcaagcaagcacttgataagtgggcagaagaaaatgatataaccgcggacttcaattctctctgtgaagattctaggacaaaaagttacataattggagaactcaccaagattgcaaaggataagaagttgaaaggttttgagtttattaaagctgttcatcttgacccagttccatttgacatggaacgtggtcttatgactccaacatttaagaagaagagacccgaattgcttaaatactatcagaataccattgacaacatgtacaagacacagaacacgcagaacaaatccagtgcctga

SEQ ID NO: 74547 - DNA, 456 bp, Glycine max
  Peptide Sequence Number=SeqID_166232
atggaacctccaacgtcaccgctgccaacttattggaccaacaactcttcctccgacgacgccttgcagatcatcgccgacaactcttcagggtttagcggccgtattccgtttgggaaaatagtcaaatgccctagctgtcggatagctgtaggtgttgcacagccacaacaaggatcacctcctgccgaacgcagcatggacatcaccgcatgggaaagggggttaagatacgtgaaattgatgaagcaaagcattcctgctgctgttcactctattgtggtgcagaccccttctggtctgactcgcactcatagatttgcaactgaaacagttgatctgccagcacaagaaggcgaaagggtaactgttgctgtggcagctctgtctaatgtatatagaaagagaatacaagcagaagccaatgatgaggctgaaagacttcttagttcctag

SEQ ID NO: 74548 - DNA, 396 bp, Glycine max
  Peptide Sequence Number=SeqID_166233
atgattcgcaccatatttgcttgctttaatggaaaagtatcacataaaaaagtgaaagtagagccactggaagtcacaaaaccagtttacagagatgagttaaccagaaaacaaaggccaaggaaggcagtgcagaaaactgtccggtttgcagaatcagaacctaccattttgggagaagatagtgaaaaagagtttgagaaaacaaggtttggtagtggtaatgaagtaggagaaaaagaagagatgagagtgaggattaaattgacaaaggaagaagcggcacggttgctatcaaaatgcaacaatggaggagttctccaattcaaggatgttgctcatgagcttgcgttcctggttaaccgagttaacattgtgcccgatgcacaatgctaa

SEQ ID NO: 74549 - DNA, 4053 bp, Glycine max
  Peptide Sequence Number=SeqID_166234
atggaagcggatttcgtcaccagtgacatgctcacactcacgcaggacgctttttacgccaacgataatgatgatgtagctgttgaaggggaaagatgtggaatatgtatggatatggttattgacaggggacttctggattgctgtcagcactggttctgctttgtatgcattgacaactgggctactatcactaatctttgcccactttgccagaatgagtttcagttaatcacttgtgttccagtatatgataccattggaaacaataaagttgaagatgattcattcttcagagatgatgactggtccattgaagagaagaataacacactgtcatttccctcttactacattgatgaaaatgcagttatttgcttggatggtgatggctgcaaggttcgcaatgggttggctactattgaaggagattctgatctcgatacatcaatagcctgtgattcatgtgatatatggtatcatgccttctgtgtgggatttgatactgaaggtacatcagacagtacatggttatgccccagatgtgttgctgatgaagtttctaaaggaacatccaattcagtagagaggacaaccgtggaatgtaatgcagataatcgtaatagtaacagtgaatgccatgctgaggattccttttcaggaaaagtgtctgtgtctgttgctgatacaggagagacagctgttgttgtttcaatggttgaccaaacaatatgggttccggcaacaagtgagaaaagcctattgtcttttgaagttggtgggtacccaatgactgaatcatgtattttaatgtctgacacaaatggtcagcaaagtggggaagtgaagacagagacaaatacgttacgaatcatggaggaagaagaactggaactgtctttgtcaaacaacatatcctgtagcataacttctaaatccttagtgcataatgatttaaagaaaagtgtcagtggagcaagggatgacccaagtggctttgacggaaccaagttattcaacgagtcccttaccaaaactagtccatccagaattgaatctgaaatgggtcttcaacttggtttgtcagtgggctctttcttatctgttgatagtgcagacaagaatgaaacaaaagatcaagcaactgatgtcctgtgcttgagttcagaagaatgttttttgaaaggagatgaaattgaagccaatgcttgtaaggacaatgccagagtggctggtggaaagagaaagcatactgattatagagagagagagaatgtaaaaatgctgtgggatgaagcacactttgccttagtcctcactcctcatgcttattatactctgacagatgactccaacatggacactagacccaacactaacacagatgctctgacatggtcaattgatgagcaagtttatataaaggctgatgatggagatgtcaagcctgaacttccagaagaagatgacaagcctgaacttccggatgaaattggacaaaagaaaattagagctaccggtagtcaaatgaccagtactaatgactctgcagatgctcatcccttagaaaatgctcagaaatgccctgctttaaagcattctccaacaaaggccattgtcaaatcaaatataatgaatatagttaaagggacaaaccggaggcaatccaagggacgtactgacactaatgcttgtgacaagttatctgaaaacaaaggaaatatggctgggttgagggttaaaaagatcatgaagagagtctctgatgatggagaatcatccttggtagttcaaaatctaaggcaagaaattagagaagctgtccgtaacaaatcctctataaactttgaggataaccattttgatcccaagcttcttgaagcatttagggctgctataacagggcctaaaactgaacttgtaaacaagttatcccctgcagctataaaggcaaagaagtcaatgttgcagaaaggaaaagtgcgtgaaaatctaaccaagaaaatttttgggacttccaatggaagaagaaagcgtgcgtgggatagggactgtgaaattgagttttggaaatatcgttgcatgagagctacaaagcctgaaaagattgaaactttaaaatcagttcttgatctactaagaaaaggttcagacagtccagaatcaaagcaagcttctgaatgtcaggccaagaatcctattctttccaggttgtatttagcagatacatctgttttccctcggaaagaggatgtcaaacctctctctgtgcttaaaaccattgctaactcggagcaaactaagcataacaacccatcagacaaagcaccaaatctatttgttgataacaatactaaagcaactaatgtatataatcttttatcaaagaacagcgtttgttcatctgaaaaaaaagtagataagaagcttgtacatggtccagttggtgataattcaacttctggtaaagtacgttcaaacaatcactcagaaaggacatcggtttcatcagctggtgccaaaactagcacaaaagagttaggccttaaattaggttgtatgaagagtgataaaagaaaatgggccttggaggttcttgcgaggaaaacagctgccacaagcaggaacacagcaaatggaaatcaggaagacaatgcagtttttaaaggaaattatcctttgcttgcccaattgccaattgatatgagaccagtattggcaccttgtcgccacaataaaattcctatatcagtgaggcaggcccagctttaccgcctgacagagcgcttattgaggaacacaaatctggctgtgattcgcagaactgcagatacagaattagctgttgcagatgcagttaatattgaaaaagaagttgctgacagatcaaacagcaaacttgtgtatttgaaccttagttcacaagagctcttgcatcgcacaaataacacaaaaaccaatgtagccacagatacaagtccaccagcctcatcagcaatgcttactgatcaacaatcggaacttaatactgatgatctttcaactgacccggaagttgaaacagccttgaaaaatgctggtctgttgtctgattccccacctagcagtccacatgagagcagagaaacatgtaatagtgatatgtcagggcctgataatatacttgaactagattctcatcctgatctggatatttatggtgattttgagtatgatttggaagatgaagattatattggtgctagtgttacaaaggtctcaaatccaaaacaagagcaaaatgagtcaaaagtgaaacttgttttctccacgatgaatttgaaaaagtcagatatcgctttggattgtgcagactgggaggggtctgaaagaattgaagtgccaggagatgcatcctgctcaccaaattgtcacaatgatgcagtccttagggacagggcttctacaattgatgaggagatgggccagccttctgtttcttctgagctcctaccctgtgaggctgctgttgagccacctgactcagaatttgaagaattatatggcccagacaaagaaccacttataaaaaaatttccagtcagtgaatcaagatcattacttggagatggcaagacagaaaatctaagtgtggccaatgattgccataatgacgaaacagaggtcttggacgatgcagtaaatgcttcagaacttgagaatgagaatctcacagaaaaagtttctgttactaccatcactgacaaatcttctaatgtgtctgagggtggtgaaaattcccaaaagaaggaagagaaatctaatgtcattgctaagcagactgactctgtaaatcatgtagaagcttacatcaaggagcacatcagaccactgtgcaagagtggtgtaatcacggctgaccaatacaagtgggctgttgcaaaaacgactgagaaggttatgaaatatcattccaaagcaaagaatgctaattttctcataaaggaaggcgagaaagtaaagaaacttgcagagcagtatgctgaagcagcccaacagaacagaaaaaattga

SEQ ID NO: 74550 - DNA, 1719 bp, Glycine max
  Peptide Sequence Number=SeqID_166235
atggcgatcctctctcaatccaccgccagcttctccttctccttctccttcgtctccactcggaccgattccactcgcctaactcgcttcccctcccgcgtcaccttccgagcccgctcgccccctcgccgccacgccctcgtctcttcgcgcctcaactcctccaggtcccccgacgccggcggctccctgtcgccggacaacggcagcggtgacgtcgcctaccagctccaccacgacttctctccgcggcgccggcgccgcggctcgccggtgttcgtcacgctgccggtgaattccgtcggccgggagggccgtgtcgcgcggcccaaggcgatgatgttctcactcaaggctctcgccacggccggtgtggaaggcgtggttattgaaatttggtggggattggtcgagaagaacaaacctagggtttacgattggagagggtatgaggaactcgtcgcgatggcgtgcaagtgtggccttaaggttcgagcggttctcgcctttcatcagcatggcacgggacctgatgatcccaattggtatgtgctaattatcgaaaatcacaccttcaccccaattggtaggatacctcttcctctatgggtgcttgatgagatacagaaagatatagagttagcgtattgtgacaggtttggaagaagaaatattgaatacatttcccttggatgtgatattcttcctgtgctacatgggcgttcacctattcaagcgtatgcagattttatgaggaattttagggacactttcgggtctttgcttggtgttatcatcacaggtgtacagattggcatgggtcctggtggtgaactaagatatccttcattctcttcacaggagccaaatttggcttggcctcatgaacttggagagtttcagtgctatgataagtatatgcttgcttctctgaatgcctctgcaagaaatattggaaagcgtgaatggggaaatggtggtccatttggtagtggaagtttgatgcaaaatccggagcatactgattttttcaaaaatgacggtggctcttgggacacaccatatggtaaatttttccttgaatggtactcagatatgttgctgctgcatggggagaggatttgtagggaagctgaaactatatttaggggttcggaagtccatatatcagcaaaattggctgccattcactggcactatgtcacgcaatcccatccatcagagttaacagctggttattataatacttctaacagggatggatacttacccattgctcgcatgtttagcaagtatggattttcaatgtgctgctcttgttttgaaatgcaagatgctgtaatgcagaagatcaatccagatggtagtcctgaaggttttcttagacagcttttgctggctgctaggctctgtgatatatcactcgaaggtcaaaatttttcaactaatttggatgatggtgcattcacccaggtgcttaagatgtcaaaattttactcagatgggattgagaagcgatctttctcattcaactttgtaagaatggacaaaagattgtttgaatcccgaaattgggatcggtttactcgttttgtgagacaaatgtctaatggaaacatttttcgagccagattaaattctgttcgtgacgtacggttgaagaccacaccagtggtagcagcagtgggactattgtatcacctatatcagcactcttga

SEQ ID NO: 74551 - DNA, 3000 bp, Glycine max
  Peptide Sequence Number=SeqID_166236
atgaaaatcgatatcgagcaagcatttcaaaatagagccgttgatgggaggatcgtagcgtggagattaaccctatttgaatcaacggcggatattgtccgggtgtgttgtacagcgaatataaaaaagcaagtattgaagaaccgaaaaaacttgaaacattggcgtctctgctttttcccacactctgctagggtttcagagtcgccgcgctccctcacttggcttcgactcgctctctcaatcgctgattccactcgttatctcgtcgtcactaagaaatgtagaacatcgatatgtagttcttcttgcattttcgatctgttgggacatctgcaaacagtgtttgaatgtgctgaagcgtattttctgagcaatggggttcagatggccatggaggttactcaaatccttttaaacgcgcaagcagtcgatggcacattaaggaaacaagccgaggaaagcttgaaacaatttcaggaacagaatcttccaagtttcttgttttctcttgctggggaactggcaaatgacgacaagcctgcagagagtcgcaagctagcaggtttaattctgaagaatgctctggatgctaaagagcagcacagaaaaatagaatttgttcaaagatggttgtcattggacccaactttgaaatcccagattaaggcattcttgttaaggacactttcttctccttctcttgatgcccggtcaactgcatcacaggttattgctaaagttgctggcattgagttgcctcataaacagtggcctgaattgataggatccctcttgtctaatgctcatcagcttcctgcccctacaagacaggcaacacttgagacccttggttacatctgtgaagaagtttcccctgatgtagtagaccaggatcatgtaaataagatactcactgctgttgttcaagggatgaattcaacagaagaaaacaatgatgtcaggcttgctgccataaaagcattgtacaatgcattgggttttgctcaggcgaatttttctaatgacatggagcgggattatatcatgagaattgtgtgtgagacaacacaatctcctgaattgaagattcgacgagcagcttttgagtgcttggtagctatttcttcgacatactatgaaaagttagctccttatatccaagatatcttcaacatcactgccaaggctgtgagggaagatgaggagccggttgcacttcaggcaattgagttttggagttcaatatgtgacgaagaaattgatatactagaagaatatggtggtgattttagtggggattcagaggttccctgcttttattttattaaacaggcactttcatttcttgtccccatgttattggagacactgctgaagcaagaagaagatcaagaccaggatgaaggagcatggaacattgctatggctggaggtacctgcttgggattagttgcacggacagttggtgatgacattgtacctttggttatgccgtttattgaagagaatataaccaaaccagattggaggcaaagggaagctgcaacttatgcctttggctctattttagaaggtccctcccctgataaacttgtgccactggtgaatatggctttgaatttcatgctcactgcattgatgaaagatccaaataatcacgtgaaggacacaactgcatggactctagggcgaatgttcgaatttttgcatggatcagctctggatactccgattattactccagcaaactgccaacagattattactgtgctgcttcagagcatgaaggatgttccaaatgttgctgagaaggcttgtggtgctctttattttcttgcccaaggctatgaggatgctgcatctgcgtcctctccattgacccccttctttcaagatattgttcatgctcttctcactgtaactcacagagaggatgctggagaatcccgccttagaacagcagcctatgaagccttaaatgaagtagtgaggtgttctaatgatgaaacagctcctatggtggtacaacttgttcctctcatcatgatggagctccatcagactcttgagaatcagaaggtttcatctgacgagaggcagaatgagttacaaggccttctatgtggttgcttgcaggttatcatacagaagttaggatcatctgaaccaacaaagtatcatttcatgcagtatgctgaccaaataatgggtttatttttgagagtgtttgcttctcgaagtgcaacagctcatgaggaggctatgcttgccattggagctttggcctatgcaactggtgctgattttgcgaaatacatgacagaattttacaagtacttggagatgggtctccaaaattttgaggactaccaggtatgtgctatcacagtgggtgtggttggtgatgtatgcagagccttggaggagaaagtactgccttattgtgatgggataatgacccaacttcttaaggatttgtccagcaatcagctgcataggtctgttaagcctcctattttttcatgttttggagacatagccttggcaattggagaaaactttgagaagtacttgttatatgcaatgcctatgcttcagagtgctgcagaactctctgctcatacatctggtgctgatgatgatatgacagaatacacaaattctttgagaaatggaattctagaggcatactcagggatcttccaaggatttaaaggttccccaaagacccagcttctgatgtcttatgctcctcatgtgctgcaattcttggatagtttgtatatggagaaggacatggatgatgttgtgactaagacagcaattggcgtgcttggagatttagctgatactttgggcagtagtgctggccccttgattcagcaatctgtgtctagcaaagacttcctcaaagagtgtttatcatctgatgaccatttgattaaggaatctgccgaatgggccaagttggcaatcagtcgagcaatttcattttga

SEQ ID NO: 74552 - DNA, 660 bp, Glycine max
  Peptide Sequence Number=SeqID_166237
atggggaattgctcaatgaagggtaccactggagaatgtcaccactctattcgtgttatgtgtgacagtggtgccattttgcagttaaaagctcctaaaacagtggctcaagtgcttcaacactacccgggttatggtattttccgccagggtcatgcttcagcacctttgccagagcaagagagtttaagctatgatcttttctattatcttctccctttgaaggaggttcaagtggagcaccaaaaaagttgctgcgacaaagtccaacaagtggttcaaagatcagaggaaatgtgcaaatctgcagcatgtgattatgttgagaatttgtcaaatgggtcagcgcttgaagtgctgccaacagctaagaatggggtgtggagagtgaagttgttgattgacccgagacaacttgaggaaattttgtctgagcaggtgaatactgaagcgctgattgagaagatgaggatggctgcaacttcatgttctactaccagtccttctccttcaaggagcccaagcccaactacgagttctaagaaagtggggtggaagacaacactcttcaatgggaaaattgctaaagacactatccctgtccctgcccctgcagttgtgaatgttggagtgaaaaagtctgagctttcatctttataa

SEQ ID NO: 74553 - DNA, 2337 bp, Glycine max
  Peptide Sequence Number=SeqID_166238
atggcacttgagctttcttcaccttttctgccattaatgatttttaggttggtgatgctgagcaaaagcgaaagaaaggcatatttggggttaaaggtggtgataaagacaaccttgcaaaaaggaggaaatacagttgccccagaattcatgattgctggtactgacaatactgcatctgaagcaccaatctatcatccgaagcaatctacaatatgctgccttgagtgctctgagaagactccctctggatcctgggaatccagcatttctgcattatgctgtacaaggttctcaaatctcaaaactagagttgactgcaggatttcatttgctgatccagttgctgtgaggcatgcactggaaattgtttctgagatagctacaatggatccttatgctgttgcaatggccttaggaaagcatgtgcagcctggaggggctttacaagatgttctccacttgcatgatgttctcgctagagtttctctagcgaggttatgttgtacaatatcaagggctagagctttagatgagagatcagatattagatctcagttcaattcagtgctctatcagcttctattggatcctagtgaaagagtctgctttgaggcaattttgtgcgtactaggaaaatatgataatgctgagaggactgaggagcgtgcagctgggtggtatcgtttgaccagggaaattctcaagttaccagatgcgtcatcaaaggaaagttctaaagataaacagaagacgaaacgacctcaactgcttattaaacttgtaatgagaaggttagagagttctttccgtagcttttctagacctgtgcttcatgcagcagctagagttgtacaggagatggggaaaagtcgggctgctgcctttgctttgggcatacaagatgttgaagaaggagcacatgtcaatacatttgctgaggctacagattataatgattcagatgaaagcacacatcctgaaagcattcgaagaacttcttcagtatctaatttaaccgctggcagagatactgtctcgggtatgttggcttcattaatggaagtggtacggacaacagttgcctgtgaatgtgtttatgtaagagccatggtgatcaaggcattaatctggatgcaaggtccatttgactcatttgatgaactagaatctattattgcatcggaactttctgatccagcttggccagcagcactattgaatgatgtactactcactttgcatgctcgttttaaggcttctccagatatggctgttactcttcttcaaattgcaagaatatttgctaccaaagttcccggaaaggttgatgctgatgtgttgcaactgctctggaagacttgtcttgttggagctggtcctgatggaaaacataaagctttagaagcagtcacaattgtacttgatctaccacctccgcagcctgggtcaatgcttggtcttacttcagtggacagggtgtctgcatctgacccaaagtctgctcttgcattacaaagactagttcaagctgctgtatggtttcttggggaaaatgcaaattatgctgcttctgaatatgcttgggaatctgctaccccgcctggtactgcattgatgatgttagatgctgacaaaatggttgctgctgctagttctcgtaatcctactctagcaggtgccttgacaaggctccagaggtgtgcattcaatggcagctgggagattcgaattattgctgctcaagctcttacaacaatggcaattagatctggtgaacctttcaggttacagatttatgagtttctgcacactttggggcaaggtggtcttcagtcacagttctctgatatgcatcttagtaatggagaagatcaaggagcaagtggtacaggccttggagttttattaagtcctatgataaaggttctggatgagatgtatagagcacaagatgatttgatcaaggaaatacgcaatcatgacaatgctaagaaagaatggactgacgatgaactgaagaaactatatgaaacccatgaaaggctgctagaccttgtttcattgttttgttatgttccaagaacaaagtatctacctttgggcccaataagtgccaaactcattgacatctatcgtacacgccacaatattagtgcatctactggtttgagtgatccagctgttgccactggtatatctgaccttgtctatgaatcccaaccaccagctgctgagcctgatacacttgatgatgacctagtaaatgcttgggcagcaaaccttggtgatgatggcttatgggggaacaacgcaccagcaatgaatagggtataa

SEQ ID NO: 74554 - DNA, 105 bp, Glycine max
  Peptide Sequence Number=SeqID_166239
atgaaggtagggaaagggaatcggaatggaatggatagtgaagtcaaatcaaggaatggcgaagcgaagatagtctcggagtcaaaggagtatccttgtcgttaa

SEQ ID NO: 74555 - DNA, 3615 bp, Glycine max
  Peptide Sequence Number=SeqID_166240
atgaaggcgcaaccaccagacggtgccgccgccgtcgcacccaacgccggcgaaggaggagagaagaaaaccataaacgctgagctatggcaagcttgtgcggggccgcttctcaacctgccttcgcctggaactcacgtcgtttacttccctcaaggccacagcgaacaggtagcagcgtctttgaagaaagacgtggatgctcaagtcccgaactataccaatctcccctccaagataccctgtcttcttcacaatgtcacgctgcatgcagatccagacacggatgaagtatatgctcagatgacacttcagccggttccttcttttgacacggatgcgttgttaagatcggatatctttctcaggtcgagtaagccacaacctgagtttttctgtaaacaactgacggcaagtgatacgagtacccatggaggtttctctgtaccccgccgtgctgcagagaagattttccctcctcttgattactctgtgcaacctcctgcccaagaacttgtagcccgggatttgcatgataatgtttggagattccgccatatatatcgtggacaaccaaaacgacacttgcttacgactggatggagtctatttatcggtggaaaaaggcttttagctggtgactctgttttgtttgtaagagatgaaaagcagcagcttcttttgggtataagacgagctaataggcaaccctccaatttatcatcttcggtactatcaagtgatagtatgcacattggagttcttgctgcagctgctcaagctgttgcaaacaatagtcccttcaccgtgttctataatcctagggctagtccctcagaatttgttattcctttagccaagtactccaaggcagtgtatagccaccatatatcacctggtatgcgcttccgaatgatgtttgaaactgaagactcaggaacaagaagatatatgggtacaatcataggtgtcagtgatctggattctgtgagatggaaaaattcactatggcgtaatttgcaggttggttgggatgaatcaactgctgaggaaaggcaaagtagggtctcagtctgggaaattgaacctgtgactactccatatttcatctgcccgcctcctttcttcagatccaagatacctagactactgggaatgccagatgatgagcctgatttcaacaaccttttcaagagtacagttccctggcttggtgatgatatgtgcgtaaagggtccccaagctctccctggcttgagcttagttcaatggatgaacatacagcaaaatcctgctcttgctagctcattgcagccaaattgtgggccttccatgtctggattggttctgcaaaatcttcctggtgcagatattgcaaatccgctggggttttctacctcacaaatctctcaatcaaacaatgtatctgtcgatgctcagaatatacttcagacttcccagcaactcgatcacattcagaagccaccatgcccatccagtgcattgggagcagtcacacagccgctgcagcagttgggtgatatcactcaacaaccaaggaacttgacaaatcaaactttaccacacgatcaagctcacacccaacttctgaatccccagagagttgtccaaactaacaatattcatcaacagcaacaatcgtccattcaaaagcaacaactgcttagaagcttgtctcagaaccgagctcagaagcatcaacaaactacattgggtttgaatgaacggcaaattgtgtttcaatcccctatgcccgatcattttaatcaacaattacaaatgtctgacaatcaggttcggtttcagttgttacagaagcttcaacagcaacaacagacactcttggcacagcagtctgcattgcagcagcctgctctaattcaaatccaagaccagcagaggcagcttttagacgttgcaaacaactctagttccccaattcctggtcaagtactggaaaatcttcctacgcttcaaaactcactccctgaggctaattctatcacccatcagataacaatgccaagtagccagaaaaattttcattactctcatctatctcagcaacctgccttgctgtctgaaatgtctggccatgttggacttccccctacagttacaaccaatccactttctgcttctggtggaagtatactgactggcgtggggcaatcggtaattactgatgatgttccatcttgttccacttcaccttccacaaataaccgtgccagtgtacttcctccggtggtaagttcccagatccataggagcacaacaataggggatgacatggctcagtctgctgtcacgatctcgggtgcaagtaccctagaaaccatgtcatctaatgcaaacattgtccagccgaagtatgaagtaaaggcttctttaaatatttcaaaaaatcagaatcaagggaatgttgcccctcagacatacttgaatggtgttgttcagacagactatttggattcatcatcttctacaacatcactttaccattttcggagtgatactcatatgcatcagaataccaacccattttcttacaatccacagttggtttattgtagagacaatagtcaaaatgttgaagttcaggctgatgctaggaacaatgttctgattggcaataacgttaatggccaaatgggaatgccatcgaatctagattctcttttaaccaaaggcacagtggggctggggaaggagttgtctaataaatttgcctccggaggcttgcttagagacttagaaaataacaaaggtgttccgccagaaatttcatcttcaatggtttcacagacatttgaagtccctgatatgagcttcaattcaattgattctacaatagatggtagtagcttcttgaataggggtccatgggatctgccaccaccacctccaccacaacaacaacaggttcaacggattagaacatacaccaaggtatataaacgtggagctgtgggaaggtccatagacataacacgatattcaggttacgaggaccttaaacaggatctggctcttaggtttggtattgagggacagctggaggatctacaaaggattggttggaaacttgtatatgtagatcacgagaatgatgttttacttgtgggagatgacccttgggaggagtttgttaactgtgtccgctgcattaaaatactttctcctcaagaagttcaacaaatgagcttggatggagattttggcaatggtggccttccatatccagcaggcagcagctctgatggacatattcatcagtgttgtccaaaaggttgtggggtcggtcggcagatgattttgtcctgctgcagcaggctgggtaatatttgcggttataacttattaggagaaatttgtctctgccatgtacaggcgaatttgaagagccaaaagaagaaaaaggtggaaaaatttgctgccctcaatctacgacttacatttaaggttgttaacctggtgatgaatgagatacttggaccacacgcacatggcacatcccaacaaagatgtgttaagccatatgcatgtgatgacgttgaaaagttgagcagaagttctcttggcagcgtttga

SEQ ID NO: 74556 - DNA, 1173 bp, Glycine max
  Peptide Sequence Number=SeqID_166241
atggactggaatttgaaagcactttcttgggatttgagtgaagtggatcaggcaaacttacccaacatggaaacaatggaaggctcaagcagatatggaatgtatagaactaagggggaattttctgttgacttgaagcttggccaggtggggaattctggcacagaatcagtgttgactaagtccaaagatgctgttggagtctccaaaatgacatcctcatctacttcagggtcatctaagagagctcgtgcccttagcaacgggacacaaacagtgtcatgccttgtggatgggtgccacgctgatctcagtaactgcagggactatcataggcgccataaggtctgtgaagtccattccaagactgcacaggtctcaattggaggccagaaacaaaggttctgccagcagtgtagcaggttccattcactggaggaatttgatgaggggaaaaggagctgcaggaagcggttagacgggcacaaccgacggagaagaaagccccaaccagaatctctaacgcgctctggtagttttttgtcgaattaccaaggcacacagttgctacctttctcaagttcacatgagtacccatccacaactgtggtgaatcctacttggggtggagttcttacaacttctggtgatgttaggcttcatgggcacaaccaacaccaccaccaggtgcatttggctgataaacaggacctttttcttggatcttctccagccggttacaaagaagggaagcaattggcattcatgcaaggtgaccacaccctcaacaaccggagcccacatcttccaggtgcttccgtgggccaggcccagatgtttcttaggaccagcctgtattcagaaagcgatgggctgagatgcaaaatgttctgtgatagcctaacaagttcgatccaagacaacaacacctctcgtgctctctctcttctgtcatcaccaccacaaccgctcagtcctggaaatggattaaacctgatggtgaactctcactcgccccttatgcaacccttgggcctgagcctgcatgataacagcctgggctccgtggaccctgttttgggccccaatgattcttcatcaatgtataacataggttctaatggatctcaggggaatgaggcccctccactatttccctttcaatgggaatag

SEQ ID NO: 74557 - DNA, 957 bp, Glycine max
  Peptide Sequence Number=SeqID_166242
atgatagaaggggttctagagatttccaaaactgcccaagaagagaaaaaattagaagaaagcaaagaggagaacaaaaaagcagaggaaccaaagaaggaagaagagaagaaagaggagagaaaaactgaggaatcaaaagatgacaaagaatctaaggagaaagttgcgccgtcagaaatcgtgcttaaagtgttcatgcattgtgaagggtgtgctcgcaaggttcgtcgctccctcaaaggattcccaggggtcgaagatatactcacagattgcaagtctcacaaggtggttgtgaaaggagaaaaagcggatccgctgaaggttctagagagactacagaagaaaagccatagaaaggttgaacttctctctccgatcccaaaaccacccacggaagaggagaaaaaaccccaagaggaacaagagaagcccaaaccagaggagaagaaagaagagcctcgggttatcacagttgttctgaaagttcacatgcattgcgaagcttgcgcccaggaaatcaagagacgcatcgagaaaatgaaaggggttgaatcagcggaagcggatctgaagaagtcggaggtaagcgtgaagggggtgttcgagacagcgaagctggtggagcacgtgtacaagaggacagggaagcatgcagtgatagtgaagcaagaggcagagaagaaagaagaagagaagaaagcagaggaagaagttgagaagaaaatggagaaagggagtggcgagggagaagaaaacaaggagaaaaaagaaggaggagagggtgaagccaaagcagaagaggcatccacagtgttggaggtgaaaaagagtgagtattattacaacccaccaccaaggtatggtggcatggagttctatgcatactctggaccagcgtaccctcctcagatcttcagtgatgagaaccccaatgcctgctctgtcatgtaa

SEQ ID NO: 74558 - DNA, 930 bp, Glycine max
  Peptide Sequence Number=SeqID_166243
atggcgttatcccttcccacccacccttctcccaccgttaatcctctccgacgatccccaaaacccaccctccgccgcgtcaaccaccgcgtttgcgtggccagcgccgccactcccctcctccaagtcaatgacttgagggccaagattgtcgaatccaacgttgacattctccacggcgttaacctcaccatcaaccaaggagaggtccacgccatcatggggaaaaacggttccggcaaaagcactttcgccaaggttcttgtggggcacccagattatgaagtaaccggaggcagtgttgttttcaagggggagaatttgcttgagatggaacctgaagaaaggtctcttgcgggtctcttcatgagttttcaatcccctgttgaaatccccggtgtttccattgatctgtttctcgccatggcctacaatgctcgaatgaaaaaacttggtcgagatgaggttggaccaatcgagtttttaccttacctgatggagaagcttcagcttgttaacatgaagcctgactttctcaataggaatgtgaaccaagggtttagtggcggtgaacgcaagcgcaatgaaatcttgcagcttgcggttttgggggcggacttggctattttggatgaaattgattctggtttggatgttgatgcgctcagggatgttgcgaatgcagttaataggattctcaccccagaaaagtccttgttgatgataactcattatagacggattctggatcttttgaatcctacacatgtccatgttatggtgctagtcctatcaattcaagtgaaggatgagcttgaagaagtagatttcctaaagaaagacaaagggaaaattgcaaggacaggcgacatatcagtggtagaagctattgagtcagatggatatgaagcagtctctgctttaacataa

SEQ ID NO: 74559 - DNA, 471 bp, Glycine max
  Peptide Sequence Number=SeqID_166244
atggacaatatatcaaagccagaagtgtgccccaatccagtaatattgcagagtgaggggttagtgaagtatatattggagaccggcgtttacccgcgagaagtggagatcctcaaagagctaagaaatgcaactgcagagcatcctctgggcttcatgggtgctgcacctgattcggggcagctaatggcgtttctcttgaagcttttaaatgctaaaaagacaattgaagtgagagtttttactggatactctcttctcctcactgcactcaccattcctaatgatggaaagattattgctatggatctagacagaaaagcttatgagataggactaccattcattaaaaagcctggtctagaacacaagattgacttcatagagtctcaagctttaccagtccttgataaactcctagaagatgtgacggagtcattatctgcagacgtcttcgctgatatgatatga

SEQ ID NO: 74560 - DNA, 699 bp, Glycine max
  Peptide Sequence Number=SeqID_166245
atgggaagagctccttgttgtgacaaagctaacgtgaaaagagggcgttggtctcctgaagaagacgaaactctcaaaaactatctcaagaaacatgccacgcctggtaactggataactctcccacaaaaagcaggcctcatatcaagcatggaggcttcacacatgaggaagaccaatttatctgctccctttatgccaccatcggaaccaggcaagtggtcccttatagctgctcagctacctgggagaacagacaatgatgtgaaaaaccattggaacactaagttaaagaaaatgtttttggcagcaaacaccaatgccactggcaatactgttttctcaactcccacttctcagcctcaagttgaagactgcagtgtctttgatgatcatgagaactcagctgagtatcatgtcttgggtttggagcaaacaccattgcctttaggatcagatgtttcaggtcttggaagcagttgtagtgtaccactatccaatgaagcagtttcagcttccttggtaaaagaggagaatgagaatgggacccaatggtttggtgaagatgaatcatttttgcttgattttgtgtatgaggataacgggtttgtttctctagaaaatagcagcgaagttgccccatcatttggctctctctatgctccaaacacaacagaaaagagaaagagagacaattaa

SEQ ID NO: 74561 - DNA, 138 bp, Glycine max
  Peptide Sequence Number=SeqID_166246
atgaaacaactagttagacacatagtgcctaagatcacctggtgtaggccaactactaggcttacttttcaaagaggcacgttgtacaagtacaatttttgcaccagcatgcatagtgcctacggagataatcaataa

SEQ ID NO: 74562 - DNA, 900 bp, Glycine max
  Peptide Sequence Number=SeqID_166247
atgaaacatcaggagaactatacggcacctcggatagtacttgcagcatctggtgttgaacatgaggaattgttatctattgcagaacctcttttgtctgatctacccagtgtcccgcgtccagaggagccaaaatcagtgtatactggtggtgattatagatgtcaaaaggaatcagggaggacccattttgctctagcatttgaacttcctggtggctggcataagttgaaggatgctatggttttgactgttcttcagatgctattgggaggcggtggatcattctcagctggtggacctggtaaagggatgtattcacggctatatcaaaatgttctgaatgaatatccacaagttcatgaaatttcagcattcaacaatatttacaatgacactggcatttttggtatccaagttacaacaggctcagattttgtatcaaaagccattgatatagctgctaatgagattcttgctgttgctactcctggacaagttgaccaggtacagctggatcgagccaaacaggctaccaaatctgcaattttgatgaatttggaatcaagaatggttgtttcagaagatataggaagacaaattttgacatatggtgagaggtatggctcacatttcattttctttggtggtttagtatcttggtgtattgcaattctgttctgcaatgagtataagagtgcggacatgatgctaaaggatgtcttctccctactcaggaaacctgtggaggatttcttgaaggcagtggatgaagtaacctcgaaggatatcacttcaatttcgcgaaagctcatttgttctcctctcacaatggcatcatatggagatgttctctatgttccaagctatgaatcagtgagtctcaaattccgtgcctaa

SEQ ID NO: 74563 - DNA, 432 bp, Glycine max
  Peptide Sequence Number=SeqID_166248
atgaaggagaatgtgattggatggcaagaactgaatggaggccaccacctcactgcagctgccatcatcggccatgatggctctgtttgggctcaaagctcttcttttcctcaggcacgtaataactttcttttcattttatttgctcattctaccccgattagacctcaagaaatcactgatatcatgaaagatttcgatgaaccgggtcatcttgctcctacaggtttgcaccttgcaggaaccaaatatatggtcatccaaggagagtcaggagctgtcattcgtggaaagaagggacctggaggcatcaccataaagaaaactggtcaagctttagtttttggtgtctatgaggaacctgtgactcctggacaatgcaacatggttgttgagaggttgggagattacctcattgatcaaggtctctag

SEQ ID NO: 74564 - DNA, 183 bp, Glycine max
  Peptide Sequence Number=SeqID_166249
atggagcggtggagcacaacagagctgaggaagaagtcccgcaatacgggtcctggtggtgttactgtgaagaagaccggcgcggccttgatcattggcatttatgacgaaccaatggctccaggtcaatgcaacatggtagtggaaaggcttggtgattatctcattgaacagggtctctaa

SEQ ID NO: 74565 - DNA, 127 bp, Glycine max
  Peptide Sequence Number=SeqID_166250
atgtgcattagtggagctcctgggcactctcgagctccaatctctagacagagagacaatagccgttactttctgagcattggaacgttaggtttcacttcacaactctctcaacaacaacaaagta

SEQ ID NO: 74566 - DNA, 273 bp, Glycine max
  Peptide Sequence Number=SeqID_166251
atggaatataaaataaaaagaggtgttggggttcacattgcaaaaataaaattctggaaaggaaaaggcaattcaaaagtgggaaaaggaaaaggggggggaagtgagaagaaagagatgggaaggttcaattcaaagaagagaacacagaacagccccatagtgaaatctctatcttcatctgtcctctggagcgacgtatcctcaaaaagaaagatacctcagtgtcccaaaacatctgacacactcgtgtctcgtgaaggcattccctaa

SEQ ID NO: 74567 - DNA, 1233 bp, Glycine max
  Peptide Sequence Number=SeqID_166252
atggggaaggtcgcggtgggagctgcggttgtctgcgccgccgccgtctgcgctacggcggcactggtgcttagacaagtggctgatgccatggatgttgagatgcacgcaggtctcgcatctgaaggtggtagcaagctcaatatgttgatcagttttgtcgataatctcccaactggggatgaggaaggactctattatgcactggatcttggaggcacaaacttccgtgtccttcgtgtacatttaggcgggaaagacaaaggtgttatcggccaggagtttgaagaagtttcaattcctccaaatttgatgactggctcttcagaagcattgtttgattttatagcagcagctcttgcaaagtttgttggttcagaacctgaaggttttcatcctccccctggcagacaaagagaactgggttttacattctcattcccagtgaggcaaacatcgattgcatctgggactctaataaagtggactaaaggtttcaatattgaagatgtggttggtgaagatgtggtgggagaactaaccaagtccatggaaaaaattggcctggatatgcgcgttgctgctctaaaatttggagttataaggttttatggcgttaatgataccattggaacattagctggaggcagattctacaatcaggatgtcgttgctgctgtgattcttggtactgggacaaatgcagcatatgtagaacgtgcacatgctattccaaaatggcatggccttataccaaaatcaggagatatggttataaacatggagtggggtaatttccgatcatcacatcttcctctaacagaatatgatctagctctggatgctgagagcttaaaccctggagaacagcgggagttgctgccgcgaatagtggctaacccaaaattcattgtcgttgtggctactggtgttgatggaggaaaatcctctcattatctctgctattgtgggacactgttgagaacgaacataagacctaacagtagtgctggtgaagagcacctctgtttctggcaaacccaaggatcaggtgttgtttccaattttcctgtgaacccttacccttgttcggttgttcctccctattgttctggtctctcctacatagctctttgtccctttctctccaacagcactctctgttctctgtctaacagactgacacatgtgtttcatttcattgttctgtccttttttcccttgtcttcttag

SEQ ID NO: 74568 - DNA, 1986 bp, Glycine max
  Peptide Sequence Number=SeqID_166253
atgtggaaacacagaaaacgagcacttggcatgggacactggtgcttatcaaacttgggattttctggctgctgtggcactaattcttcaaagagaaaaatctcaaaggatcagcattataacactggtgaagataagaaagtaattggcagagaaatggagagcacactgaaggccttgagagatggagagtcggtgttggacctcagcccaagatccaccgtcagtggcggcgttgaggacatctacggcgaggatcgcgccaccgaggatcaacttgttaccccatggattttctcggttgccagtgggtactctttgctacgagatccacagtacaacaaagggctatctttcactgagaaagagagggatgcacactatttgcgtgggctcctgcctcccacagtcagcactcagcaacttcaggagaagaaactgatgaacagcatcaggcaatatcaggttcccttgcaaaagtacgtggccatgatggaccttcaggagaggaatgaaaggctattttacaaacttctcattgataatgttgaggaattgctccctgttgtatatactcctaccgttggtgaggcttgccagaaatatgggagcatattcaggcgtcctcagggtctttacattagtttgaaagagaagggtaaaatccttgaggttttaaaaaattggcctgagaggagtattcaagttattgttgtaaccgacggtgagcggattttgggacttggggatcttggatgtcaggggatgggaattcctgttggtaaattggctttgtacacagcactaggaggagttcgtccttcagcatgtttgcctattactatcgatgtggggacaaacaatgagaaattattgaatgatgaattctacattgggcttagacaaaggagggcaactgggcaggaatattatgaccttatgcatgagtttatgactgctgtgaagcaaaactacggggaaaaagtccttgtacagtttgaagactttgcaaatcacaatgcttttgagttacttgctaaatatgggacaactcatctcgttttcaatgacgatatacaggggactgcatctgttgttctagctggagttgtagcagccctaaaactcattggtggtacattgcctgagcacacattcctcttccttggtgctggagaagcaggaactggtatagccgagctaatagctcttgagatgtcaaagcagactaaggcacccatagaagagagtcgcaagaagatatggcttgtagactcaaagggtttaattgttagttcacgaaagaattcacttcaacacttcaagaagccttgggctcatgaacatgagcctgttaacagtctcctagaggcagtcaaggtgatcaagccaacagttttgattggatcatcaggagtgggaagaacatttacaaaggaagtagttgaggctatgacttcaaacaatgatgtaaaaccttgtgtcactcttcttgtggatgagtatttgtgtgagtatttagataaacctctcattctggctctctccaatcctacctcacagtctgagtgtacagctgaagaggcttaccagtggagtgagggtcgtgcaatttttgctagtgggagtccatttgatcctgttgaatacaagggcaaagtttatgcttctggccaggccaacaatgcttacattttccctggctttggtttgggtttagtaatctcaggagcaattcgagtacatgacgatatgcttctagcagcttcggaatccttggctaaacaagtgagtgaggagaactacaaaaatggcttgatttacccaccattctctaatatcagaagaatttcggctaatatagctgcaaatgttgctgccaaggcatacgaactgggcttggctacccgtcttcctcgtcctcagaatcttgtgaagtgtgctgagagttgcatgtatactcccgtataccgcaactataggtga

SEQ ID NO: 74569 - DNA, 1308 bp, Glycine max
  Peptide Sequence Number=SeqID_166254
atgcacgagcacgctgtggagttcgaggaccttcctttccccttcgctccaaacttatcggaatcggagatccgggaaacggcctatgagatgctcgtgggggcttgccggagttcggggccgaagccgttaacgttcttctctcactctgagcagtctaaccgaggaggtcagcggattccgtcgccgtcattgtacaggtcgctgactgtaacggcgtcgagtaaggtgaagaagaagctgggtctgagattgagaacgacgtcgtcgtcgtcggggaatagaagggcagccaccacgggggagttgatgagagtgcagatgaaggtttcggaactcactgacactagagtcaggcgtgccctcctcagagtagctgcaggccagcttggaagacgaatagaatcgatggttctgccgctagagctaatacaacagctcaagtgctcagattttcctagtgaacaagagtacgaggcttggctaaggaggaatttgaaggttctcgaagcaggactcctcttgcatcctcgcctgccattggataaggcagatactagtgcactgcgcctgcaacagataatccatgaaggccttgagaagcctatggacattggaaaagacagtgaatcaatgcttgcacttcgcagtgttgttatgtctcttgcttggaggtcatttgacgggtctgttcccgatacatgccattgggctgatgggtttccactgaaccttagaatctaccaaactctgttagaagcatgtttcgataatcatgatgaaacctgtgtgatacaagaggttgacgaggtcttggagctcattaagacgacctgggctatgcttggagtgaatgagatgctgcatgatgtttgtttttcctgggtcttatttcaacggtatgttgccaatggtcaagtggataacgatcttttgtttgcatcgagtaatctgctggcagaagttgagaaagatgccaaggcgatgaaggatccgttttacgcaaaatccttgagctacgcattgaatttgatgttaagttgggcagaagaaagactccttgcataccatgatactttccataatggtaacattgaatcaatgcagagtgttgtttctcttgcagtatcgtcagcaaaaatattggcaggagatatctctcttgagtgtaataaagaagctgatgtatcctgcaccaaagtcgaaaattatattacatcatcattgcatgctgttttcgttcaggcatgttcagccattcaaactcccctcctctccctaagcacaaacattacttttctttcttga

SEQ ID NO: 74570 - DNA, 342 bp, Glycine max
  Peptide Sequence Number=SeqID_166255
atgacatccactccacaagcttgtggttacgtgagcctgaactactaccaatatatagatgttgtttatacaaatgagcacatcttaaaagcttattccgcacaatggtggcctcttgggaatgaagcagctattcctccttctaatgatgcatggacacttatccctgacccaaccacaattcgtgcgaaaggtcggccaaaatcaacaaggataaggaatgaaatggattgggtcgaaccgtctgagcaccgaataaaatgcagtagatgtggagccgaagggcataataggcgtcgctgtccaatgcaatctgagcgtgggagttgttcaaataattga

SEQ ID NO: 74571 - DNA, 147 bp, Glycine max
  Peptide Sequence Number=SeqID_166256
atgatagcaacagtgatggtgatgatggtgatagaggtgacaaaggtgagagacgatgacaacgagtgtggtggtggtggtgataacagtaacaacgacgatgattgtggtggaatgataacaatgaagataacaccgatagtgtga

SEQ ID NO: 74572 - DNA, 1380 bp, Glycine max
  Peptide Sequence Number=SeqID_166257
atggaacgcatcgttggcggcaagtacaagctcggccgcaagatcggaagtggatccttcggcgaaatctacctcgcgacgcatattgataccttcgagatcgtcgccgtcaagatcgagaatagtaaaacaaaacatccacaactgctttacgaggcaaagctatacaatattcttcaaggaggaagtggcattccgaacataaaatggtctggcatagacggggaggataatgtgcttgttattgatttgcttgggccgagtcttgaggatctctttgtgtattgtggaaggaagttttcattgaagacagtattaatgttggctgatcaaatgatcactagaatagaatatgtgcattccaaaggatttttacacagggatattaaacctgataactttctcatgggacttggtcgaaaggccaaccaggtttacataattgattttgggcttgcaaaacgatatcgggattccactaccaatcgccacatcccttacagggagaacaaaaacttaacgggtactgctcgatatgcaagttgcaatactcatcttgggattgagcaaagtcgccgggatgatttggaatcactaggatatgtacttctgtacttcctaagaggaagccttccttggcaaggtctaaaggcggctacaaagaaacagaagtatgataaaatatgccagaagaaattatcaactcctattgaggtactatgcaaatctcatcctgtagagtttgcttcgtatttccattactgccactctttgacatttgatcaacgacctgattatggtttcttgaagcgcctatttcgggacctatttgctcgtgatggttatgattttgattacgtttttgattggaccattttgaagtaccagcaatctcaaaagaatgtaatgctccctccattatcttttgaggcagaggaagagggttactatttatttggtaacttgaatcttcctgtgctcctgacaatattaaattatgtcatatcacagccagttccaggagcaagtaacagtcgtgcaattccaatggatattgacaatcatcaaggtcttaattcatattcagggcatgttaaagagcgtattagagctggtgatgctactggttctggtgttaaaattcagtttaaatcaccagtgggtaaaaatttgagttatgagaaaccacttgacaaaaatatttttggagaagcaaatattccctctacttcattttctcctgctagtacttcacaaaggaactccttgaagcaatccttgtctgctgaagcttccaaccctggacatgcacaaggcagtaaaattggcccttcaagtagcttgatgtcatctctgcagcacatgtcttctgctaaatga

SEQ ID NO: 74573 - DNA, 369 bp, Glycine max
  Peptide Sequence Number=SeqID_166258
atgaaggttgaggaagaaaggaggaagaagaaggatagaaagggcatactaaattttttggaggtgcaagaagtaagcacagataataaaggcttagctcgaacattgaacccaatctatttatgtttggggcttggagcactacaaatctttgtccgtgtgaaaagcccagtagcggctcggctcgactcggctgtgaagcgcgccgagccgaagagtttcatcatcgtttcgtttatgtcatttggtgtggagcggcctctgagagtagttttgccaaatgtcaatatagaaatttcagcaactctaaccaaggcgaaagaaataattggggttagggctttgaacacttctaatcaatgtgcatga

SEQ ID NO: 74574 - DNA, 426 bp, Glycine max
  Peptide Sequence Number=SeqID_166259
atggttttaagcaaaaagggtcctttgggtaaatttgatagtttcttggctaactggaatttgccaatgatttatagggttgggatgggttgtggcttttccaagtacacagcgtgctgcacgggttctgagcaagatggtctggctgctgaggctcaggttgatggtggaaacgaagacaatgttgttgagggtgttgacttgccgtggtttcatgaattcacaattgatcagcttaggaaggctacgtccggatttgccattgaaaatatagtttctgaacatggagaaaaggctccaaatgtggtttataaagggagacttgataatcagatgcgaattgctgtcaaacggttcaacagaaatgcctggccagaagcgcagccatttttgagatggatcctatggggattggggagtggctga

SEQ ID NO: 74575 - DNA, 752 bp, Glycine max
  Peptide Sequence Number=SeqID_166260
gcagagttactccagagagtgtaacatatagctttgggacccttttgcttgacctcctcagtggcaagcatattcctccaagccatgcccttgacctaattagagacaagaaccttcagatgctatcagactcttgcttagaaggagagcttacaaatgatgacgggactgaattagtgcgtctagcctcacgatgtttgcaatctgaaccacgagagcgtcctaatccaaagtcactggttgctgctctaatacctctacagaaggattctgaggttccttctcatgtgttgatgggtatcccagatggtacagctgcttttcccctttcacctcttggagaagcttgtctacgaatggatctgactgccctgcatgaggtgatggagaaaattgggtataaagacgacgagggcgcagcaactgaggaaacgttgaactcaaagaagaaaggggatgctgcttttcggcacaaggattttaaaactgcaattgatagctatacgatgttcattgatgttggaaccatggtttctccaacggtttatgtacgtcgtagtctatgttatcttatgagcaatatgcccgacgaagcacttaatgatgcaatgcaagcacaagtaatatcccccgtttggtacattgcgttttatttacaagctgttgctcttttagccctgggcaaggagaatgatgcccaagtggcacttaaagagggttcttcactggaaactaaaaagaacacaaattag

SEQ ID NO: 74576 - DNA, 2283 bp, Glycine max
  Peptide Sequence Number=SeqID_166261
atgcagcattatgccaattttgtcaagtggaattgggtctgtttgagtatgtctttggattcatcaatgggacaagagttggagctggatcttgatgacaagtcttcagtgggtttgagtcccaatactgttcttccacctcatcaatactgtgtgaatgtgaagaagagatctaaaaagggaaaacccactgggaaagatgatttttttactctcaaggagggctttgctgggatcaaatttgctcgcttccgcagttcttcatgtaagagccatctctctagacctcatgaattggaaggtaatacagaaaccaggcgcagttccatgtatcagagttcagaggaagtgaaaagtataaaaaaaatgggcaccatggtagagggaaggagaaaaatagaaatttcaaggaggagtgacacctctttcgtaggtagcattgttgattctttatgtggttcagatgatgaaggttctgggctgagatcttcagagatatccaggtccaggacttgcaaggcgccagactctccaaatagctttattgaaatctgtataaattcagatgttaaaaataagaactctgccacagtacaagggagagaatctataaatttgaagtccagaagtgacaaagtttctgattctgtaatcaatggcaattatcatgttgaaaaggacatggtccactggctgcaaaagtcactctcagctaaggcagggatctctcacatgccatctccattaggaagtgattgctcatcaagatcaagtccaaaagtccaagtcacccattgcaggaaaaggttgaatcatttcacaaagtcaaaatcattgagaagtccagtgagtaagatactggaaaatagtgagatcaaatcaaatggcatagcaaacattgcaagacataggacttatcaaaaatcattgctaaatgacttatccaacaaaggaaagcattctgacattatttctgaatttatcagcagagaaatccagtattcaggtatagcttcttcaccagttcatctgcatggcaatctcaaaatggaaaataaacatggagtgctgttttttgagttcaaggtgaagtgccctgaagatgtgtttgtggccaagacatggagaacaggtaatgctttcaactgggtgtatacttttcactcaattgataatagaaagaagagcaatgccaatgggttgggatcccatgattttgacaaagattcctcaatagtagcacagatgctagtttcctgtaatttaggttctgaactagaagacaaagtatttgacaactttatggtgacagaatttgtgttgtatgattttacacactcaaggcagagtgtttcgcgtgaaaaaaagtctttctgtgaactagatggttctaaaactccaaaagcttcccatgttggattgaaggaggaaactttggggctggatgggaaccatgtggtaaaaaataaacttcaagacaagcctctatcaagcagtgttgaatttgatgatttaaattcttatccttacctgtccactgaatgctatccaaaccttgaaattgctgccattgtcttgcaaattccgttttctaagagagaaagcttgaagtacaaaagaggagaaagaaaaagtgctaaagaatgttccaacagaagtgatctctctgcagtaaaagatagaaaaagtcttcattatgaccaaatccaggaacaggtaaaggtggtaataccaactggcaatcatggtttgccaaatgctgaaagccaggctccctcgtcattacttgatcgactgaggcatggtggaggttgtgactgtggtggctgggacatggcctgtccccttattcttttaggcaatcctactattcaatttgccgaagactgctcactcatggaggaacatcaaccattggaactttttgttcagatgtatgcagccttaacccccccgggagcaaaaggaagcagtcctaccttcagcatgacaagaattgaagaggggcattatgctgttgattttcatgcacaattatccactttacaagcattctccatctgtgttgccattttgcatggaacttctgccttcagcaatgcaagtcaccagaaaaaccaacagttatctcagtgcagttcactgaaaatgctacttgaggaggatgttgatttctttttcaaatcagtcacaactgagaaggagactggttgcaagaatcagaaaggaattcctcgatcctatgtgctgaacccgcctttttctcctattgcacgcgtataa

SEQ ID NO: 74577 - DNA, 2124 bp, Glycine max
  Peptide Sequence Number=SeqID_166262
atgggaaatcgacgcttcactcaggtcgcaaccagcgacgacgaggacgaagcgccgccggcgccggcgcctcctcccaagcagcaatcgtccgtcagtgcctccgaagaaaactgttcgaagcagcagcagcagcagcagcgcaagaggaagaggatgaagctccaagaagaagaggaagaggagaaagaggaagagaagaagaagaagagaaaaatcaaagacaagcaggaagagagatccaacgaagaagaggaaccgccgcaggaagacgccaagcccattggcgaaccggttaggctatccggaaagggaaggggccgcaaaaagcattatgaatccttcgagtacgacggaaaccaatacacgctggtttctgccatgaagttggcttgtgcattgtttgaggaggaccctatacttctcacgcctgaggacaaagaccaaaagccgtatgtggcgattatcaaggacattactcaatccctgaatggcagcatgatggtcactggacagtggttttatcgtcctgaagaagctgaaagaaaaggtggtggcagctggcaatcatgtgacacaagggagctgttttatagtttccaccgtgatgatgttcctgcagaatctgttatgcataagtgtgtggttcattttgttcccatacacaaacagcttccaaatcgtaagcagcatcctgggtttattgtgcaaaaggtgtatgacacagtagaaaggaaactctggaagctaactgataaggactatgaggacaataaacagcaagaaattgatgagcttgttcagaaaactcttcaacgtttgggcaaactacttgacattgagcctgaagaacctgttgctgatcaggaagatctgatgaaaaataaaagaatcttaaggaaaaagagcatttcacctcttgatgtttcaaaggaggaggaaacaactcgtcaaggggaccaacctctgaaacctgaaacaccatggagttgtgtaaataatgcctcagaacattatcgcatattagtcgatttcaatgctctaacaggagatacccatcgtgacaaatgtttggagaagttgcttcaaagtgttcaattcatgtttaattctgatgacagcataaagaaggaagagaaaggaaatgacaattctggtgctgccaacaatggaagcaataacaaaagtttagaatctgctaacgaatgtgaagacaaggttcaaaagagttccaagccttttgtttggccagatgatgctgttccagctgtagttgctctggaaaaagcttcacatgataccttatcatcagattatcagaagtataaccaaaagctacgacaattagtatttaatctcaagaacaatgcaatcctagcacgccgtctactaaatggagagttggaaccttctataatattgaatatgacgcccaatgagttgaaggggttagcggttgagtttgtgtgggttggcatgtcggcctgtagctctcagctggtggtgctgtccattttggagtttgtgaatcagtttgaaggtggatttgggattatgcaaagtaaccaatctacgttgaaaagtgacaccaacacattctaccggactccagtgaagacgaaggccaggaggactgtgacagaggagagtgcgaccaacaggagtgtcaacaaatatagatcttttcacggatcttgttcattggctgaagtctacagattgcaggctcttgatggtgtcaagggagtgattggcttcatgttttcttccattagtgtattggagaaggagggtttgactgctgaggaaacaaccaagaaggagcctgatgagtcacaacacatgcagatgacaggtgcccgatgccatagatgcacagagggtaaggtgggcttgagggatattatccatgctggacatggtgatcgatatcagctggaatgtactgcctgtggtcattcctggtttgcttcccgtgatgaggtgtctgagctgactatagatgcatcagattcaaaaagaagtgtaggcacggcaccatgggccactgcaaaatttgaagatgttgagaagaagctgtctaggaaagatggaaacatccaagcttcaaaactcgctgactag

SEQ ID NO: 74578 - DNA, 396 bp, Glycine max
  Peptide Sequence Number=SeqID_166263
atgcgagatgcacacctcggtgttggacgtcggtggcagcgcagagttcttggaggaactcgcagcagtggcagtagagggccacagaggcggcaagggaaaccaggtggagctccgcattcagggagagcttggtggggtgggggggggggggagcccagggaactccaggttcacgcccaccaagatgcggtcggaggtggccaagcccacggcggcgatgaagaacttggtgatgggggcgggctaggggttgggcggtgggggacaaggtggagaggagtttcgggagggtcacgacggcggactctgccatgggcttcgaaggctgcaacaaggaggcatgcccaatacaaagtgagtgtgaattggggtagatttgcatcaagcatttga

SEQ ID NO: 74579 - DNA, 408 bp, Glycine max
  Peptide Sequence Number=SeqID_166264
atgaaatcaaatcttgcatatttgatgaatttaacagtttgtctggtgtataccaaaagggccttagtttattacaggcttctccaatacaacgtattggtggcaaagagtgtggttaaccctcaaaagcaagcaattttagtatttactgatactcatagcaatgaaatcaaatatcacatatttgatgaatttaacagtttgtctatcgtataccaaaaggttactttgaagtttattagtgttggtgaagagatactcctcattgtatttgaatctattcatcttttcataactatcactgttaatgaacctgctcctggtctggaggctatctttagtttcaagttcctgaccaaaggtctggaaaggtggaagttcactacttgcatgactatgctggaatag

SEQ ID NO: 74580 - DNA, 1629 bp, Glycine max
  Peptide Sequence Number=SeqID_166265
atggaaatcaagcccggtttgtcagcactcgttaccggtggtgcctctggaatcggcaaaggtcttgcactagctcttgcagagaagggtgtatttatcacgatcgtggatttctctgaagaaaagggaagacaagctgcaatcctcgtcgagaaaattaactccaattttcattctaagttaggatttccgtctgccatatttgtgaaatgtgatgtgagtaatgcaagggatctagctgctgcatttgaaaagcattttttgacatatggaggactagacatttgtattaacagtgcggggattagtagttctgtaccattccgtgatgatcaaacggatggcacccgaacatggagatacactgttaatgtgaatttcactgctgttattgattccactcgccttgcgattaaaatcatggaagcttccaaaaggcctggtgtgattatcaacttgggttctgcttctggtctttatccaatggtggctgacccaatttacagtggctctaaaggtggtgttgttatgttttctagatcacttcgtctatacaaacgtcaaggaattcgagtcaatgtgctttgccctgagtactataatgccaaaagtttggtgcagtttgttgaaactgagatgggaaataagattgatcccaagatcatcaatttgagtgggggctttgtacctatggaaatggtggtgaaaggccgctattttggtggcaacaacaatgatgttgtttctcgtcttccatttgatgcaggatttgaggctgtagggataattgcagcagttggggattctgtcactgacttgaaagttggtatgccttgtgcattcatgacttttggaggctacgctgaattcttaatgattccttcaaaacatgctcttccggtgcctagaccagatcctgaagttgttgccatgcttacatcgggattgactgcctcaattgctctagaaaaggcaggacagatggaatctggaaaagtggtccttgttactgctgcggcaggaggaacggggcaatttgctgttcagctagcaaaattagcaggaaatacagtggttgcaacttgtggaggtggggcaaaagccaagcttctgaaagatttgggagttaacagagtcatagactatcatagtgaagatgttctaagggaagagttccccaaaggtattgacatcatctatgagtctgttggcggtgacatgttaaacttgtgcttgaatgctttggctgttcatggacgactcattgttattggcatgatttctcagtctgttagaagagtgtatgacactggattagaaattgcatatcaaggagagaagggttggacgccatcaaaataccctggactattggagaagctcttagcaaagagccaaacagtgtctggctttttcctggtgcaatatggtcacttgtggcaagaacatcttgacagactatttaatctttactcttcgggaaagctaaaggttgctattgatccaaagaaatttataggcctgcattctgctgcagacgctgttgaatatctccattcaggcaaaagtgttgggaaggttgtcgtctccgtggacccaagcttccttcctcaagtggccaaattgtga

SEQ ID NO: 74581 - DNA, 528 bp, Glycine max
  Peptide Sequence Number=SeqID_166266
atggaccctagaatctccttctcctatgatttcgtggtttcccaacaagcaatcaagcatgaaaacatatacagagaagatcctgtctcttcggatttcgaattctctgtcaagaacaattctatgatatcagcagatgaagtcttctttcagggtatgttgttgcctctcaagagtgattgctccaataagaaggtgactttgagggatgagttgcttgtgaatgatgatcactatgaagaggagttaccaagattgccaaagagttcaagccggtggaaggagcgattaggcctcaggaaaggttcatctaagaaagataagaataagaacaatgaggggtttcagcagactagagttgctggtgaaaaagggtttagctcaggacaaggagacaagactgagcaagtgaactctatagaagcaggattcatttctcaaggagaggggatggcatattctactaatatctatataaagacattaattgttaggattttgggcgccgacttccttttcaactgttaa

SEQ ID NO: 74582 - DNA, 1734 bp, Glycine max
  Peptide Sequence Number=SeqID_166267
atgactattactatctttcaggagagcctcggaggtgtcaacccttgtggggcagtggcttttgacagtatgagcccctccgtcttcctcctgtggattatcactatttctctcctcgcccactctgccctagcttcaatccctctagggtattttttagactgtgggggcaccaaagaggtaacaatagacaataatctcacatacattcctgatggaagctacatcaaggtgggcaaaaccaccaccatcagcaagccagacttgttgccaatactctccacattgcgttactttcccgacatgtgggctaaaaaatattgctattcattgcccgtcatcaaaggaagcaaataccttgtgaagacaatgtactactatggaggttttgatggaaggaataagcagcctccggtgtttgatcaaatcgttgaagggacaagatggagcgttgtgaacaccacagaggactatgctaaaggtcttagttcttactatgatattgttgtggtgccaccggggaagactttgagcgtgtgcttggcaaggaatgcacacacgggtggtgcaagccccttcatttcggccttggaggtgaagatgttggatgcttctttctataatcctattgactttaacaaatatgcccttctaaccgttgccaggaataccttcggagatgacaaattcaacaggatgtggcaaccatacaaggaccagaatcctgttgtggaaagcaattcaaatgtgacttcttcagacttttggaatcaacctccagtgaaagcattcagttctgcagttacaacaagtagggggaagactcttgagattcagtggccttctatgtcccttcccagcacctactactacatttccctctattttcaggacaacagacatccaagcccttacagctggagagtttttaacgtttctatcaatggccacaccttctattccagcctcaatgccacaactaatggtgtcactgtttatgctacaaaatggccgctctcagggaagaccaaaattacgttgacccctggtagtggaatacctgttggaccactgatcaatgccggggaaatttatcaagttctacctcttggtggtcgaactcatactagagatgtaattgcaatggaagatttggcaagaagcattcagaatccacctgttgattggcatggcgatccttgcctacctaagggaaattcttggactggggttacatgctctaatggtttccatgcacgagtcacaatagtgaatttgacaaatgccggggtgtcagggtcacttcctccaactcttggccatctaagtgcattagagcatctcccttcgtccttccggtgccgcgccgccgccggagacctctccgcgggcccctccttcatccagtccgtcgccggcggtctaagaattggccagttccccgacggcgcaggactcgccgtggaaggacggcgcggcggcggcggaaacgaaccaataagggtgaagaaatggtctcggaagaatgagagttacttggataacgacgccgagcctcttccccttccaatgacgtatcccgattcctcgcccgtttcgcaagaagagattgataagcgcctccaatgcgatccccaaattcaggttttagcctctactgattacttgattgtaaagaggtggtgtatgaatggactgggaagtgccgtagttgccaaggatcgggatatgtga

SEQ ID NO: 74583 - DNA, 672 bp, Glycine max
  Peptide Sequence Number=SeqID_166268
atgggtgactctgataggtgcagcttgtacatagaagcagatcctgcccgcttggttaccatggggagagtttatgagggatccactgttgttcataacactcctttgttgcctggccaagtaaaggtgagtgtggaggaggttacagatgcagatgctccagttcctgtacccactgatgaggtttccttagtggggcagacacttcacaccttccttgcttggccgacacatctggtcaagtctttatcacagcaggtacttattgtccttactatatctgtgtctccggcaaaaccacctccaaagcctgattcggaggtcgatgatccactttatctgatgacattgacaatcccagagcttttcttgaggccttatcaggttagatgggatgccaccgtgttcggggtctttaatccagatttccccctttacataaagcacgaagacctctccgaaatcgcacacggtggtcaatgtctcagcatatcagtgttacagttatggattctacaaaaaggaagtactgagtgcggctactatgtgatgcactggatgtccaccatcattttcggaacttttaggaataattgggaagcgccagagagattaaaggcattgcggatccactgggcacagttttatctccgagttagagatcaggcctag

SEQ ID NO: 74584 - DNA, 642 bp, Glycine max
  Peptide Sequence Number=SeqID_166269
atgaccttggaagacgttgtcgtgcaacttggcctccccattgatggagaagtcattacaagcattagcagtggtgatttggttgcttggtgtgaacctttattgggttatcttcctcccacaggttgtgcatcgggaaatatgatcaagttatcatggctaaacaatgaattccaacaacttcctaatgatgtagacaaagttgcttttgcacaacatacacaagctcatattttatcactcataggaggtttattgatgcagaatacaataagctcttggatcatgggattgattttaagcaagaaaacattgaagggtgttgctcctccaatcatggttctttatacttatgatattttttatggacattcaaatatgtttgctacctattccacaacaccaccgtctgcatacaatccaacatcattaatggattgttatcatcccacattacctactcagatgaggaacactaatgattataaagacgatggagatgaagataataacaacaatgatggtagtagtcttagggccagtaatgacggtgatgatactacaacaaagggagcccaaccaactcaacgtggtcatagaccaagagaacaacaagcagaaccaactcaacaacaacaataa

SEQ ID NO: 74585 - DNA, 1086 bp, Glycine max
  Peptide Sequence Number=SeqID_166270
atgggtagaggaagatgcttcttggacattagcataggggaagagcttgaagggagaatagtggtggagctttatgatgatgttgttcccaaaactgctgagaatttcagagccctatgcactggtgagaaaggcattggttcaaatactggagtgccccttcatttcaagggatcttgctttcatcgtgttattaaaggcttcatgattcaaggaggtgatatatctgctggggatggtactggaggagaatctgtatatggacttaagtttgaagatgaaaatttcgagttgaagcatgaaaggaaagggatgttatcaatggcaaactctggtcctgatactaatgggtctcagttttttatcagcactacccgaacatctcacctagatggtaagcatgttgtatttgggaaagtagttaaaggaatgggagtggtccgatcagttgagcatgttgcgaccggagacaatgatcgtcccactctagatgttaaaattgtggactgtggagaaattcctgaaggagaagatgatgggatatctaactttttcaaagatggagacacctatcccgactggccagcagaccttgatgagagccctaatgaacttgagtggtggatgaaatctgttgactcgattaaagcttttggcaatgattattacaggaaacaagattacaaaatggctctaaggaagtatcggaaggctttacgctacctggatatttgttgggagaaggaaggcattgatgaagagataagttcaggtttgagaaaaacgaagtctcagatttttacaaacagctctgcttctaaattgaaattaggggatattaaaggagcattgttggatacagaatttgcaatgcgtgagggagacaacaatgctaaagctttgttccgccaaggacaggcatacatggcactccatgacattgatgctgcagttgaaagctttaagaaggcactgaccttggaaccaaatgatgctggaataaaaaaggaacttgctgctgctaggaagaagatagctgataggcgtgatctagagaaaaaggcatatagcaagatgttccaataa

SEQ ID NO: 74586 - DNA, 729 bp, Glycine max
  Peptide Sequence Number=SeqID_166271
atgggtgtcatctctagcaatctaggagattattattacagcaagggtgaacaaccaaataatgtgaatcctcaacttcttgcattttgggctcctatttttctaatacaccttggtggtcctgatacaatcacagcttatgcattggaagacaatgagttatggctaaggcactttgttggtttgttgtcccaaactaccttggttgtctacataattatttttgtcttggaaagtactaattcaagtgaaacgagggagcaccaaggtgtggatcacatcatcacatacttgttgctgagccagactctgttcttaggaccttgccttcgcttctgctacgaccacccatcatttgttgttcacgcaccaagcccaagaagtgttgtgcgtgagggggtgtgttgggaaataatccaagtcccacatcgactaaaaatctgttttattattactgtgaggaacaacatattgaagttttttgaacaaatcaaagtttctccacaacaagataatttagctgaaacttgtaggatattgcttcaacatgtggacacagctacgtcagaagacgatgaagactcagagtcagagatgcaaagtgcatctgttctgtttcatgcttgtgcagtcgcaaaacaactcattgctgtagaagatagacttccaacgtgggcgttcgttcaaaatttgtggattgagattgagttgtgctggtggtcaatgtag

SEQ ID NO: 74587 - DNA, 1327 bp, Glycine max
  Peptide Sequence Number=SeqID_166272
atggctcaacccagttccaacggggatctgaataataaccagcagcagggtcaggttcagcaacaacagcagcagggtcagtgggcggcggcggcgcagccgcatcagtatcagcagcaatggatggctatgcagtacccggccaccgccatggccatgatgcagcaacagatgttgatgtacccgcagcattatatgccctatgctcaccctcattacccgccgccgccgccgcctcctccctcctcccaccaccaccaccaccacaaacaggccgcggcctcctccgacgagatcaggaccgtctggctcggcgacctccaccattggatggacgagaactacctccacaactgctttgctcacaccggcgaggttgtttcggccaaggtcattcggaataagcaaactggtcagtccgagggatatggattcgtggagttctattcgcgagggacggctgagaaagtcttgcagaactataatggcacgatgatgcccaatacagatcaggcattccgtctgaattgggccacattcagtgccggggaaagacgttcctccgatgctacttcggatctctctatatttgttggggacttggccattgatgttaccgatgctatgctgcaggatacttttgctggccgatattcgtctattaagggagcaaaagttgtcattgattctaatactggccgctcaaaaggctatggttttgttaggtttggtgatgaaaacgagagaacgagggcaatgaccgaaatgaatggcgtttattgttctagtaggcccatgcgaataggtgttgcaactcccaagaaaacttatggcttccaacaacaatattcttctcaagctgtggtattggctgggggacactcagctaatggtgctgtggcccaaggttcccattctgaaggggatataaacaacactactatatttgttggagggcttgattctgataccagtgatgaggatctcagacaaccatttttgcaatttggtgaggttgtctctgtgaaaattccagttggtaaagggtgtggatttgttcaatttgctgacaggagccctgctccagctgtgatagtccttggaggagcggcaagaaagaatgctgaggaagcaattcagggattgaatgggacagtaattgggaagcagacagtgcgtctttcttggggtcgcagtccaggaaataagcattggagatctgattccaatggaggccattatggtggtcatcagggttatggtggccatggatttgctgtgagacagaatcaggatatagccatgcaacctgctgctgcaattcaag

SEQ ID NO: 74588 - DNA, 843 bp, Glycine max
  Peptide Sequence Number=SeqID_166273
atggatgttatggactggtgtgaggattttgcacaagtgcagaaaaatactaggcatttgctggttgtggaaagagcagtgcagaatgagttctggatgtttgctagtagatcccaacggtcaaaattgagaaaagctgtgattttggttgatgtgttgagcagagttctctgcctttgctctgttttgcttggctgtgatagcttgtgctgtttgaatgttgttttgcttggatgttgtggaagcttgggaggattgatggggacccggggatggtgggtttatgcgcgcattgtggatgtggaaaacttgttgtgcaccatcgcccgaccgccacctagtaccacatgtgatggggtgaaacttcctgcttttattgttgaccacagagtggtacctggagatatgtcgcgggggtcaggagaccttggggacgtcaggcgagctcctggcagtcaacagataaaaggaaaacaagaccacaaagcaaggaggcttgtggtggctggccagctgcttgaaaacgaggtcaggaagctaaggaagcctctggtaatcgattaccaagggatcgtgatggcggcgcagctaatccgtgatcgagtagagatggagtgcttagagggagcttgggagaccctcaaaggcaacacgaggtgccgatttcggggcaccattcgattcacggctacttctttggtgcatccagatgaacctgcacggacgcttcagcgcacggaatttgatgattgtatacttgtggctgaagccaccactatggacacctttgctctggatgacactatatattttgtaaaactcccatattttggacagctttaa

SEQ ID NO: 74589 - DNA, 234 bp, Glycine max
  Peptide Sequence Number=SeqID_166274
atgtggtggaaagggtctaatgttgattatgaaaccgtaagggatttttccaatgatcaagatgccatggacttggcaagtatacctgatccaccctatgaggaaccttatacaaattttaaggagatgcatgatttggagactggctatgaaattgaggagatgtatagtgatgttgaatctgaggatgacactacaaagcttggaaaaaggtttccaatgtttaggaagtaa

SEQ ID NO: 74590 - DNA, 183 bp, Glycine max
  Peptide Sequence Number=SeqID_166275
atgccttttgggctcattaatgcaccaagcaccttcacgaggctaatgaatcatgtcaaaaaggagttcataggtgtgggagctgtgttgttgcaaggtatgcaccctattgcttactttagtgagaaacttcatggtgccactctcaactaccccacacctgataaagagcttatgccttag

SEQ ID NO: 74591 - DNA, 758 bp, Glycine max
  Peptide Sequence Number=SeqID_166276
atggccaagttcgatccagaaatagtccttgagttttatgccaatgcttggccaacagaggagggcgtgcgtgacatgaggtcctgggtaaggggtcagtggatcccgtttgatgttgacgctatcggccagctcctgggatatccattggtgttggaagagggccaggagtgtgagtatggccaaaggaggaaccggtctgatgggttcgatgaggaggccatcgcccagttgctatgtataccggggcaggattttgcccggactgctgccggaagacgggtgcgaattatgcgcaccaacatgaccaccctgactcatatatggatgactctgctgctcagcaacatcctgcccaccgatcataattccgacctccccatgccgaagtgtcagctggtgtatggcgcctaccagcaccctttggacccagataagtccaacagggccctgggatttcccgcactgatcacaggactctgccagtcgttcggagtcccgttgcacctaccaaggcgcgcccccacacctcatcaggctggccaggctggggcatttgacatggagcagtatttacggcatttggttcgccagcaggcggccaaccaccgagcacatggcagaggttgcatggcccggagattggccgaggcccaagcaggagaggcacccccagaagctcccggcgatggagaagaagcccacgaggatgaggagatggctgatttgcttgacttcttgggagggagtggagacac

SEQ ID NO: 74592 - DNA, 294 bp, Glycine max
  Peptide Sequence Number=SeqID_166277
gtggtggcacctccaggatccatttcatccgttgtgcagtttctggagagggtagcctggcctggggcccaaccttgtcttcacaaggaagatgaaggtcccacagcccaggtcacgagaggccacattagatccacccacaccagcggtggacctatcctcacctcatcatgcagcagacccctccactcctatactcgagatactagaggaccaaccacaccagtcctgactctgaacacttctcctccagctactccagtacttcatctgacagatgaggaggatgtttag

SEQ ID NO: 74593 - DNA, 907 bp, Glycine max
  Peptide Sequence Number=SeqID_166278
agggctacgtgccatcaccttcagaggactacacgtcctcgccctcagagggctgcacgccatcgccttcagaggactgcatgtccttcccttcggaggactacaagtcttcgccttcagtgggctgcacgtcgtcgccttcagaggactacacgtcgtcgccttcagagggctgcacgccctcaccttcagaggactacacgtcctcactttcagaggactccacgtccttgccctcagaggactacacgtcctcgccttcagagggctacacgtcgtcaccttcagaggactgcacgtcctcgccttcagaggactacacgtcctcccctttagaggtctacatgccctcagcttcagaggactacacatcctcaccttcagagggctacacgccttcaccttcagaggactacatgccctcgccttcagagggctacacaccctcgccatcagaagactacacattctcacctttagatggctacacgccctcgctttcagaggactacacatcctccccttcagagggctacatgccctcgccttcaaagggctgcacaccctcaccttcatagggctacatgccctcgccttaagaggactacacatcctcgccttccgagggctacaccccttcgccttcagagggcgacacgtcctcgactttggagtgttgcatgccccctcgcctttaaagggctacggatcctcactttcatcccttggttacccccctgatctcagaggatggccaactgtgcaagcacaaccagagggaggctatcgtgcaaccactatgcatactggggcaagatttcacccgtgctgctacaaagagacgagtgtagatcatgcacaccaacatgaccactcttacacagatatggatgacgttgctacttag

SEQ ID NO: 74594 - DNA, 64 bp, Glycine max
  Peptide Sequence Number=SeqID_166279
atggagcttacatcacgcttagcgagtaaaggggaatctggaaaggcatctactaggcaagcac

SEQ ID NO: 74595 - DNA, 519 bp, Glycine max
  Peptide Sequence Number=SeqID_166280
atggcggaaaacctccacggatttgcttatggaaatgtcacggacgagttacggaagcgtctcgacttggattttcttcacggaaacgattttttcactgatttcaaaaaaataggggaggagctagccacccagctcgcccaggcaagccaagttacttcctccataagcaacctccttctggaggaacatcttggaaggcccaaggtgccaagtacctcgaagcggtcaaacaaaggttgcatgccatcaaacaatggtccccggacgacattagggtatgacacaacaagtgcaaccaacttggtcacatcaaagaaaattgtccctcaatcgagcaatggcctgagaagaatgagaagaacagtcatgaagaacgaagatccaagaaggcctatattgcataggatgacaatcactcatcctatggttcggagaaggagatcaaccttctatccaaggactatgagagcgatgacaacatctctcaagaagattacgcaaaaagcaaaagtctga

SEQ ID NO: 74596 - DNA, 1020 bp, Glycine max
  Peptide Sequence Number=SeqID_166281
atgctggcgactgaaattgaagtgctgaatgcttcattgacgccgccgttcatgctggatgacgataacctgaccgagacggtacgcctggaacaccgttatatcgatctgcgccgtcctgccatgcagaaaaacctcatgctacgctacaaagtagcgaagaatctgcgcgactacctggatgaaaacggcttcattgaagttgaaacgccgatgctgacacgttcaacacctgagggtgcacgtgattacctggtgccatcccgtgtacatcacggtatgttctttgcactaccgcaatcaccacaattgttcaagcagttgctgatggtgtccggctttgaccgttacttccagatcaccaagtgtttccgggatgaagacttgcgcgcggaccgccagccagaattcacccaggtcgatattgaaacatcgttcctggaagaaaatgaaatcatggacatcgtggaagagatgatccgccgcatgctgaaaaaagtgcaaaacgtcgatttgccagccaagttcccacgcatgccattttctgaggcgatgaaccgttacggttccgataaaccggatatgcgcgtgacactcgaaatcacagagctcagcgatgtgatgaaagatgtagacttcaaagtgtttgcgggtgctgccaatatggcaggtggccgtgtggcggcgatccgcgtacctaatggtgcagcgatcagccgctctgagattgatgcttacaccgagtttgtcaaaatctacggtgccaaaggtctagcttatatcaaaatcaacgacattaccaaactgaacgaagaaggcctgcaaagcccgattgtgaagaacattcacgtcaacgcgctgcaagccattattgagcgtactggcgcacaaaacggtgatatcgtattctttggtgcagacaaagccaaaattgtgaacgaagcgctgggtgccttgcgtaccaaggttggccacgaaaaaggccatgtcgatggtcgccagtgggcgccattgtgggtg

SEQ ID NO: 74597 - DNA, 225 bp, Glycine max
  Peptide Sequence Number=SeqID_166282
atggcagcggaatggagaaggaagagagagaggagacgccacttcaaggagaagatgagtctagaagaagctcgccaccataggaggccatggataagagcttggaggaaaaaggagatgaataaagggagagggagagaagagcaagaaattttgcgctctaagagagctctgaaatctgaacccactaatccaagatcaagtccaagattctccactaagtga

SEQ ID NO: 74598 - DNA, 670 bp, Glycine max
  Peptide Sequence Number=SeqID_166283
gctgccgtcccttgggacagacgtgtggggtgctaataccttccccgtgcgtaaatacaactcccgaacctttcacttaaaagttcgtagatcgcgtcttttccggtttttccgacgttttcctcaaataaacgttggtggcgactccgcgcgtattcctttcatggaactcgcatcccgcgagtctcgcgtcgccctcccgccgaaggagcagttcattgagaagctatcctggcttggaaccttaccttctattgtgagaaagggtgaggatcccagtgctcaagtacctcaacaggtacaggatgcgtcttctgaggctaccatccctagagctttttatctttcaagtgcaggagtagagatgaggcctgatgaggctgtttttcctgagccaattgtgccagctatacacgggactatggaagcaggtgagtcacaattgagacaggaggttcctactcctgagaggacatcacagaccccagaagatccaccctcaccaggggtagcagatcctcctgcaccagtacatgagagactagctgacccctctacacccaccatggagatgccagaagaccctaccacgctagtcctgagattgtcatccactcctccagctaccccagttttacatctgacagatgaggaggatatgcaggactag

SEQ ID NO: 74599 - DNA, 198 bp, Glycine max
  Peptide Sequence Number=SeqID_166284
atggccaaattatctttccctgtcattacagctttggtcacactgctaaaagctgaattagttattcttaagtattatcaagcttgtatatgcttacaaatgattggcctcaacaagccaacctctggtaccgcatttgttcaaggtcttgacataagaactcatatggatggaatatatactagcataggtgtatag

SEQ ID NO: 74600 - DNA, 174 bp, Glycine max
  Peptide Sequence Number=SeqID_166285
atgggattcctcgtgttcggggtctttaatccagattccccctcaaaaagcgaagtactctccgagtcgcacacggtgtattttaacgatcctagaccattggagccagagagattaaaggcattgcagatccagtgggcacagtattatctccgagttagagatcagacctag

SEQ ID NO: 74601 - DNA, 414 bp, Glycine max
  Peptide Sequence Number=SeqID_166286
atgagcctcgcatcgccctcccaccgaagggtaggttgcaacagtatccaagatggaccaagtcaagcattgcgattgaatgctccattgccatatccacacctagtcacccttttccttcaacactttaacatccctcttgattctgaaccctatgttccaatcaagagatcctttctaataggaacttctgtcattgcatcctttggttatcaaaaagagcatgatggctcttgggtgaaaaagggtgctcgacatgttgatgaagaaggacatggtggagaagattcatctcttctttcaaagattttggataggttcgatggtcttcaaacctttgttggtgaaaggtttgatactttgaagttacaagtggacttgcgcttcaatgagatggagtcaagaatcacctag

SEQ ID NO: 74602 - DNA, 684 bp, Glycine max
  Peptide Sequence Number=SeqID_166287
atgcgcataatctgcggatggcagcgtgagtgctgcggcgggagaagcgcagcaggtggagtcactgattgcatggctgaaggcaggcggaccgcccagtgcccggtcgcggttggcgaagcccagcaggctcagcaggctgacaaagatgttgtacagcgagacatacaggctgacggtggcgcgaatgtagttggtttcaccgccctgaatgatgttgctggtttcccacaaaatggcaccggcagagaacagaataaacagggcgctgatcgccaggtgcagcgcgggcagctgcaggaagatattggcaaccacggccaccagcagcaccacaaagccggccatcatcatgccgccaaggaaagacatgtcgcgacgcgtggtcaggacataggcggaacagcagaagaacaccagcgcggtgccgcccagcgccatggcgataacatcacccataccggcggtgaggaacgagctgagaatcgggccgaggcagtaaccgaggaagccggtaaaggcaaacgcggccagaatacccgccggactgttcgccaggcgataggtcaggaacatcaatccgtaaaagcccaccagcatcagaatcagtcccggcgagggcagggcgtagacggtgctgagcgtggcggtgacggcggaaaacgccagcgtcaggccaagtaa

SEQ ID NO: 74603 - DNA, 304 bp, Glycine max
  Peptide Sequence Number=SeqID_166288
gttctcccaagaaaggaaagtgttttcatttcagctacctctggagcagttggtcaatgataagcataagtataagccacacatcaccaaggtgttcacctgcaaacacccaaggggtgcaaaccacccaacagttacaacccacccaaagggtgtaaatcacccaaagggtgcaaggtcaaaagatgtgaatcaaggggacatgacccttgggaacagtcacaaccaaccgaaaggggacatgacccttgagaacagtcacaaccaatcgaaaaaatgtgaatcaaggggacatgacccttag

SEQ ID NO: 74604 - DNA, 318 bp, Glycine max
  Peptide Sequence Number=SeqID_166289
atgacttggggaaatccagttgatttacaaccctttgatcctaaaacagatagaaccattcatagattatttaggcatagtgtgcattttgagcattctgagcattttgttcattctgttgctagtgattttgaacattctgattttgagcattcggctgctaattttcatactaagaacatggctcaatctccacctcgtgagaggactcttagggagatggctgcacctgacttcacttatgaaagcttgtgcattcaatatcctaatgaggatgttccatatgttctcaagactggactaatacatttgttgcct

SEQ ID NO: 74605 - DNA, 352 bp, Glycine max
  Peptide Sequence Number=SeqID_166290
ggtgttgaagtattggtcatcaaaatttccattcttgcaaacatgggctggggtagcgggtggatcaagttctacgtcaggcttttagcaaggatgcccgataggaggaaggaagccatacctcttttctgggtactatccttctatggcgagaataacaggagtggtcaagacctaggaacaagaattagatcaagtgaagccaaaaaggaatggagtagcaggaataccaaggaagtgcttggaggagaaggcggaaactgtggcaagccaaggagagtgggcgtcattcatcgacgtattagcatgactagtgtttgggacaatactatttccaaatgtagacgagctg

SEQ ID NO: 74606 - DNA, 231 bp, Glycine max
  Peptide Sequence Number=SeqID_166291
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggagaggagaaagagtgtgacacacagtcaagatttttgctacagagaaatcatatagaagaggccgaagagaatcagagtccggatttctaa

SEQ ID NO: 74607 - DNA, 333 bp, Glycine max
  Peptide Sequence Number=SeqID_166292
atgatttgggcattcccatcttttggaaccatttggctaaacagatatcccgacatacattgtgtcccgccattggcaggtgtctcaacttgccctatggcgggggcgcaacatgaggctcaattgagcgtcttccaaggaaggaaaacacctggagtctccaccaacgtttatttgaggaaaatgctagaaaaaccaaaaggaaaaaggtctgtgtattttgaaaatgagggttcgcgagttgtttacgcacagggaaggataagacttttgcagcaccccagttcctcatatccatttctacccctaaaagacacaaggatatcaatgtaa

SEQ ID NO: 74608 - DNA, 1151 bp, Glycine max
  Peptide Sequence Number=SeqID_166293
tacctattgcctttagagggcttcacgtcctccccttcagagggctaaacgtcctcgcctttagagggttgcacgccctcgccttcagaggactgcacatcctttcctttagaggattgcatgtcctcgccatcagaggattgtatgtcctcggcttcagagggctacacgtactcgccttcagagggttggacgtcctcctcttcagagggctacacgtgctctactttagagggctgcacgtcctcgcctttagaggactagggctacactccctcacctttagagagctacacgcccttgcctttagaggactgcacgtgttcgccttcagagagctacacaccctcgcctttagaggactacacttccttgccttcagaggattgcacgtcctcgccttctggggaccacacctcttcgccttcagaaagcttgacgtccttgcctacagagggccacacgtccttgccttcagagggctacacgccttcgccttcagaggattgcacatcctcgccttcaggggactacatgccttcgtctttagagggcttcgcgtcctcgcctgcagagggctacacaccctcgcctttacagggctacacgccctcgccttcagagcgctgcatgccctccccttcagagggctacacgtcctcgccttcagagggctgcacgccctcacctttagagggctacacattctggccttcagagggctacacaccctcgccttaagagggccacacgccctcggcttcaaaaggctacatgccctcactttcagaggattgcatgtcctcgccttcaggggactacatgtcttcgccttcagagggcttcacgtcctcgcctgtagagggctacacgcctttgcctttacagggctacacgccctcgccttcatagcgctgcatgccctcccctttagagtgctacacgtcctcgcctttagagggctgcacgccctcaccttcagagagctacacgtcctggcctacagagagttgcacgccctcgccttaagagggctacacgccctcggcttcaaagggctacacgccctcgctttgagagggttgcatgtcctcaccttcagagggctacatgtcctcgcgttcagatggctgcacaccctcaccttttga

SEQ ID NO: 74609 - DNA, 1211 bp, Glycine max
  Peptide Sequence Number=SeqID_166294
aggactacacgtcctcgccttcagagggttgcacgccctcacccttcagaggactgcacgtcctcaccttcagagggctacgcgccctcacctttagaggactacacgtcctcaccttgagagggctacacgctcttaccttcagagcaattaacatcctcaccttcagagggctgcacgctcttatcttcagaggactacacgtcctcgccttcaaacggttgcatgccctcagcgtcaaaggattgcacgtcctcacctttagagggctgcacaccctcacctttagaggactacacatcctaaccttcagaggggtacacgctcttaccatcagagcactacacgtccttcccttcagagtgttgcacgccctcaccttcagagtgttgtacgctctcaccttcagaggactgcacatcctcaccttcaaatcgctactcaccctcaacttccaaggactacacgtccccaccttgatagggctacacgctgttaccttcaaaagactacacgccctcgacttcagagtgttgcacgccttcaccttcaatggactgcacgtcgtcaccttcagaggattacgcgccttcacctttagaggtctacacgtcctcacctttataaggctacacgttctcaccttaagaggactaggactacacatcctcaccttcagagggctacacgctctaaccaacagaggactacacgtcctcgccttcagagggttgcacgcgctcaccttcagaggactgcacgtcctcaccttcagagggccacgcgccctcaccttcagaggactacacgtcctcaccttgagagggctacacgctcttaccttcagagcaattaacatcctcaccttcagagggctgcacgctcttaccttcagagggctacacgtcctcgccttcaaacggttgcatgccctcagcgtcaaaggattgcacgtcctcacctttagagggctacgcaccctcaccttcagaggactacacatcctaaccttcagagggaggactgcacgtcctaaccttcaaagcgctacgcgccctcaacttccaaggactacacgtccccaccttgatagggctacacgctgttaccttcaaaagactacacgccctcgacttcagagtgttgcacgccttcaccttcaatggactccacgtcgtcaccttcagaggattacgcgccttcacctttag

SEQ ID NO: 74610 - DNA, 2754 bp, Glycine max
  Peptide Sequence Number=SeqID_166295
atggcatcttcccagattgaaatcgcttcttcatcgccttttggttgcgctttgagggaccgcaatcaccgcgaagcgtgcagcagggaaagcggtaacgtgaagagcacgcatcatcatcatcatgctaatttccaaagaaacatgaagaactttgtgatggaccttaacatgtgcatggctgtgtcttctgattcgaaagcaaatgaaaatgaaaacaacagcagcagcagcagcagcatcaacaaccaccggaaggctccaaaaaacaaacagctagagaggcttcttatcacacgagccaacccctttattaacaacagcaatgtcgccagcaatgaaacctcgttggcctcgttgatcagcccgagacactcgggccttctcgatcgatgggccacgaggcaggcttgccagatggtgtcgaatttggagaatgaggcggagttgttgtcgatggatggcaatgacatgcttccaaggacttctagttcctccgaggaggagtcatccttctcctcggagactcgaaatggaggtggtgcctcttctcttgttcagatatgggagaagaggctgaaccaatccagtgtctccaaacccaacacgccaagggagaggattggttcgacctcttcttccataaatgagaatgctaatgctttctctccggagaatgttaatgctttctctggggaggaacaatgctttgatggaccctcagggaacgaagaatcatttacatcttcttcgttccctgattgggaatctagtgatcagtccctttcgccaagccgcaggtcggagagtgacagggtcagggttgctgacatcataaagaaactaacttctacaagccagaatcagtgtccaacaccttcctttgctgatgacaatgaacatgaagggtatggtagcagcgtgacaggttctccttgtagagagcgtgaatgtgatcaacaacattcggagcagaaccgtagagttaattgttccttgcgaattagagggcgccgtgcgtacattgatttacttgcacagatggagaatgacaggcttggggagcttaacaacctggtagagcgtggagcagtctccaagttcccacaaagaggtcgcattcaggcaatgcttcgacttagattattgcaacgtggtgtggcagctaatgatcagccccgccagaaatcaacagcatctgaagtaaacaacagtcagccacatggatatgcaattatgcaattaagtggagctgaacttagaactccagtccagaccgaattagctaacccaagaagtcctcaaagggagacagtaaacaaaaccacacaattggataactctgtcactactgatcaactcagcaaagacacaagcaacaagaaaggtcacggaaatgccaatcatgccacagaatccacacaaaagtcagcatcgcagactagaatagatcatagcacagaagaagctcatccaagttcagatatcaaggctccacaaaatgactcacgagaaactaccgaggcaactacatccacgattgattcaaatctaaatgagatgaccgcagatagggaagagacgagcaaccaacagaatgctatggctaaaagcagtaatgatgagacagtgaatgaggaagaggaaagtaaccagcagcatgccgaaaccagttatgaggagacaatagaagaggcaagtaatcagaactatgctgaaagcagttatgatgatgagatggaggaagaggtagaggaaattgaccagaattgttatgaaactaattatgactggatcagtgaaatttctaggcctaggagctactgggaagagtgcaggcaagcatggtatagagagatgctagaaactggtactcaaaatgaggatatacggaggcttcttgaaagaagaacagtgtcaagtttcctttctagtgacttccggggtagaatggatagattgatggaatctcataggggaacacaaacacatctagtgaatagtcaagaccgtgaggaagacagccaaggattgatggcatttttacaagaacgcttgcattctacaagagcttctcaagatggaagtaatgcgagggaggaagaagatgagagtagaaatcaggatgaggaagaggaggataatacagatgagcaggagcaggagcatgaagaagagcatgaaaaggagagcttgataagtggttcatatcatgaagtcggcgattattctaatcaatcctcatcatggagttacagggacaacgaagctggtgatgatttcgatagagttgtttcttcatccccacaaccttatcaatctcaatctttctattcggaatgtcggcactcttcatccaccaatcatcattcaattgaaatggaactcatatatgatttgagagggcatatggagcaactttatagtgagatatctgagctaaggaaatcaataaagggctgcttggaaatgcagatggaattacaacaatctattaaacaagaggttcaaacagtcatgcaatgtaaacacaccattacagttaaaaaagaagaaaagaagtccaatgacacgactttaaagaaaggcaactgctgcatttgctatgagatgaaagttgactcagttttgtacaggtgtggacacatgtgtacatgtctcaagtgtgccaatgagttgcaatggaacagtggaaaatgtcctatatgtcgcgctaaaatagtggatgttgttcacgtatatgttgacagttag

SEQ ID NO: 74611 - DNA, 1710 bp, Glycine max
  Peptide Sequence Number=SeqID_166296
atggccaaagagcgagagaagaaactctacgtagccctactcggaaactacgccgccgaactcaaactcctcctcaccactctcctcctcctctgtgccgtcgccactctcctccagttcctcccttcccgcttcaccatctccgcctccgacctccgcgtctgcatttcacgcgtcactcaaactacccaaactatccctaactcaactaatgcgacgtcaccaccagtaacagcaacagcatcagcatcagcatcagcatccccactcgttgcatctttatcttccaccacttcaccctccccaccgccaccctcaccaccgccaccgtcgccgccatcgtcagagcaaatcctccccgacggaacaataaagcgcgtgttcaacccttacggctccgcagcttacaactttgtcaccatgggcgcttacagaggtggcctcgacacgttcgctatcataggcatcgcttcgaagcctcttcatgtctacgccaaacccacctacgagtgcgcgtggttctcactcgccggcgacaagaaaaaactttccaccaccgtcggttacaagatcctccccgactggggctacggccgcgtctacaccgtagttatcgtgaactgcacattcccgattcccgtaaacgccgacaactcaggcgggaagctcgtcctctttgcctccacctccggcggcggcgacgccagcttcaacaccaccgacagaatagaagctctcaccgaacaacctcgtaccctcgacacaaccttattctcctcgaagccgaagtacgactacttatactgcggctcctcgctctacgggaacctgaacccgcagcgagtgagggagtggatcgcgtaccacgtgaagttcttcgggccaagatcgcattttgtcatccacgacgccggtggggtccacccacaggttcttgaggtgctgaagccgtggatggatttggggtatgtgactctgcatgacataagggaccaagaacggtttgatgggtattaccataaccagttcatggtggtgaatgattgcttgcataggtataagttcatggctaagtggatgttcttctttgatgtggatgagtacatctatgtgccgccaaagagtactattaagtctgtgcttgattcgctctctgagtactctcagttcaccattgaacagatgccaatgagtagcaagttgtgtcttacttctgattacgggaagacatatagtttaggcatgagggaatcttggatggttgtgggggagtgtaaggagcatttactgcgggtggtgggatttgatttggttttgtacgagtttggagtagcccattcctgtggacaggtcaaaatgtggaaatgggggtttgagaagctggtgtacaaagattcaaagaaagggattagaagggatcgaaaatatgcagtgcaaccaaggagtttgtatgcaactggggttcacatgtcacaaaaccttgcaggaaagaccactcacaaaactgaagggaaaataatgtactaccactatcatggaaccatagctgaaaagagagaatcatgtaaaatgcttataaattcaacagaaatcacatatgacaaaaccccctatgtgttggacaccaccatgagggacattgctggtgtgatcaagaaatttgagctcaagatgattggagacaggctacaacacaagacacggcaatga

SEQ ID NO: 74612 - DNA, 930 bp, Glycine max
  Peptide Sequence Number=SeqID_166297
atgcatgcagggccatatgataatctgaaagatattgccatgaagatcttgcaaaaggaggtttcaactgttcctattatccattcatcttctgaagatgcttcatttccacagttactacatcttgcttcactttcaggaatacttaaatgcatgcttgatccttaccaaattgatttttcaggcatttgtaggtattttaggcactgctctagttccttgcctgtacttcaacttccaatctgtgcaatacctgtgggcacgtgggtgcccaaaattggggaatcaaatcggcggcctctagcaatgttgagaccaaccgcttctcttgcgtcagccctaaatttattagttcaaggtgtgaactttttgtctgaccctgaacatagtgtatcaaaaagaaaagcaacagagagaaaggatgaagaaattgcccaagtaagctcaataccaatagttgatgataatgactcattattggatatatactgtcggagtgacataacagctttggcaaagaacagagcatatacacatattaatcttgacgaaatgactgttcatcaggctttgcagttgggccaggacgcatatagtccctatgagcttagaagtcaaagatgtcagatgtgtttgcgttctgatcctctgcataaagtgatggaacgcttggcaaatccaggtgtcaggcggcttgtcatcgtggaagctggcagcaagcgtgtagaaggcattgtttcattgagtgacatattcaagttcttcattggtgattttaggctgagaaagaggcctgtaaattcagagtatttgattgcccaaaatttattcatctctccccattcgtattatcttcaaatgtattgtgctcctgacatagataccagcaaggtgggggagcacaacttctgtaatcattccatgctgtga

SEQ ID NO: 74613 - DNA, 888 bp, Glycine max
  Peptide Sequence Number=SeqID_166298
atgcgcagtgcattgaattggcgcggcattcacttgaatttgcaacgtgggagccggagctgcgatgaagtgtggtgcttggagggtattctcaaagtagcacttaattcgaggttgaatgtttggtcagagcatggattctgcaagggatgctgcgggtggtgtggcagggacagtgctaattcccatgcgttttgtgtggccatatggaggaaggagtgtgtttctcagtggttctttcacacggtgcttaattttgttgattgtttcatgaacgtcgtaatgtttttgctagaatgttttagtttaatcttgcttatctctcttgatcttctaccgatgtcgccagtggaaggttgtccaactgtgtttcaagtgatttataacttgccacccggttaccatcagtacaagttttttgttgatggagaatggcggcatgatgaacatcaaccttatgtacctggagaatatgggatagtcaacactgtcttattggccactgatcctaactacatgcctgttttacctccagacgttgcttctggaaatagcatggatgtggataatgatgcttttcgccgaatggcccggttgaccgatggtactttgagtgaggtgctgccaagaatatcagatactgatgtacaaatatcccgtcagcgtatttctgcatttctatcttcacacaccgcttatgaattacttcccgagtcaggcaaggttgttgctttggatgttgatctaccagtgaaacaggcatttcatatattgcatgagcagggagttttcatggctcctctttgggacttctgcaaggggcaatttgttggtgttcttagtgcttcggattttattttaattttaagagagatagaagaggtatga

SEQ ID NO: 74614 - DNA, 4522 bp, Glycine max
  Peptide Sequence Number=SeqID_166299
gcctagggctagaaagttttggtgggtggtggagatgaaggagaatactgatattgaggaaggagaggcttgctattataatgttgatgatgaagccaacattgaccccgattctttctcgtacattgatgagaagattcaacattttcttggtcattttcaaaaggactttgaaggtggtgtatctgctgagaatttgggtgcaaaatttggtggctatggttcctttttacctacccaggagcgctctccttgtttgtgttctcatccaaggactccacaaagaaaccacagctcaccagaacttagtatcaatctccacatggaggctgtgtctcataacacaaaagcatcttcaaatgggcttcctgcaaggcctgaaaatgcttctcatagttcttattcatttcgtgatttaaaagaagcttcagtaaatgattcagtgaagaaagaacaaggaatttcttccagtgatatagctgagaggtgcacttcgaaagatgatagtacaaaaaagacaggaaattcaactgaccaaaggccactgaagtttcgaattaaaatgaaatctaatatcttagcaccaaacaatgcagagatatatagtggccttgggcttgataactctccctcttcctcaatggggaacagccctgtggaaagtgaaggcatgccaccagtatctcaagagaatgctgaagattctccaaatggcattattcaggttatgacttcctttcctatctctgggggtgttctaatatctcctctgcatgatagtttgctctacatgataaagaatgaaaaagttatcagagacagcaaatacttgtcttctcttaaaggtcatcaagatacttgttccatgtctactgacgaatcagattcttttgtgggggatgaacatttgaagaagaaaacagtgagaataatgagagaaagtgaaaaacagttggaattgaagcatacaaatggcaccttttctgagaaggatttgacattgcatacaaagaaaagattaggaaatagaacaccggattgtaaagatttcctctctaatgacttgaaacgtacacctctgtcaagttcaatttgtgatgctggtgaaacagctgaagtcactgctaaagcttttgaagcctccaaggactttaatgagagtggagtgcaaggcagaatggttcccgtagaagctttgaaggaggagtcattggagtcaatatctggtcaggattttgagaagactgaaaagcaaaatgcaggaaatgggtttatgaaaaatgctttagagcataaactggaaaattcccgcaaggataattttacagaccctatgaataataacatgcgtaatactttcatgaataagtttgaatctgatgcagtaaaacacaaggtagatcataagtatgagaaccatcagaaagtaaaggccgtgtctgagcggaagactaagtcaaagggtgatctgagtcctggaaaagctgaggctgttggaagaaaagatagctttggtggtactaataatgcaatggtaattgataaagggattgctggctttgacaatacttgtaaaagtaaaatgaataagtcaatgtcactgaagggcaaaaagttcagtaatagtaacggggattcattgaaagaaaaaaaatcagaacagaaagttgccagtgttgccagtattggtgctataaaaaacggtaacatcggtaatggaaaaaagagtgcatttgggactaaggtaaaggaaagactgagtggccataaagtggccaaccagttgctagctgggccatgcatcaaagatacttcagctgcacttcctattgctgaaaacaaccttgctccagagatgatttcatcagcagtaggagtgcctcaagttattgcggaagattgggtatgttgtgacagttgccagaaatggcggctactgcctaatggtatgaagccagagcatcttccagagaagtggctgtgtagcatgctaaattggctgcctggaatgaattcatgtgacttcagtgaggatgagacaacaaaagcactttatgcctcatatcaaataccaatttccgatggtcaaaataacatgcaaagccatggcactgaaactgcaattggagtgagctgtactttgcaatatggcctgaatcacaaaatgtccacttttgatatgttgtctgatcgagaaaagaagaaacatgttattaaggaaaagacaatgtcaggaagtaataatgatgttcttcagttcccaaattctgcaaagatcaatgttcaagtatctggaaaaaatagaagcttgaatgccatgaatcatcatcctgctgacttaaacccaatgaagaagacaagttcttctaaacatcttagcaggcttgacaacatgatagaagagaaaaacgtgcctaaagagaaagaaaagcaagtaaatgaaggtgatagaaagcatgctaagttgaaacgtaagatggatgctgatcaatataaattgggaactcctaagaaaccaaaagtcgaaaatgttttctatactgataagcaattgaatcctggcatggaccttgagaaggtgtctctatattcaagaaatggtttgccaacaaaagctagtgggaaggaaatgaggaagtatgatgaatattgtttatctgatgacatacaggacagattaccagtcactgtcaagaatgagggagatcatgctcaggtctcgtctggtggtgggtccttggatgtgaaaaacagaagtaaaagtggtttaatgaagaaaaggaaattgaaggagcatatggatgatgaaaagcataacaactcatactcctcgcatggtgaaaagcagtatggtgaagaaggcaatgcaagtgaaattaggaagcaaaagaaatacagaattttgagtaaagaggcaaaattagtaactgaaggtgatgataaattgagtaaagatgggatgaggcaagtttgcttgtcaggcaatagggaccaaatggctgttgggacagaagtaagatttgttgataaaggcaaccagccaaggaagcataggaaaaatgttgcatctcttcatgcttcggacagtattgatcaattgggcaagggtttgggctctagaccgctttcattggcagcaacttcaagctcttctaaaatttcagggtctcataaagctaaaaccaactttgaagatgtgagaggttcacctgttgaatctgtcacctcgtcacctctgagggccttcaacttggataagaatattttggcaataggagacacttcagtgaaagatgatgctacaaaaggttacctctcttcagtaggttcaaggagaagtgttgataatagggagggaaagctatcagtaaaattgaaggcgggtagaatttcgcatgacttacatcctgcatcccacaaattatcttcaatagaggctcggtttgaggatgctaaagacacagccagggtccaagctaaaaaatcttctgaactaaagaataatcatttgcttgaagctggtgttcatgttgaacagcctggttattgtgctaatggtatacgttatgaggagaaagtaaacaaggacaaccaggaaagtgaactttcttggcagaaatctggtaaggtttcatcattgcaccgcaaggagaagggcagaaagtctggttctcatgttggtatgaataagatgaagatttcagtttcagacattggtggttattcaaaaacaagtgggaagcatgattcagcagttaatcccagtaatcatgcatctggtgctgaggcaaaaaataatgctaaatatatttctttgaagtctaaaagtgaaattgactgtattattcagaaaagtgctttaagacatgggccaaatgaaactggaaaacaaactgagataaaagaaagagactttgagaattcaattctgaagatgaatgctcaatgtagcactgataataagactatctcccggcaaaacctgactcaggattttaagggagaaaacaaagctaatctcactgaatccagagttggggaatccaaagttctcccatctgcagtggatgaagtaaaaagggaagcattgaatgtgagttctagaactgtacctcagtatcaaaagggaggcatgtctaatgagcgtcctgtccatgtttctggcaatgatgatttggccaagtcaatgagaaattatgccgatgttagtaacaatgctggagttaattatagttctggaaattttgcacctgatcagcaacttactttgtcaagtcctttgagaactaattccagccaaactgctactggcaccctggaagaagccgcaaaactaaaagatagagcagataattataagaactccgggtttgactttgaaagcaatgagacatactttcaagctggtttgaagtttctgcatggagcctctcttttagaaaattgtcataatgagagtagcaagcatggggaaatgagtcaaatgaaaatttttgctactgcagcaaaacttttcaagtaa

SEQ ID NO: 74615 - DNA, 1272 bp, Glycine max
  Peptide Sequence Number=SeqID_166300
atgttcaataaacttctctatctgaaagatgtcactttcacagcaacatcacgttacccttttatccaccaccactccccattactatttcctctgcgtttctacacaacgaccacttcaaattcacactcattcgcggtatcctacctcatccacaattttgggttctcccctgaatctgcttccagaacttgtgactcctaccgcatttgttttcggaccccagaaaagcctgactcagcaatcaggttcctcagagaccacggtttctctaactcccaaataaacagtatggttagaagggtaccatggttgctttcctgcgacccttgcaaaagagtattgcccaagtttcaatttttactctcaaaaggtgtttctagctctacaattgttgacatagtgagtaagtcccctgcaatactgagtcgaagcctggagaatactatagtcccaagctatgatttggtatttagattcttgaaatctgatgaccacactatttcttgtttgtttggtaattgcatttactatggcagaagagattacatcgagcgcaacatcagagttttgcttgataatggagtgggagaaacaaacattgcaagattgcttcggaaccgttgtagggcggttttcacctctgatattcttaaggtggtggaggaagtaaaggatctggggtttgatccttcaaaatcagcttttgttacagcattgcttgccctaaaaagtatgagtcaaacctcgtggaaggagaaagttggcgtctataagaaatggggttggtccgatgaagcctgtcttgaagcatttaggaggcaccctcactgtatgttggcatccattgacaaaataaatactgtgatgaacttttgggtcaatcagttgggctgggattctttggaccttgtccgatctcccaagattcttgggttgagtatggaaaaaacaatcattccaagggctcttgttgtccagtatttagtcgcgaaaggcttgaggaaaaagagtgcctgctttcatatcccatttgctgtttccaaaaaggcgtttatggaaaagctatatcaactatcaagtgacaacttcaggatacagcattgtaggctagtgttggcttggggtgagccttggcacaatggcaagaaactacccctgtgctcattgggtttgggattcatacatttgactctccaaagtccaaactcccacaatagtgagagccttgtgaactgggctgttatttacaatagaggtgcaaaggactag

SEQ ID NO: 74616 - DNA, 123 bp, Glycine max
  Peptide Sequence Number=SeqID_166301
atggctccatcctatcctaataaagatccacccctcggcatcaacaataatgatggtaatagccacaacaatgtagatttggtgatggtcaacatcaatgtaataatgatggtgtccttataa

SEQ ID NO: 74617 - DNA, 582 bp, Glycine max
  Peptide Sequence Number=SeqID_166302
atggggcttaccgtaaccgttaccgttatcgatagagaagaagatgaattgtgctttttatttgagggctcattaaaggaaggtttggcattttcgcataacggcgcagatggctactctagctatattgtatgcctgagttggactcgccaagagcatttgggtatcgtggtagtttctgtgtctggctctgtttcagagcatttgggtagcggggtggacccacagagggcgtggtttccggagaagcttacattgccgaatttggtgagcatggaatcggggatatggcggcagagttcgttgttggtgacgttgagtacggtgagattaaggagggaagctgaaagatcggggacgtggtcggagagggcgttgttctgtaacctcaatgtgaggaggtgggttagtttcgctagttgtgtggggattgggccgcggatgttgttgttggagatgtcaaggcggaggagaaggcagagcgaggatatctccgccggaatctcgccggagaaatcgttgcaggaaaggtatagtagttccatgcttgtgcagtttaagagaggtgaaatggtagattag

SEQ ID NO: 74618 - DNA, 213 bp, Glycine max
  Peptide Sequence Number=SeqID_166303
atgccttcttttgctcaagcagatatcatggtgttcctcatcttggcactaatctccatggtgtttcgtgaaggccatattgttaagtgtaatgcagaagaagatggtcatgtaggtaatcaacaaattaaagggtatagagttgcatatccgaatattaatgtgatcattaaattttttagagctgaaggtcacaagaaggtgaataattaa

SEQ ID NO: 74619 - DNA, 174 bp, Glycine max
  Peptide Sequence Number=SeqID_166304
atgaggaccactaagggaaaaggaaggagaagcttgccacccagctcgcctaggcaagctcagctcgcccagaacttcacgaattgcctaacgatgggtgccaagtacctcaaagtggtgaaacgagggtcgcatcccaacaatggatggtccccggatgaaattagggtatga

SEQ ID NO: 74620 - DNA, 814 bp, Glycine max
  Peptide Sequence Number=SeqID_166305
atggctacccgcagcaaaagcagccagcgctggctcaaggaacacttctccgaccccttcgtgaagaaggcccaggccgaaggcatgcgttcgcgcgccgcctacaagctcgaagagctgctggaacgtgaccggttgctgaagccgcacatggtggtggtcgacctcggcgcggccccgggcggctggtctcagcaggttcggagacagatcggcgacaccggccgcgtgctggccctggacatcctggacatgccgccgctggccggcgtcgagttccttcatggtgacttcagggaagaagccgttctatcgcagtttgaagccatgctcggggatcagccggtagaccttgtgctgtcggacatggcccccaataagagtggtgtgggcgcggtcgaccagccgcggatgatgcacctggcggagctggccctggattttgccgacaaccacctgaaaaccggtggggcattcctgatcaagctgttccagggcgagggctttgacgactacgtgcgcgacatgcgccgccggtacgacaaagtctccatccgcaagccggaagcctcgcgcaagcgctctcccgaggtgtatgccttggttcgaccccaacgcaacgccagcactgagaggaacaccggagccaatgaggatgaacgacttgaccaagaacctcctgctatgggtggtcgtcgccgtcgtgctgatggtggtcttccagagcttctcgcccaagtcctccggggccggggcgcagggcgcgtcgtattcgcagttcctggaccaggtggacagcggcaacgtgcagaag

SEQ ID NO: 74621 - DNA, 300 bp, Glycine max
  Peptide Sequence Number=SeqID_166306
atgcctcaccctatagtggctgaatgcacacaagtcatgacagtggatgaagggtctcatgttcgagccttaactgtctaccaagctagcttgggtggtgaatttgacatagatccgcgatatgacaccttcaatagaggcctgaaacccattgaagatcttgcgcaagacctcttcgctcatgaataccggtgccttgctgacatgctacgcaaaaacattgatctctttgcctcgcaaccatctgaaatgtcaagaatccaccttgacataatcttccaccaactggggatcctctag

SEQ ID NO: 74622 - DNA, 202 bp, Glycine max
  Peptide Sequence Number=SeqID_166307
gcccacttgggccctctggaatattcctccagaaggcggttgcttctggaggaagcaaccctgctcgcctgggcgagctgagctcgcctgggcgagctgccgaggcgcttccgaaacgtttccgtaacgttttccgtgaggaatctcgcaaaggtttcaaccgttcttcgacgttcttcattcgttcttcgatcttcaacgg

SEQ ID NO: 74623 - DNA, 123 bp, Glycine max
  Peptide Sequence Number=SeqID_166308
atgttgaaatctaggttatcaaacacaaaagtcatcaagtctaaagcatgtcttgtagctaaaggctacagtcagaaaaagttgaaaaggtatctcaatgaattaaaacaatctccacgatag

SEQ ID NO: 74624 - DNA, 390 bp, Glycine max
  Peptide Sequence Number=SeqID_166309
atgggtgaagcagaggaggtgcaagagaagatgaaggccgacatggaggccatgaaagagcaaatggccacaatgatggaggccatgatgagcatgaagaagataatggaagccaatgcggttgcaattgccgctaccagtgctgttgctaaggtgaacccgatgcccccatctggcctcaaccaaatgaatcatccaacctcaaatatggtaggcaaagatttgggaagtacaggtggcccccattatgcgcaaattcaaaacgagcgcaccttcccgccatatggattgcctcccaactatacaccacccaatgtggcgtacactcctagtgagaatgtcaataactccactcctatactcattgagagccaacaacctcaaatctga

SEQ ID NO: 74625 - DNA, 267 bp, Glycine max
  Peptide Sequence Number=SeqID_166310
atggcctcctatggtgaagcaaaggaatccattgatgaagaatatcctaggcctacaagctccaatggagcttacatcaggtggtgcgtggttctacagggcaaaacaattggtgttaatgtagaagatgatgattcatacatggacacctacgttagtcctttgtccacacaaatcactcctaacattgtcggagaagaagaagctgacgacgttcatgctaaccgtaatgatcatgatgaaggagaattaattaacatcgtctaa

SEQ ID NO: 74626 - DNA, 213 bp, Glycine max
  Peptide Sequence Number=SeqID_166311
atggagcttggcctcatatacgacacatcaaatggaaatttatccaatgtcgttttgggcatgacgttgagagaacacccattgccaatgagtaccttggccactatgggtaccgagctcgaattcgtaatcatggtcatagctgtttcctgtgtgaaattgttatccgctcacaattccacacaacatacgagccggaagcataaagtgtaa

SEQ ID NO: 74627 - DNA, 234 bp, Glycine max
  Peptide Sequence Number=SeqID_166312
atgaagaacgtcgaagaacggttgaaaccttttgcgaaattcttcacggaaacgtttcggaagcgcctcggcttagattttcttcacggaaacaatttttccaagcaaattcgaaaaagagagaacaaaataggggagatgcttgccgcccagctcgcccaggcgagccaggttgcttcctccagaagcaacagccttctggaggaatcttctggaaggcccaagtgggcctga

SEQ ID NO: 74628 - DNA, 192 bp, Glycine max
  Peptide Sequence Number=SeqID_166313
atgaagggtattgggtttggctccatcttaggaatgatagatttcctactaagagaaaatgtagttgattcagatgatgcggggcctgcagatttgaggaaaaatcctcttcaagagggaggggatgatgtaaccctcccaaggaggggacccatcaccagagccatggctaggagactccaggaagattga

SEQ ID NO: 74629 - DNA, 192 bp, Glycine max
  Peptide Sequence Number=SeqID_166314
atgtcaactgttcagagagagggtgatatctttggatcagacacactggggatgacacttggagaaatagagggtaagatggaaagtgacccgacgtcgcatcacaaacactcggcaatcttcaatggggatgatgccactagggcatatcaaaatagtgacgaggtaaagcccggcatatgcagcaactga

SEQ ID NO: 74630 - DNA, 993 bp, Glycine max
  Peptide Sequence Number=SeqID_166315
actttatcctctcaatcggagaggcctacggggcattacgagagaaaaagctcgccgtgggtcaagaccagagagctacaggtacaccaggggcaacagagcactcaggcggggtcggggcaagggcagcacgtcacggaagttctcagcttaatcttaccagcgctatatcttgggtgcgcgatatggtgggactgtctagcacagacacccccaagcatccctgagttacagcagctggcggaggcaacgcaaatcggggaaccggcaagttcttccgcagaagtaaggcagctagtagaccacctcagtgagcaagccagggaggtggccagtgaagcttcaatggaaagaacacccagagctcttgcaatgtggatggctgggctaacgctagcattcgctatctccatagcgcttgctcaaaagacgagtgaaaatgggaaaagaaaggtggaggttgacctgctttgtgacagatgtggaatggagcctgaatctaccattcatgttttaaagggctgcccctgggcatctggcatttggctactctgcccattagcccttcatactcaacagatgcaggctctcaacttctcagattgggtgaaggagatggggaagtgtcttgatgaagagcagctggaacttatgctagtagttgcatgggctttatggagtgatagaaatttgctgctgttccaggacatacagaactatcctgtggatgtggtgaacaaagcaatcagcttcttcgaagagtataagaaggagaagctaaaaatagtgcaaacacctataggttggcaggccccaccccatggtgtttataagattaatactgatgctgcaatttttaaccagcaagggattggctgcttgcttcatcccgcccttccttccctcacctcacgcaaggctactagagaaggggtgaaaccagccaagggcgggctccaaggcgacaatagcaatcgagtggccaagcgttga

SEQ ID NO: 74631 - DNA, 1146 bp, Glycine max
  Peptide Sequence Number=SeqID_166316
atgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattgcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataa

SEQ ID NO: 74632 - DNA, 1008 bp, Glycine max
  Peptide Sequence Number=SeqID_166317
gacttccagctagtgccgactgtgaaagagtttgaagaaatcctgggatgcctactgggaggaaggaagccatatcttttctctgggttctatccctcctcgacaagagttgccaaggtagtgaaaatctcagcacaagagttggaccgggcgaatgggctttcttttattgacatcttggcgcttttgatctttggagttgtcctctttccgaatatggaagggttagtggacctagtagtgattgacgctttcctcgcctttcagcatggcaaggaaagcccggtcgtcgccattttggccatgtatgacacgttcgaccgaggatgtgaaaagagcggcacaagaattgtttgttgtgcactggctctctatgtgtggctggtttcacacccttttctccaagaaggtaggcccgtctatccgctacaaggtcaccgctcgtgcgtcgaaaaaggaaaggcgaattgggaccaactcttggctagcatagaggggcgtctgttaattggttccctcgctagaaggaaggaagatcaggattctatcttcatgcgaaggatgtccaaatgttcccttgatggaacaaggggttgtattaaatataatcccgtcctcgccataagacagcttggctaccccatgagaggagttccatcagacgaaagcatcacgcctttcatcgcacggggtttcagtgaccacaatgcgagggacagagagcttaggggaagcagtaatgggatcatcggtgactatcataagtggctgagagtccggacacaaggattggattggctcccaaatctaaagactgtgagagacaatgaggttaaagcttcagaagaaagtgatgaggtacaagccttaaaggcaaagcttgaaagagccagggtagtcaaacagaagttcaaggcagcaatagtgagctcaaactccgaagaggtgaaaggaatcatcacgggtcaaaggcatgatctggaaggacgagctaaaggcttgccttag

SEQ ID NO: 74633 - DNA, 168 bp, Glycine max
  Peptide Sequence Number=SeqID_166318
atgggtgccaagttcctcgaagtggtcaaaagagggtcgcatcccaacaacggatggtccccggacgaaattaagctttgtaaatcagttttgaaaagaatgctggctactggtaatcgattgctaccttctggtaatcgattaccagagagtaaaactctttggtaa

SEQ ID NO: 74634 - DNA, 624 bp, Glycine max
  Peptide Sequence Number=SeqID_166319
atgcctactgacattagggaaattgaggctgctctgtgcatacccagccgagggtttattttaaatgctaaaggtcaccctgggaagatcctcaggaaagatctaaccactattgctcaggtctggagtgttctctcatactccaacctggctccaacttcccacacctcgaatttgactgtggatagagctaggttaatctttggcctagttactcagctggacatgaatgtcgaagctctcatctctagacagatcacatcaatggcccagtctaactcctctagactcgggttccccgctcttatcacaattttatgtaggtccagaggagtcgcttccgacagcttggtctttgaatgtttgagcccggtcattaatttggcctacataaggaaaaactattggaacctagatgatccaatagttattattagaggggccagaagaccgagggtaaggctagctgaggctccttctacatcagcaggtcctcatccaacttctacatcagcagcttgtcatccagcttctacatcagcaactcctcctccagctcgtatgatagcagctctttctaccctacctcctacagattttcaacgttttgaagccatgctttaa

SEQ ID NO: 74635 - DNA, 338 bp, Glycine max
  Peptide Sequence Number=SeqID_166320
caaatgagactagtgcacagtctcgacttgaagactctgacatcttcggggaagcgaaagtgactttttctcagtctcggccagaaaatgctgactttttcgggaaaggtgcagaagatgctgacatctacggggaagaagacgttgacatcctgaggaaaggtgaaggtgacgagtctcggccgaaagacgcttacgtctctgggaaaggtgcagcaaatgagactttatcgaagtctcggccggaagacgcaaacatctctgggaaagggaaggtgctaatgatggcgcaagccactgcatgctatcgggctttgagtcttacggatagcaaatga

SEQ ID NO: 74636 - DNA, 420 bp, Glycine max
  Peptide Sequence Number=SeqID_166321
atgagatgtctcatggtggcagatggaaattcacattgcttgagttgggaaaggagaatgcagatagcaatcgatgctgcagaggatgaattgagtactcaagataagaatatggaagagtccattctcaagaaagtttctgaagagtcttcacacctaagaaggaattcaaacaacataagaaacactagcagttctaatgcagcctcacttaataaaaggaatgatcaaacaacagttgacaaagatttgccattattctctcaagaaagaaaacaagggcttagtgtaagtaaagactacatgaaaaaggaacacttaggagttgcaaagagaatgtttgctcgtgctttaggaatgcattctgggaaggatggttctgttcctagaagtagaagtggagaaataaagaagaattag

SEQ ID NO: 74637 - DNA, 351 bp, Glycine max
  Peptide Sequence Number=SeqID_166322
atggaaaacgccagcaacgcggcttttacggttctggcttttgctggcttttgctcacatgttcttctgcgttatcccctgattctgtggataaccgtattaccgcctttgagtgagctgataccgctcgccgcagccgaacgaccgagcgcagcgagtcactggcacgacaggtttcccgactggaaagcgggcagtgagcgcaacgcaattaatgaaacagctatgaccatgattacgaattcgagctcggtacccgcaagccttccgcaaagtgtacgggaagattctagatttgaccgcagcggaggtatttacggaagctgtcgtatccctcgtccaatactatga

SEQ ID NO: 74638 - DNA, 177 bp, Glycine max
  Peptide Sequence Number=SeqID_166323
atgtggtaccatggagaccagtcagggtcacagtgttttgcgagaatgctccaaccatatgggatcaacataggcttaaaggagcactcaaaccgggtgacccccaaggcctacactccgaagagtttgtcagggcctttccctcctgattcaggtccaacccagaaaacattttag

SEQ ID NO: 74639 - DNA, 835 bp, Glycine max
  Peptide Sequence Number=SeqID_166324
gttcctgggacaccctttagtgttggagaagggccaggagtgcgagtatggccaaaggaggaaccaggccgatgggtttgatgaggaggccatcgcccagttgctgtgtataccggggcaggattttgcccggactgctgctaggagacgggtgcggatcatgcgcaccaacatgaccaccctgacccagatatggatgacgttgctgctcagcaacatccagcccagcgatcataattccgacctccccctgccgaagtgtcagctggtgtacgccgtcctgacacgaatgagcattcacgtggctcagttgattgctgatgacatttatctatttgcaggtatggcgccgaccaggcaccctttggacccggataagtccaacagggccctgggatttcccgcattgatcacaggactttgtcattcgttcggagtccccatcgcacctagcaaggtgattcggccacccatcacccgggcttttattgagaagtattgcacgcagaggccggcccagggtgatgcaccacaggccgcaaacgcgccgccacctcatcaggctggcccagctgggtcatttgattcggagcagtatttacggcatttggtttgccagcaggcggccaaccaccgagcgcacagccagggttttacttcttttccatgccctactccggatcagttcagggcagagatcgcatggcccggagattggcttgaggcccaggcaggggaggcacctgcagaggctcccggcgaggcagatgaggcccacgaggacgaggagatgaccgatttgcttgatttcttgggagggagcggagccacatga

SEQ ID NO: 74640 - DNA, 136 bp, Glycine max
  Peptide Sequence Number=SeqID_166325
gtcgactctagaggatcccctccgcaggcaggcgcaaggcgaaacaccacaacagcctgaggatggccggcagcgggcaacagacgcaccgccatcacctctagagttcacctcagctcatccacaaaaaggttag

SEQ ID NO: 74641 - DNA, 567 bp, Glycine max
  Peptide Sequence Number=SeqID_166326
atgacccaagagctggtagcccgcggagacaccttacggttatccgcacctcgtcattcagtgaccccaagtgtgattgacgagcagaggccaatgtggtcatctgcgccctttccggagatgtcagcatcttccgatggagacttttcaagtctcacaagttatctagaactacgtagaggcggcgggcccgatgacacgcggagataccttacggttatccgcacccttgtgtcatccagaggcggcgggcccgatgacacgcggagataccttacggttatccgcacccttttatcatccagaggcggcgggcccgatgacacgcggagataccttacggcggcgggcccgatgacacgcagagacaaaatttggtcattctgcacccttgtgtcatccagaggcggcgggcccgatgacacgcggagataccttacggttatccgcacccttgtgtcatccagaggcggcgggcccgatgacacgcggagataccttacggttatccgcacccttttgtcatccagaggcggcgggcccgatgacatgcagagactgacatag

SEQ ID NO: 74642 - DNA, 315 bp, Glycine max
  Peptide Sequence Number=SeqID_166327
atgtggtcctgggaaagcatactgcatagtgatagtagcggcgggcgaaggtttgatactgagaagaagaatggcaatggcatcattgaaggtaatgtgttaccagtggaattgggatgcttggaatcaatgatgccgtttcatagcgttgtagcttcagctcgattagtgtcaagcttgtctattgagtctctcggttggggattagttcctcaagagttagagctttgttgtgtggaagatttttatagggtataccatatgatcagcacttgggcactggaagtatttatatttgtgatagaatttacttag

SEQ ID NO: 74643 - DNA, 624 bp, Glycine max
  Peptide Sequence Number=SeqID_166328
atggtggtgggggaggtcatggaacttgggacggtagaggaaattttggacgttagtgaggttagttctgagatgggagcgcgatggcgagatcagatctgtgacgatgggtattggggtacattcaccctcctggcggtcatttctaggcggtgtggttgggtattgttggtggttgtgggtaggggtatttgtggaaaatctctccaagtttgggctcacattcgtgatttggctcctttccgcaggcgtttcacttctttacagcgcattactgactctttaattaggggcagattcacatcaggtgttcaaggaaaattacgttgtttagagtctagtctactacatctgcaccactccatcctgacaacaactgcattttcctccttgtcatctgctttttcgaacatcgacgacaacatggctggcaaagcaacatcgtcctttccagcaactgcgagatacgataaaatagagttgtcgacattgctttttggcattaggggtgagaaagggtcgccgatgttgatgatgaggttgaagcagatgaacaactttttgtctttgttcttcgatgacaattccatgactccattaagatgcttggactttgaagattaa

SEQ ID NO: 74644 - DNA, 76 bp, Glycine max
  Peptide Sequence Number=SeqID_166329
atggcccttcatatacaggggcgggtggtgggggcggagaaactgaaggtggagtttcgcacggaggcggtgaatg

SEQ ID NO: 74645 - DNA, 291 bp, Glycine max
  Peptide Sequence Number=SeqID_166330
atggacattgatggaactgctgatgttgatgagaactcaggagcggacaaaaacaagggaaaatgcaaacttaacgtagggtctcagtcactaggataccgcagagactatatggaggtgctgtcaccattgaagaatggagttgttgttgactggaatatttactttgtatgcactattcttccaaaacatgcttcttcattaaaaattatcactagtgggttatggtttcaaggcccttttcgagtaaggaagaactccatagaaaattgggaagaggaagggaaatag

SEQ ID NO: 74646 - DNA, 1518 bp, Glycine max
  Peptide Sequence Number=SeqID_166331
atggccgaagaatttgtgaagggcactgttcatcaaaacggcgtcgctgtcatcaccctcgatcgccccaaagctctcaacgccatgaacctagatatggatgtaaagtataaaagttatcttgatgaatgggaatctgatccaagggtcaaatgcgtactggttgatagtagctcgcctcgtgccttttgcgctgtgctaggtaaggttttgagagtcaccattggtggtcaatgcaggccacatggtatcctcactcctgaaggtgtttgtatggccatggccagaaggccacacaaggtatcctcactcctgaaggtgtgtgaccaatctctctgctcaggtgttggtatggccatgaccagaagatacgcgggctcatacttagcccatgggctcgaaatctaccctaagactcatgagaaccctagggcctacccttggatctctagtccaatctacttggagtcttctacccaatgcccttacgggcttgtttctgtacttaaagcagacttgctaaagcagccttggaatcacaattttgagcgagttcatctgatcctggttgagttcacacaagtttggtctggtgaggtccaagtttccttgggagttattgcatttttggaccttaatcctagacaagtcttcactgctgagtattctttgatatgcaaaatttctgattacaagaagccatacataagcttcatggatggaataactatgggttttggaattggtttatctggtcatggccgctatcgcatcataacagagagaactgttcttgcgatgccagaaaatggaattggtttgttccctgatgtaggttttgctcatatagcggctcaaagtccaggggaaggatccgttggtgcttatcttggattgactggaaagaggatttctactccttcagatgcaatatatcttggccttggaacacactatgtgccatctggaaagttaggttcattcaaggaggccctcttggccacaaacttgtatgatccacatcaggacatcaaagtacttttagcaagatatgagtccaaccctgagtctgaggcacagttgaaattgcttttaccccagatagtttctacatttggaggaaataaatcagtcactgaaatcattgaggagctaaaaaaacaccagtcaagcactgaccctaatgtcgtggagtgggctaatgaagctctccaaggcctcggaaaaggtgctcccttttcccttttcttgacctacaagtacttctctttggttgcctctgcagtggggaataatgacggcgaactatccacgcttagtggcgtaatgaaaactgagtatcgtattgccttgaggtcttcactacgacatgatttttcagaaggtgtccgagcagtgctggtggccaaggatcagaacccaaaatggaaaccatcaagcttggaggaagttgatccgagtgaagtggaagccgtctttaaacctttaggaccagaagttggggagttgagagtgtaa

SEQ ID NO: 74647 - DNA, 1089 bp, Glycine max
  Peptide Sequence Number=SeqID_166332
atgggtccgaaattggcgaaaacagggtctttccgtcacggtttggcggagaagaaggagaagcttctctctgcgtcggcgaagagtagtagtagttattctgagataggtattgacataaccacgcgagaggaagacgaagagcaatcgtggtggaacacgtttaagcgcgtggctgggaaggcattggaaatgggtcgctctgatccaaggaagattatcttctctgcaaaattgggtcttgctttgaccattctctcccttttgattttcctcaaagaacccttcgccgatttgagcagctactgcgtctgggccattctaactgttgtcgtagtctttgaattcaacataggggcaactctgagcaaaggggtaaacggtggaatggggaccatgttggctggaggacttgctgtgggcatggcagagttatcaacattgggtggaaaatgggaggaacttataatcattatgtgcaccttcattgtaggattttgtgccacctatacaaagctataccctactttgaagccttatgagtacgggttccgcatgttcttgatcacctattgtttcatcactgtatccgggtatcaaacaggggaatttgttgatacagctataaatagatttgttctcattgcacttggtgctgctgtatctttgggagtcaatatctgcatatatccaatctgggctggtgaggatctgcatgatcttgtcacaaaaaatttcatgggtgttgcaacatctttggaaggtgttgtcaatcactaccttcattgtgttgaatataagaaggtgccatctaaaattcttacttaccaagctgctgatgacccaatttacagtggctacagatcagctgttgaatctacaagtaaagaagattcattgatgggatttgctgtctgggaaccaccacatggtcattacaaaatgcttaagtatccatggaagaattatgtgaaattaagtggggctctaaggcactgtgcgtttatggtcatggctatgcatgggtgcatactttctgaaatacaggttagtttactccgttcggatcccttaaataaggccttctag

SEQ ID NO: 74648 - DNA, 689 bp, Glycine max
  Peptide Sequence Number=SeqID_166333
atgacgctggggctttctggcgtggcgatcccttttgccgggttggctttcagaccgccctgactgaccagccagtcgaagaaactgcgcagggcagagagccggagcgccaggctcgccgggctgagattttttttacggctacgcacgacgaacccgcgtaccgtggcggcgtcacattgttgccagcttttcaggccgatttcatcggcaatctgcatgatggcatcaagctgacgctgatagttgagcagcgtaatagggctgagctggctccgtccgtcatacgcgctcaatccagcgctccagcagctcaggcagcatcagggcgatctcctgcaacagttgcgtgccctgcccctcaccaccagcagttctggcccgttaagcggccccagatagtggtgctcatggcccagacgctgaatgcgcagcggctcaaacgcctgacggctcagcgccagatggtaaatcccggacggcgcgccaatgcgccagcggtcaggaaagagacggatcgtcgcgcctgccagcccaagctcgcgcgcccagcgatggaaacggctgaggaactcttcgaggctgtgcgccgacgccagacgcgcctgcagatggagcagacggtagaacagactttcgttcgtactcgcctgttccatcagcagcgtcatgtctctcaagctgattga

SEQ ID NO: 74649 - DNA, 207 bp, Glycine max
  Peptide Sequence Number=SeqID_166334
atgaaaggcctttttgttaaaaaatttgaaagcaatgaaatgcttcttagtccaatatgtggaagcaatgctttccaagattatttctatgatgccaaagacttaagtcaaggatcaagagtcaagcaagtttcaagaatcaaagagtcattcaatcaagatcaagatttaagaatcaagagaagactcaatcaagataagtattaa

SEQ ID NO: 74650 - DNA, 703 bp, Glycine max
  Peptide Sequence Number=SeqID_166335
atggctgatgaaccaagaagagttacccttgaagattactctagctcaagtgtgccgcagttctttactagcattgcacggccagaggttcaagcacagaatataacatatccacattcattaattcagttgattcagaacaatttgtttcatggtctgcccaatgaagacctgtatgcatatctagccacttatattgagatttgcaacactgtcagactggctggttgtgttatatgtggtggagaacatgattttggttgctgcattcccacagaagatgcagcacatgaagtgaactacatggggaaccacccaagaccaaactttaatgcaggtgggtattctggatttcaacatggccaacaatttaatcagcaactgggacagtggagaactcaccctagtaatcagtttaataaagaccagggtaggccatctaataggccacaacaacaagggcctaatctctatgacagaacgacgaagctggaagagactcttgctcagttcatgcaagtatccatgtccaatcaaaagagcacagagtcagccatcaagaatctagaagtccaggtgggacaattggcaaaacaactggcagaccgaccgtcaagcagctttggagccaacacagagaagaatccgaaggaggagtgcaaggttgttatgactagaagcaaaatggtgagcatgaatgaag

SEQ ID NO: 74651 - DNA, 192 bp, Glycine max
  Peptide Sequence Number=SeqID_166336
atggagtcgggtggcaggtggagatacctggtggtcatccgcacccttcgtcaaccgaggtttaccctagttgtccggagacgttcaagcccgacgacgcatgagattattctctgttgggtgcgggcgatcaagtttgatagcgtggggaagtgtcatggttgtccaactttatcgctttccagacactga

SEQ ID NO: 74652 - DNA, 204 bp, Glycine max
  Peptide Sequence Number=SeqID_166337
ttgagcttagctcatcagtgggctaagcgtgcatccaccgctaagtacagcttcagcgtgcttagcgcgatagaagaatctgacagggcattaatatcaaggacgcacgctaagcgcgagatcagtgcgctaaacgcaacagttatcttcagccaggctcagcgcataattggaactaagctcaaatccacttactcgcgctga

SEQ ID NO: 74653 - DNA, 246 bp, Glycine max
  Peptide Sequence Number=SeqID_166338
atggaagaggcagagaagaagatcttggaaacatttaggaaagtaaaggtaaacatacctctgttggatgctatcgcaacgtgcccttttgcgggcgagcgaaggcgaggctcacgggtgcgctttccaaaggaggaaagatgcgcggagtcaccaccaacgtttatttgtggaaaacgtcagaaaaaccgacggaaaccggctcaaaatgaaaattctaagttcgggagttgtatttacgcttga

SEQ ID NO: 74654 - DNA, 184 bp, Glycine max
  Peptide Sequence Number=SeqID_166339
tcctttcgttaagcgtaagcctcgtgctaagcgcatctttgttcatgcgctaagccgcgagtctcaagcgcttagcgcccaacccttgaatctgaggctgatttggtgcgctgagctggccaaggctgagctaagccaacttcaatttgatctggatttggctaagcgaaagcctaaccactaa

SEQ ID NO: 74655 - DNA, 191 bp, Glycine max
  Peptide Sequence Number=SeqID_166340
atgagccctgtcgcaacctacccttcggcgggagggcgacgcggggctcacgggtgcatcttccatgggaggaaaatgcgcggagtcaccagcaacgtttattcgaggaaaacgtcagaaaaaccggaaaagacgtggtctacgaacattaagtgtgaaaggttcgggagttgtatttgcgcatggggaag

SEQ ID NO: 74656 - DNA, 705 bp, Glycine max
  Peptide Sequence Number=SeqID_166341
atggccctgaggaaacttgcctcaaagagatccaggaaggataaagcggccgaaggaaccagttccactcccgagtatgacagtcaccgctttaggagcgctgaacaccagcagtgcttcgaggccatcaagggatggtcatttctccgggagcgacgcgtccagctcaggaatgacgagtataccgatttccaggaggagatagttcgccggcagtgggcatcactagttacccccatggccaagtttgatccagacatagtcctcgaattttatgccaatgcttggcctacagaggagggcgtgcgagatatgaggtcttgggtgaggggtcagtggatcccgtttgatgcagatgctatcagccagttcctgggataccctttagtgctggaagagggtcaggagtgcgagtatggccagaggaggaatcggtccgatgggttcgatgaggaggccatcacccatttgctatgtataccggggcaggattttgcccggactgctgccgggagacgggtgtggatcatgcgcacccacatgaccaccctgactcaaatctggatgactttactgctcagcaacatccagcccagcgatcataattccgacctccccctgccgaagtgtcagctggtatggcgcctaccaggcaccctctggacccggataagtccaacagggccctgggatttcccgcattga

SEQ ID NO: 74657 - DNA, 285 bp, Glycine max
  Peptide Sequence Number=SeqID_166342
atgtatctctacttacttcattctaagaatgaagctttagatgcctttaaagtttttaaggctgaagttgagaaacaatgtggaaaacaaattaagattgtgagatcagatagacggaggatggacaagcacggaggatggacaagcaccaggttcatttgcgaaatttcttcaagaacatgggattgttgcccaatacactatgcctggttctccaaatcagaatggtgtcgtagaacgaagaaatcgaaccttattagacatgatgagaagcatgaggagtaa

SEQ ID NO: 74658 - DNA, 639 bp, Glycine max
  Peptide Sequence Number=SeqID_166343
atgcttggggatggaaatgaaggaatgtctacactacctggattgaatcagatacaatttgaagggttttgtaggttcattgatcggggcttaccagaagggctttttaagtttccaaaaattgaggatacagatcaagaaattgaatttcaattatttgtagaaacatatcaattattagaacccttgataaacgaaaaagatgctgtatatgaatcgcttacatattctgctgaattatatgtatctgcgggattaatttggaaaagtagtagggacatacaagaacaaactatttttgttggaaacattcctttaatgaattctctgggaacttctatagtaaatggaatatacagaattgtaatcaatcaaatattgcaaagccctggtatttattaccgttcagaattggaccctagcggaatttcggtctatactggcaccataatatcagactgggggggtagattagaattagagattgatagaaaagcaaggatatgggctcgtggtcaaaagaaaatgccattttggagttttatcgacaatttgcttgtgttggtggagatccagtattttctgaatctttatgtaaagaattacaataaaaattttttcaacaaagatgtgaattag

SEQ ID NO: 74659 - DNA, 729 bp, Glycine max
  Peptide Sequence Number=SeqID_166344
atgtggagcccactgaaagtgaggacacgtagccctctaaaggcgagggcgtgcagccctctgaagttgaggacgtgtcgccctttgaaggcgagggcgtgcaaccctctgaagttgaggacgtgttgccctttgaaggcgagggcgtgcagccctctgaaggtgagggcgtgcaaccctctaaagacaacgccgtgcagccctcttaaggcgagggtgtgcaaccctctgaaggtgaggacgtgcagtcctcagaaggcgaggacgtgtagccctttgatggcgaggatgtgtagtcctctgaaggtgaggacgtgcagtcctctgaaggtgaggacatgcagtcctctaaaggcgagggcgtgtagccctacgatggtgagggcgtgtagccctctaaaggtgagggcgtgtagccctacgatggtgagggcgtgcagccctctaaaggcgagtgggtgtagccctacgattatgagggcgtgcagccctctgagggtgaggtcatgtagccctatgaaggcgaggacgtgtagtcctctaaaggtgagggcgcgtagccctacgatggcgaggacgtgcagtactctgaaggtgagggcgtgcatccctctgaaggtgaggatgtgtggtcatctgaagctaagggcgtgcagcccttatgaaggaacgacgattgactcattgacagggaggaccggtcatccattcaaaaagattggacattag

SEQ ID NO: 74660 - DNA, 321 bp, Glycine max
  Peptide Sequence Number=SeqID_166345
atggatgacgtcgtgtcgttgctacatttgcctatcgtaggggcgttccacagcttcgagcaacttcatgtcgatgacatcgtcgatatgttggtggaattactcgaggtcagcgctgtagagagtgggacttactcttggagcgttgctgcacttgtgcacatgtatgataatttaaatgaggcttcaaagagcacggcgaggcagcttgtaagatatatcactctattacagtattggatctacgagcattttccgtccgttagttcgaccttaactgtcgaggaatatgacgagatgagaccgcgtgcatgccgatag

SEQ ID NO: 74661 - DNA, 357 bp, Glycine max
  misc_feature (273)..(273): n is a, c, g, or t
  Peptide Sequence Number=SeqID_166346
atgtcaaatcataaaagcactgagtcagcattgaaaaaccttaaggtccaggtgggacaactggccaagcagatagctgacaagtcatccaacagttttgtggcgaatacagaaaagaatcccaaggaggaatgcaaagttgtgatgacaaggagtaaaaggtttatggaggcgaaggatgaggatagtgtagtgtacaagaagaaagatgctgaaaagaaaggtgcggaagtaccatatcctgtggtaccttccaagaaggagaaggaccancatttggcgagattcgtagatattttcaggaaactggaaataaccatgcccttcggagaagctttacaggagatgccactctag

SEQ ID NO: 74662 - DNA, 366 bp, Glycine max
  Peptide Sequence Number=SeqID_166347
atgtttatagatgggctgagaccacaaaccaagcaactgctagatgcttcagcagggggaaaaataaagctgaagacccctgaagaggcaactgagctaattgagaatatgtcagccaatgatcatgccattctgcgcgacagagttcatcaacccacaaagaaaagcttgttacaggttgtaccatctgtggtgaggctcatgaaacaggccaatgtattcccattgaagaaaacactcaagaagttcactatatgggaaatccacagagacaaggatatactcaaggaggattttcaggcttccaacagggtcctaataatcaacaaggacagtggaggtcacacctggaaattagttcaataa

SEQ ID NO: 74663 - DNA, 258 bp, Glycine max
  Peptide Sequence Number=SeqID_166348
atggtaatcgattacatgcccatggcttctggaatcgattactaccttatgtgcttagctctactgagctttaaaagattggctaagattttgttaaaacataagcacttagacaatgaaggaaagctggagttgctgcacatgatgtccaacgttatgtcaaggaatgagatcgggctgcacaatgcacaatgcaagataaaagtcaactgcagaagtgaagttgcaggatccacgatgtcggatacaatgtcctga

SEQ ID NO: 74664 - DNA, 129 bp, Glycine max
  Peptide Sequence Number=SeqID_166349
atggataagagcttgaaggtaggagaagatgactggagggagagggggagaaggagcacaaaattttgtggctcgaatgagcccactaatccaagatcaagtccaagattctccactaagtgtacttag

SEQ ID NO: 74665 - DNA, 627 bp, Glycine max
  Peptide Sequence Number=SeqID_166350
atggcgagagtagcaagagtgttcaagatctcagaacgagaattagatcaattgaagcaaagtaggaatggagtagcaggaataccgaggaagtgcttggaagagaaggtggaaactctggcaagccaaggagagtgggtatcattcatggacgtattagcactgctagtgtataggacggtactatttccgaatatggacggacttgtagatctagcagggatcgatgtctttcttgcttatcaccacagcaaggaaagccaatatgtctgtcccctacaaggtcatcgcatgtactcgagaaaggataaagcaaattgggaagaggtgatagagttattgcataaagaaggcatgaaatggatggataggttttctctcactctgaatgaaagtcaagagcttccaaagttgttagccagagccaagacaatggctgacacatactccgctcccgatgaagttcatagtcttttcaattactaccaacacatggtcgaattaatgacccacataattacaagtttcaagaatcaagattcaagaacaatcaatatcaagattcaagaatcaagagaagacttaatcaagataagtactaaaaaagtttttcaaaacattgagtag

SEQ ID NO: 74666 - DNA, 257 bp, Glycine max
  Peptide Sequence Number=SeqID_166351
atggaaacatgttcggcagtaagagatctattacaatggatgatagaccaaggccggcttaaggtcggcagtgagaggaaggaggaacaacatgtatacatgcagtcggcagatgaagaaggacctaaaaagcctaaacccttggtaatacacttcactaggaacacggctccccaaagacctcaacacccctcggtagtgtcgggcggtagatctattttgtttccttacgagaacagccgcacagttccgtggag

SEQ ID NO: 74667 - DNA, 992 bp, Glycine max
  Peptide Sequence Number=SeqID_166352
atgctttcttttgaattgggacttctttggccacagttcatgaaacacgccggccccatcttcggaatgcctttttctcttgaaggaacagcattttttatcgaagcaattgctatcggtttttttctttacggatgggataagttcaacaaatggtttcactggttctgtggatttttagtcggactcagtggattggcttccggcatccttgtcgttgcagccaatgcgtggatgaactctcccgcaggctttgattatatcaacggacaatatgtaaatatagatcctatcaaagcgatgtttaatgaagcctggtttccacaggcattgcatatgacggtagctgcattttgtgcaaccggttttgccgttgcaggagttcatgcttttttaattatgcgaaaaagaaatgtggaatttcacaccaaagcatttagaattgccgcaggttttgccctcataggagctttcggagctcccttaagtggtgatatcgctgccaaatcggttgcagaaagacagcctataaaattagctgcaatggaagctcattttaaaacagaaaagggagcctcttttgtgatcggaggaattccggatgaaaagaaaggcgaaatcaaatatgcattaaaaatccctaaattattaagttttctcgtcagtaatgattttaatgctgaagtaaagggattgaatgatttcagcagagatgaatggcctcctgttgccgttgtccactactctttccagatcatgatcttctttggtgtcataatgatctgcataggttctctatatgtctattcgctattctttaaaaaagaatggctgagcaagaactggctgctgaaaacatttctgatcgccactccttttggatatatagcattggaagcaggctggactgtaacagaagtaggccgccagccctggataatttatggtattatgcggactgtagatgctgtaacgcctatgccgggcatcca

SEQ ID NO: 74668 - DNA, 276 bp, Glycine max
  Peptide Sequence Number=SeqID_166353
atgccattgaggcatttcaccgagcacttggtgggcgcacttttgggtacaaacagcaaggtgatgggggcaatgtggcttgcccccatcatttcagaacataacctaggcctaaggccatcccctacaacccctcaattcaatgaatcaaagcacaaatttaccccaaattgtctcacgaaattggtcaaatcatgtaggaatttaaaggatactaggctgcctcccagtagcgcttctcgcttgtctggagctggacgtgggatgacgatctaa

SEQ ID NO: 74669 - DNA, 207 bp, Glycine max
  Peptide Sequence Number=SeqID_166354
atgcagagccttcatggcttgggcttgccatccattatgagcatggatgagttttatgcgcaggtggcttggctaggagcccagccttctccttctggagggggtggggcctccgcagcccaggagcctgttcctgaggagccagtagcagcagcagagggggaagatgagctcacccctcaagaggaggagacttctatagactag

SEQ ID NO: 74670 - DNA, 420 bp, Glycine max
  Peptide Sequence Number=SeqID_166355
atgaagaagaagctggaggaagctgcacaatcaggaagcattgatggtgtcatcaaccctccatcctcggttagacgccacgtgaagtggaatatggcccgcacgaagaaaacatgggagatgacgactgaggccgcaaaggaaatcgctgagaagattggatccttcgtcccccatggacgtcaggatgttatcgccgctgctattggacgtccagagcaccttggacgtgtccgtgctgctggagccggtgtcaccatcaagcaatactttggatcggctccatggacgtcccgcaacgcttcctccttgccttttgaaaaattgcagcagttgacccagcaaatcagggaccagctaaaggagtccatcacagagaaagtgacgaggcaggtcatggcatccttcagccacatgtag

SEQ ID NO: 74671 - DNA, 537 bp, Glycine max
  Peptide Sequence Number=SeqID_166356
atggcaaaatacactgtgtctactgtcacgtgtctcgccccctctgaaaatcgtcagtcaaactggctacatccagtgcatgactatatcgccagcacaagcaacgagaccacgggctattccgtcagtggcagtggtgttttcgccacgtgttgcatgcagaggcttctcacctataacactagcggtttgcatgtgtatgatgtcaccccatttttggatgatcatccaggaggtgatgaagttttagtgactgcaacagagaaggatgccaccactgattttgaagatattgggcacagtgattcagcaacagagatgatggaaaaatactttgttggtgaggttgacaccaacactcttccagcacaagttaccagcagcagcagtgtacgcccaccaacacaagcacctgtctataacaatcaatcttctggatttgttgtgaagatcttgcagtacatagtgccattgctgatattggcctttgcatttggcctgcagtactatggcaaaaaaagcaagtcagaaaattga

SEQ ID NO: 74672 - DNA, 537 bp, Glycine max
  Peptide Sequence Number=SeqID_166357
atggcgcttgctttggttgttcatctcgtcggcgatggtgtcgatgtggcggaggtactggcggaggatgcggcgtttatcagtttttctgatttggagaacgaaggaggaaatccggttcggttcggttttttggttgaaccaatagagtctggccccgaggaagcggtcctcgatggtttggttcgggtcgaggcgcaaaacgatgtcgctttggttattcggctgcatattggtttcgttaaattcggggactttgaggaactggtacacgtggaaccaatccacgacccttgggaagcgtattcttatggtgtgtatcaatcccgttttgaacaggaaccaccgaatcgtgaaacctacgacgacactgaggattacgaggaacatagggctgtaaccagacatgatggaagattcctccaagacccaatttgtgtgtctagtgtttcacgactctctccttcttcgtctttgtttgcagctacgtctgtgttctgttcaattcaacgtctacgtgtttattattctccttga

SEQ ID NO: 74673 - DNA, 1908 bp, Glycine max
  Peptide Sequence Number=SeqID_166358
atggggaagaagggaagtggtagttcatggttaactgctgtcaaaagggcattcagatctcccaccaaagacagtgacaaaaggagtggcagaagaagagaagactgtgatcaagaagaagacgaagaaaagaagagggaaaagagaagatggattttcaggaagactcacatgagtcatgaaggagggaacaacaacaacaacactcaacaaaagttgaagcatgatgtggcagcaagtggtggtggttcaaggacagaccaggatcagaagcatgcagttgcggtggcggtggccaccgcagaagccgccatggccaccgctcaggcggcggtggaggtggcaaggttgtccaaacctgctagccatgccagggagcattatgctgctgttgtgatccaaactgcttttagagggtatcttgctagaagagcacttcgtgcactaaagggtttggtgaagttgcaagctttggttaggggtcacaatgttaggaagcaggcaaagatgacccttaggtgcatgcaggctttggttagagttcaagcaagggttcttgaccaacgcataaggtcttcacttgaaggtagtagaaaatccactttcagtgacactgctagtgtttgggactcgcggtatcttcaggacatttcagataggaaatcaatatcaagagagggaagcagcattacagatgactgggatgaaaggcatcacacagttgaagaagtgaaggccatgttgatgcagaggaaggaagctgctgcaatgaagagggacaagaccttatcccaagccttttcccaacagatttggaggaatggtaggacatcatcaattggaaatgaagatgagttggaagagagaccaaaatggctagatcggtggatggccacaaagccatgggagaatagaggaagggcttcaactgatcaaagagaccacattaagactgtggaaattgacacatctcagccttattcatatctaggaaccaattacagaagatcacatccaaattatcaatacaacccaaaccatcaccaaccacaaaggcattccattgcttccccactccatagatctcaccaaaatggatcctcccttcaccagtcccctgccaccccttctcctgccaaatcgaggcccatccaagtccggtccgcgagtccacgttgcattagagacgacagaagctaccacacctcccaaacaccaagcttgaggtctaattaccactacgcaggaaatttgtaccaaaatgggagggttgttggaactggaactagtaatggtggtgctactgctacattgcctaattacatggcggcaaccgagtctgcaaaggctcgaattcggtcacaaagcgcgccaaggcagaggccatccacaccagagagggacagggttggatcagccaagaaaaggctttcttttccagctcctgacccttatggtgtgggagtgagttatggaaactatggacatagtttaaggagtccaagcttcaagagtgtgagtggatcacactttggggggttagaacaacaatcaaattactcttcttgctgcactgagagtattggtgggggtcaggtttctccttcttcaacagatgccaagataaaaagtgagccctatgtggtggcctacctcacttgggatgttgtgttgatgttgaaagaattgccaagaccatctgaaatagcttttaatggactgtcctgtcacaataacatttttaaaccacggtatctttttttcccaaactcttcttctagacttgtaagagcatctctagcagtttataatggactccagctggacaaccttttcttcactgaaactcataatcagaggtatcttggaattatgagctgtttggggtcccatcctactgaacactag

SEQ ID NO: 74674 - DNA, 156 bp, Glycine max
  Peptide Sequence Number=SeqID_166359
atgacatggcactattacgagggtgaaggagatgaagtggtgaagatgaagctgtgggatcaatgtgtagatatcataaaggatgacgtgcaagaagccatgcatagtgctgttgcactgcaagagtcacagagattgagggagtgcaatccgtag

SEQ ID NO: 74675 - DNA, 309 bp, Glycine max
  Peptide Sequence Number=SeqID_166360
atgggcttccgtaaggcttccgtaaattatgaaagaaggggtgaacttatcgaaattggggggggtgcaaatagcaattttcaaattttgatttgggccttccagactgtttttcggagctgggttgcttccggaagcaacccagctcaccttggcgagctaggcggcaacctcctccccctttttcctataaataggctgaagggtgctgttcttaggatccctgatccccctaatgatgtatttcagctgttttgggtgaaaaaagttttttccgtgaagaaaatccaagccgagatgcttccgtaa

SEQ ID NO: 74676 - DNA, 1081 bp, Glycine max
  Peptide Sequence Number=SeqID_166361
ggacgatgagtataccgatttccaggaggagatagttcgccggcggtgggcatcactagttacccccatggccaagttcgacctagacatagtcctcgaattttatgccaatgcttggcttacggaggagggcgtgcgagatatgagatcctgggtgaggggtcagtggatctcgttcgatgcggatgctatcagccagttcctgggatatcctttagtgctggaagagggccaggagtgcgagtatggccagaggaggaaccagtccgatggttttgatgaggaggccatcgcccagttgttgtgtataccggggcaggattttgcccgaactgctgcagggaggcgagtgcggatcatgcgcaccaacatgaccaccctgacccagatatggatgacgttgctgctcagcaacatcctgccaagcgatcataattccgacctccctctgccgaagtgtcagctggtgtacgccatcctggcacggatgagttttcatgtggttcagttgatcgctgatgccatctatctatttgcaggtatggcgccgaccaggcaccctttggacccagataagtccaacagggccctgggttttcccgcactgatcacaggactctgccagtcgttcggcgttcccgttgcacctaccaaggtgattcggctgcccatcacccgagcttttattgagaagtactgcacccagagacaggctcagggtgatgctccacaggccgcaggcgcgccaccaccacctcatcaggctggcccagctgggtcgtttgacatggagcagtatttacggcatgtggttcgccaggaggcggccaaccacagggcccatgtgcggaccaatgagaccctttaccagctgagcctcagcatgcagagccagggcttcacttctttttcatgccctactccagaccagttcagggcagaggtcgcgtggcccggggattggcccgaggcccaagcaggagaggcacccccagaggctcccgacgatggagaggaggcccacgaggacgaggagatggccgatttgcttgacttcttgggagggagtggagctacatga

SEQ ID NO: 74677 - DNA, 131 bp, Glycine max
  Peptide Sequence Number=SeqID_166362
atggaggaatgccaccacatcgtccagggtgatcgtcaactcttctactggaaggtggaaggtgctggatgtcacgacatcacgcttcagaacatgcagcttgtatatgaccgtatgaacagattaaacaa

SEQ ID NO: 74678 - DNA, 436 bp, Glycine max
  Peptide Sequence Number=SeqID_166363
atggctatcttaacccgtgaagaaattgaacagatgggatttgcctccgttggaaataatgtttttatctcaacgaaagcgtctttctatggtacatcaaaaatccatatcgggaacaatgttcggatagatgatttctgcgtcatttctgcaggtgaggggggcgtgtatatcgggaattatattcatatcgccgtgtattcttctctgattggctcaggccgaatcacattgatggactattcaaatatttcttcgcgggtttcgatttattcaagtaatgatgactactcaggtaattatatgagtaacccgatggtgccgtcagattttacaaacgttactcatgatgcggttgttgtgggtaaacatgtgatcgtcggtagcgggagtatcgttttacctggtgtgattctcgatgagggttgtgcaattg

SEQ ID NO: 74679 - DNA, 387 bp, Glycine max
  Peptide Sequence Number=SeqID_166364
atgtaccttctcttgttctcagtcacaacaacccaagtagatgtaccctctacttgtaccacaaaggatgtaccttccaatgtgttaagaaaaagttctcaggcacaaagggagaagagaatgaaaaagatgaagagcacacttttgttttctgtgaaagaacaaagtttggaaaccagaaaactcagaaagcttttggcaaaggaagaagaagaagatgttcaaagagattcaaagaaaaaccattggaagagttatgaccttgagaaaaacctgaaaaccattggaagagctacatctcttgatttttattcagaacttgtcactggtaatcgattaccaaaaccatgtaatcgattacacaaagcattttatgaaaagctgtga

SEQ ID NO: 74680 - DNA, 360 bp, Glycine max
  Peptide Sequence Number=SeqID_166365
agggtgttgggagacctcgaaggcaatgagaggtgtcgattccgtggcacgattcgactcactgctacttcattagtacatccggaggaacccgcacgcacgcttcagcagtctgtggagtggatactagtggagccagttcaagtgatagaggtgtcatcctctgaagaggatcttgaagaggacccagaggagttacctcctgaacctactgtggatgatcttgacttacctgaggatgatgaagacccactccctgatgttgattttccagaggatatcatgttagcatctgaggcagactctacagaggagagtggccctggagggacaacgaatagtgacaactcttcatcgtag

SEQ ID NO: 74681 - DNA, 330 bp, Glycine max
  Peptide Sequence Number=SeqID_166366
atgggttctccacctgcctccactactcctcctcctccttctcctccttctcctcctcctcctcttcctacttcgaacgcattggcttcgacgtctgccgtgaagtggacacgcaaagcctcacgcctacgatcgttgtccactagaccacctagtgttgagagaccagtggtgcatgttgatcctgctacagggaaggccgacggtccccacaagaagaaattaagaacatatttggggattgtggcacgtgataaggtggacatcacctacgagaactggaaggaggtccctactgctcagaaggacctgatttgggaggatattcag

SEQ ID NO: 74682 - DNA, 765 bp, Glycine max
  Peptide Sequence Number=SeqID_166367
atgtcattgaatcctaagcttcattgtcctggggatgcttttttcaaaagaaatgaaggcacatgtaatggtggtattcttccacattattggggattcagagttgaatcacgaggaacaccgtcaaacattcttgatccttttgctatagaacaaggtaatccaacaaaaattaaaaagggatatgaagagaaatggttgttcaacatcatggtcattgatacacgtggtgcacaagataagaaatgttgcattgaatgtagatgtgaccatatgaatctcccaaaggacttttataatgtcacaagggatatacataaccagccattgactacaaattacaaaggaggttttcaaggttcaagaagaatggtttccttaagatacaaaattagttgggttgattggaacaaacaccaagtaccagttaaagtttacatacttgattccaccaatagaattagatcaaatggttccaaaataattcatgattgccaggcagaatataccattctagaaaatggtgatggtgattctcctcatgtccaaaaggcaaacatcccagtagaaaaaggaggttatctcatttatggcactgctcatattcattcaggcattgtaaatgtaactttatatggacaggatgggaggacattgtgtacttcaacaccaaaatatggaacaggaaatgaggcaggaaatgagaaaggttatctcattggtgttagacaagtggcctcagatatcttaagaagggggggttga

SEQ ID NO: 74683 - DNA, 336 bp, Glycine max
  Peptide Sequence Number=SeqID_166368
atggtcacagctcgaccggagagggtggtacggaagtttggttacattcagagcattcctccggcgcctgttagtgctcgattgtcacatgatgatatagatgacaggtggatgcattttgcggagcacgtattgtctgtgggtgagctttgtctagtgtctgggcaggtatctgcggattacatggagtggtttttccgcatatctcacccattcatgatatcgacccaggcaggtgaccagcccagagatgcaccagccgcagaccctgaggagtacatacaaccgcccagcccccaggttccagtggcatttgacccccctccacatgcagtg

SEQ ID NO: 74684 - DNA, 348 bp, Glycine max
  Peptide Sequence Number=SeqID_166369
atgcgtgttgcggttgctgcagtggtgcgagcgggcacccgtaactgggcccggtgggcttcgagtggggcgtcgagcccaagcctttcgatatggcggcggaagaaggagatggggaaggaagggctggtggtggccaaagagctgaagaggttccggtcggacccggtccggctagaccgcttcatccggtccagcgtctcccgcttgctcaagtccgacctcgtcgccgtcctggccgagttccagagacagaatcaattcttcctctgcgtcaaggttccttcttttgataataaaacatctcattattttaacctatcgtccaatttgaacaaattatactag

SEQ ID NO: 74685 - DNA, 216 bp, Glycine max
  Peptide Sequence Number=SeqID_166370
atgccagaatgtgcacaaatgccccgagaagctgctcaaagagtccagaaggacaaggcggccgaaggaactagtccgctcctgagtatgacaatcaccgctttaggagtgttgtacaccagcagcgcttcgaggccatcaagggatggtcgtttctccgggagcgacgcgtccagctcagggacgacgagtatactgatttccaggaggaaatag

SEQ ID NO: 74686 - DNA, 156 bp, Glycine max
  Peptide Sequence Number=SeqID_166371
atggctggtacattcttccttttgaaacagcaaaataatttagagaattatgagcgctggattgcttctggaggaagcaacccagctcgcctgggcgaggtgagctcgcctgggcgagctgggcggcaacctcctccccctttttcctataaatag

SEQ ID NO: 74687 - DNA, 273 bp, Glycine max
  Peptide Sequence Number=SeqID_166372
atgaaagttctgatgaccaatacatcaacaccctatcatagaggaggtatgatgaatgcaccaaggcatgttcatgctatgcgtgacaaatgcgtttatctacgaatacaagagctcgaaagaccatctcttcttacccacaatgcattgggtatcatggttcatttacagtcattaccacggtgcccaatgcatgcaattaagaaggcgatgcagactttttggcttctcgtgaagaagatgacgaaaacaaatgcaaggcatgagcaatga

SEQ ID NO: 74688 - DNA, 240 bp, Glycine max
  Peptide Sequence Number=SeqID_166373
atgaattcggttataacagtgttgtatttcaatggaagggtatatgaagataatgatgatgtaatatttgaagacagtaaaaaagcgattcagattaaacgtggaattagtttcaatgctttcaagtataaaattggagacaagtgtcatgaaaatatattgccttgcaaatttgcgatgacgaagacgttgaaacgatgctggaaagttttaaactactacaagaaatgtcagttctag

SEQ ID NO: 74689 - DNA, 195 bp, Glycine max
  Peptide Sequence Number=SeqID_166374
atgaatatcgaggaatccattcatgttacctttgatgactctaatgctatcttgtcaagaaagaatatgctagatgatattgcagattctttagaacatatgaatattcatgaacaagattccaaagtgtcataccctaatttcgtccggggacctttgcttgatgacatgcgacctttctttggtccttgtgag

SEQ ID NO: 74690 - DNA, 165 bp, Glycine max
  Peptide Sequence Number=SeqID_166375
atggataagagcttgaagaaaggagaagatgcatggagggagagggagagaaggagcacggaatattgtgcctcaaatgagctatggttcaacccactaatccaagatcaagtccaagattctccactaagtgtgcttaggtgtcatgaggcatgtaaaacatga

SEQ ID NO: 74691 - DNA, 133 bp, Glycine max
  Peptide Sequence Number=SeqID_166376
atggcaacccatgtggacggaagaaaagctgagaagaagatggaggaacataaacaacaattggctgatgaactggcgctggaaccgattgatgatttagttgaacttgaagaaattgttgaggaagcagaag

SEQ ID NO: 74692 - DNA, 327 bp, Glycine max
  Peptide Sequence Number=SeqID_166377
atggtgcaaaagaaggacaaagaactcagaggcagtaacaacgggcccatcggcggctaccgtaagtggttgaaagcccacatgcaaggggaggaagttgaggcaccagaggaagacgaagaggtgcaggcccttagggcagaactcgagcaagcccaaacagtaaaagaaaggtttaaatcagcagctctcaagatccgaaagaagaatgccggactgagagatgcaaatatagctaccaccaaggccttggaacaagagaccaaaagggctcgtagggaagaacatggccggaacaaattccgaggggctctgtgggggcagtaa

SEQ ID NO: 74693 - DNA, 333 bp, Glycine max
  Peptide Sequence Number=SeqID_166378
atgccctctcggtttccaactaggaaattggcgggtggaggaacgcccagacgtttacgcgacaagcataatgtaaccatttgtagctttaaaactctacgatccgacgatgagtcccgtgaaggtactaataccggggacccgaccgtcgatttcgagcaagaagcaagtcagacggagaatgaagaggacgaggatgtaggccttcccccagagctagagaggataaccgctcaggaggaccgagagatgaggccacatcaagaagagacagaactcgtagacttaggaaccggcagtgggaaaaaggaagtaaaagtaggcacgggatga

SEQ ID NO: 74694 - DNA, 153 bp, Glycine max
  Peptide Sequence Number=SeqID_166379
atgaaaactagtctgttgttggagttagagctagaagatggaaatgctggttatggagaagggtttcactatgcacttctgctattggtcttcccatctcaaagcagtcttctagaagtagggagtgttcatgaatgtaacagtttaaactag

SEQ ID NO: 74695 - DNA, 567 bp, Glycine max
  Peptide Sequence Number=SeqID_166380
atggctctggtgatgggtcccctccttgagaggattacatcagaaatgcctcatgctcctagccatagatttattctgattagaaggtgggaagaggtttcggtcggtaatgggtcagaagtttgcgggtatgatgaagaggtcatggtggggtctttcggttccaactcattgggattggattcttccaccttagtaggtgaatcttccaccaaaagggagtcgagtgacttctcgacatttataaaccaactaccagaaagagtgggcgagaacattacgactctggttgcagttgttgctgcccaattgaggcctttaacggaagttagatctcaacctaaggagcaccttgcgttgaaggaggcaagtgtgcctctccctatcatgcttcttaggtacacatgggttgatggtgaggaaaatgaggagaggaggttgcacagcagctcgcccaggcgagctgcttacttcctccagaagcaacctaggtcgcccaagcgagctggttgcttcatccctaagctttctagtgggcccaagggctggaaaatgtccccaaagtga

SEQ ID NO: 74696 - DNA, 780 bp, Glycine max
  Peptide Sequence Number=SeqID_166381
atggggatacaaaagaattctcaggcgggagaagggagacacaaaagaattcaggcggttagtccttcattcttttggaaaagggagaagagagacacaaaaagaattcaggcgggcaaggatgacaaagtatgtcaaaagtacagcataagaaaagagaaatggaaccagttttgtcaaaactgtagagacccttcatgggaggatgttcgaaagaaggcgcaggccattcagaaacaaaaccctgctcctcacgtgttgtctcgtaggggttatgattttttagaacaaaagcaaaagaaacgattagaggtagcaacccaatccaggagtactgacacagtcgttgatcctccatctcccattagacgacatgatgtattgactgctgccattgggcgaccaaagcaccctagtcgtgtccatgctcctagagccggtgcactcgcactagctcctaacattgaggttcatccttttgttgcttgtgttagcaaaaaggaaagttgtgtcgatccctcggggcagaacccaaaaatggtccacaatgttcctttgagcaatgatcaagtgaaggtcggtgttgaggaagataaacaggaagctgagggactgacgaaacctgtagatatgttggatcctgacgtcgatcccatgtacctgatgacattgaccatcctgcagcttttcctcaagtcgttgcaggtgctgtgggacactaccgtgtttgggcttgcttgtggagcttctatggaggctggatctttgagcttcaatgag

SEQ ID NO: 74697 - DNA, 387 bp, Glycine max
  Peptide Sequence Number=SeqID_166382
atggctacaccacccagctctcatcctccccttcctcctcttgagttagtagcaccttcaccatctacatcaaagaagacaagaaaatcaacacaactcagaccgttggctactagactagttggggaggagaaaccaatggtccatgtcgatcatgtcactgggaaagctaatggtccccacagaaagaaattaagaatgtatttggtgattgtcactcgcgataagggtaggttgcgacagttggcgactccactggggattgtttttagagagttaggccttctcggcgaagcagaggaagcccacacggatgaggatatgaccgacctgctcggttacctgggagagggcggagccacacgatcaaggtcaccgcacttgtga

SEQ ID NO: 74698 - DNA, 288 bp, Glycine max
  Peptide Sequence Number=SeqID_166383
atgaagaggaaggaaatgtctaatatgtctaatccttgggtccatcaggaatcttctggaggaagcaacagctcgcatgggcgagcatgttgcttcaagcttaagccaccagctcgcctaagcgagctgggcggcaagctcctcctccattttccctataaaatggcattggaggctgaggggaaagggtttagcccctttggcaatcagatttcacttaaaattagtgaggagaagaagaaagaaggagaaaatccaagtcgaggtgcttccgtaatgcttctatga

SEQ ID NO: 74699 - DNA, 300 bp, Glycine max
  Peptide Sequence Number=SeqID_166384
atgggtggccttgctggtgcttgcacgcttagcgcaactctatctcgcttagcgcacattagtgaatttcggcttagtgcacgtctttttgctcagcggatggactcaaacggttaccttagcgggatgatccctcgctcagtgaacatgtacaactcatccttcctcacgctcagccaaaggagtggtgccctcagcggatggctcgctaagccggcagattggctaagcgagcagatcaaaatcagcacttcacaaacttgcctaattaacctgaaattgagagcaaatgattattaa

SEQ ID NO: 74700 - DNA, 216 bp, Glycine max
  Peptide Sequence Number=SeqID_166385
atggcccaaaaatacatcatgaagcatagccaacaaaacatgttatccaacaaaacccctcacatttattcccaaaacaattccaaagctccaaaattccttaaggttaaggaagcatcagcaagaatcaagccaaggctattgtgcaaggaatcaatggggaaaaacacaccaaaagattatgatgatggatggctcaaattctcacaaaggtaa

SEQ ID NO: 74701 - DNA, 192 bp, Glycine max
  Peptide Sequence Number=SeqID_166386
atgcattggatctggaacatcataaccaacgacataaagagtgactggtccatgccctttgatgatgattatcgtagccatcatgggtgccttcatcctttcagaaaaaatatatcttggaggctgatttcaggggtcattagagctattctcatagtaatgggacttcactctttcaggttgaagctgtag

SEQ ID NO: 74702 - DNA, 225 bp, Glycine max
  Peptide Sequence Number=SeqID_166387
atgtcaatccctaccctcggaagaaaaagagtgggagaaagcaagaaaagaaaagaaggaaaattcccaaatcaaagagtgggagaaagcaaaaaaaagaaaagaatgaaaattcctaaatcaaagagtgggaggaagaaaaggaaggaaagaaaattcccgatcaaggatcgaaggaaaacagaggaaaggtgcagaaaggtcgttggaccagatgatatctga

SEQ ID NO: 74703 - DNA, 333 bp, Glycine max
  Peptide Sequence Number=SeqID_166388
atgtcacttgagcaaacaaaccaatggcttgcacccacattccagtggaagcaaagatgtaattgcgaggggatgagggagaaagaggattcaacaagcgattctcctcaaatttcagccagctcgcatcaattagatcttgcaccttatgcttcagggccctacaatgctcaatggaatgccccagggcttctccatgataagcacacgttgtgttcgagttgtatcctcagagtaatggaggttgagaaaccttggttggggttatggctaccattgaattatcgagtagatatgggagcaagtcagcataggacactgaaattagggtga

SEQ ID NO: 74704 - DNA, 774 bp, Glycine max
  Peptide Sequence Number=SeqID_166389
atggctacaccacccagctttcctcctcctcctcctcctcctactgagagaccgctgatccatgtcgatcctgcaactaggaaagccgatggtccccacaaaaagaagttaagaacatatttggggatcataacgcgtgataaggttgaatttgatatccctgaagcatgtgatctgaggacaaaaaagaaaatacttcagattgtgagagagcggtggagacaatttaagtctgatttgacattgaaatgggcacttgtagctgacaaggaaagtgtcaacgacactgtatgcgaaaagtacgacattagcaaggagaagtgggcccaattttttcaaacccacaaagacccttcgtgggaggatgtacgaaagaaggcacaggccatccagaaacaaaacactacccctcacgtgttgtctcgtgggggttatgaatatttagaaaacaacactgacaccgtgattgatcctccatctccaatcagacgacacatgaagtggaagatggcccataccaagaaaactgggcaaatgacgtctgaggcagtaaaggaaattgttgagaagattgattcattggaggggcaggcctcacagggttcctttgtcgcccatggacgtcaagatgtactgactgctgccattgggcgaccagaacaccctggttgtgtgcgtgctactggagccggtgtcacgatcaagcaatattttggaccagctccaaggacctccctcacatcttcctccatggctcctgaagacctggagtag

SEQ ID NO: 74705 - DNA, 980 bp, Glycine max
  Peptide Sequence Number=SeqID_166390
agtttgatgagttcaaggaggaactcgagagacgccattgggacgaggatttgactgactttctggatggcaacattcatgttgccattgtaaaagaattctatgcaaacctctatgaccccgatgacaaatcacctaagcaggtcagggtgagaggtcatctgattaagtttgatgaggatactcttaacacattcttgaagactcctatagtgttggaagagggggagaacttgtgcacatactctagatttgcactcctgaggcctgatcctcaggagttagctgctaagctttgtatcccagggaggggattcgagcttaatgttgatgggcggcctttgaagattctgaggaaaaacatgaccactcttgctcagacttggagcattctttccttttctaacctcatccccacttcccacacttttgatgtaactcttgacagagccaaacttatttatggcatcatcatgaagatggacataaatatggggtccttagagagcctgagtcctgccattaatttggcatatattaagaagaactgttggaatcttgatgatccaacagtaactttcagaggacccaagaaggccaggggtaagagatctgaggccccttctacttcagcaccatcagaagcaccaacaccctcttcttctccagtaccccccttttcatccactcagattctagttattcctccagcacctctacatatgccattcccagctcctttatctgcagagccttcagggcttgggcttgccctccattatgagcatggaggagagcctatgactgaggagccaccagcaccagcaccagtaccagtagcaacagaggaggagactactctagaccagacccaaccatcttcaccagttgcgaagcctgagcagcttatacaggattcaacagtaactccagcactagatcttaatgaagaccagccacatgaggagcaggatgtttaa

SEQ ID NO: 74706 - DNA, 237 bp, Glycine max
  Peptide Sequence Number=SeqID_166391
atggcattagaggtcatggcagctcacccaggtgagttgttgcttcaacctgaagtaaccttgctcgcccaagcgagctgcgatcttgctgtggaagcaatgccttccaagattgttttgatgatgccaaagaatcaagagtcaaacaagtttcaagaatcaagatcaagattcaagattcaagtaaagaatcaagactcaagattcaagaatcaagagaagactcaatcaagatga

SEQ ID NO: 74707 - DNA, 276 bp, Glycine max
  Peptide Sequence Number=SeqID_166392
atgacccctactcatgatgcctgccaaaatgagtttgttggttactcgttcacagaaaaaaatctcaaaaagtttgacattccttccggatgtaccatggatgaactaaaggatttgatcaagcaagttgcgcctcatgggattctcccttatggtattcatgaaacacatacgcttatggatcatctacgtcaactacggatcaaatatagcttctgcgggtcaacaaaaacctatgtgaatcatgccatagcatacgcggatcaagctgaatga

SEQ ID NO: 74708 - DNA, 639 bp, Glycine max
  Peptide Sequence Number=SeqID_166393
atggaagcatcggagatttgttccgtcaaagtcgctcttcatattcgtcctctcattgccgatgaacgacaacaaggttgcattgaatgtgtttccgttacgccttcgaagcctcaggttcaaattgggtcgcatgcctttacatttgattatgtttatggtaatggtggatctccttcagttgacatgtttgaggaatgcgttgctccattggttgaaggcttattccaaggatacaacgctacagtacttgcctatggtcagacaggatctgggaaaacatataccatgggaactggctataatgacaattgtcggagcggattaattcctcaggttatgaatgcctttttcaacaagattgaaacactaaagcatcaaacggaatttcagttgcgagtctccttcgttgagattttgaaggaagaagtgagggacttgttggatatggtatccatgggcaaaccagaaacctctaactctaatggccattctggaaaagtaactgttcctgggaagtcaccaattcaaattcgtgaaacatcaaatggagtaataacactgtcaggaataactgaagttcctggttctttaagcagggcaacaggaagtacaaatatgaacaaccagtccaggtaa

SEQ ID NO: 74709 - DNA, 1389 bp, Glycine max
  Peptide Sequence Number=SeqID_166394
atggttaccctttcctcagcttgcattagtcctgctgatatcaatgctgaggaaactctcaatactctcaagtatgcaaaccgtgctcgcaatattcaaaataagcctgtggttaatcaagatttcatctccaatgagatgcagcaattgcgccagcagttgaagtacttgcaggctgaactttgttttcagggaggagttcctgctgatgaagtgcgggttctcaaggaaaggattgcttggcttgagtctactaatgaggacctctacagagaacttcacgaatatcgcagtagatgtgcttttgtagggagatgtgaaattgatgaacctgatggacacatttatctcatgaaaaccgatgggcttgagaggcggtttcagagcttagattcatctgatcattccctggttggaagtctatcaggtgaggattctagggaaactgatgaagcagcaaaagagttggagcatgtactatttcaaaataccatggataaagagatgaatgagttgaataagcacttggagcagaaagagattaggctttttgctatatcattctctattatgatcacagattcacagcagagagatgaaatttcaactgagtatctgattctatcgcccctttttttcttgcagtctgagatgaagctcattgcagttgatactgaaacactcaaacagcacttcgggaagaaaattttggaacttgaggaggagaaaagaaaagtgcaggaagagagggaccgtttatttcatgaggtagagaatcttgctgctaattcagatggactagcacacaaaactcaagatgttcgtggccaaaaattgaaagcattggaagcacaggttcagttgcagcataaaatgaagcaagaagcagaacaatttcgacaatggaaggcttctcgtgagaaagagctactccaggtgtattttgttagtgggaggtattcaaacccacaacctcttcctcccccttctcccttcaatcaccaagtcaaccttatgactccaaggtgcatttatgttacccatacttcactcccaaagggtggttatgtgaggggacatggtaattgtaaaccatttttgaaaaaggagggaagaaaaaatgagtatgaaaggcataagcttgaggctctaaaccagcgtcagaaaatggttcttcaaaggaagacagaggaagcaacaatggctacgaaaaggctaaaagaattgttggaagcccgcaaatcttctcctcgtgacaactctgtttattcaaatgggcatctacagcccgcgctggtaataacctatacttggcctatatattatgcaatttgtcagcttaagagtcaaccaaaaatgttttgctggttaactttgaaccaaccataa

SEQ ID NO: 74710 - DNA, 450 bp, Glycine max
  Peptide Sequence Number=SeqID_166395
atggcaagagctggtgacaatggtggtgtatatcatcaactggacgaatctcagcgcttatttctggacgcgtggactacacaaatgcaacatttgttgaaccgtaacaaagaaaagccctacagacgaatagccaaatcttcctcgtttactcttaaacctttatcccctagagaagtgtgtgatgaccaaatcagaatgagagaacaagagaaagaaaatagtgaggcaccacaaaggaatatgaaaaagaagagtgatacacccgaggaaaagagtgatacacataagagaaagagtgatacacatgagagaaaatttaattattttgcagaggcgagtgaagtgaggaaagtgttacctgctcatgaaccactcaatctacagtattgcaaagacagtaaaatttctactgataattctaatgagtttactatttctattctccta

SEQ ID NO: 74711 - DNA, 303 bp, Glycine max
  Peptide Sequence Number=SeqID_166396
atggtccttgtccttagttgtgtccttatcaatttttgccatcaagcgctagctccggattcagaccatctacgaaaccacatgcaggagcttaggagggtcaggtctaggatcatgggggagaaggataacatggccaccatgcatgatgtcatggatgctcagtgggtttatgataattatagggatgagacttatttgaggaaggttgttatgcccttggagattcttctactagctataagaggcttgttgtcaaggattttgctgtcaatgctatttgttttggtgctaagttcatga

SEQ ID NO: 74712 - DNA, 192 bp, Glycine max
  Peptide Sequence Number=SeqID_166397
atgagatatgatgtagaaccactccatgtagtccaatacacactgtccaggagcaatacaaatctgacccaccggtgcaagataaagatggagcaacaaggtgtggaggaatggtctgcacataaccaaattgtcacaaccctctttagcagtgtcgtctcgaacatcttcggggcccgaagcaaaaactaa

SEQ ID NO: 74713 - DNA, 513 bp, Glycine max
  Peptide Sequence Number=SeqID_166398
atgacgtcaaattcatttttccatccacctgagtttggagttcctcgcggtcggggtgacgggcaccgggccggtgagattgttgtaggacaggtcgaggagtttcaaggtggtctggttgaaggaaggaagcgtgccggagaagttgttggagttgagacggagcgcgatgaggcggtggaggagggtgacgtttccggggaggggaccggagaagcggttgtgggagagggagagagtgaggaggcggtggaggaggaggagggagggagggaaggagccggagaagctgttgtggtcgaggaagagggacttgagggagttgttgcggaggctgaggactcggagctggtccagacttgtgagagtgtgcggcgggaatgggcctcgcaggcccatggactgggccacgaagctgaccactctgccctgcgcgcacttcacgccctgccactcgcagtagtcgtaccgctcgttgagggagtagaggagcttgttgtcttggtccgctag

SEQ ID NO: 74714 - DNA, 1212 bp, Glycine max
  Peptide Sequence Number=SeqID_166399
atggcctccagaaagaggaaatcatccacatcccgatctcaggaaccctatgatacgacaagattcgtttttgaggtcgcctgggaacattatgagcaaaatgtacatgccagaaacatcttcccagagaggaatgttgatttatacttgacccagtacgacgagttccgaaaggagctcgagatgaggaggtggcacaaggccttgaccaggcagcctgatggccgcactgatgtggccctggtcaaggaattctatgctaatttgttcgatccagaggataagtccccgaggcaggtcagggtgtggggcaagttaatcaagtttgatcctgcgaccctcaacacattcctggagacccccgtggttttggagccaggggagaggtactccacatattccaggttctgtcattcacatccggacccacaggagcttgcatccaagctctacattccagggcgaggatttgttctgaacactaagggagcgccttggaagcttctaaggaaagacctcaccactcttgcccagacctggagtgttttatcatactccaaccttacccccacctctcatacttctaatctgaacatggatagggcgaggttggtatacggactcgtcatgaagatggacatggacgtgggctcgatcatctctggtcagatctcgcagatggcccagtccaactcctctaggctcggatttcccgcaatcatcactgctatgtgcatcgcccggggaaacccggattatcccatgatcaccttttcggggacccgcaagactagggctcggggaccttatgataccaccacctctgctccagcttctatctcagcaccagcaccaccaccagctcctgctcctgcccctccaacactcatagcaccttccggcccttccgctcagagctcagacattttggtgccaatgctgcagagccttcaccatggcttatgcctggtggcctggacaggagtccacccttctcctgtggggggaggtgaggctcctacagcccaggagccacaaccagaggaaacgctcgaggacactcctgtcaccacgcctttggaggccattgaggaggaagatgtcgttgcagatacagattacgttgcagacatgatagcagacactccaatgccagctcaggatgccccttcaccaccttgtgatgacccagctccagctcaggaggagtga

SEQ ID NO: 74715 - DNA, 180 bp, Glycine max
  Peptide Sequence Number=SeqID_166400
atgtcgaaggccggttgttacaaccagaaggcacatctttaccgccgatgtcatgcaagacatgatcgaacataccaaccctttggagatgaagttatgttcttctttaggtttgacgaacatgtatgggaggtcttatttaggaaacaagttatatgggatgaagacctcccggtttga

SEQ ID NO: 74716 - DNA, 480 bp, Glycine max
  Peptide Sequence Number=SeqID_166401
atggaaattccaggtgtatacttttggctacctgaacctcctgaaggttacaaggcccttggctatttggttactaacaaacatgacaagcctttgttggatgaaatgtgttgtgttcgtgctgacctcaccgataaatgtgaaccttaccgccaaatactcgctactggttctagaattccagagttttcatttcaggtatggagtttaagaacttgtgaccgtggcatgttagggaaaggtgtttctattggtacttttttctgcagcaatggctggaccatgggagaagagctactacctgttgcatgcttgaagaacctgaatcttgtgctaccagcaatgccagattcgcaacaaatacatgcacttattaagcattatggccctactgtcccgcaactggcagttgcggcatcccatccctctctcctctctccccctatcccgccagctccaaaggcgggactgcccacgtag

SEQ ID NO: 74717 - DNA, 480 bp, Glycine max
  Peptide Sequence Number=SeqID_166402
atggtcattgaccaatccctcttctatgatttgacccaattgtctagcgaaggtgtaccatttgaaggtacactggatgatgattggaaatttgatttttctgtgcatgatgcccgccggttggtttgcaccaaccaagcggatatgaccggaaggctgtttgccggttcattggctcttgaaagctgcatccttcattatctaattgttcgtatcctactccctagatcttcaaaccttgcacaagtttctgaagaagatctaacagtcatatatttcttgatcggtgctgctgtggttgcctcctttggttaccgcaaagagcgtgatggcgctaagtggatgtaccctccactagaactgatccacaagagatgtaccctctcttgttctcagtcaaacccaaatagatgtaccctctacttgtaccacaaaggatgtaccctccaatgtgttgagacaaagatctcaggctgttaa

SEQ ID NO: 74718 - DNA, 741 bp, Glycine max
  Peptide Sequence Number=SeqID_166403
atggccccgatgcgcctgtgctatttgtccgtggcgggctgtggcggcgcggaacaggacgccggtggcgacgccgaagtatgtgccgtgcagctccaggtcgcccttttcgacgcggcggcggatggaggggaaggtcatcaggttgttcaggctgtggccgatgacggcgagttccaggcgcttgaggttggcggcgcggtcgtcgccgccggggccgagttcttcggcgacgggggcgatctgggacatccacttgccgatgaagtcgcccttggtcaggggcttggcgtcgtcgaagaaggcgcggatgccgccgcaggaggcgtggccgaggacgacgatgtgcttgacgttcaggccgttgacggcgaattcgatggcggcgctggtgccgtggttggcgacgttgcgcacgacgaacatttcgccggggccggcgtcgaagatggcttcgggcgagacgcgcgagtcgcaacagccaatgatcaggatttccgggctttgcccagtttcggccagtttttcgtagcggctgcgttccgagtggaagcggccggcgagaaaggactgatagccttcggtgagtcttttgggaaacatgatcttttcacttccttgataactgggccgggcatgccggcgtgccggcggacgctactaggggcttcgtgtggaagccccttttgtcgagtcggctgcggaattttcccacaattggacttgcgccggcttgactaa

SEQ ID NO: 74719 - DNA, 491 bp, Glycine max
  Peptide Sequence Number=SeqID_166404
atgagtcatcattcatctagtgttaatggcgagggtactagtcataaggaccctctatctagaatcttagatgagttgagttccctcaagttatggaaagaaaaactagaaagaaaagaaaaaggaaaagagagagtagaaataaatcaagatgagagagaacaaataagaaaggaagaaagaagaaaaataatgaaagaaatgaaaagagaaaaacatgtttcctatagtagtcatgactcttgcaagagtttaagtgaagaacttagcaactattatagagggcaccatagttcacatactaaacatcattcccaaataaaagaaacggatagaaggcctcaagaggttaacattagcctcccatatttccatggaaaagataatgttgaggcctacttagattcggaaatgaaggttgaacaactctttgtttgtcatcatattaccgaagagagaaaagttccattggctacccatagctttcaagg

SEQ ID NO: 74720 - DNA, 192 bp, Glycine max
  Peptide Sequence Number=SeqID_166405
atgagtgaacggattgtcatcatcaaaaagggggagattgtggaagcaatgtcttccaaggttattttgatgatgccaaagaatcaagagtcaagcaaaatccaaagattcaagaatcaagtttcaagaatcaagattcaagattcaagtttcacgaatcaagattcaagaataatccagatcaagatttaa

SEQ ID NO: 74721 - DNA, 285 bp, Glycine max
  Peptide Sequence Number=SeqID_166406
gataatgaaccctttgtgaaagtcaaacactcttttgctattggtgccgaagaacttactccctctcctccacctcaacgagatgactcctcagccctcatgcatgaagttctttcggagttacgaggcttccgcacctacgttggcgagtgctttgattccttggatggtcgtatcgatgccattgatgctctctttgcacgcatggatacccgcatcactcaacttgaggaggatataagttatgttcgtcagtgcttcgaccttccaccaccatcttcatag

SEQ ID NO: 74722 - DNA, 382 bp, Glycine max
  Peptide Sequence Number=SeqID_166407
ggatcgcgaccacaagacacccagtggacccggagaagtccaacaaggccctggggtttccagctctggttacgggcctctgcctgtcctacagggtgcctgttcccccagcaagggatcgcgcccgcaagacaccttgtggacctaaagtagtccaacagggtcctggggtttccagctctgattacgggcctcggtcagttctacggagtgcctgccgcccccagcaagggcgatacactataatagcctggggatggccggcagtgggtaacaggcgcaccgccgccacctccagagcacctcaactcatccacaaaaagattagagcgttgccaacgacacatggccgaccaataggcgaccaagtccaaacccaaag

SEQ ID NO: 74723 - DNA, 804 bp, Glycine max
  Peptide Sequence Number=SeqID_166408
atgatcaccatttgtaccgcctgcggcacgtcttatcagcagcagcaacctgcccttacgcagtgtcgcatttgtcaggatgaacgccagtttgtgccgcccggcgggcagcagtggatcgatcagtctgcgctgcgcgcctcgcatcaaaaccagtggcaacagctggagcccgggctgctcagcctgcaaaccgtaccggattttgccattaaccagcgcgccattgtgctgcaaacgccgcacggcaatatcctgtgggattgcatcgcgcatctggatgacgccaccgtcacgctgctgcgtgcgctcggcggcctgcacgccatcgccatctcccatccccactattacagcaccatgcaggactgggccgacgccttcgacgcgccggtgtatctgcacgccagcgacagcgagtggattatgcgtgcatcgccccgtctgcagccctggcacggcgacagctgtgatctgctgccgggcgtgcggctgttacgtctgggcggccactttgccggcggcacggtgctgcactgggcgcacgacggcggcgtgctgctgagcggcgatattttgcaggtaacgcccggtgccagtgcggtttcgtttatgtggagctatcccaatatgctaccgctggctggcgccacggtgacagccatgctgcagcggttgcagggcgtgaagtttacgcgcctgtacggcgcgtttgccggccgcgaaattctcgcgcgtgccgatgaggcagtacagcagtcgggccgtcgctatctggcctgtctgcaacatccacagccatag

SEQ ID NO: 74724 - DNA, 1143 bp, Glycine max
  Peptide Sequence Number=SeqID_166409
gtatgctctcactcgaacccttcacagaagatcagggtcggtcggcggtgcaacccacagggggatcccaccaatcagcttccttgcgccttacgggtttactcgcccgttgactcgcacacatgtcagactccttggtccgtgtttcaagacgggccgaatggggagcccacaggccgacgccaggagcgcgcaggtgccgaggcacgccaagggcgcgcgctgccatccacaatcgcgatgatgacgtctccacgagcatatcaacagcccgggcttgggccaccatcgcaatccgcgtcggtcaatgtcccgagtcgatcggcggaccggctctcaccgttccacatccgaccgggacacatcgccggcccccatccgcttccctcccgacaatttcaagcactctttgactctcttttcaaagtccttttcatctttccctcgcggtacttgttcgctatcggtctctcgccagtatttagccttggacggaatttaccgcccgattggggctgcattcccaaacaacccgactcgccgacagcgcctcgtggtgcgacagggtccgggcacgacggggctctcaccctctctggcgcccccttccaggggacttgggcccggtccgccactgaggacgcttctccagactacaattcggacgccgagggcgaccgattttcatggtgggcttttcccggttcgctcgccgttactaagggaatccttcgggtagccccgcctgacctgaggtctcgttgggagcgtgcgtgcacgcaaagggtcgtcgatgggtccagaactgaccggctcgcacgtgattggtctcgagcgtggctcatccaccattttatcacggcgaagtcggccatgaacccagatttcaaccaaccacgaggcgggtgctcgcgggaggtcagcatacaccccgcgcagcaacattgttacatgtttgcgttggggaaacgatgtgtgacacccaggcaggcgtgccctcggcctaatggcttcgggcgcaacttgcgttcaaagactcgatggttcacgggattctgcaattcacaccaagtatcgcatttcgctacgttcttcatcgatgcaagagccgagatatccgttgccgagagtcattgtatgtaa

SEQ ID NO: 74725 - DNA, 450 bp, Glycine max
  Peptide Sequence Number=SeqID_166410
atgaattttgcagtaagaaagcctatagaattcaccccaattccagtgtcctatgctgacttgctcccatatctacttgataattcaatggtagccataaccctaaccaaggttcatcaacctccatttctccgagaatacgactcgaacgcaacgtgtgcttgtcatggagaagccccggggcattccattgagcattataggggcctgaagcataagatgcaaggtctaattgatgcgggctggctgaaatttgaggagaatcgggataaagttgatatctatgtccctcgtcctctcacaaacgcatctttgcttattcaactttcaccggaatgtgggtgcaagccattggtccatttgctcaagcgacctgtgctcctgagtttggacttccaagaccattcaatcagagattactcatcttgcacgttgggggggctgccgtaa

SEQ ID NO: 74726 - DNA, 333 bp, Glycine max
  Peptide Sequence Number=SeqID_166411
atgccacttcaaggagaagacgagtcaagcacaagctcaccaccaaaggaagccatggataagagcttgaaggaggagaagatgaggggaggcaaaagaagagaagaagccattctcttatcctgggttatggagaattcgtccctaacagtcaaccacttaatccaaccctatttcaatttactaagcgaaaatcaacttaggggagaactgccaggaaaccacattacaagcgaaacctcaaagagagttgggcttcgtcctcaaaaaggaaacaacaccagaaaatctagccttccatggattcaaagagaaaacgcaattgaaacatga

SEQ ID NO: 74727 - DNA, 465 bp, Glycine max
  Peptide Sequence Number=SeqID_166412
atgaagttcatagtggaagggcatttggttatcttatcgggcaaggaagacatcttggtggttagtattgcctctgtagattccttctctgggcaaccttgcctgtccgatgcggcagtaatgatggcccgagtgatgttggggaatggttacgagcctggaatgggtttaggcaaggacaacggcaacataaccagcctgataagcgctaaaggaaaccgtgggaagtttaggttaggctataaacccacacaagcgaacataaagaaaggcattacaggaaggaagagcagagatcaaggctcacctttgggacaagaagtcaaaagaggcccgccctgccacatcagtaggagctttataagggcgggtctaggacatgaagtcaagttgttgcgatatgtgaagatgatttgccaagtgggtcggagttggtatgaccatgtcctcctggtttccgactag

SEQ ID NO: 74728 - DNA, 996 bp, Glycine max
  Peptide Sequence Number=SeqID_166413
atgacggaagggtgtggtgaagggttttgccttgcaaaccttcccggtgatgcttttagtctatgggggaacttctttgaggcaaagaaacaaatgatggctgatgccaagtttgcggggctgcttggtcttggcaagccgttggttgaaattttgccccccggtcaacttcgtggtttttgcccgttgttggcttggctagggtcggcggtgctgggttatggccccgtgctaagtttcggattggttggccccctcctcccccccgtgatcagttttgttgccaggattttgccaactttggcttgcgccccgttggctaagtctgtgcctcgggacgaatcaaagcgacaagggctgaatctcagtggatcgtgcagcaagccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattctcacgttccctattggtgggtgaacaatccaacacttggtgaattctgcttcacaatgataggaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacggttcgtattcgtactggaaatcagaatcaaacgagcttttacccttttgttccacacgagatttctgttctcgttgagctcatcttaggacacctgcgttatcttttaacagat

SEQ ID NO: 74729 - DNA, 676 bp, Glycine max
  Peptide Sequence Number=SeqID_166414
atgtgtccttgctattttgcggcgttcagcacttacgctgaacccgtgtcacttggggcttcggttatttatgcccagtcgccgtaccgcggcggccaggaccgttatctgccgatcccggtcatcaattatgagggagaaaacttttggttccgcagcctgcagggcggttattacctgtggaaagacccgcagaatcagctgtcgttaacgctgctgggctcgccgcagcagtatgacccgaaagataacgatctgggcgacatgaaagggctggacaagcgtcgcatgacgctgatggccggcgcgacttatcgtcacgttgccgactgggggattgtgcgtaccgcgctgctgggcgatgtgctgaataacagcaacggcatgatttgggacctgacctacctgtaccgctttgatttcggcgcgttcagcctgacaccgggcattggcgcaatgtggaacagtgccaaccaaaaccgctattactacggcgtttccggccacgaaagcgcgcgtaccggcattgatcgctatcacccggacgacagctggtcgccttacgtcgagatgaacgccagctatcagattagcgagagctggaacgccagcctgtcaggccgttacacccgcttcgccagcgaaatcaaagacagtccaatggtagataaagacg

SEQ ID NO: 74730 - DNA, 910 bp, Glycine max
  Peptide Sequence Number=SeqID_166415
atgataaatgcaaatcgtccgatactgaatctcgatctcgatctgctgcggaccttcgtcgctgtcgccgatctgagcaccttcgcggcggccgctgccgcggtatgtcgtacccagtccgccgtcagtcagcagatgcagcgcctggagcaactggtaggcaaagagcttttcgcccgtcatgggcgcaataaattactgaccgagcaggggatccaactgctcagctacgcgcgcaaaatactgcgctttaatgatgaggcctgcatgtcgctgatgtttggcagcctgcaggggacgctgactatcggcgcttccgatgaaacggcggataccatcctgccttacctgctcaaccgaatcggcagcttctatcccaaactgacgctggaaataaaggtcctgaattacgccgatatcgtcgcgaagttgggcagcggcgagatcgacctggcattaacgacgcatcaaaccggcgaatttgacgtcctgacgctgcgtacctcgccgacgctgtggtactgcgccgcggattacgtactggcgcagggtgaatccgttccgctggtgctgctcgaagagtccgggccgtttcgcgaagatatcatctccgcgctgaacgctgcgcaggttccctggcatttggcgcatgccgccagttctttagccggggtgaaggcggcggtgaaagcgggccttggcgtcaccgcgcgtccggtagaaatgatgagtccggagctacgcgttccgggtaaaagcgatggcctaccgggcttgcctgatacccactatgtgctgagctgcaatccgcagcgggaaaacgaactggcgcaggcgatttttcagtcgctgagccaggaccataatccgtggacacaggaaaccctatataccccggaagggggagaca

SEQ ID NO: 74731 - DNA, 513 bp, Glycine max
  Peptide Sequence Number=SeqID_166416
atggaagagctttttaaaaggtggaatgaatatcttaacagcacacgatcaagggtcagccaaccaccattgatcaattgtgatttttgtggaggagagcattacaatgacaattttcatctctactccatgaatgactctaggtgggaacaagagttaagtccttacaatcaatatgaagaagaaaaaactcctaatcttgaaagtgtgtttgaggaattcatggcataccatgctagctcaaaagccaatcaaaattcaatgaaaaatcatgaaattcattttggcaagagctactcaatagaaaactttcaagggggaccaaagttacaaccttactatcaaaatgaagcagaaagaggttccaatttggataatttgttgatgcaattcaaggaaacaactaaatcaactcaacaagcactccaaagtgtaaaaatccaagttagtgagctggcagaagaagtgactccatttatgtccagacaagaaaaatactttgtagaggtttaa

SEQ ID NO: 74732 - DNA, 493 bp, Glycine max
  Peptide Sequence Number=SeqID_166417
atgggtggcctatggatggagtttccttccggaaacaaaaaatttgaggaggccatgaatcttgaagttggaagaagaagacaaacacaagaattttgtactggttcggcaacaacccatgcctacatccagtccccaagcaaccaccggttcttgagatttcttcaaccttgtaaaatcctttacagcaaagatccacaagggattcaaacccaagtagatgtaccctctacttgtaccacaaaggatgtaccctccaatgtgttaagacaaagatctcaggctgttaaacctttgatactttgtgaatggggatacaaaagaattcttaagcgggagaagggagacacaaaagaattcaggcggttagtccttcgttcttttggaaaagggagaagagagacacaaaaagaattcaggcggttagtccttggcgaattcttttcggcaaagggagaagagaatgaagagatgaatagcacaagttttccag

SEQ ID NO: 74733 - DNA, 702 bp, Glycine max
  Peptide Sequence Number=SeqID_166418
atgagcactgaacgcagcgtattttatatctctgacggcaccgccatcaccgcggaagtgctgggccacgcggtgctgtcacagtttccggtgaataccaacagcgtgacgctgccgttcgtggagaatgtgcagcgcgcccaggcggtgaaagcccagatcaacgccctgttccagcagagcggcgtgcgtccgctggtgtttttctcaattgtcacgcccgaggtgcgcgacatcattctggagagcgaaggcttctgccaggacatcgtgcaggcgctggtggcaccgctgcagagtgaactgggcgtggcctcgatgccggtggcgcaccgtacccacggcctgaccgccagtaacttaggcaaatacgatgcccgcatcgccgcgattgattacaccctggcgcacgatgacggtatttcgctgcgcgggctggaagatgcgcaggtgattctgctgggggtatcgcgctgcggcaaaacaccaaccagcctgtatctggcgatgcagtttggcgtccgcgcggctaactatccgttcatcgctgatgacatggataatctgaagctgccgcctgcgctgcgcgcccatcagcacaagctgtttggcctgaccatcgatccggaacggctggcggcgattcgtcaggagcgcgctgaaaatacccgctatgcgtcaatgcgtcagtgccggctggag

SEQ ID NO: 74734 - DNA, 414 bp, Glycine max
  Peptide Sequence Number=SeqID_166419
atgcatttgacggacaggtgcaaagccttgttgtgtcccctgccttcaactggcatctccttatcggcaaaagtcagaaatatagttgcctcctcagctaatatctatctcttgctaaagtcatctccttcatcattcgcggttgggcccgtcttctccctctcgcctatatctgcctttgcctcccccttgtctttagacctccacagggaatggattttatgggtggtgttggggaggtctttgtggttgattgggcatgctcgatcggacaagcgtcaggcaggggggagattcgatattggtcgagtaattgtattggtgcaggggatactggcatgggcatctccttcctttttcttcgccccacctattctagtccttctattaccaacactttttgaagtagtgtaa

SEQ ID NO: 74735 - DNA, 318 bp, Glycine max
  Peptide Sequence Number=SeqID_166420
atggctccgaaaaagctttttgtgaagagatctaggaggggcgccacgactgaagagaccagtgtcgccctcgagtttgatagccaccgtttcaggagcgccgagcaccagcagcgcttcgaggccatcaaaggatggtcgttccaccaagagagacgcatccagctccgggacgatgagtacatcgattttcaggaagagatagctcgccgacgttggacatcgctggtcattcccatggctaagtttgacccagatatagtcctggagttttatgctaatgcttggcccacagaggagggagtgcgggacatgtag

SEQ ID NO: 74736 - DNA, 850 bp, Glycine max
  Peptide Sequence Number=SeqID_166421
atggacccttgggtacacgtcctcaccttcggaggactacacgtcctcaccttcagaggactacacgtcctcactttcagagggctacacgccctcaccttcagaggactacacgtccttacctttaaaggactgcacgtcctcgccatcagaggactgcacgtccttgccttcagagggttgcacaccctctcctttagtgggctggacgccctcaccttcaaaggtttccttttatcagttcctgggccaccccctgatattggagggcgaccaactgtgcgagcacatccagagagggaggctatcacgcagctactatgcataccgggccaagatttcacccgtaccgctgcaaagagacgagtgtggatcatgcgcaccaacatgaccactcttacacagatgacgttgctacttagcaacattctgcccagcgaccgcaatgccaggatctccccggagggcccaacagggccctggagtattcagctctggttggggcccacaagacacccagtggacccggaggagcccaacagggccctggagtttccagctctggttaatggcctctggatcacgcctgcaagacactcagtggacccggagaagtccaacagggtcttggagttgctagctctgattacgggcctctttcagttctacggggtgtctgtcgcccccagcaaggtcatcaggccccctactactcgagctttcatcaagaagtactgcaccctcaggcaggtgcagggcaaaacaccccagcagcctggggacgaccggcagcaggcaacagacgcaccgccaccacctctagagttcacctcagctcatccacaaaaag

SEQ ID NO: 74737 - DNA, 1865 bp, Glycine max
  Peptide Sequence Number=SeqID_166422
gggctcgatcagagcagcggcgcggtgaaatggagcgtgaatctggatatgccagcgctgtcgctgcgcggtgaatcggcgccggcagtagcgttcggcggcgcgattgttggcggcgataacggtcgcgtcagcgcggtgatcatgaaccagggtcagctgatctggcagcagcgtatctcccagccaagtggcgcgaccgagatcgatcgtcttaacgatgtcgacaccacgccggttatcgtcaatggcgtggtctatgcgctggcctacaacggtaacctgacggcgctggatctgcgttccggtcagattctgtggaagcgtgaaatcggcggcgtcaaagatctgatcgtcgatgccggtcgcatctatctggtggatcaggatgatcgcgtgattgcgctcaacgccgatggcggcgtggcgatctggcgtcagagcgatctgctgcaccgtaacctgacgtctccggtgctgttcaacggttacctggtggttgccgatagcgaaggctacgtgcactggatcaacacccttgacggccgcttcgtggcgcagcagaaactggacagcgatggcttccagaccgagccggtcgtggccggtgacaagctgctgatccaggcgaaaggcggtgaggtctacgccatcaccctcaggcatgatattcttggcgcctgcggcctgaacctgacggcaaatgccgttataatcacgccattcgggcgatttatttttaaaactgaggcaagtgttatggtacctgtggtcgcgctggttgggcgtcccaatgtggggaaatccacgctgtttaaccgcttaacgcgcacacgtgatgcgttagtggccgatttccctggactgactcgcgatcgcaaatatggtcgcgccgaagtggaagggcgcgaatttattgttatcgataccggcggtattgatggcaccgaggaaggcgtggaaaaccgcatggcggaacagtcgctgctggcgattgaagaggccgatgtggtgctgtttttagttgatgcgcgtgctggcgtcatgccggcggatcagcagatcgccaatcatctgcgttcgcgcgataaagcgacgttcctcgttgccaacaaaactgacggtctcgatccggatgctgcggtgctggacttctacgcgctcggcctgggtgagattcacccgattgccgcgtcgcacggtcgtggcgtcaccagcctgctggaaaccgcgctgctgccgtggatggatgatatcgcgccgcgggaagtcagcgaagaggacgaaaacgaagcttactgggccgcgttagccgccgaagagaacggtgaagcgctggaggaagaagaggaagaagccttcgatccgaccggtctgcctatcaaactggcgattgtcgggcgtcccaacgtaggtaagtcaacgcttaccaaccgtatcctcggtgaagaccgtgtggtggtgtacgacatgccgggcaccacgcgcgacagcatctacattccgatggagcgtgatgaccgcgagtacattctgattgataccgcgggcgtgcgtaagcgcggcaaaatcactgatacggtggaaaaattctccgtcatcaaaacgctgcaggcgattgaagatgccaacgtggtgatgctggtgattgacgcgcgcgcgggcatttccgatcaggacctgtcgctgctcggctttatcctgaatagtgggcgctcactggtgattgtggtcaacaagtgggatggcctgtcgcaggagattaaagacgaagtgaaagagacgctggacttccgtctcggctttatcgacttcgcgcgtgtgcactttatctcggcactgcacggcagcggcgtgggcaacct

SEQ ID NO: 74738 - DNA, 1623 bp, Glycine max
  Peptide Sequence Number=SeqID_166423
cgcggcgaggcggcgctgctggcggtgctgccgcaggcacccagccgtttgcgcccggaccgctggccgcagcgcgctgaagctgcccgcaataaagtgctggatcgcctggcgcagtatcaggtgtggccggcgcataccgtcgccgaaatcaaacaggagccggtatggctgccgccgcgccagctgccgcagctggcaccgctgctggcgcgccggctgctgtcgctgtcgcccgacagcaaaattacctccacgctggatgtgtcgctgcagcgtgaactggagaacctcgctgcgtcgctgcaaacccggctgccgccgcgcacctcgctggcactgctggttgtcgaccacagcaccatgaaggtgcgcggctacgtcggctcggtgtctttcaatgacgatagccgctttggccatgtggatatgattgccagcgttcgttcgccgggatcgctgctcaagccgtttgtctacggcatggcgctggatgatggcctgattcatggcgaatcgctgctgcaggatgtgccacgccgctttagcgactatcgtcccggcaatttcgacagcggctttcacggcccggtcagcgccagcgaagcgctgcagcgttcgctcaatctgccggcggtgcagctgctggaggcgcttggaccgaaaaacgtcgccgcgcggctgcgcaacgtcggcctgaatctgcgctttccggcgggcggtgaaccgaatctgtcgctggtgctgggcggcaccggcgcgcggctggacgacattgtcgccgcctacagcgcctttgcccgccacggtaatgctgcagcagctgcgctggctgccacagcagccgctgctgcagcgcccgttactgtcgcccggcgcggcgtggattgtgcgccgcattctcgccggccggatgccacgccggttgccggccagttcggttacgcgtcggcggtgccggtgatgcagcaggttaatcacctgctggcgggacacctgccggcgcgcggcgtgcccggcgatccgcgcccggcgacggtcagcgccgtcagtatctgctggcccggcggccagccgttgcccgccggcgacgagaactgccggcagcggcgttacagctgggtgctgaatcagaccgtgccgccaacgctgctggcgccggggcaggagggcgtcaatggcttacgccagcgcttctggcaaaacagcaaagggctgcgcgtggcggcggattgtccggatgcgcaaagccgggaacgcgtgatgtggccgctgccgcttgagccgtggctgccaccgggcgaacggcgggcgcagcgcctgccgccagtggatgtgacctgtccgccgctgaatcagggggacagcgcgccgctgctggtgaccggcgtgatcaatggccagcgcgtgcagccgctgcccggtaaggtcgtattgctgctgccggtggcggtgcagggcgggcagggtacgcagcgctggtggtttttaaacgggcagccggtggagcttgctgcgggaaaaagcagcgcctcgctggtgctgcgcgagcccggtcgttatcagctggtggtgatggatgaggccgggcagctggcttcggtgtccttcacgcgtggctaa

SEQ ID NO: 74739 - DNA, 601 bp, Glycine max
  Peptide Sequence Number=SeqID_166424
aacctgccctaagacacagcagacacttgtgcatacagcccttacccctaactatgttttgaagagtttgattgctttgtggtgtgaaagcaacggtattgagctaccaaagaagcaagggaactgtagaacaaagaaatgtggtggcagcagtctttcagattgtgatcgaactgctattggtgctttattggataaactaacgagtaacgatatagaacagcaaagggcagctgttggtaagaaggatgctgctactgctctaataaagttactttgtgaagatgaagcactagctattatggcaatccttgcaagccaccatgaaggcagggtagcgatcggtcaggccaagccaattcatattcttgttgaggttatacgaaccggctctccatgcaatcgagagaatgctgctgctgtcttgtggtcactatgcaccggagatccactgcaattaaaactagcgaaagaacatggtgcagaagcagcactgcaggagttgtcagaaaatggaactgataaagctaagagaaaagctggaagcatattggaactcttgcagcgaatggaaggggttgataatctgcagagttcatag

SEQ ID NO: 74740 - DNA, 462 bp, Glycine max
  Peptide Sequence Number=SeqID_166425
atgccccgtaggcctctctcgggtgacctaagcatttggtacttcgatcttttattaggttggcgccaggttaggttcgtattcaaccttcttccaaatcagtccttgttcatttcattcgtggtgctcttggcacaatggtctaatctggaggagggaagttggatgtttttctctatttatcatcactacgggccatatggccagatcgacgttgtcagaataatagtgtgcccctttgaaaaggatgaatgccctacccatgtgatatctgctaaaggatttgtcagtgagggcttgacctctgatgtatggaagtacgtggttgaagtgaattcctcggaaatgcaaccggagggcaatctctcttttgacccggtctgcatatggctatggttcagatacagactaaagactttctttcgtgctttgatctcagtggaagtagagtattgctcttga

SEQ ID NO: 74741 - DNA, 255 bp, Glycine max
  Peptide Sequence Number=SeqID_166426
atggataaaagttataatttgtttgactcattcatcagtgcacaaaatgtaaggcaagtgtattatgtgtcatatccaacaacaagaagggacaaatgtgatttaagaggtggtgttgaagaagtaaaccctgttgatttgttgacaaatgaagaagaatcaactaatttgaatagagaatcaaacaatattgaacaagacaatgaaggggaattagattatgactttgaagtttacaattctgaagaggattag

SEQ ID NO: 74742 - DNA, 456 bp, Glycine max
  Peptide Sequence Number=SeqID_166427
atgaattctttagcattgtgttccctttgcctgtttctcattgctcagtctccttggttaacaaatgctacagtgtttggtgatgatcctacagtcctgggtgcaaaaaatcttcttcaactttcggaggcaatcttgaacttggccgtgaataagacagaaaaagctgaagattttctaaagggattggcgaacacaacagatgttccggccattgcaaattgtgcactttattatgaaaatgcggttgaacgctttatgagttctttgcaagtgttgaaacaccaagatcttgaagtggctaactatttggccgccattgctggtgatgaaccatcgtcatgtgagacagaattgagtgctgcacatattgttaaccatgcaatttctgctgttaaccaccaaacaagtttgcttagctatattgcattcgtagccacagggaaactgtcttag

SEQ ID NO: 74743 - DNA, 2535 bp, Glycine max
  Peptide Sequence Number=SeqID_166428
atggagttcagacatcgaaattacagtgccgagcttgaatctcacgcgctccctcgcctacgcgccggagctcatcctctctctgctccacctccacctccacctctctcccaggttgatgccatagattgtgggaacactgatttctatgatccactgagaggaactaataatgatgcaaatgccgcccctcctgatcatgacaacttgaatgaagctgctgatcatcagccaacaaaggagtggacctctttcaggagattactaacgcagaggtttcctgtctccaaaatggtttccgttgcttcaatcatagatgtgaattttgatactgctggcaagttaggttcaaccagtgtgaatttggacattacctccttctgcaaggtacttgagaaatcttcaacaaatatgcacttggaggaattggaggatccacaaaaattcgcagacgagggtgtcaagacgattacgtggcaggagtatgtttctcgactacatgaactcaaagatgaaattactcgttcctggcttgctgaagatcgagtgacatccttaaagttatccataaaggttgctaagcttctgatggatacgtcagtatttgagttttatcctacactttttgttcttgtcacagatatcatggatatgcttgggaacctggtttggcaacgcataaagcggaaagctgagttttccgaagatggagctttacgctgcaacttagcagaaaactttcaagcaagggatatttgtgctgatgccaaagaaacttgctataactggttcaacaaaattggtgctgtgcaagagcttcttccacgcatttacttggagctggcaatattgccttgctggcggtttttgcttgagcaacctttagacagcctccgacgcttggtaatgatgataagaggattaggagatccagtagcatctgcatattgccgtctttatatggctcactgtgctcagaagctgccttcacatgatatagtatggctaactgtgctaaagagacaagtcaatgaagttttatcagagtttggattgatgaagaatcaacaggatttggggagtgtttcatgtgtttcaatcattcttcatcatttactgaaggaactccctatagaagtagttagttccaatgttgtgcagatccttcatctcattgaatttagcaaggataattcctttgatcagcatatgaattacagattgcttggattcaggctgtacgaaagaaaatcccctgttgatattgttgatgctgtgttagataaagttattcaggttattgctctgtatgatagccttgacgaatacctgaaggttgtagatgcttatactgatcttattcttcagaatcagatggataaccatttgaaaatcattttggaaggcatttcaaagcgtacttggaataaaggagttacagaggatgaaatgccgagcttgcaatctcttgtggtgaagcttctgtctcattttaagcatctggaagatgtgttttctctggatcagtttcctgaaatcttggatgtaatgtatggcaagtcacaggatgttgtctttttgcatatccttaatatggcgacaaggtgcaaaagagagggaaagggggagagagagagggaaagggagaaaagagatgcagaaatgaaagaggcacaaaagagagataggagagagagggagggaggtgttgaagagaaagggagagacagtgagaggtgtggaagagagagtggtgtcaaagagaaaaaaggagagaggtgcaaaagtgatagagtgtgcactagagttttggggaatggtcgcattagtgatccgacgagcatacagttgctttttgaaatttctctggctctacataataatatagagtttatgaacatgaaagatgatgatggccaagtggcatgttcaatagctcgctttgtgcacatggtagattatggaacagagatggaacaccatttagcatttctggttgattgccgaggagcttttggtagattaaatgagcttaaggaaactcttgttcactctagcaattctttagcaattcaagctttgaaatgtgctaagaaacatctgaattttgtcaaatcctgtgttacatttagtgaagtcacaataccttctatttctgctcacaggcagtttgatctttttctagaaactgcagaggttgcattcttagggggcttggtttctcattcagatggattgattgattcagcaatcagctgtttgcataccttagacataattgatggcaatgacatgttatactacggggattcatcgtacaaccaagagcttgtttctttgtctaaacttgttcttgagaacctgcttagtgccgttcaacaagaaccttcccaggctgctcgaggaattatggcacttgaagcttgcaattgcattgcttcttctttcatggtaagctcttctatagttgttttgaacttagttctcactatcattgacgtggggagaaaatacaaaggaaaaaaagaggactaa

SEQ ID NO: 74744 - DNA, 462 bp, Glycine max
  Peptide Sequence Number=SeqID_166429
atggtgcacggattttccaggggtgctatcgtggacgagggaggaagagaagagagtgttgaggcgttgatgaccatggaagatcttgcgttgccacttaccacaactttggagttttttcgaatattcagcatgcactcctgcactacccctgcttcaaacgaaatccctgaggtagcaagcctcacaattctcctcatgtttgttgctgtttgcacccgtgtgtttgctacccctatgcctccttctacctatcactctcaaccccatcaaaaacaccttgtcctcaaggtgttaggaaccaagcacaggaatgggaacaacctagcttcgagggttaggaacctccatagaagaagagggagagagagagcaagagagagaactaagggaagaacttttctgatatattttcagcatcacattgcagaagcgcttcttacactacataagggctactaa

SEQ ID NO: 74745 - DNA, 1074 bp, Glycine max
  Peptide Sequence Number=SeqID_166430
atgaagtcagagagtgtcagtgagtgtttgtgtttgttgggttgtgccggggagatggaagtgtctttgctggaggaagtagagaatattctaaggtacagatttcgaaacaagaagcttttagaagaagccttgactcactcctccttccttgacggtgtctcctacgagcgtctcgagttcgtgggagaccccgttctgagtctcgccatcagtaactacttgtttctcgcttaccctgatctagatcccggccagctctccgccctccgcgccgccaacgtcagcaccgagaagctcgcccgtgtcgctgtccgcattggcctccaccgctttgtccgccacagcgcccctccccttgtcgacaaggtcgagcgcttcgtcgacgccgtcaagctcgagattaaccccgttgctcacggcggatccgtcaaggcgcccaaggtcctcgccgacgtcgtcgagtccgtcgccgccgcgatttacgtggacgtcaattttgaccttcagacactatgggtggtactgtacctttttatcagaattcatcatcaagtttacgtttttcgtatggaatgccatactttaacccaaaagcaaaagcttaaggttcaggtggataggtcttatcttcactcaattttttcacttctaatcgatataatgaggggtgttttggagccaatagtgacaccggatgctttggagaaacagcctcaaccagtgactatgttgtatgagatgtgccaaaagaaggggaagcaggttgatataaaaccgtcaagggaaggagatttaagtgttgctaaggtgtttgttgatggagagtttgttgcctctgcttcctcttctcaaaaggatcatgcaaagcttgaagctgccaagattgccttgggtaaactagcacatttggtgccttccaccgataagaagtctgccactaacatgaagctcaactttgctgccgatgaaaatggtacctgggttgttgaagcacccaaaaataaacttcgtgagttatgtgcggttaaaaaatggcctataccagagtacatgtactgttctttaacatga

SEQ ID NO: 74746 - DNA, 1263 bp, Glycine max
  Peptide Sequence Number=SeqID_166431
atggagagggcgatcaccagagacttgttttcacgtatattgttgttccaaacccatttgataaaggtggcaacttttgcagctgaactggactgctttttgtcaatggcattggttgcacggcagaacaattatgtcaggccgtcgttgactgaagaaaatttgcttgatataaaaaatggaaggcatgttttgcaggaaatgactgtagacacatttattcctaatgacactaagattcttcatgatgggagaattaatatcatcactggtcctaatttttctggaaaaagtatctatctaaagcaggattttgatcatactgttttaaatagcaattatgttgaaaaggttgctataattgttttcctctcccacattggcagttttgtgccagctgatgcagcaactgtgggtctgacagatagaatattttgtgcaacaggaagccggcttatgacagctgaacaatcaacatttatgattgatctacatcaaatagggatgatgctcaggcatgctacttcgcgttctctgtgtctagtggatgaatttggtaaaggcactcttacagaagatggaattggtctacttgctgggaccataaatcactttgtcacgactgatgaacctccaaaggtttttgtgtgcactcatctcatggatttattgcatgggcattccttgaccaagtctgagcagattaagttttacacaatgagtatactgaggcccgacggaaattccacgcatattgaagacattgtatttttatacaggcttgtccctgggcatgcgcatcatagctatgggctgcactgtgcactgcttgctggtgtaccagaggaaatcataaaaagagcaacagctgtgttggataccgtttcaaataataaacatgttgagcggttatccaatgagaacatctctgctcaagatcgtcaatacaaggatgccatggagaagttgttggaatttgatattgacaaaggcgacttaaaaattttctttgaggatcatactgacccaaacgttgcgacatctactttagggtcgataccacctgggttaggttggatcaaagttaatgttgatgcggctgttagaatgtctgataatgaggctgtttgcggaggagttctgcgtgatcattatggtgtctttttgcatggttttatggcaaactttggaacttgttatatcttagaagccaaactttgggctatcctcaatggcctccagctagctttggatagaggctga

SEQ ID NO: 74747 - DNA, 2094 bp, Glycine max
  Peptide Sequence Number=SeqID_166432
atggaggaggagcagcagacttttgtgtccaaagcgagaaccgcctttcattccgccgcggccaaagcggagcgcgttctcttggatttcaaatccgatcgagcattgactcaatttgttgaccgtgaagaagatcacgataaacaatcgtcgcccaacaccttcaccggccaacaaccagaagctgaatctcctcacaccgacgaaaacgactccaagcttcatagtgaatcgaagcatataaagtggaggcctccacatttaggaattaagcaggattggcaagataaaataaagaacatccggagagggagaaaagaagttgaagatacagataaagttggggatgcaagcatggcaattccattttatgatgataatttgtacctcctgaatgtaaagaatgatctcgaggccaaggcttcagaagcaatgccctcagttgaaggcctcactgctgcaactaaagatcccattcctccatcatctgtgctaaagcaattggctatagctgttgaggctggaagtaaagcaaagtcaatgaaagatgttatagcttcaccaggaggttcttcacctgctagagagagggcaggcttaagtctctcagcagttaaggctttagtgctacgggaaaaggaggacaaacttacatctgagtttactagcaatgagaaagttgtgcagttaattaattctctgtttgatccagaaggagatttccttagaagaaagatcgactctaatctggaggaaactgctatgacatctttgccaagagatattcatggtgcgcctcccgaaagccttgttgttaagctagctgaaatccttggaaactacaagactcttcgaaaaatggctcttttctggtgcagggttgttgctgaactaaggaaactttggttcgaggaacaatacttaccaggagtcccccaggatgagattcctgatctgaagtcatgtcttctatatcaacaatttcaagtaattaattgctgcatctctcggaaaaggttccgtattattgccactgaatctttagactctatgatgatgcaagctaattcagacataaaagaatcaactgattgtagcgctgaagcttctgcaagccctgttctatatgctagattgaatagtggggagcttgttcttcgacttggtgctgatcatcctgctggagatatgacattgttggaaactggcgagcctgtgtattctccaatcactcaggaaggacctttgcttacagaagatctaatcagggaaacagaggagtttgtgctgcggacagggagtgttggtgctgggtgctctcaattgctctcagatatgcaggctttcaaggctgcaaatcctggatgtattttggaggattttgtaagatggcactctcctcctgattggacagataatgaagcaagtacagaggatagtgatgtttttgatagtggtgagccattgtctgccagaggtaatttatggcgtgaattgtgggaaacatccaaaccagtacctgctgttaagcaggcgcctctgtttgatgaggatttggcagtggagggcatcctcaatgcatttgaagaaatgcatccatctgatctttttggacagctgtttgtttctttacttggtttaggatttggaattgccgaacctatgctgtctggtaacagtgacttctcgaagttattctatgactgcaaggagtacataattactgcttgtcaaaacaacaaattgaatgagaaagttgatggtctcgtccaggtatatgaaacagtggagaaaatgttattgaatcctgaagaagctctaaaaatgattaagcagacagaggaatcaactacagttaccggtgaaccaaggagcccgtttaagaggcttagccttatctttggaggcaaagataaactattgaggaagtctgtctcaaaagatcagacaaacgacgaagaaaagtcaggtcggcaatcattctccagtttctttgacagcaagtcatctttgtttggaaagaagcctcccaagtctggatccccatctccttctgagaaatcttctatcgatactggttggccagttgtttag

SEQ ID NO: 74748 - DNA, 1197 bp, Glycine max
  Peptide Sequence Number=SeqID_166433
atgcaattcaatgcggcggagaccatataccacaaacaggcacgatcaatacaagaactagcaaggaaaaagtttgaaaagttaaggattgactatgaacgttctcagagtaagctgaagtctgaacaaaaaacaagatctaattccctaactaagaagctaggaaagaggccgctgggtcaagcttcacaggaacctgttggctatgattttacctcaggtccaactcatgctactattgaagatgtattgccaacttcccttccaatgcaaggtgctgtatgtgaagggcctggcaatattgatggccttctggaggggaatgctttcttgattgattcaaatcaagagaaagtagaagactatataccagggagggatctgctctccaagttgggaaggaaaccatctgtgcaagataatatgtctaatctaccagctactagatcggattccttatttacaacatttgagggtgaagttaagccacagctagttagtgttggaccacaagatgaatattcatatgccaggagtttggctcgttttgctgcaactctgggacctactgcatggaaagttgcttcccagaagattcggcaagcactgccacctgactgtaaatttgatcgtggttgggttggagagtatgaaccacttccaaccccagtatcaatgcttaataatcatgcccagcaacaacctagtttagcgactaagttgcagtctactactgaattcatagaggttgaaaaaaattgtaagaatgtggaatccaccatggaacaatattctgttaatggaccaatgcatgagggaaaacagcctacagcctgttctagtagtgggctaacatcagatgaaaaatcatccttgtttggttctgatggaccaagacccaattctcctgtcaatctcttttatcagcagctcaatgtccaaaccaggaacctcgacaagtatgagaacaagggttcgaaacaagtggaattcaactctttaccctcgagtgatcagaataatgccagcttagttgcaaagcttacaagtaataatacacctgcagcagtgtctaagcccagagaaatggttccaagtaacatgaatattggttcccaatctcctgggtcacctgcaaaacaatcatctggggtgctggttgactctcagcaaccagaccttgctttgcaacaatga

SEQ ID NO: 74749 - DNA, 498 bp, Glycine max
  Peptide Sequence Number=SeqID_166434
atgataataaaatcttttcaagtattggatgaacattctgagctttggcgacctcctgccatgaccgttccccttgattctgcttatggcaccacgaaaattaaagtagtgggccaaaactcagtcctgtctactcaagttctaagtggtcctcgtgaggtgcaggtgagtttgactcgctctaactcgtcgctgactcggtcattaaggccgttgagtgaagatgaaacgaggctgcacacgccggttgtgatttcgtgtaacgaagatagaagagaggttttagctgttcagaatatcgccaacaaacagatcgatagaaccttcgcatttgacaaggttttatccagcttcagatacctgaaaagagaagagcgagatggcgtcggtggtgaagaacgaactcaaatccgtcagagaaaagggtttcggcgctttcctcagagagctcaaggatggaggctacctgtttgtcccttttctttccttcgctcttaa

SEQ ID NO: 74750 - DNA, 426 bp, Glycine max
  Peptide Sequence Number=SeqID_166435
atgggtgaccaaaatttctataatgattcagtagcggttgtaatgaaaggtcaatgtatggagctcgagagggtattaactattttcacaaccattgatttatcaaataacatgtttgaaggaaaacttccgaaagtcattggagaattgcattctctcaaagggcttaacctttcgcacaatgcaatcactggtatcattccaaactcgtggaaccagttgaaaggagagattcctatggctttgatcaatttgaattttctgccacattcaacatttcaccatgaagaatcgagatttggctggaaagctataccagtgggacatgcatgtgggttgctatttggaatgcttttgggatataatgttttcatgaatgggaaaccacaatggctcgcgagacttgttgaaggtgtgcttagttaa

SEQ ID NO: 74751 - DNA, 183 bp, Glycine max
  Peptide Sequence Number=SeqID_166436
atgaagaaccttaaggccaaggaagagagaaagagcaacggcggccaaaacactaacggtgacgataagtgtttgcgtgtcgaaacaggaagtggtggcgacgccgtaaaagagcaaaatggggtcgatgatctttggaggggaaaagagcgagaaggtgtggaagagcatggagaaagatga

SEQ ID NO: 74752 - DNA, 618 bp, Glycine max
  Peptide Sequence Number=SeqID_166437
atgggagttagagggagctcagtgttagcaatgttggtgcttggcggcatctcagctgaaactgaaactgaaggcatattaggaacaacaccaactccatttgaatacggtgataataaggcaattggattgaaatgtggcaggtatgtgtcacgcattgggccaaaggaaccgccatcacaagcctgctgccaatccctggaaggtgctgacattccctgcctatgccaatattttactatttacgctcttctcttcagcttagaaaaagattacttagaggatgtaaagaacatgaatggtggtgggagggttagattgcatgtggaggtgccatcattggtatgtgaggattgttacaagagggtcatagcagagtttatgaagcaagcaaagatccctggatttcgccctggaaagaaagttccagaaagcattcttattagttacgttgggagtcaaaatgttcagaaggctactattgaatctatattgaggaggacactctcacatgctatgacatcggttactggaagggctttgcaggaatcagtacgaatagtgactaagttttctgagatggaggagacatattcttctcttgggtctcttgggtaa

SEQ ID NO: 74753 - DNA, 321 bp, Glycine max
  Peptide Sequence Number=SeqID_166438
atgggggtgcaaatagcaaccaagcccacttgggccctccagaagattcctccagaaggctgttgcttctggagaaaatctaagccgaggcgcttccgaaacgtttccgtaaggaatttcgcgaaggtttcgaccgttcttcgacgttcttcatcgttcttcgatcttcaacggaggaaagtgatcaaggtttactccaaagtcttcaagttgatgcttcatctagagacattgagcacaacaacttccaactgctatatactcagcttctgcagtggaaagtactacacaagcttgttttttgcaattccaagacactag

SEQ ID NO: 74754 - DNA, 633 bp, Glycine max
  Peptide Sequence Number=SeqID_166439
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtcgttcgctccaagctgggctgtgtgcacgaaccccccgttcagcccgaccgctgcgccttatccggtaactatcgtcttgagtccaacccgagttcttgaagtggtggctaactacggctacactagaagaacagtatttggtatctgccgctctgctgaaggcagttacctcgaaaaagagttggtagctcttgatcccggctaa

SEQ ID NO: 74755 - DNA, 159 bp, Glycine max
  Peptide Sequence Number=SeqID_166440
atggggcatgctgctgaccgtggcggcgctgatcgccctgttcggcctggcgtcggacaacttcctcgatgccaacaacatcatcaatatcctgcgttcgatcgccatcgtgacggtgaactcgccagcctcggcgtctctatccgctgtcggtcggcg

SEQ ID NO: 74756 - DNA, 594 bp, Glycine max
  Peptide Sequence Number=SeqID_166441
atggctgttatgctctgttgtaacacagattacgccgttggcaaccaacaaaatggcataacggcggtggaaaacgcgttggcgggtaggggcgcaacccgcgtcaggctgcgccggtgcgagaagcgctcagaaggtggtgggagtgtgtgcgctgacgatgcggcagatgcgcgccgaggtattgctgaagctgtgcggaatgccggtgttgatggcgtaactctggccggcggtcaggcagtagctctggccgttgatggtcagcacgatctcgccctccagcagggtgccgatctcttcgccctggtgcttgatcttttcaccggtggtggtgccgggctggtaggtttccagcatcatcgccaggttacgcgtcgggctgccgttgtgcaccagcctcatcgataccccctggctgccgatctcaatcagatcctcggcgtcgatcaccacgcgcggctcgtcgacggcttccggttcggcaaagaattcagacagcgacaggccatacaccttcagcagcttttgcagcgtgctgatggccgggctgaccttgtcctgttcgatggtgctgatcgcactgtgggttaa

SEQ ID NO: 74757 - DNA, 2413 bp, Glycine max
  Peptide Sequence Number=SeqID_166442
ggctttacatggcttcctcaagtgcatggaccacctttccgccaaggtgcttatcgatcccgtcaaccacagccgcaatctgcacccagctgctgacgctgagttcgctggaatcgctggcggtgctgatgcgcgaagggccgcaggaacagcggcaggcggcggcggggcagctggcggagatcgccggcgagctgaaaacgctgatgcaggaggtcagcctcggccagcacggcgaagcgccgatttacggctatgtctggctcagtatggagctggcgcagcaactggaagagctgggggatctgctccaggtctgcaccgccgccgggcgcgaataaggggtcagatcatgaaggcggcgctttgggttttggccgccggggcaaagtggggtataaagatggataatgcaaataagccgagtttccaggacgtgctggagtttgtgcgtatgttccgccgcaaaaacaaactgcaacgcgagatcgtcgacaacgaaaagaaaattcgtgataaccagaagcgcgtgctgctgctcgacaacctgagtgagtacatcaagcccggcatgagcatcgaagacattcagggcatcatcgccaacatgcgcagcgactacgaagatcgcgttgatgactacatcatcaaaaatgccgatctgtccaaagagcgccgcgagctgtccaaaaagctgaaagcgatgggcgaagatctgcaggtgaccgccggggaacgcttgttactgctccgcaccgtacatgtcgaagtcgaaatacttgtcgttgattttcttgtaagtgccgttggcgcggatcgcctgcagcgcggtgttgaaggcgttaagcagcgcggtatcctctttgcgcaccccgatgccgtcgccgacgccgaagtatttgctgtcgttcagttcggcgccgataaaggcgaaatctttgccgccgggcgttttgaagaactcgctggcgctgacgctggccagcagcgacgcatccagccggccgttggccagatcttcgttcacctcctgctggctttggtaggcgaccacgttaacgccggccgggcgccacagcgcgttggcataggcctcctggctggagccttgctgtacgccgaccgatttgcccttcagcgaggcggcggtaggctgcaggctgctgcccttatgcgccaccagccgcgccggggcgttggagactttgctggagaaggcgatctgctgctggcgctgcggtgtgatggtcatcgacgaggcgatggcgtcgaatttcttcgcctgcaggccggggatcatgccgtcccagctgctttccacccacacgcatttggcctgcatctgatcgcacagcgcctgggcgatgtcgacgccgaagccggtcagcttgccctgcgggtttttatattccagcggcggaaaggtgggatcgatgcccagcttgatcaccttgccgctgaattcgccgctcagcgcgggaaagctcgcggccagcggcagcagcaacaacagccctttgatggttttcatgttgtcgtcattgaagtcatagccggggttgtgcagggaattgcccggcgttgcggggccgttgccgatcgagatgtagctgcctgggcacttctccagcataaaggcgaaatcttcgctggcggtaaacggccgcagcgtggggataacctggctctctccggcccagtccagcgccaccgcgcgcgccagctcggtttctgccgggtggttcaccagcaccgggtagccgtgccggtagtcgatctccgcgcgggcgccgaagctggcggcctgcgccgtgaccagctcggtgatgcgctgttccagccgcgcgcgcaccaccgccgtcagcgcgcgcacgctgagcgtcagggtggcggtcgccgggattacgttggcggcctggccggcctgcatcgctcccacggtgacgatcgccgtttcctgcggatcgatattgcgcgccacgatggtttgcaggctcatgacgatggccgcgcaggccaccaccggatcgacggtgctctgcggcactgcgccgtggccgccgtggccgtgcagggtgatgtgcaccgtatcggccgagcacatcaaggggccgctggcgaagcccaggtggccggtggggaagccgggcacgttgtgcatggcgaacaccgcgtcgcaggggaagcgctcaaacaggccgtcttcaatcatcactctggcgccgccgccgccttcttccgccggctgaaagatcaggtgcagcgtgccgctgaagttcggctgccgcgccagacagcgcgccgccgccagcagcatggcggtgtgcccgtcgtggccgcaggcgtgcatcaccccggcatgggtgctggcatgcggcaagccggtcgtttcggcgatcggcagggcgtccat

SEQ ID NO: 74758 - DNA, 234 bp, Glycine max
  Peptide Sequence Number=SeqID_166443
atgctccaaccatatgggatcaacataggcttaaaggagcactcaaactgggtgacccccaaggcctacactccgaagagtccttttaactctaagggtcttagcattaacttgtcgcccatgaagggacttagcattaactcgtcgcccttaaagggacttagcattaactcatcacccttaaagggacttaacattaactcgtcgcccttaaagggtcttatagtcatgtga

SEQ ID NO: 74759 - DNA, 1086 bp, Glycine max
  Peptide Sequence Number=SeqID_166444
atgggaacaaatcaaaccggcaagaggttctaccaagtcaaggtcaaaagcccaaataccaccagcatcaaggaattagggcggttgatggaacccctccaaatgcaagccttccgcaagacttacggaaagatcttagagttgaccatagcagaagtgtccatagaagccattgcatcacttacccaatactacgaccagcctttgagatgcttcacattcggagacttccaattagtaccaaccattgaagaatttgaggaaattctaggatgtcctctcgggggaagaaaaccatatctttcctccgggattcagcaaaggtttggaccgcataaaacagactcggaacggcatagcgggcctaccacagaggtacctagaagacaaggcgaggggtatggccaatcaaggagattggtcccgtttatggatgtgttagctttgctaatttttggggtcgtcctctttccaaacgtggatggtttggtggacctagcagcaatcgacgctttccttgcctaccaccatagcaaggaaagtccggtggtagctgtcttggcagatctatttgacacatttgaccgaaggtgcgaaaagagtagcgcacggatcatctgttgcttacccgccctctgtgtttggttggtttcgcacttgttccaacaagacacaagacatccatgtccgctcctgagccatcgctcgtgtactgaaaagaggagaatagattgggaccagctcttggccgggataggaggtagaacaatcagttggttcccccgatggaaggaaggaaaagaaggagtccttttctcatgtggaagatacccaaacatcccgctggtaggaacgaggggttgtattaactacaatcccgcgctcgctataagacaactagggtaccccatgaggggagcaccgacggaggaaagcatgtctcttttccttgtgagggatttcggcgcacaaaattccaagactatacaaagaatccataaggcatgggaaaccccgttaaggaaagatcaagagcttagaggcattcgtaatggcatcattggtgggtaccacgaatggctgaaa

SEQ ID NO: 74760 - DNA, 632 bp, Glycine max
  Peptide Sequence Number=SeqID_166445
gcgctgtgcgtatcgacccgtgcaatgctgtagctaacgcgttaagtatcccgcctggggagtaccgaagaaccttaccagggcttgacatgccgcgaatcctcttgaaagagaggggtgccttcgggaacgcggacacaggtggtgcatggctgtcgtcagctcgtgccactgccggtgataagccggaggaaggtgaggatgacgtcaagtcatcatgcccccttatgccctgggcgacacacgctgcaaactccgcctgcatgaagccggaaatcgctagtaaatcgccgggtcagccatacggcggtgaattcgttccccgggccttgtacacaccgcccgtcacactatgggagctggccatgcccgaagtagcccgtactgggaaggtggcggctgggatcacctcctttttcaggagagctaatgcttgtggggagctacttttttcacccccatccatgtcgccacacgggggcgacatggatgggggtgaaaaaaggaaagagagggatggggtttctcttgcttttggcatagcgggccccggcgggaggcccgcacgacgggctattagctcagtggtagagcgcgcccctgataattgcgtcgttgtgcctggactgtga

SEQ ID NO: 74761 - DNA, 174 bp, Glycine max
  Peptide Sequence Number=SeqID_166446
atggaagaaaactctcccaacttcccttcttctccaagacacacgccctcaaaaggtcctccaatgactgaatggtccgttcagtttgtccatcaatctaaggatgctctcccaaaatctagaggtgaatctaggatctctatcagatactatgctagatggcacaccatgtaa

SEQ ID NO: 74762 - DNA, 468 bp, Glycine max
  Peptide Sequence Number=SeqID_166447
atgagaggtgcactgacggaggaaatcatcgcgcctttcatcgcgcgagggttcaatgaagctaatgtgaagatacttcagagaatccgtaaagtatggaatagagtggaaataaaagataaggagtttaggggaagtagcaatggcgtcataggcgactatcacaaatggttgaagtctagaaagcaagggataacttggctcccaaagctaaaaggcctaaatgggaaagaggctgaaattcctgaggagagcgaagaagtgcaagctttgaaagcaaagcttgaaaggacaagagtggtgaaggagaagctgaaagtggcagtcactagggtcaggaaagaatgtgatgaactgaaaaatatcaacatgaccacggttgaagtgctagagtgggaaaggaaaaaaggcccaaaaggaagaatggagaaggaacaagtttcagggggctttgtggggcagcagtaa

SEQ ID NO: 74763 - DNA, 347 bp, Glycine max
  Peptide Sequence Number=SeqID_166448
gaagccttctttacaacaaagagaagaacaagatgaaagattgcaaaaatacaagtggtgaggatgtctccttcacctctaggatctcacaatcactcacaaactcatctcaagctctcaaaccggctcctgcttcaagctctggtggccttgttcgtgctcgtgcgcttagcgcacttatggaccgcttagcgcacattattgaattttggcttaggggaggagttgtttgtgcacgacagggtgacctcgactcttactgcctaattttcctaagtgagagtgtcgtgtggacacatgtaggctatttccttgaggatggtatcacattgcatttgagagttgag

SEQ ID NO: 74764 - DNA, 276 bp, Glycine max
  Peptide Sequence Number=SeqID_166449
atgcccagggcacaaaattccacagacaccatagtgcctattttggggaaagagctctggaggcatcaagatgagcagcttttgcagagatacctaggttttgtgactttagcattgggaaatgtactattgccttacaacttgattgaagcaggattgaaacttagtcttataagagggatctacggattaagttttggttttaattatgttgttacaataatgctgtttagtctaggcctagtcttacaagagggatctacggatgaagcttag

SEQ ID NO: 74765 - DNA, 438 bp, Glycine max
  Peptide Sequence Number=SeqID_166450
atgggaaggagggaagaacaaaaatgtttaaccctcttggtatctgagaatcacttaaaattagtgagaaaaattgtttccgtgaagaatccatccaagccgaggcgctttcgtaacgattacgtaggtgatttcgggaagattttcaagtgttcattgtcgtttgtcgtttgttcttcgtcgttcttcggtcttcaaccggctgcctctcttgtgacgaacgcgtggggtgctaatgccttccccgtgcgtaaatacaactcccgaacctttcacttaaagttcgtagataacgtctttttccggtttttccgatgttttcctcaaataaatgttggtggcgactccgcgcgtattcctttcttggaagatgcacccgcgagtcacgcgtcgccctcccgccgaagggtaggttgcgacagttggcgactccactga

SEQ ID NO: 74766 - DNA, 186 bp, Glycine max
  Peptide Sequence Number=SeqID_166451
atgtaccctccacttgaactgatccacaagagatgtaccctctcttgttctcagtataacaatccccaagtagatgtaccctctacttgtaccacaaaggatggagaagagaggcacaaaagaattcaggcgattagtctttctgttcttttggcaaagggagaagagaatgaaaaagatgaatag

SEQ ID NO: 74767 - DNA, 80 bp, Glycine max
  Peptide Sequence Number=SeqID_166452
atgcatgctagagatgagatgtgtctgccatcgccttggccttggctaacaatcggggaagttcttgactcccgttcaag

SEQ ID NO: 74768 - DNA, 249 bp, Glycine max
  Peptide Sequence Number=SeqID_166453
atggctacaccacccagctcacctcctcctcctcttgagtcagcaacaccttcttcaccgtacaccaattggggtggagagacactagtggttcatgttgatcctgtcactgggaaagccgatggtccccatagaaagaaattaagaacatatttggggattgtcgctcgcgataaggtggatgttacacatgataattggaaaaaagtgtctgtcgctcaaaaggatctgataagggaggatattcaa

SEQ ID NO: 74769 - DNA, 90 bp, Glycine max
  Peptide Sequence Number=SeqID_166454
atggctgaggagcaaatgaaagtgtctgagacaatggctgagagacattctaaggcggttataaataaccgccttagaatgtatgagtaa

SEQ ID NO: 74770 - DNA, 366 bp, Glycine max
  Peptide Sequence Number=SeqID_166455
atgaagtgtctaactataccagttagagaggaagaggattgtgaagatgtcaaactaaaacccaacgatagaagtttcaggacctacttaagcaatgaagagatagacgcaaactctcaaattgattcttctgaagatgtgtccgccaaagcaaacaccaatggagctgcactgagtgctgattgtagaacatctagtggttctgacattacattgtcaatggaaagaaatgagctggtgagtgaaattggtttattgaagaaggaggcagaaaggtcacttgatgagctaactaggatgaagaatctcaagtatgaaaaagagatggtgggtacagtgttgcagtcagaattagaagcactttga

SEQ ID NO: 74771 - DNA, 249 bp, Glycine max
  Peptide Sequence Number=SeqID_166456
atggcttctccacctgcctcgcctcctcttcctcctcctttagacgcatcagcttcgctgtctgccgtgaagaggacatgcaaagcctcacttctacgatccttgtctaccagaccacccggtgctgacagaccagtggtccacgttgatcctactaccaacaaggctgacggtccccatagaaagaaattaagaacatatttggggattgtggcacgtgataaggtggacgtcacatacgagaactag

SEQ ID NO: 74772 - DNA, 453 bp, Glycine max
  Peptide Sequence Number=SeqID_166457
atggttgctgttgtcagagtcatctgctttctccaatgggtttggatcattccaaataataacaaagttttacggtggctctttttctgtaattggaatttaaccggcgtcaaaggccttagggacggttacctaaaatataacaacgtgaactacattgtcaagaaaaaaaaattggaaaaagaattaaataagtgtacaaaaatactactgcgcccctgtaagagttgtgttggtgaccttgaaaagagtgaagcaaagttaccatgttatcccatcactttcgtgcacacaaaaggggggtctgtttctaatttgatgccgccagatgcattaccgagtccagggatgtcgccaataggagaagtgattccccttgtgaagccgccagcagtagcagcgagcaagcagtcccgccagcagcaggagcgagatgctccacgtaggcattga

SEQ ID NO: 74773 - DNA, 354 bp, Glycine max
  Peptide Sequence Number=SeqID_166458
atgagcggtccaagagtagtaagaaaagcgcaaggttcaaggaccaagaggaggacttcgtttggagaagaagcggaggaggtcaacggcgatggccttctcgatggggaacatggttttgaagaaaggtgtgaaaggttccgttgtagcagtgaagaagaaggttcaggagaaggtgacaaatcctttgttcaggatcagaggtgcgctgctgctaaagcgggacttgacgcgattcgtgaagtggccaaagaacatccatatccaacacaagaagtgcatcctcaagcagagactcaaggtccctcccgtactcaaccagttcaccaaaaccctccacaagaatctcggtaa

SEQ ID NO: 74774 - DNA, 471 bp, Glycine max
  Peptide Sequence Number=SeqID_166459
atgactaaatataataaacttttggctaagtgggagaggtctaatacattgaatttgattgctattaagaagaccatctctaaacatcttctaagtggtctgccaaagaaagcgatagttaaggagttcctcgatgctttaggaaagagatatcaaggttcggaaaaccaagtaaaaggtcagcatcgcaatgtaggaggtcctaagccaactatctttaagaaatctattatcctgtcaactagagagaagaaacctgctattggtgatgactttcaagtctatcttagtgagtatgcatgtgacattagagatattgttgatccaaagatcgatcaagaagttgtttcttgccctcaatcacaaatttggaaacatgtaatgaataaagagatgcaatctatgttagttaatggagtatggaagctagttgaattacttcagaattttaaggcaatcgattgtaaatag

SEQ ID NO: 74775 - DNA, 387 bp, Glycine max
  Peptide Sequence Number=SeqID_166460
atgcttacggatcacttgatccgtaaacaactccaagcttccctgctccgacatcaatggcggaaaacgattgaaatgcctacctcgacgatcgacgctgacgatgctagacggtggacgctggaagaagacgaagatggtagcgcgcgaggaagaacaatggctggctgcaagaagaatgcgacgaagaagaagaagaatgcgacgaagaagaatgactttgtggggggaaagaagaagaatgcaaggaagaagaggctacaaggaaggaagaagacgaacgcggggaagaagaagagtgctgggtgtgcgaggaggagagagagagtagcgggagagagagagtcagacgttttttttttaaaattaacccaaggacataactga

SEQ ID NO: 74776 - DNA, 363 bp, Glycine max
  Peptide Sequence Number=SeqID_166461
atggaagttcctttggtaatcacagtccatctgggtttggtggcgtgcttcgtgatactttggaaaattggatttcaggatacttggacactagtgatttttcagcaaataccaccattgcagagctttatccaatatggtcttaaagtggctaaagaagttgattgcatacatgagttatatatggttgtttatccttatgcttccattgtggatgctattcgatacttcatgcaattctcttgggatctctccttcaagcatacgttgagacaatacaattttgttgcggattcattggcaaagaaaggagccaagtgtagctttttcacaattcctttcgtctcacataaaactgcttaa

SEQ ID NO: 74777 - DNA, 1746 bp, Glycine max
  Peptide Sequence Number=SeqID_166462
gatgaaacaatgcattcaggggtggatgtggaagctttccaggctgccctaaatagagatataggtggagctgggtctacttcacagttttctggttcagatgcagtgctcattctttatgctgctataattgctgcagtgttgtctcaaggaagcaataatatatcaagtcaatctttatcacagtggcctacttctaaccatgacacccaaactgactgtcaaaagcaagaatctaaaactgcacaacagcaagagcaaccttcatctgaggtggaactgaagcagcacggatctcttgcggaacaactacagcatgttgcttctcaggacataaatactcctcatttatcacagaaacaatctcaagatgaatgccaccaagcaccagctgtacaagtttccctccccaattctcaagctatcggaattcagaattctggaaaagatccagtccttaataatgaggtagtaaagaatcataaccccagcagtgaatctcagtatgcaaagttgcagcagatgagtaatcaacaggctacagtctctgagcagccgagtagtcaaggaaatcgtagtactagtaaacaagtaccatttggcatgttgctacccatcttgcttcctcaacttgccaaagacagagccatgcaacttcaaactttatttgctaaattgaagaaagaggagataccgaaagacagttttgtgcggcttatgaaaggtatcgtaggggatcagatgcttagattagcattagcaaaggtgcaagtgcaaccacagataaggcccaatcaagcatctgctgggcagcagcaccctatgaggatgccaactgttggttcaggtgcaaggcaattgaatgatccccatgctttagcacagatgcaccagagaagtatgaatgctgccgttgaccaatctcgcatgggttcttcggctggccatactatggagagcaatgctagaaaatctcaggaactggatgttaaattagaatctcaaggattgcaaccaagccaattgacatcttccagttccaacacagttggccaagaaatcgaaagaacatcagttcacatacaagggcttaataagcagcagcaacaacatctacatttcccatcagcatatggaaatagtggtgttaactataaccctttttctgggacaaccagtagttccacttcatctatcaaatcacaatcgcatgattcacacatgagtcaaattttgcatcaaagtattggttcaaatcatcacttaagtgggtcaacacatggtttgaatgtaattggtatgccaaaacttgaacagcagaattcttttaatgatcccaagagactgccaggtggatctgtgtctcctgctgtaaacaatacagtgtctcaacaaactaaaaatgcttggcaaccatcaacaaacaaagaacaaaatctgggcttaatgtcatctgtttcttatgtcaaaaaggaacctagtgacttatctactgagcagcaaaataggcatagtttgtctaaattgcatgggtattctcctgttaattctgctcagcttgaacagggtggtgctagtcaaggaactgtaaaggatgagttttcaagaggtcaagcacctccaagcatgcctcctacatctactggcttgctgccacaaagttctgcttccccttctgtaatgacccaactagaccccagtgtctcggtaagtttgagaccgaccgatgtatgtgatcttgtctaa

SEQ ID NO: 74778 - DNA, 2325 bp, Glycine max
  Peptide Sequence Number=SeqID_166463
atgaagaagccaccgattttcgaacctcttcaaattttccttctcctactaatcttctatggcagcaacacaaaagcagagaagcaaacaacccacgaccatgcaaacaaaaagacctacataatccacatggacaagtccactatgcccttaaccttcaccgaccaccttagctggttcgactcctccctcaaatcagcgtccccctccgcagagattctatacacctacaaacacgtggcccacggcttctccactaggcttactccagaggacgcagacacactttctaaacaacccggaatcctctccgtcatccctgaactcaaatacaaactccacaccacaagaaccccctccttcctcggactcgacaaagccacaaccttgttacccgcctcggagcagcagagccaggtcatcatcggagtcctcgacaccggcgtctggcccgagctcaaaagccttgacgacacgggcctcggcccggtcccttccacctggaaaggccagtgcgaaattggcaacaacatgaactcatcgaactgcaacagaaaactcgtcggagcgaggtttttctcgaaaggctacgaagccgcacttggacccatcgacacaaccacggagtcaaagtcagcgcgtgacgacgacgggcacgggagtcacacgttaaccaccgcggcgggctcggtcgtacccgaggctagcctcttcggcttggcatcgggcacggcacgtggaatggccacgcaagcgcgcgtggcggtttacaaagtgtgctggctaggcggatgttttacctccgacatagccgcgggaatcgacaaggccatagaagacggcgtgaatgttttgtccatgtccattgggggaagcttgatggagtattatagagatatcatcgcgattggttccttcaccgccacgtcacacgggattctggtgtccacatcagcaggaaacggtgggcccagccaaggaagtttgtccaacgtggcaccgtggataactacagtgggagcgggaactatcgaccgtgattttccagcatacataaccctcggaacagggaaaacatacaccggagcttctctttacagaggtaaacccttgtcggattcgccgcttcctcttgtttacgctgggaatgcgagtaactcttctgtagggtatctttgcttgcaagattctctgattcctgaaaaggtatctgggaaaattgttatatgcgaaagaggtgggaatccgagagtggagaagggtttggtggttaagctcgcagggggtgctggaatgattttggctaacagtgaagcctacggagaagaattagttgctgactctcatcttctccctgctgcgtctctgggacaaaaatcaagcgagattttgaagaactacgtttcgtcatctcctaatccaacggctaagattgctttcttagggactcatttgcaggttcaaccttctccagttgtagcggcttttagctccagaggacctaatgctcttaccccaaagattctcaaaccggatttaatagcgccaggtgtcaacattttagctggctggaccggcgcggttggaccaaccggtttaaccgttgacagccgccacatcagctttaacataatttctggaacatccatgtcatgccctcacgtgagtggcttagccgcgattctcaaaggcgcgcaccctcagtggagccctgccgccattaggtctgccctcatgacaacagcatacacaagttacaaaaatggtgaaacgattcaagatgtttcaacaggacaacctgcgacaccgtttgattacggagcaggacacgtggaccctgtggccgctcttgatcctggtcttgtatatgatgccaacgtggacgattacttagggtttttctgcgctttaaactactcgtcgtttcagatcaaacttgctgcgaggagggactttacgtgtgactcgaagaaggtttacagagtggaggattttaattatccttcttttgcggttcctttggagacaacttcggggattgggggaggttcggatgctccgaagacagtgaagtactctagggttttaactaacgtgggagctccgggaacgtataaagcttcggtggtgtcgttaggggatttgaatgtgaaaattgtggtggaaccggagacgctgagtttcaccgagttgtacgagaagaagggttatatggtgtcgtttaggtacacttcgatgccgtctgggacgaccagcttcgcacgtttggaatggacagatggaaagcatagggttggaagtccaattgcgttcagctggacatga

SEQ ID NO: 74779 - DNA, 783 bp, Glycine max
  Peptide Sequence Number=SeqID_166464
atggcggacgccgaactttctcccgctagcatggaccgcctcgaggccgccttagccaaacttatcctcagtcaactcaacctcgccactgccgcatcgataccagccgccatcatatcgactccgttcatgttgactccacggctcatgctgactccgccacccatgtcgactccgctgcccatgtcgactctgtcacccacgtcgactccgccgctcatgccgccttcgattcccatgccgactgggcctccatgtcctgcacccgtgcaaccattccttccaccattgttgggtccacttcctatgcctgctctttatctgcctaatctcggtctcgttcgcaccgccatttccttcaacaagcgcatcaacactattcctctttatgaccatgcaactgtttcgaatgacaagccttggaaaaataaagacatggcgctatttgagatgggacatgtgtcctatgagacttccatggtcgtatacaagctccaaccagttgcctttgcactatgcacaactgctaaacaaggtgcaattcgccggaatagaccttgggatcccggtattgtttttggaagccatagtttgaagccccaacaccttgaggataaggtgtttttgatgggacagagaatgttaggaagtgataaggaaccaaagacagcagcagagaacatattcacgaagccagaagcaagagtgcaaggagagatgcaagaagtaaacaagcccaaaagaaaaattacgaaatcttcatactttaaggatttcgtatga

SEQ ID NO: 74780 - DNA, 288 bp, Glycine max
  Peptide Sequence Number=SeqID_166465
atggtattgctctttctcaccaatggcattctagaccatgacaacaatggtattgatggcgaaaaccacgtcggatgtctgaacctcggtgtcaaagaaccgaatgtcccgagtcaacgtagcctccagaacctaggtgtcggaggggatgaagctcgaaatgatggcatggggattgctaagtgcatcttcccatcttctcctgcagttgtggtgtatgttgatggcagtcgtgttagggttatgtggctcgtcgggggtgacaaatcaaagctgctagtgatttag

SEQ ID NO: 74781 - DNA, 1026 bp, Glycine max
  Peptide Sequence Number=SeqID_166466
atggatcccataatttggagcaaattgccacccgaaatcctcgaatacatactctcttttcttcctctcaaaaccttcttaaacctaagatccacttgcaaaggtttctggtctctcatattctctcctcctttcatttcgaaacactgttctcccactgcttcttcacccttctcttcattcctcttactctcacaccctcaattccaccgtcacttccctctctacgattgcacactcggcacgtggcgcaatttctctctctcactctctgattcattccactcttttccttctttcagcactcttatctcctctggtggtctcttttgcctatcagattccacatcatgttccttgctcgtgtgcaaccttttggccaagtcctctagaaagattcaatacccaagtttctctcttcacttggagcatctcacttttgtcaccaccccaactgggtacaccatatttgttctattttctgaggctgcctcaaactgtgcctttgtttatgactcaaaggttcaaacttggaaacgttttcgcggttttgctccggttctcggtgacaaccatcagcaacaaggtgttttgttcaatgggggtttgtattttgccaccccagaaccgttttctgtggtgatgtttgatttgaagagtggaaggtgggagagacccgtttgggagttaccgagtcatcacctcacttttgttcgattggtgagtgatggagggggaaaattgtacttggttggtggggttgggagcaatggaatatcaaggagcatcaagttgtgggaattgggtggagatgggaattattgggtggaagttcaaagtttgcctgatcttatgtgtaggaagtttgtgtcagtgtgttaccataactatgaacatgtttattgcttttggcatgaagggatgatctgcatttgctgctacacttggccagagattttgtattacttgctttctaggaggacttggcattggcttccaaggtgttgggattgtgttaggagttga

SEQ ID NO: 74782 - DNA, 234 bp, Glycine max
  Peptide Sequence Number=SeqID_166467
atggaatcaaacggcacacttccctctgcaccagaaaccaataccataaagtcagattcagggaacgaaagggcaatgcagacaaccttcaacaataagccttatcccactaggccagagatgagcaaaaagaaagacagtcatttgggttgctattactgtgtcactgctacatcgatcaaaggtataaaaacctcactttgtccctctatctgttgtccctttaagtcttga

SEQ ID NO: 74783 - DNA, 1181 bp, Glycine max
  Peptide Sequence Number=SeqID_166468
atcaattggagtggacttcattcattgatgttttagcacttttggtgttcgaggtcgtcctctttccaaatgtggatgggctagtggatctagcggcgatgggcgcttttcttgcttatcaccacatcaaggaaagtctagttgttgatgttttggccaatgcctatgacacgtttgaccggagatgcgagaagagtagcgtgagaattgtctgttgcacacctgctatttatgtatcgctggtctctcacatttttcatcatgaaagtagacctgtctgtcccctacaaggtcaccgcatgtgtgccaagaaagggaaagcaaattgggagcagctcttggcggatgtacttgccataagacaactaggctaccccatgagcggagtgccatcagaagagcgtattgcacctttcatcgcacgaggtttcagtgaccccaatgcaaaaatgcttcaaagagtccgaaaagcaaggaatgcggtgcaaaggaaggataaggagcttagaggaagcagcaacggagctgaagtccctgaggaaagtgaagaagtgcaagccttgaaagtgaaacttgaaagaacacgagtggtcaaggaaaagttcaagaaaacaaccattagggtcagaaaagagtatgacgagctgagagacgggctttatggggcagcaacaacggactcaagcttcggaggactgaaagggacgagtccaaggtcgaagagcagcttgaccgaacagttgagtaggacgaaagagaacatgtgggctatcattgaccagtataaagagaagctaaatctagctgctagccatgagcaaaggctagaggacgagcatgcaaaagtatcagtcctgcaagaggaaagggaagcaagggagagcgtgatagattcattacacagagaagctatgatgtggatggataggctcactttcactttgaatggaagtcaagatcttccaagactattagccaaagccaaggtaatggcaaacgtgtactcggctcctgaggaggccgatatggaggccatgaaagatcagatgacctctatgatggaggccatgaaggatccgacgcacccatctgccataaaccaagccaaccaaccaatcctagacatggtaagacagggaggaaaggtgttaggtagcacgagcggtcccttcatggggtaa

SEQ ID NO: 74784 - DNA, 435 bp, Glycine max
  Peptide Sequence Number=SeqID_166469
atgagaaagcgccacgcttcccgaagggagaaaggcggacaggtatccggtaagcggcagggtcggaacaggagagcgcacgagggagcttccagggggaaacgcctggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagaaacagctatgaccatgattacgaattcgagctcggtacccaagggatgtaccctcccttgttctctttgaacctagtggatgtaccctccactagaactgatccacaagagatgtaccctctcttgttctcagtcaaacccaagtag

SEQ ID NO: 74785 - DNA, 452 bp, Glycine max
  Peptide Sequence Number=SeqID_166470
atgggatcgagtcagtcgccttcgcttaaaaagaggttctatcaagtcaaggtcaagagcctaggagtcaccagtcttaaagaattagggcagttgatgggtcagctccagcaacaagctcttcgtaaagcttacggtaagatctgggacctagccatggcagaggtctccactgaggccattgcctccttcgtccaatattatgaccagccgttgagatgcttcacctttggggacttccagttatcacccatggaaatgtttggaagcaaaagcaagagtcttggcaggcagcgatcgacgcttttctcgcctttcatgaccgcaaggaaagcccagttgtcgatctatatgacaccttcgaccgaagatgtgaaaagagcagtacaaggattgtttgttgtactctggccctctacgtatggttggtttagcaccttttccgccaagag

SEQ ID NO: 74786 - DNA, 240 bp, Glycine max
  Peptide Sequence Number=SeqID_166471
atggtcatggacatggctgacacatttggagaagattttggtattcatttcaaccaatggtcatccaatatcagagcaggatttaatcatatacactttaaagaaagattctcagagcagaatccttgcagaccaaccttggaagggatccagatctcttcccttgatcaaaggcagaaggaaagccttgttgatagactcactgagctggaaatcaagtctgcagtttggccttgctag

SEQ ID NO: 74787 - DNA, 63 bp, Glycine max
  Peptide Sequence Number=SeqID_166472
atggctgggacgccacataaagcctcatcttctattcaagaagaaagtgacaaagatgactag

SEQ ID NO: 74788 - DNA, 114 bp, Glycine max
  Peptide Sequence Number=SeqID_166473
atggagggcactgtcaaggaggaggaagaaagggcttatcctataactgccaaagcctctagtaatcgattacagcctatggtaatcgattacaatggccttgttctatggtaa

SEQ ID NO: 74789 - DNA, 387 bp, Glycine max
  Peptide Sequence Number=SeqID_166474
atgcagagatacattatgattatccacaccttttgtcaaccagaggcaagcgagcccgttgacacgcagagactaatgtcgtcatctgcacctttctcatccagagacggcgagtctgatgacataagtagataccttatggttatccgcaccttttgtcaaccagaggcaagcgagctcgttgacacgcagagactaacatcgtcatctgcatctttgtcatcaagaaacggccagtcggatgacatgtggagataccttatggttatccgcaccatttgtcagccagaggcaagcgaacccattgacacgcagagactaacctcgtcatctgcacctttgtcatccagagacgacgagtccaatgacatgcggagatacattatg

SEQ ID NO: 74790 - DNA, 1008 bp, Glycine max
  Peptide Sequence Number=SeqID_166475
atgataaaaaagctttcgccgacgggcctcggcgtggccgtgatgctgcttggaatgctgctgtttgcgttgaacgacgccatggggaaatggctcgtatcgacctacagccagggccaggtgatccttatccgaagcgccgcggcgctggtcatccttgttccgatcgtctggagagccggcctctccggcctcgtgaaaatcgagcggcccggccttcaggcggcgcgcgtctttttctccacggccgagcttttctgtttctatttcgcggtcgcggcgctgcccctggcggacgtcatgacctattggctcgcggcgccgatttacgtggctgcgctctccccgtttctgctcggagaaaaggtcggctggcgtagatggacggccattggcatcggttttgtcggcgttctcatcgcgctcaagccgagctcggcaagcctcacctccgctgcactcttttctatcctcggcagcgctgcctttgcattcatgatgttgtccggccgccagctgcgcaatacgcccgacacggtgctcgccttctggcagatcatcggcgcggcgcttgcgggcattgtcgccgtgctcgtcacgccatcgggatggctgccggtgcaatccggttttgatcttgccttcctcggcctgctcggcgtcgtcgccatggcggcgcatgtgctggtcaaccgggcgctcaaacttgccgatgctgcaacagttgcgccgctgcaatatacgctgctgctctgggcggtcatttttggatggctgttcttcggcgatgtgccccagacaagtatcgtggtcggcgcgggcctgattgttctttcgggcctttacatcttctttcgcgaaaatacgctcaaacgccgtcgcgaaaccgccgaagatctggccgcacagcagggagtaagaaggggccctgcgatgatttgtctcgcaagggcagatgaaacaaaggtgccgggcccctctggcgagagttttacggcgctctcgtga

SEQ ID NO: 74791 - DNA, 393 bp, Glycine max
  Peptide Sequence Number=SeqID_166476
atgaaacccccagatgtccaagaggatcacatatttctgaaggcttttcctcattcattagagggagtggcaaaggactggctgtattaccttgctccaagatggcctccaactcccagcagtttagcgccagaaaatgatgccatagtcattagaggagtgcatgaggtagctacaaacccatctgcatcatctgaaactaagaagcttgaaggcaaactggatgcgttggtcaacttggtaacccagctggccttgaatcagaaatctgtacctatcgcaagggtttgtggtttgtgctcctctgctgaccaccatacagacctttgcccttccatgcagcaacctggagcaattgagcagcctgaaggttatgctgcggggatcctctag

SEQ ID NO: 74792 - DNA, 461 bp, Glycine max
  Peptide Sequence Number=SeqID_166477
gtggtcattgcaaagaggttcgtgcttgcaaggtgctcaaggtggtgactttcagtccgttggtgctcgcaatgtgctcacaaggtgcttcgtgctcccaaggtagagatgctgagttttgggcagaagtcacaatcattgccagaatgcaccacctcaacttggtgaggctgtggggattctatgctgagaagggccaaagggtacttgtctatgaacacatccctggtggatcattggacaagtacctcttcagggtcaataagtatcataacaataacaatcttaaggagcaatcaagcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 74793 - DNA, 165 bp, Glycine max
  Peptide Sequence Number=SeqID_166478
atgaagatctctccaaattgcacacggtcgtcaatgtctcaacatatttgttatacagttgtggattcttattttaacgatgttagaccattggaagtagagagattgaaggcgcttcacatccagtgggcacaattttatctcaaagttagaaatcaaagttag

SEQ ID NO: 74794 - DNA, 332 bp, Glycine max
  Peptide Sequence Number=SeqID_166479
cgaggaagcggaagagcgcccaatacgcaaaccgcctctccccgcgcgttggccgattcattaatgcagctggcacgacaggtttcccgactggaaagcgggcaggagctgtaggggatggccataggcctatcttgaattctgatatgaatgggcttgtcgcattgccccgcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 74795 - DNA, 441 bp, Glycine max
  Peptide Sequence Number=SeqID_166480
atgagcgagggagagagaaacctaccggtgagaggaagaaaagctacggagagggagctggtagctcgtgatgctgctgagagggaaagagagagccacgcatgtgcgctgagagggagagagagagagagctggtggtgtgctgagagggagatagcgctgctacggagaaagagagagagagagctggtggtgtgtttctacggaaggaggaattttaatttctttttcttttgcaccaaaccacaagacaatggaggcgaaaaggtgtgcggaatgaccataatttgtcttcgcccagctctcgacttactgtttttgaatgacaaagggcacagacttgtctctacatgtttatcacccaacttgcaaaatttgaatgacaaagggcgcagaatttatctctgcgcgtttatcacccgccatgctgctcctgaatga

SEQ ID NO: 74796 - DNA, 362 bp, Glycine max
  Peptide Sequence Number=SeqID_166481
atggggatgagtggttacattaattataatcctatgctggccataagacagttaggctaccctatgagaggtgcgccgtcagaggaaatcatcatgcctttcatctcgcgaggttttaatgaagctaatgcaaagatacttcagaaaatctataaagcatggaatagagtgggaagaaaagataaggagcttaggggaagtagcaatggcgctgaaattcctaaggaaagtaaagaagtgcaagcttttaaaggagagcttgaaaagacaagagtggtgaaagagaagctgaagacggcagtcactagggtcaggaaagagtgtgatgagttaaaagatatcaacatgaccatggttgaagc

SEQ ID NO: 74797 - DNA, 198 bp, Glycine max
  Peptide Sequence Number=SeqID_166482
atgactggtgctacagcggaatggagaaggaagagacagaggacacgccaattcaaggagaagatgagtctagaagaagctcaccaccataggaggtcatggataagagcttggaggaagaaggagatgaatgaagggagtgaaagagaagagcacgaaattttatgctctaaaagagctctgaaatctgaattttaa

SEQ ID NO: 74798 - DNA, 519 bp, Glycine max
  Peptide Sequence Number=SeqID_166483
atgcatattttgttatcttatgacaagaacagaatcgtcttaggcaatggtcagatgtcgggctggatccagaggcagagaccaatcaaggttagctcgcctgggcgagctgagcttgcctgggtgatcgcctgggtgtatgccatcctgacacggatgagtgcccacgtggcccaggtgattgctaacgccatctatttttttgcaggtatgccacccaccaggcaccctctagacccggataagtctaacaaggccctgggatttccggcattgatcacgggcctctgccattcgttcgaggttcccgtcacccccagtaaggtgatccaaccgccgatcacccgggccttcattgagaagtattgcacgcctaggcaggcgcagggtgatgcacctcaggccgcagactcaccgccaccacctcatcaggccgatcccgctggatcactaggcatggagcgttatctacagcacttggttcgccagcaggcggccaaccaccgggggcaggtgtag

SEQ ID NO: 74799 - DNA, 729 bp, Glycine max
  Peptide Sequence Number=SeqID_166484
atgatgaccccaccgaaagcggaaaaacgcccttatcccatcaccatccacggcgacacgcgcgtggatgactattactggctgcgcgacgacgagcgcgcagaccgccaggtgctggactacctgcaggcggagaacgcctacaccgatgcgatgctgaagccgcagcaggcgctgcgcgaaaccctgtacgaagagatggtggcgcgtattccgcagcaggaacattcggtgccttacgtgcgccacggctatcgctatcagacgcgctatgagccgggcaatgaatacgcgatttccgtgcgccaaccgcaggccgagagcgagcgctgggaggtgcttatcgacggcaaccagcgcgccgagaatcacgagttttacaccctgggcgggctggacgtcagccccgacaaccagcggctgggggtggcggaggatttcctgtcgcgccgccagtatgacattcgcttcaagaacctggccgacggcagttgggcggacgaagtgctggagaacacctccggcagcttcgaatgggccaacgactcctcgacggtgtactaccgatccgcagcaggacgagctgatttacgaagagctggacgataccttctacgtcgggctggagaagaccacctccgagcgctttatcctgatccacctgagcagcaccaccacctcggagatcctgctgctggacgccgaccgtgcggacgccaagccgcagct

SEQ ID NO: 74800 - DNA, 87 bp, Glycine max
  Peptide Sequence Number=SeqID_166485
atgtcgtcggaaatggcgccgaaaacttgttcgcttctggcaagtgcaccagatcatgcaagtagtataaaacgatgtgtaaactaa

SEQ ID NO: 74801 - DNA, 105 bp, Glycine max
  Peptide Sequence Number=SeqID_166486
atggaaaaaggtcgaaggtctgcgaattttgaaaatgagggttcgggagtcatttatgcacggggaagagtttacaacacaaatgatcggtcgaaacttatttaa

SEQ ID NO: 74802 - DNA, 90 bp, Glycine max
  Peptide Sequence Number=SeqID_166487
atggcaaggtatcaacggctcacaacgacggcggtggctttgcctccggtgagagacccacataaggtggcccctttgcctccggtgtag

SEQ ID NO: 74803 - DNA, 570 bp, Glycine max
  Peptide Sequence Number=SeqID_166488
atggatctggaacgtgcaattgttcaaaactctgataagaggaaagaatcatggaaaacggtgctaactctggcatatcagagtcttggagtagtgtatggagagattagcacttcaccactttacgtgtacagaaacacatttgctgaagacattggtcactcagagaccaatgaggagatttatggtgttttgtctttggttttctggactctcacattggtgcctttggttaagtatgtgttcatagtgctgaaagctgatgacaatggcgaaggtggcacgttcgcactgtactctttgctgtgccgccatgccagggttggcttgttgcctaattgtcaattggcagatgaggagctctcggagtacaggaggaacgactgcggcgtggcaccagagagaagccttgccttcaggctcaggtccttgttggagaggtacaaggtcttgcagaggattttgctggttcttgctttgttagggacttgcatggtgattggtgttggagtccttaaacctgctatttctggtgattatgaaaagttttcttttctttttttgatttga

SEQ ID NO: 74804 - DNA, 405 bp, Glycine max
  Peptide Sequence Number=SeqID_166489
atgaaggacacgagaggtgaatgggatgaccgagtctttgatgccaagacgaaaggagtcagcagtggcgcagtcagcagtggcgcagtcaacataggagaagatgtgtgcccaattaatacctggggacctttcggatgccttggctgcactataaaatctaacatggtatcagagcaggctttgactctgggacctcgtcttcgcttctgctgcgacaagcacccaccatttgtggttcacgcaccaagcccaataagtgttgggcgtgaagggggtgtattggaaaaatatcctagtcccacatcggctgcctcaatccttggaggtgatagatacggtgatgaggtacctacttggaagaaatctgatacttcaccactttcttcttggaaagcttcataa

SEQ ID NO: 74805 - DNA, 918 bp, Glycine max
  Peptide Sequence Number=SeqID_166490
atggcctctttctcactccacgaaaatgcacctccggtgatattgatgatacatgcaggagccatcagccatgctcatgtgggatctgcatctgtgttggttggtgatattgatgatgcattggactctgaaaaaaggtacttgaaaaggggtgtgaatgatcgggggagggttgctaatgatgttgagacagagcagattgtccttgatgaagaatcaggctcttgcaagggaaagatgagttcagttgtgcaaatgcgtggatcaataccacttttctggtcacaagaagcatccagatttagccccaagcctgatataattttgcagaggtatgatccaacataccaagcaacaaaattgcattttgaagacctagctaagagatatggcaatccaattattgttctgaatttgattaagacagttgagaaacggcctcgagaaatgatgttgaggcgtgaatttgcaaatgatgttgggtatctgaaccaaattctaccagtggagaaccatcttagatttattcactgggattttcacaagtttgcaaagagcaagtctgccaatgttttggcagttttaggagctatagcaagtgaagcgctcgatttaactggtttttactacagtggtaaacccagcatcattaagagagccaacaagagcaatcaaacaagcacagggagggatacttcactgagagatctgagagctagttctgtggatcttgtgaggattgggaacagtaatgaaatgataaattctgtggttaatcaagacaaagagactgacatgaatttaaatatagctccatcattaagcaagaaaagggtgaatggttcagtgatccactcaccatcagagtttgatgcagcttcaatggcttttgagatccctctcctaacctatggttaa

SEQ ID NO: 74806 - DNA, 1305 bp, Glycine max
  Peptide Sequence Number=SeqID_166491
atgtccgccgccacacctaccaccatgtccaccacaactatcgaagccactattggcacgggtctacattcacagccctcagcacatcatcgtctgcgtttcgttgacaatggtgttacggtcatcaagctcttggctgtgtgttctacattcgcagccctcaacgcaggtcataaacccaaccttctccaccttcacggtacttaccagcctcagcctcacatagctcaagagctgttaaatttccctgatgaaaatctcacagtcaaacagatccaacaattcttggggattaataagaaggagaaaagaattattgctagtggactattcaaggaagctgagaaacattatcctattacattcaaagaggccttggcgatgccaccagatcctcaaattttaaggctcaaggattggttctccaagtatgatttttctgtgaaacacatacaaaggaagaataatttgattcttgatttcttatccagaccaaacaacaagatcgtcaaggtgataactttcactcactcctttccattgatattcatggcaaaaccattatctgaaatagccaaaactattaaggttttccctctaagattgattactcatactcctgcacacatccttgaatatgctaagtctcattactcccattttctgcatgaaaccatgagattcaaatataccccagcacaaatatttgaccctgagataccctttggagtacaatattcaatcctcatcgccatgaaacctttgatgacatacaacatgttgacagatccatgtaaagatgaatatcttttatggacaatgttagagtggttttctcctttagcatggtggcgtatgaagctaaaacaaattctagacattgagagacaaagaggaatctcagaagatcacataggaaaactagttggcgagacatctctgtgtctaggaaagaagctcaaatttaggaaacttttgaagcatatcccttggaagaaagttatggcaaccagctggcgagacatctctgtgaagtcaacaattactcatacagacctctggatccaaatctaccaaatttatgttccagaccctgagtttcaagaggtggaagatttggttgatgactattctgcattagaacaagaatgggaagactacaatgctcaattgatggaggaattgttacacaaaaagagatatccttatcaccacccagtgtacggaagtctcaccagatcaaaggataaggatgaccgtaatcctatccttgtcattgtgtgccacatgtcagtcgtcgtttag

SEQ ID NO: 74807 - DNA, 960 bp, Glycine max
  Peptide Sequence Number=SeqID_166492
atggatttcagcgagctgagaaaagcagtggaggaggttgaactggtggatggtcactcccataacatagttgccctaaactccacctccatctccggttttgttcaggcctttactgtgggagcctttgttgatgctgatgccattgcttttgcacaaacctctctatccttcaagagaagtttgagagatgttgctgagctatacggaaccgaggtatctttgcaaggtgtagaggaataccgtaaagcgtctggaatagaatccatcagctcaacatgcctcaaagctgcaaaattctccgccatactcattgatgatggcatagaaatggacaaaaagcatgacatgcaatggcacaaaaattttacaccttttgttggcagaatcttaagaactgaacgtgtggccgagcaaatccttgaacaaggtttgcctaatggatcttcatggacaatcgattcatttactgaagcatatgtctcaaagcttgatgaaagtaagaaaaaaagtatcaatgttttagctttgttccttagcatcactgttacagttgctaaagagatccatgctttgaaaagcatagctgcatactacggtggcttagaaatcaatttaaatgtgactaaaacggatgctgaggagagtctgaaagaggtgttaacaaatactacgaaacctatttttctactaaaatacaaaaattacaaaaatcttgttgactacctcttcttgcaaagtttggaaattgctctatcttatgacttgccaatgcagatacacacaggctttggggatagacttttggatttgaggaagaccaatcctcttcatctccgttcagttcttgaggacaagagatattcaaagtgtcggtttgttttgttacatgcatctcatccatactcaaaggaagcatcatatctagcttctgtttactcccaggcaaacattttatga

SEQ ID NO: 74808 - DNA, 210 bp, Glycine max
  Peptide Sequence Number=SeqID_166493
atgcctctgatgttgaataagcttggtctaagcgagtcaatctcgctaagcctaaggcaattcagttgttctaaattttgttcatgcgctaagcgagtccactcgctaagcatggcctctagaaagagaaagacaacaacctcccgaccccagcagccctatgataccaccaaattcatttctgagggtgcctgggagagatacgagtag

SEQ ID NO: 74809 - DNA, 402 bp, Glycine max
  Peptide Sequence Number=SeqID_166494
atggctgctagtgatcaggctattttgcatgatcggtctcatgtaccaacaaaaaaaagcctgctagagctttctttacaagatgcactattggcgcagaacaaactgctagctaaacaacttgagatattgacagagacacttattatgcaggttggaggttgtagcatatatggaggagcgcatgaatctggttactgtatacctcttgagtatgctgcaaaggaagtggattatatgggaaatcagcatagaccagggtttaatgtagatggatttttaggttatcagcaaggttccaattttaatcaaaatcaagggcagtggaggtctcatcctagaaaccagttcagcaaagaccaaggaggatcatccaaaatgcctcaaaatcaaagggcctag

SEQ ID NO: 74810 - DNA, 297 bp, Glycine max
  Peptide Sequence Number=SeqID_166495
atggaggttggtcagaattccagaatggccgagacaaaggggggtattcccactggtggagggaccttagaaagctgtatcctcagtctgaccacaacatctttcatcaaaatatggcttggaagttggaggtgggacatgaagtggaggaggaacttatttgatcatgaaaatgacttagcagtggactttatggaggaaatcacttctatccctattcagagacatgtgaaagacaccatgctgtggaaggctgaacctagtggaggaggcgggtcatctcttcttcaattgtaa

SEQ ID NO: 74811 - DNA, 483 bp, Glycine max
  Peptide Sequence Number=SeqID_166496
atgtataatatactaaccgaagattgcaaactccagtttatagggaagaaggctgtctatgctttgagtgagggtctgggtgtgatagcatgtattggggaactgttacaagaaagagaagctgggaaaactttcgatgtttgttttcagcaattgaaggcttttgcagatgtagtgccaagttgggataatatagttattgcatatgagcctgtatgggcaattggaactggcaaagtggccacacccgagcaagcccaggaagtccatgcagctgttcgtgactggcttaagaagaatgtatcggctgaagtttcatctaaaacgcgaattatttatggagggtctgtaaatgcgagcaacagtgctgagctcgcgaagcaagaagatattgatggatttcttgttggtggtgcttcattaaagggtccggagtttgctaccattatcaattcagtcacatccaagaaagttgcggcttaa

SEQ ID NO: 74812 - DNA, 1788 bp, Glycine max
  Peptide Sequence Number=SeqID_166497
atgttggggaacaaaaacattctggggcaagccttatttcctgtaaagggtgttgtagtggttgaaaaagttgcatcgtttggccttatgttcttcttcttcatatgttgtgttaaaatgaatatttccacattgatgaagattgaaaagctggccatcactgttgctatttctgtgttcgctcttacattggtaatccctactggactagccattctgttgaggaaatatgctacgatggacaggagccttgcacaggcactgccctttatggctctctcacaagccttaattgtatttattagcatagcaatgctcttgaaacatgtcaaattccttaacactgatataggacgtttaaccatgtcagcagcaatgtttgttgatatagctggttttaccttcacagtgattatttttgttgcactgcagaatcagagtggtagctttctgacactagcaggcctccttcagttcatagttgcacgcagagatagcaagattggggtcacaacattagtcatagtgaagcttcaaggaagacccaggcctattcttgttgataaccaaaaccaaccccatcatgacctacgctcaatgtcttgcaacgcaagtcacattgataatgcattgaggcaatatggacaacaaaatgaaagatgtgtatctgttcaatctttcacttcaatctccacatttgaaaccatgtatggtgatatttgtagaatttcactagacagtggatccaacattttgatcttgctattccacaagaggtgggtaagtgatgacaccgttgaaatttctcataggaccatccaaaccatgaacattaatgtcctccaaacggcaccatgtttagtgggaattctagttgataagagcatgttcaatccttctccttcactcttgatggctagagcatcattctatgtcgcagtgttcttcattggcggtcaagatgtcatggagacattagcgtatgccactagaatgggtaggcatcaatgtgtgtatgtaactgtggtaaggttccttctatttggagaggagaattctaaagatagaaaacgtgacggtaatcttatagatgagtatagatactataaagccagaaatggtaggtttcagattctagaagaattggagaaagatgagatagatatgtcaacatgtataacaacattgatagattattttgatctagtgatggtgggaaatgagcatccagagagttataatagagagataaagtctattgggagcagaaattcttatgggaatgatttgttgggtattctcttagatgagatgaagaaggagggtgctaccttcaatgtacaactagttatggatgaatgcaaaacatttttctttgttggacatgaaaccactgcactcttgctcacttggacaactatgttgctagcaagcaatccatattggcaagacaaagtccgacttgaagtgaaagagctcttcaagggggaaattccatcagttgatcaactctctaagctcactctgggacatgatgaatggagtgagtgtgaagagctaggggtcattggagacatgctaccatcaccaaattttgtgaccaaggcatcgttgttggtggtgcaacaacagagaataagagggagggaaatgctgggagtgtcagagaaagatgtagcatcatgtgtaacagggaaccccattgatgattgttggaaatgtgacccagattgggccaacaacaggcagaggctagcagatggtgcaattgggttcggtcagaactaa

SEQ ID NO: 74813 - DNA, 561 bp, Glycine max
  Peptide Sequence Number=SeqID_166498
atggatgaagccaagagaatggaagaagggctaaagacaacctataatgattaccataagggcgagttgaaacatgaaattgaaagaactaacggtaatggagattccattgagcatgacaaagacgcaaggattacccaagagggtgagtccgttcagcaaatagtggagcaagagcaaccattgctgatggtactagaagatgatgctgatgctggtggagcatatccacgcattgatcactccccatggaatggatgtacattggctgatttcgtgatgcctttctttcttttcgttgttggggttgctatagccctggcactaaagagaatccccaaagttaagtatgctgtgaagaacattatccttaggacattgaagcttctcttctggggtatacttttgcaaggtggatactctcatgcccctgatgatctatcatatggagttgacatgagatttatccgatggtgtggcattctccagagaatagcccttgtgtactgtgctgtagctctaatagaaacatacaccaccaagcttagacccctaccttga

SEQ ID NO: 74814 - DNA, 300 bp, Glycine max
  Peptide Sequence Number=SeqID_166499
atgaccatcaaaccaccatcctgtggccgatgcgaccatcacaatcccaacatcgtcattgtgacctcgatcccatcacctcaaaggcgtgtgtgtacctctctccctcaaatttgtggccctaatgctgtcgcgtgtctccaccaccactatatcaccatttgtgacctcgacagcgtcatgcacgctgtgctggttggtgcgggaggcggtgtgacgcagaggagatgggtagggtacttgactggttggtcgtgcggtggtcagggttgtggtgatgatgacatgcgcgaattttga

SEQ ID NO: 74815 - DNA, 378 bp, Glycine max
  Peptide Sequence Number=SeqID_166500
atggcttcagaattatcgactgacacaaccaagacaagtaccagttctgattcatcatcagcaacaagcaaggacattatagaagtgccctctttttaccaccgacaatgggcaccagaataccctaagtttgtcaacttaagatatgatggaacaatataccaaatcaggttaaggcagcatcaagcaaaagtctactatgcagaaggactaaaagaattcagaaaagatttatcaatttttgaatctgtgatgattaaattcttggcatgcaacaacaaatccatgtttgatctttatttcgttccctcactggaatgccatacttgcggaaggtcagaagttatgtcaagacaacaaacatatttggacaattga

SEQ ID NO: 74816 - DNA, 375 bp, Glycine max
  Peptide Sequence Number=SeqID_166501
atgtcatttgagaaagatggaaaatcaatcgtacttgttagaaatagcaacaaaaattctacaggcagtaaacacgcacacacacacaaatacgatatggttcaacaattttacaatatcgtcattgtaaaggaaattcttatgggggttgtgaagaggagagaaaaataccttgactcaagtggtctagagtatgcctcccaaaagaaggaagggggtttagggtctaatgttgatttgtggacttggagaagtggctcacacaaatcatatccagtgtgtgacatcgatattgaaacatgcataggtgtgggtcatgttttagtattgaatgatgacaacatgcacaggctcttgcagaagggtggtttttaa

SEQ ID NO: 74817 - DNA, 117 bp, Glycine max
  Peptide Sequence Number=SeqID_166502
atggcttccattgttgtggccatttgctctttcatgaccttcatgtcggccttcatctgctcttgcacctcctctatttcactcattactctaactctggcacgcgttcggacatag

SEQ ID NO: 74818 - DNA, 423 bp, Glycine max
  Peptide Sequence Number=SeqID_166503
atgtctcctccacctctagaacctcacaatcactcacagactcatatcatgctctcaagatggcttcctcttcaagctcagttctctgccattcttcacacagcaaagctctcaaaactctctggaacttggacctttctctctctagaaatctctaaacacgcaagagcttcgagaatttcccaaactacctctccatttctgatttcaggcttaaggtggccttgttggtgcttattcttcctcgtgctcagcggatggctcgctgagcaggcaaaatggcttagtgagcggatgaaaatcagcacttcacaaacttgcctaattaacctgaaaggaattggaaaagaggattggtgttatcccttgaagaatttgagtcaagaagcaaggggccaaccaccttacgagctattggactaa

SEQ ID NO: 74819 - DNA, 459 bp, Glycine max
  Peptide Sequence Number=SeqID_166504
atgcggccccgcatttcggttgcggcaatgatggtggcccgtgtgatgttagggcacgactatgagcccgaaatgggcttggcaaagaataatgatggcgtggccaacttagtggacatcaaggaaaaccgcggaaagtttgggctaggctatgagcccacgtggactgatgtaagaaaaagcatcgtggaaaggaggaataggggcgcgagcctgcaactaaggccacaaccgagggaggtccctccttgccatatcagtaaaagcttcgtgagtgcgggcttgagacatgaagaaaaagtcgctgtgatatacgatggggtccctcaagaacgttcagactgggtgtggccatgccttcctgattttcaattgggaaactggcaagtcgtggaacaacccgaagtttccatggcaggcacatgtaatgctttagttttactctacagttgggcctag

SEQ ID NO: 74820 - DNA, 617 bp, Glycine max
  Peptide Sequence Number=SeqID_166505
agaatttaaggtcctctgcccttaaatgcttaaccgagacttgcgctcccggttatggggccagtagtttccttttatcagttcctgggccaccccctaatattggagggcgaccaactgtgcgagcacaaccagagagggaggctatcacacagctactatgcataccggggcaagatttcactcgtgccgctgcaaagagacgagtgcgggtcatgcgcaccaacatgaccactcttacacagatatggatgacgttgctacttagcaacattccacccgatgaccacaatgttgatctaccccctatggaagtatcagttggtttgtgccgtcatgacatagggatcacgcccacgagacacctaggggacccggagaagtccaacagagccctggggtttccagctctggttacgggcctctgtcagtcctatagggtgcccatccccccagcaagttcatgccatcgtgacatagggatcacgcccgtaagacactcagtggacccggagaagtccaatagggtcctggggtttccagctttgattatgggcctctgtcagttctacggagtgcctgtcaccccccagcaaggtcatcaagccccctactaa

SEQ ID NO: 74821 - DNA, 294 bp, Glycine max
  Peptide Sequence Number=SeqID_166506
atgccagaacctgaagcatttgtctccactacgaagggaatgctaaaatcgggtagggcaagtaccggagctgtggagatggctgtctttaattgttcgaaggccgccatggcttcaggtgtccatagaaagggagttgtgttaatggggcggccaatgaaaattgcatcaacctttttcggcactgctttgactccttcacctgaaacaatgtgtcccaagtatttaatgcaatcctaccccgcaagggcatcggataaaagactccaagaagattgggccaaagatgcatga

SEQ ID NO: 74822 - DNA, 237 bp, Glycine max
  Peptide Sequence Number=SeqID_166507
atgactatgagtcgtgatattgatggttggattggatcaatcgccccccaggaaggcgcttccatggagcacgcgacacgtggcacagcgcggcgcacgagacagcagcagggtagcgcccctgacgcgggcgcgtctggtagcgccctgctgctgggtgcgactggtagtgcccagcgcgtgggcgcgactggtagtgcccctgacgcgggcacgacccaggcgtgtattttttaa

SEQ ID NO: 74823 - DNA, 70 bp, Glycine max
  Peptide Sequence Number=SeqID_166508
gtgcttggcacccatcattaggcaatttgtgaagttccgggacatgccagaaatcaaaagaaaatactga

SEQ ID NO: 74824 - DNA, 552 bp, Glycine max
  Peptide Sequence Number=SeqID_166509
atgtcttgcctagcgatcacaactccgatctccctttccctaagtgccatttggtgtatggtgcctaccaggtaccctctggacccagataagtccaacagggccctggggtttccggcgctgatcccgggcctctgccagtcctatggaggtctcgtcacccccagtaaagtaatccgaccgccgatcacccgggccttcattgagaagtactgcatgcttaggcgggcgcagggtgatgcacatcaggccgcaggcgcaccgccaccacctcggcaggccgatccagctgggccactgggcgtggagcgttatctacaacatttggttcgccagcaggctgccaaccaccgtgggcaggggcagggttcctccccctttgcatgccctactccggagcagtttggggctgaggtcacaaggcctagagactggcccgatgccaaggcaggggagaagcctgcaggatcccccggtgagctagatgagtcccatatggatgaagatatgattgacttgctcggtttcttgggagggagcggagccacgtga

SEQ ID NO: 74825 - DNA, 159 bp, Glycine max
  Peptide Sequence Number=SeqID_166510
ggattaagagaccgagggtctcttgctgtacaacactctaaacacaaaggaagggttgtccttgtgtggttcagaacttgtaaagggcttttgcaagatagtggaactctcaagcgggttgctggacgtaggcacaagggtgtggccgaaccagtataa

SEQ ID NO: 74826 - DNA, 601 bp, Glycine max
  Peptide Sequence Number=SeqID_166511
atgtcaaatcataaaagcactgagtcagcactgaagaaccttgaaatccaggtgggacaactggccaagcagatagctgacaagttgtccaacagttttgcagcaaatacagaaaagaatcccaaggcggaattcaaagatgtgatgacaaggagtaaaaggtttatggaggctgaggaggaggagagtattgtgcacaaagagaaaactgctgaaaagaaaggtactgatggcaagaaaaatgaggaaactggaaataaccatgcccttcagagaagctttacatcaaatgccactctactccaaattcttgaaggatatatccttccacccaagcataaagaccctgggagtgtaactattccttgttcaattggagaagtcactgtaacaatgtcaaatcataaaagaactgagtcaacacttaagaaccttgaggtccatgtgggacaactagccaagcagatagctgacaagtcctccaatagttttgtggcaaatacagagaaggatcccaaggaggaatgcaaagctagtgttggacttaagaagaaagttgttgaagagaaaggtactgatggcaaggaaaatgatgagcgag

SEQ ID NO: 74827 - DNA, 261 bp, Glycine max
  Peptide Sequence Number=SeqID_166512
atgatgacaaagtggatgaacaaaagctcagagatcaaagaacatccatctcaagaaaatctagaacaagtcaaagagttcaagaatcaagaagaattcaagactcaagaacaaagcctacaacaagaatcaagattcaagatctcaagaatcgagatcaagattcaagacttaagagattcaagatctcaagaatcacgatcaagattcaagactcaagattcaagaatgaagaaaagactcaatcaagataagtattaa

SEQ ID NO: 74828 - DNA, 426 bp, Glycine max
  Peptide Sequence Number=SeqID_166513
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtcgactctagaggatccccaggcaggccttgtggctgatttagggacgacctttgtggttgattgggtggtgggtcctttaatggtggttttccaccatggagatgcagcggaagacaaaggagaagaggggagaggaggcgccatccactag

SEQ ID NO: 74829 - DNA, 2172 bp, Glycine max
  Peptide Sequence Number=SeqID_166514
aagctggcggaatacggtgtgaagagcgtactggaaaatgcgcacggtgataatggctggtgtctggcgctggtcgagccggatggcgagcgcacctttctttccgtcagtggcgtggaaaaccagtgggacgccgcgctgttgcgcacattgccgcagccggcgcagcgctggatctatctctccggttatcagctcaccagcaaaagcggcgaagtgctgatcgactggctggagcagcaggcacagccgtatcagctgctggtggattttggcccgcggctggcggacatcggcgaggcgcagtttgcgcgtatcatggcgttgcagccactgattacagtgaacaggcaggaagcggagctgctgtggcatgagcgtctgcgcgagtctgaacctttcgacgcccatcagctgatggcgcgctggcagcagcagtttggcggcgcaatggtgttaaggctggacagcgaaggtgccggatacatcgacgctgaggcgcagggctgggtgcccgcactggcgacaacggtggtcgatactatcggcgcgggcgacagccatgctggcggattactggcgggattagcgtccggctggtcactggcggagagcgttgcgctgggcaacgcagtggcgtcgtatgtggtttcccggcgcggcggcgacttagctgatgctgtactccagcggattgccctgtgcgtcgagtgccagctgcttaatcaccagcaccggcacattggcgggcagggcaatttgctgctgcagggcttcgtccggcatacgcgcactgacccggctctgggatttcaccggcaggatctgctggcgatgaaaatagtcatacagcgaaataccaatctcatcggcatcggcaatgtagcgcgccggtacccacgactcttcaaccgagaccgcctggcggtcaacatagcgaatacgtttcagcagatagacatcgctgcccgtgctcagccccagcttttcggcgatctctgcgctacaggcaattttgcttttattgatccacacgatctgcgtgccgtagccgcgggaacgaaacacgacgccctctttttccagctcgtccatggctttacgcacggtgatgcgcgaaatgttcagcgactggctgaactcgcgctcgcccggcaggatctcctcgtgcaccagcgtgccatcgcgcactgcctctttaatcgcactggcaaagcgtttatacagcggcgtgcggctctctatcgccagcgtggtggtcaaccgcgccaacagcgcattgtggtcagtcatagcgggcagggcactcactcggacattatgttaatcgctcagatttcagacatccatgccgcaccggacaatgatcacctgctgcgcctggcgcgcgcgctggcgtggctcactcatgtgcaaccggatgcgctggtattaacaggcgatcttgttgatggcgagtggcggcagggttactggcagatagctgagcaactgcgccagcagcattaccctgcatttatattgccgggcaacgccgatgatcgacgactcatgcaaacgacatggcatgaaaatcactgggcgaaaaacaccccggcagacgcgctgcattttgttcaggatatgggcggtttgcgtatgctggggctggactccacggtgaataaacagaattttggcagcgtcggggatcatctggaatggctggaaagacaactcagcaatacgcctgcgctgccagcgctgctttttctgcatcatccggttatcgcatcgggcataccgacgctggatgaatcaatgtgtcgcgggcttgataagcttgagtcgaccctcagacgcagccgggtcagaatactggctattgcagccgggcatgtgcaccggcccgcagcaggcatgtttgcaggggttccggcttatatttgtggctcaatttgcccggcgaacccgctgtggtttggcagccagcgggttcctccggcaaatggtcgcgttctgttagccacggcacggtgtgcgagcaccagatataggaaaccggcgtctgagcgggatcgtcgtccagcgtggccacacgcagaatcacgtggctctgatgaggtctttcagccatcagatgagatccgcagactgaacagaaataacgcaacttatccggagaagaattaa

SEQ ID NO: 74830 - DNA, 1177 bp, Glycine max
  Peptide Sequence Number=SeqID_166515
atgagccgtatcattcaccgcagcctgcgcagcgtgcccgccgtggccacgcgcgcacacggggcctacatttttgatgcacagggaaaacagtatcttgatgcctgcggtggcgccgctgtttcctgcctgggccacgcccatcctgacgtcctcgcagccatgcatcgtcaaatcgatcaactggcttatgcgcataccagtttcttcaccagcgataccgttgaacagctcgccgaacagttaacgcgcaccgcaccgggcgatcttaactatgcctatttcgtgtcgggcggttctgaggcagtggaaaccgcactgaaactggcccggcaatactttgttgagatcgaacagcccgcgcgtacccgtttcatcgcccgcaaacagagctaccacggcaatacgctgggcgcgctggcggtgggtggcaacgaatggcgccggcgtcagttcgcgcccctgttaatcgacgtgattcgcgtttcagcctgcaatgagtatcgcgatcgccgtgctgatgaaacccagcagcagtatacccagcggctgttgagcgagctggagcaggcgatcgtcgatgcgggcccggaaacgattattggcttctgcgcggagacggtggtcggtgctaccagcggtgccacgccgccgacgccgggctatctgcagggtgtacgtcgcctgtgcgacaagtacggcattttgtttatcgccgatgaggtgatgtgcggaatggggcgtaccggcacactgcacgcgttcgaacaggatggcgtggtacctgatttggttaccatcgccaaaggactgggtggcggttatcaacccatcggcgcggtgctggccagtgagaagatcgtgtctgcgctgcaggccggcagcggtctgttccagcatggacacacttatatttgtcacgcgacagccgctgcggcggcgttagcagtacagcaggtgattgagcgcgaccatctgctggaggcggttcagcagcagggcgcttatctgcacaaggcgctacgcgacgtgctgggggagctaccgcacgtcggtgatacgcgcggccgcggcctgtttgccggtgtggagctggtgcgtgataaagccacaaaatccccgttcgatccggcggtgaaacttcacgcagccatcaaggccaactgtatggcgcgcg

SEQ ID NO: 74831 - DNA, 255 bp, Glycine max
  Peptide Sequence Number=SeqID_166516
atgactaaagcacgtcaaaagggggtacggaaattcgatttcgggaacttaccggttgaagaccgaagaacgatcaaagaacggttgaaaatcttcgcgaaatcaccaacgaaaacgttacggacaagaaaaataggggaggagcttgccagccagctcgcccaggcgagctcagctcgcccaggtgagttaggttgctcctctagaagcaaccgccttctggagaaacatccaggaaggcccaagtgggcctga

SEQ ID NO: 74832 - DNA, 213 bp, Glycine max
  Peptide Sequence Number=SeqID_166517
atgctcaatggaatgccccagggctcctccacgataagcacacgttgcgttcgagtcgtatcctcagaaaaatggaggttgaggaaccttggttggggctttgtggttgatttagggatggcctttgtggataactgggtggtgggtaaggaggaggtttgttattggctgagtaatgacattgttgggttggtgggaaacttggccgtatag

SEQ ID NO: 74833 - DNA, 1152 bp, Glycine max
  Peptide Sequence Number=SeqID_166518
atggaagcgcttgaaactcccaccttacaacctgcatttattcacctgcgttgccacagtgaatattccattgtggatggcactgtacgtattgacgattacgtcaaggcagccaaaagtgatgcgatgcctgcgattgccctgactgaccttgccaacctgtttggtgcagtcaagttttacaaggctgcgcgcggcaaaggcttaaagcctgtgctcggatgcgatgtttgggttgagaatacgatacagcgagatcagccgcatcgtttgttattgctggtgcagaaccagcaaggctatcgtaatctgtgtgagttgctctctagggcttatttagaaaaccagtatcgtgaacgggctgaaatcaaacctgaatggttgctggaaaaaaatgccggtttattgatgctgtccgggtttgcagctggcgatgttggtcaggcgttacaagctggaaatcaggcattggctttgcagtatgccggtcaatgggcaaagacatttgctggccgatactaccttgaggtgcaacgtgtacatgaggctgccagcgccgaagcttatacacaagagcaactgatccagcaaactgtgttgctggcgcagcaactggatctgcccattgtcgccacacatcccgtacagttccaaacacccgatgattttatggcacacgaggcgcgcacctgtattgctgaaggctacgtgctcgctgacaaccggcgtccacgccgctttctcgcatcacaatatgtcaaaacacaagccgagatgcaggccttgtttgccgacatgcctctggcattacaaaactcggtagagattgccaaacgatgtaacctgacactgacactaggtaaaaactacctgccagattttccaacacccaatggcgaaagcctggatgcttatctggttgaccaatctaaagccgggctggagcatcggctggcgtatttatatccggatgagcaacaacgagaagcaaagcgtgctgagtatgaagagcgtttgcagtttgagtgcaatatcatcgtacaaatgggctttcccggatattttctgatcgttgccgactttattaactgggctaaaacaacggtgtgcctgttggccctggccggggttccggtgctggctccctggtag

SEQ ID NO: 74834 - DNA, 423 bp, Glycine max
  Peptide Sequence Number=SeqID_166519
atggctaagtatgatgcagaactagtcatggagttctatgtcaatgcatggcccacgaaggagggagtcaaagacaaggccaacgctgtgaattcagttagaggaggagccaggccttggggacttttcccgaagcatggcagggagacggggatcacgccgcctagacatctagtggacccagagaagtccaacagagcactagggttttcggctttggtcacgggcctctgccagttttatggggtaccggacctcaatcctttcccgtggcatacccccgagcagtttggggccacagttgcatggcctggagataggcccagtgttcagacaggggcaggatccgtagggacctccagagatggagatggagcacaggatgatgatgacatagccgatgggatggacttctttctttga

SEQ ID NO: 74835 - DNA, 156 bp, Glycine max
  Peptide Sequence Number=SeqID_166520
atggaagctcctgaggcgcataatatatcgagacgcgctgaaattgaacaacggaagctcttgagcaattcaaatggtcataacttttcactcggaggtccgattcaggcgcataatatatcgagacgctcgaaattgagcaatggaagctcttga

SEQ ID NO: 74836 - DNA, 849 bp, Glycine max
  Peptide Sequence Number=SeqID_166521
atgtcttccatcgtcgatacacctttttccaacctgccacagcctaaatcgggctggcagctcttcaaaaatctggctttcggtacgctcacgccagggctggcgtggcagaaccccgcctatcgacgtaaattcatgttacgttcgctggcgacacccattagcaccgcgcgcctgttaacgagccttgctaagcaaccgcgtctgatgcagatgctgcaggtccagccaggactgccgtgtcggctgcatcgcccctggctgacggtgaaaatggatcgtcagcatgcgctggaatcgcttaactggcactatcagaccctgagccgccagcttcctgcgacgctgcttgcgggttacctttctaagccaggttacaccctgctgaccttaaccggcaaagaggaacagcagttcaccgttcgtctgtgcgctgatgcgttcctggataaagaaggggaagccaccctcgccttctgcgacaggcacaacacggtgctgacggaaatgacctttacgctctgccagtttgcaggaaaaacgacgctgttcatcggcggtctacagggcgcaaaagcgcacgttccccatgagctgatccagggggcgacgaaagcctgtcatggtctgttcccgaaacgtctgctgctggaagccgcgatgacgcttggcaccgctttcccggttgagcagatcgttgccgtcatttttggatctcgatcggcggtgaaaaacaggataacggtcacttcctgctgccgcttgccatgccgcgtaaaccgatggaagagatcgcgagcaaaaagcgcgccgagtatcgccgccgttatgaactgctggatagcctga

SEQ ID NO: 74837 - DNA, 393 bp, Glycine max
  Peptide Sequence Number=SeqID_166522
atgtgggtgcaagccattggtctgtttgctcaagcgacctgtgctcctgagtttggacttccaagatcgttcagtcagagattactcgtcttgcacgttggtgggggtgctgtaaaacaacgagtaaaatttcctacatctcgtgtccaatctttttggatgaccggccctctcgatgagtcaatctcttgctttctcataaaggtgggcccttgggtactagtacctaacacctttagaggactgtatgtcctcgccatcagaggactgcacatccttgcctgcagagggctacacgccctcgcctttagagggctacgcgtcctcattttcagtgtgctccatatccacagcttaggagaatataaaggccctttgcccttagatgcttag

SEQ ID NO: 74838 - DNA, 126 bp, Glycine max
  Peptide Sequence Number=SeqID_166523
atggacggacaggattcgttacccgcaaccggaggaactggtcgtcatggattaatcggaaacatgggagatcggagaattataataagaagggatgatgaagtggaaacaaagggatccatgtga

SEQ ID NO: 74839 - DNA, 264 bp, Glycine max
  Peptide Sequence Number=SeqID_166524
atgtctcagaacatgtttggaatggggaagaagatcggaaattacatatcagacgagttgtccccacgtatcaaggggaagaacaaattccagagcaaatttttccttttcttcgacaatccgtgctttgatagaaagatggaggccggaaacacatacgttgcacatgagatgcgaagagtgtactattactctccaagacatctctgtattgttaggtatacgtgtggatggtttaccattaatcggtccaacaaatcttaa

SEQ ID NO: 74840 - DNA, 543 bp, Glycine max
  Peptide Sequence Number=SeqID_166525
atgaagataagtgatttattgccatattggttccacatagcagaaggtgttgtgtgtaatgatgttgatatgcaatcattatttctgttgacgggaccgaacggtggtgggaaatcaagtttacttaggtcaatttgtgctgctgcactacttgggatatgtggactcatggttcctgcagaatcagccctaattccttattttgactccatcacgcttcatatgaagtcatatgatagtccagttgataagaagagttcctttcagagattgttcaaaattggggctaaaggaaagaatgagatcatcgaaaataactcaaactccatcaagtacacgagtaaaatcttggcctgccaatttgaatctctgctcatcaaccaactttttggtcaaggcttccaactgagcaatatagctaatgaatcagaaatcttacggattgaagaggcaattgcaattcaaggaaatagttcttttgaggagagagcaattgtactttacaagattttttcggaagagtcaaagacagagagaggttaa

SEQ ID NO: 74841 - DNA, 1125 bp, Glycine max
  Peptide Sequence Number=SeqID_166526
atgtcttcttttctgtctgattctaccactgggctaggtggcagtgattctaggggctcgattgagcaacttatcatggatcgagaggctatctcgataggcggttcctcgtttgaagatactcgccgaggacctcgcgccgaactggtgggagcacttctctccttcgcagaagggcatgaccttctacggattttggggagccagtcccacgtgagtgttgggtcaccgttgtccatcttggacgttgctggatatgagtgggtgagggataatgtgttgaagtacaagtcctgcctgactttggtagcaagtgtcactgggcttcagtgcgaggtgaagctggcaaaccctgaggactcttgtcctaagtgtcattctacccttgaccgcttttcagtgtgctttgttggagcacttgaatgtggccccttcccagctccacccaaaattcgtccaagctatcagatttcgaatctggatggttgtgcgcccaaatctgtccgtgaattttctgaggaactcgtcatctgcctgtcacagattggccaaggtggtcggggtcatgtggtgagacctactagtggtgtattatgcattgaatcgttcgatgagggtgtcaaagctgtctatggacctaggtggaagtccattgcactaggcattcagatgcttgtctggatctattgtcccatcatatcgctcgaggttgagtggctttcaccccaaggtgttgcctatgcgttaggggtgcgtttccccttacgtgctttcagagtgtttgtgtctaccatagctgtcggacgaggatgggagtcagtgaggggggtctcgtatctgaggccagaccaagtgctaaccatggatggttgtgagaggattgacaagaggccttgggggtacatcatttatggtcaagtagaggatacatctacttgggttgttgtgactgagaacaagagatggtacatctcttgtggatcagttctagtggagggtacatccactaggttattcaaagagaacaagggagggtacattccttgtggatctttgcttgtaaaggattttacaaggttgaaaagaaatctcaaagaccgcaggtcgcttggggactggatgtag

SEQ ID NO: 74842 - DNA, 651 bp, Glycine max
  Peptide Sequence Number=SeqID_166527
atggatcgggcggcgttgacggtcggaccgggcatggacatgccgataatgcacgacagcgaccgttacgatctggtccgcgacatcgggtccggaaatttcggcgtggcgaggctgatgcaggataaacaaaccaaggaactcgtcgccgtcaagtacatcgaaaggggtgataagattgatgaaaatgtgaagagggaaattatcaatcacaggtctctgaggcatcctaacattgttaggtttaaagaggtaattttaacacctactcatcttgctattgtaatggaatatgcatctgggggagagctctttgagaaaatctgcaatgctggacgttttactgaggatgaggctcgattcttctttcagcaactcatatccggggtcagctattgccatgctatgtcttcttataatatgtctcttcacgaagcaagtatgtcatcgggacttgaagctggaaaacactttgctggatggaagctcggcacctcgtttaaagatatgcgattttgggtactccaagatttagactgtgatgatggaaatgagttgctccttaagttactaaaagattgtttcggtaatttgggatattggaagagacacatttctacacgactgttgatggtgaattttataatctaa

SEQ ID NO: 74843 - DNA, 207 bp, Glycine max
  Peptide Sequence Number=SeqID_166528
atggaaggagaagcttcaccaccaagagagtgcatcttggctgcttctatttatagcctaggtcataggctaagtcttgaagtgctaaaagtggtagttgcgctcaccatttgggctcagcgtgcatccaccgctaagcgcagcttcagtgcgcttagcgctcaacgcatgactggcgctaagctcaaatccactaactcgtgctaa

SEQ ID NO: 74844 - DNA, 776 bp, Glycine max
  Peptide Sequence Number=SeqID_166529
atgatgctggtggctatgccattgctgaaatgttttatcaggctttcaagacaagatatggaaatggaattgagggagatgggagctttgaagaatatggggtgggagtggaactttaaatggaggaggaacctattcgacaacgagattgatatggcagccagctttctaggaggggtggaaggcacccaaatacaaattaacagaagagatgagtggacttggctagcagaaactagtggtgaatattccacaaaaagtgcctatgatgagatgtggggagctgatatagaaggcaatcaattgcaggagcttaaagatatatggaaggttgaggaggatgctgctcatttgttcctccactgtgataagattctgcctttgtggtgggaatgtatgtcgtgggtgaacatcttaggtgctatcccgcagcaccgaaggcagcatttctcccaacatgtcaaagctttgggtagaggaggccaagataatagatggaagtgctggtggatggcccttacatgttacttggaagagattaaacaccactatgaggtcttcgttgaagatgttaaccagattgaatctggttgtgtgcctttaccatcttataattcttctacagagggctcaacaagccatgctagtgatgaaggagctagcaagaagggaggccactcttggaatagtaacaatgaatgtaatcatggaactaaggcttcaagatcagatcaggaacggcgaaagggtattgcatgtacagaggatgaacacag

SEQ ID NO: 74845 - DNA, 522 bp, Glycine max
  Peptide Sequence Number=SeqID_166530
atgggaggacaacaacgaccttatgataacttccaacaaaaaggtttccaaaacatacatggaaactacaaccaagcgggagacaataaaccacaacaaagacaaaatttgtgggatcacattgcaaagttggaagaatccttgaccaaactcaccgaagtgatcatcactaaccacaaaaacagagaagccataatcaaaagcatggagactcaaatagggcaattggccaaacaatttcaaacctctttaagtggcttttctgcaaccatcaaggagaacccaaagggccattgcaaggctattatctccaccttagaatgtgacgtgggaggtgaagaagaagaggtagaagaaagcaccatgctagaagaagagatgaaagcacaagccaacccttcaacccaaggtatgcaatcctcacttaatcctccattgtttgattttagcaagctaagcatccataagcaaggagacaatgagagaatggccaaatttgagaaatacatggagatgctataa

SEQ ID NO: 74846 - DNA, 417 bp, Glycine max
  Peptide Sequence Number=SeqID_166531
atgaatcagaaatctgcatctgcacctgttgcaagagtctgtggtctatgttcttctgcagatcaccgtacagatctctgtccttctttgcagcaatatggagtcaatgagcaacctgaagcttatgctgcaaacatttataatagaccccctcagcagcaaaaccaacaacaacagaataattatgatctttcaagcaacagatacaatccaggttggaggaatcatccaaatctgagatgggcaagtcctccacaacaacaacagcctcagcaacagcaacaacaacaacaaagacaacaagcaactgaggccccatctcaaccttccttagaggagttagtgaggcaaatgaccattcagaatatgcaatttcagcaagagacaagagcctccattcagagtctgaaaaattag

SEQ ID NO: 74847 - DNA, 665 bp, Glycine max
  Peptide Sequence Number=SeqID_166532
atgaggcccacctacgaattcaaagaaatttgggtcgggtataggtctgggttatcgggtgggtctcggggtggtgtattgggtgggttaggaatgggtatattatgggtagttgggtcttcctcatccgcaatgaggagaaaaaccctagaggcacatcgatgtcctatgtggaatttctcctcacaattgaaacagagacctcgttccctccgagaggcaatctcctcgggagacaagcgtttcaaggccagtggttggggatgggaaggggttggcaaaaggggtgggaggggtatcgaggatatcggggacgcatatccaggaacttctcttcttgcaagcgagcgaggccgacttcctacaccagagtcattggttgatgggcctgcacctccctgcgtatctccaggccaccgtgcctctctgggtgaacttaaacagcgcaccgatgggatcatcgtactgagatggggcaaagcaagtgtgcaaggcttgaaggaaaatggaccaggaggaggaggcaatggtgttggcatggatggagttggtgacagggcaggggagacacgctggagtagtttgttgatcttcagagtcattgcattgacagactcaccaaggtacaactgctggttggtgaggcgaatgagggcatcctcaag

SEQ ID NO: 74848 - DNA, 783 bp, Glycine max
  Peptide Sequence Number=SeqID_166533
atggtcgaggtactcaatgcgcctttggccgaaaatgcatttggaaggtttcaaatggaattgcccctattgcaaggtcctgaaaacgcattccagatgattgatgtgggcttggaaatcacgattgccgaatggcatcacgacatattcgtagtggccttggtgtgttctgaaagcggtcttggaaatgtcatgctcctccatgcgaatctgatgaaagccctgcgcgagtgcgcggtaatccacgcagaaccgccacgtcccatcctttttcttgacaaggagcaccggactagagtatgggctacggctggggcgtatgagttgacgacgaagcatgtcgtcgacttgccgttcaatctctcgcttctgggaataggggtatctataggggtggacgttaactggtttcgaattgggctcgaggtggatggagtggtctgttggtcggggaggagggagggttgtcggagtttgaaaaaggttggagtatttggtgaggaggggacgaagggaagggggtgtggaaggttgaaagttgatgcaagctccattggagcttgtaggcctaggatcttcttcatcaatggattcctttacttcttggaagatgaatggaagcggaatggagaaaggaagagagagaggagactccacttcaatgagaagatgagtctagaagaagctcaccaccataggaggccatggataagagcttggaggaagaaggagatgaatgaagggagagggagagaagagcacgaaattttgtgctctaaatga

SEQ ID NO: 74849 - DNA, 311 bp, Glycine max
  Peptide Sequence Number=SeqID_166534
gtggccttgttcgtgctcgtgcgcttagcgcacttatggaccgcttagcgcacattagtgaatttcggcttagcgcgtgcctttctcgcatagcggatgaactgaagcggtgtttctacaaggaggaggcaccagagccagagattgttgcacaagctctagaagtggaaatgaagcctctttctccttttgaggccatattgctcaggaaaatagatcagatttatagctggaaactcaagcaaaatgaagctcacaatgagtacatggaaaacatagtgagaggttggaaaacattgaagagaagttaa

SEQ ID NO: 74850 - DNA, 618 bp, Glycine max
  Peptide Sequence Number=SeqID_166535
atggctctagtgactggtcccttcctagggaggattgcatcatgttggaatgtggatgatctgacagttaacttcagaggggttaggaaggtaaaggctcgactagtagatactccttcttcttctgcaccaccagctccttccacttctgccactcctacaccaactcaacccacttctgccacccctgcaccagtggcccaggactctcagcgctttgaagccatgcttcagagtgtaagggtagagatgagacctgatgaggctgttcttccagagccaattgtgccagttatacaggagactgttgaagcaggtgagtcacagttaaggcaggaggctactactcttaagaggacatcacagaccccagaaggtccactctcaccagggatggacctatcttttgctcagcaggtagtagatccttctacaccaatacaagagagacaggcagaccctcctacacccatcatggagatgccagaagaccctaccacgccagtcctaagactgtcatccactcctctagctaccccaattttacatctgataaatgaggaggatatgcaagaccaggacacacagggcacacaggaccagtcacaggaattctaa

SEQ ID NO: 74851 - DNA, 336 bp, Glycine max
  Peptide Sequence Number=SeqID_166536
atgaagaggcataacttacacaaacacctcgccaatctccaagacggaagcatagatgtaactgtggtgaaggagttttatgctaacttatacagcccggaagaccagagccctaagcaagtgagggtaagagggcatttaatcaagattagtgctgacagcctgaacaccatcttagagaccccagtagttttggaggagggtgagacacttcctacctattccagatttacgaggatgaggattgatcctcaggagtttgctgcccgtctctacatccctgacgtgcagtgtcttctcctacaacaacctgactctcacttcccacacctctga

SEQ ID NO: 74852 - DNA, 771 bp, Glycine max
  Peptide Sequence Number=SeqID_166537
atggagaattatgcacaaacaccattttctctttctccctctctcatccaattttgcatctgcattgtgtttactgcatcaacaattcaaaaaatgcacagtgttttctgcattttttctagaaaacgcaatgaactcactcagcgagcttgccgtgcccagcgagctcatctatatttgttgcacatatgcattttatggaagacctcgctgagcacgcttatcgcgctcagcaagtgcatcaatccgcgcgctaagccgcgaatctctgggctaagcgaaatctgttgcggcaagtgttggctaagcgagccctatttcgctaagcgatggcatcgagaaagagagcaagaactaaagacatcccttcatcttccaacttacctcctccgacagcacccatggaggcagctgatgattgtatacaaccagcaggagttagctcacaacaggccagttatatccatggaacaatttctggaaaaggtagcctggcctgaagctcagcttcctctgggaaggtcccccgaggctgttccttctagtcctgtaccagcaaggacagagccaagacctgctgagctacaacttccagtagcagatccacctgcttctacggaggttgagatactatctcctccaccaactccacgggcaccacctctgataatcattcccgatgactcaactaatgaaactgctgctcctcctgattcaccatcgtgctacctagaggatggtttggacttttctgattggatggactgctga

SEQ ID NO: 74853 - DNA, 720 bp, Glycine max
  Peptide Sequence Number=SeqID_166538
atgcctgataggaggaaggaagccatacctcttttctgggtactatccttctatggggagaataacatcaatggtcaagatcttggaatgagaattagattgagtgaagcaaagaaggaaagcctggtcattgctattttagcagatgcgtatgatacatttgacttaacatgcgagaagagcagtgcaagaaaggacaaagcaaatcgggaagaactgttggcaggcatgatgggagcgtccattagttggttcccatggcggaaagaaggaggggcaggagtgttatgctcatgtgaaggatttccaaatgcccctttgatagggatgaggggttctaatacaaagatacttcagaggatccataaggcatggaataaagtgggaagaaaagataaagaacttaggggaagtagcaatggtgtcataggcggctatcacaaatggttgaaatctagaacacgagggataacttggctccaaaagctaaagtatctgaatagggaagaggcagaagtgcctaaggagagcgaagaggtgcaagctttgaaagctgagctcgaaaagacaagagtagcgaaggagaagctgaaggtggcagccactagagttaggaaagaatgtgatgagctaaaagatatcaacatgaccacggatgaagcgctagagcgggaaatgaaaaaggccagaaaggaagaatggagcagaaacaagttctaa

SEQ ID NO: 74854 - DNA, 425 bp, Glycine max
  Peptide Sequence Number=SeqID_166539
atgggtcattacacaagtccttctaacaactcttatgcagttggtttgaaggataatggtgagaaaaagaataaagaaggagttgaaaaagaaaaagagaaaaatgatgaagtgatggctaatgaaaaagtggaagagaaagtggtgagtgaagaagagaagcataaatcaaagaaacaagccactaacaaagcctactcgcctaggctagctacagctcgcctaggcgagttggtttggcagcttcttcaaaaggaaacacgtagtaaggaagaaggagtgagaaagtggagcccgagtgctacagagtttttagtggcagcggaatggagaaggaagaaagatgattggagacgccacttcaaggagaagatgagtcaagaagaagctcatcaccataggaagccatggataagagctttaag

SEQ ID NO: 74855 - DNA, 177 bp, Glycine max
  Peptide Sequence Number=SeqID_166540
atgtcaagacattatcaagtacacataaagactacaacaagtcctaaggtagtcctcggagcatcctcagactttccccagatcaacaggtcatctaccttacgcaagaacactcactctgaagcctctctatacgcaaccaacaactccttacgaatgaccttacactccccttaa

SEQ ID NO: 74856 - DNA, 1053 bp, Glycine max
  Peptide Sequence Number=SeqID_166541
atgggatcaaatcaaacacctctgctcaagaaaaggttctatcaagtcaaaatcaagagcttagaggtcgccagtttacaagagttggggaaattgatgggtcaacttcaatggcaagccttccgcaaagcctatggtaagatttgggacctagctacgatacaagtctccctggaagcgattgcatcccttacccagtattatgacgagcccctgaggtgcttcacaattaaggatttccagctagtgccgactgtggaagtgtttgaagaaatcctgggatgcccgctgggaggaaggaagccatatcttttctcgggtttctatccctccatggctagagtttccaaggtagtgaaaatctcagcacaagagttggaccgagtaaagcaaaatcggaatgttgtagtcggagtaccaaggaggtgtttggaggagaaggcaaaggccttggcaaatcaaggcgaatgggcttcttttattgacatcttggcacttttgatcttcggagttgtcctctttccaaatgtggaagggttagtggacctagcagcgattgacgctttcctcgcctttcatgatcacagggaaagcctggtcgtcgccattttggatgacatgtatgacacgtttgactggagatgtgaaaaaagcgatgcaagaattgtctgttgtacaccggttctctacgtgtggctggtttcacacctttttcgccaagaaagtaggcacgtctgtccactacaaggtcaccataaaattggagctggggaccagctcgcccaggcgagtgttgcagactttaaattacgaaccagcagcagaaaacatccatttcttcctcctcccttcccccaaaaccctccccaacactcccaaactcctcctccaccacccacgaccaccggtggccgccgcgagccgccattgtgtgccgttgaacccccgcaccaagaggaacactttaatcagagcggaatactcaaaatccttctcaaggatttagtggagaaagttcccccaatcctccatttcatagcttttctgaggtaa

SEQ ID NO: 74857 - DNA, 704 bp, Glycine max
  Peptide Sequence Number=SeqID_166542
taccctcaccttcgagaggactacacgtcctcccctccagaggactgcacgtcctcaccttcagagagctgcacgccctcgccttcagagggctacatgtccttgccttcagagggttgcacgtcctcaccttaggtactcgtaccctcaccttcagaggactacacgttctcgccatcagagggttgcacgtcctcaccttcagagggttacacgccctcaccttcagaggactagacgtcctcgccgtcagaggactgcatgccctcactttcagtggactacacattctcgccatcagagggctgcacgccctcaccttcagaggactacacgtcctcaccttcagagggctacacaccctcaccttcagaggactacacgtcctcgccatcagagggctggacgccttcaccttcagaggactacacgtcctcgccatcagaggactagatgtcctcaccttcagaggactacatgtcctcgcctttagagggctatgcgtcctcactttcattcctgggccaccctctgatcctggaggagcgaccaactgtgctagcacaaccagagagggaggctatcacacagctactatgcatactggggcaagatttcacccgtgccactgcaaagagacgagtgcggatcgtgcgcaccaacatgaccactctttcacagatatagatgatgttactacttag

SEQ ID NO: 74858 - DNA, 513 bp, Glycine max
  Peptide Sequence Number=SeqID_166543
atgttggaaagttttaaacaacaagaacaaatgtcagttctggaattgtacatagaaaaggatgtggttggtggttcaatgtttcattctgcaaattcgcttacatcatgtgaaaattatttatctaatgatgagacacaaccgacaacaaatatgagcaatttacatattgacgaagacgatgatgatgatgatgatgattatcttgtgtctaactcatacgttgaagagtctttagacgaagatgacagtgttgacggtatatctgataccgacgatgaagtcaccaacattcctcaaccagtaaggattgttcacccagcagaaggtgcacaacgaattgaaaatccattttggaatgatgatatgcattataacaatatcaactggagttatcctgatgaggaggacatttgcggtttggagttgccatcgacctttaatattggccaagaattatatgttggcatggaatttgatagtaaagatgcggtcaaaaatgcagtcaaataa

SEQ ID NO: 74859 - DNA, 492 bp, Glycine max
  Peptide Sequence Number=SeqID_166544
atgactaaagcacgtccaaagggggtacggaaattcaatttcgagaacttaccggttgaagaccaaagaacgacgaacgacgaagaacggttgaaaatcttcgcgaaatcacccacggaaactttacggaaacgttacggaggcgcctcggcttggattttctttacggaaacaatttttctcactaattttaagtggttacaaagtactggaagggctgaccttttctccttcactcctccctctatttattggaaaataggggaggagcttgccacacagctcgtccaggcgatccagctttcagaatgttacggaaactcacggattgcgtatcaatacttccttttgatttccgacatgttacagaatttcacagattgcgaaacaatgcttccttttgatttccggcatgtctcggaacttcacgtattgtgcaacaaaggttgccaagtacctcgaagcggtcaaccaaaggttgcatgccattaa

SEQ ID NO: 74860 - DNA, 183 bp, Glycine max
  Peptide Sequence Number=SeqID_166545
atgaaatgcaaaactttggagtcttacttgcaggttgttagtaaaattgcaaacactgaaccagacacttatacgaaaaatgaggttacattaagcaaaaagggcaacagaaatgaagagaaagaaggaattctaaagcaggcccagcccaacagtggcgctaagcgcgaggtgtcacactga

SEQ ID NO: 74861 - DNA, 843 bp, Glycine max
  Peptide Sequence Number=SeqID_166546
gaagacaagagccggctctcagcctccgagagccgcatcgcggaaatcatcgtcaatgatttcgaattcgcggtgaatgcctcgatcatcgagctcgccgagcgggcggcggtctcgccgccgacggtgacacgcttctgccgccggctcggctgcgagagcttttccgatttcaaggtgcagcttgcccgcaccgcccatatcggcgtgcgatacctgaagccggaatcgaagagcggcgatccggccgatgtcgcccaagacatcatcaccaaggcgcagaacgccctcttcctgctgcaccgctcgctggatctcgccgcgatcgaggcggccgtcgggctgatctccaaggccgagatgatctacgccttcggctccggcggcaactcctcgatgatcgccgacgagctgcagaaccgcctcttccgcctcggcctgcgcatcaccgccagttccgaccacagcatgcagctgatgatggccgccgcagcgaaatccggcgacgttatcatcggctcctccttctccggccgtaatgccgagctggtgcgtgcttttgcactggcgcgcgaggcgaaggtgaagaccatcgcgctgacgcagaccggcagttcggtcgccaaggcggccgaggtcgtcgtgccgatcgacctgcccgagggcaccaatatctaccgtccgacctcgacgcgcatcgcctatatcgcgacggtcgacattctggcgagcctcgttgcctacgccatacaaccgaaggcgacgacgacgctgagacgtatcaagcagcagctggtcacccaccgtgacggcagcgacgacaagcagctgctcggagactga

SEQ ID NO: 74862 - DNA, 93 bp, Glycine max
  Peptide Sequence Number=SeqID_166547
atgtcggcagaaaaatatcagtcgtggctatataacgaccgatgtcaggaaatgttcgatcggcgtcatccggtgagcttgcttttattttag

SEQ ID NO: 74863 - DNA, 165 bp, Glycine max
  Peptide Sequence Number=SeqID_166548
atgctgcagttcacagcagtaagagcatggagacagggggagcagaaagctgatgtcacaattttgctgtcaccactacagatactgctgtgcttgattactctgataatgaaagttgctgatcccacttgcatgactgctcgtccctgctcaggaagtgtctaa

SEQ ID NO: 74864 - DNA, 415 bp, Glycine max
  Peptide Sequence Number=SeqID_166549
gccacccaccaggcaccctccagacctggataagtctaacagggccctggggtttccagtgttgatcacgagcctctaccagtcattcggggttcccgtcacacctagtaaggtgattcggccgccgatcactcgagccttcattgagaagtattgcacacctaggcaggcgcagggtgatgcgccacaggtcgcagacgcaccaccgccacctcatcaggctgatcccgctgggtcattaggcatggagcggtatctacaacacttggttcgccaacaggcagccaaccaccgggggcagatcagtttagggctgaggtcgcatggcccggagattggcccgaggactagacggaggaggcaccagcaggagctcccgatgatgcagaggacgcccgcatggatgaggagatga

SEQ ID NO: 74865 - DNA, 543 bp, Glycine max
  Peptide Sequence Number=SeqID_166550
atggcttctaggaaacataaaagtattagttcaagacccacagcgcagtatgacacaaggagattctcttccttagatgcttggaccaaatacacagataatgtcctggggagaaacattttacccaagaggaaaaggcgtaatttccataaacgcctcaccaatttagttgatgggagcatagacctagctttggtgaaagaattctatgcaaatttatactgttttgaggaccatccaccaaagcagtccagagtcagagttcatttggtgaagattgatgttgacagtctcaacacattcttggagacacttgtggtattagctgagggggagaccttacccgcttactccagatactgcaggttacctacaaactacagagagatagaggctgccttatgcatacctggccaagggttcatcttgaactcaaagggccatcctgggaagattctcaggaaggatatgactacaccagctcaggtgtggagtgtcctctcatactccaacttggccccacatcacatacttctgacttga

SEQ ID NO: 74866 - DNA, 177 bp, Glycine max
  Peptide Sequence Number=SeqID_166551
atgaccaaacccaagaacaaaaggaacaagattgaccaaactgatgttgaatgtttcttctctaaggagaaaggtcactggaagagaaattgcaagcatcttgattctttgaaaaacaagaaacaaggcagtagttttaatatttgcaatacgttgcaagagactacagataactag

SEQ ID NO: 74867 - DNA, 75 bp, Glycine max
  Peptide Sequence Number=SeqID_166552
gagctcttgatgatgatagcttctttagccaacagggaactgaaaaggactttcaatgatagagagatggaatag

SEQ ID NO: 74868 - DNA, 125 bp, Glycine max
  Peptide Sequence Number=SeqID_166553
atgacgttcctttgtaaaacccgaaatgctctcagctctttcatgcttgtgtggaatcaacgagcaaggacaaaaaggaatcttcaagtgacgcgacgaggaatccgcggggtagctcatgatag

SEQ ID NO: 74869 - DNA, 372 bp, Glycine max
  Peptide Sequence Number=SeqID_166554
atggaagaatcgttaaagaagagaaagggatcatccttcaccgctgctggtactagccatcgtcgccacagaccatccgatgcacccacaacacctatccatccttccttgtcatctccaagatcatccactctgttttcttctgatgatcaacgtctacgtcatgatgctcaccgtatggtttgcaatgaccaggctgaaatgaccggtagattgctggtcagatcattaacctttgataatcgcatcatgcactacattgttgttagaattttgcttccccagtcttcaaatttggctcaagcctctgaggagaacttgattttgatgtgggctttccttaccggtcgtcagatcgactgggctcacttg

SEQ ID NO: 74870 - DNA, 801 bp, Glycine max
  Peptide Sequence Number=SeqID_166555
atggtttccggattatctccgtctactacgtatgatttctatgtaattgctaaggatgccggcggaaattcatctcctcagagcaatattgcacaaggggctactttagcagcaccggcaggaggaagttgcggaactgagacttttgatgccataccaaccgctcctaatcctagctcttatatcgatagaacatggacgagcaacggaattacgtggaacgctacctctgcaagaacggatgaaacgatcaatggaaaatccatcacgatcaaaaacggagtcttaacaagctctaccatttcaggaggagtacaaagcttaacactaacgactcagttgaagtatagcggagctgccggaacattaaatgttgaaatcaatggaaaccttgtaggtaccataccttatagtgcttccgtacaaacaacaacgatcaacaatatcaatgttaccggaaatgctgtgatcaaaatcatcacaacatcatctccagcaaacagaattgccatggacgatcttagctggacgtgtaattccacattagcgactgttgatgtaaataaaaattcatcatcatttgtggtttatcctaacccggtgaagaacaatgagctttatgtaaaaggtgaacagctgaataaagtttccaaagcagagatttatgatctgtcgggaaaactgatccgggtgattaacaatccattcaaaaattctaacagaattcatttaaatggactgaccaaaggaaattacatcctaaaaacagacaacatttctgcaaaattcattgtggaataa

SEQ ID NO: 74871 - DNA, 733 bp, Glycine max
  Peptide Sequence Number=SeqID_166556
cttctcttctctctcttccttctccattccactgccattcatcttccaagaagcaaaggaatccattgatgaagaagatcctaggcctacaagctccaatggagcttacatcaccagaagaccaagggcaaggctagttgagactccttctacatcagcagctcctcatccagcttctacattagtagctcctcctccaactcgtattacagaagctccttctaccccacttcctgcaaggtttcaatgtttcaaagccatgcttcgaagcatacatcaggggcagattattttgctgcaaagtctccagctggtagcacctcttgactccatccctacagtagaaaaatttaatgaatgggtagcctggccagggactcagcctcctcttcacagggatgacgaggatcccgctgctcaggtaccacatcagccatcggatgagtcatcaaagtcttccacccctgagcccttgatcaggaagaggagggtagttgtaactcaggaagctgcagccactcctaaaaagtcctctgaggccactctagagcctccggcaccactggcagataccacttctccacagcaagcagcagatccttcaatgcctgaagttcaaaccaccccagttctgtctccaaacacctctcctgtagctactcttgtactacatttgactgacgaggaggaggttcagacacaggacacccaggaccaatcacaggatctttaa

SEQ ID NO: 74872 - DNA, 357 bp, Glycine max
  Peptide Sequence Number=SeqID_166557
atggaaggatttattctaggaaggtcagcaagtgtccacccaatggcttttttgtggcctctcaatacctacaacaacttcttcacatgctcaggtgctcaggtagtggttttagctccaagtgtagaagcaaagcttcatgatgaatcaagagtatttcaaagatgttttgatgataacaaaaatgatgacaaaggtgatgacaaaaagctcaatggtcaatcaaagaatgagttcaagatgttcaagatagaatcaagaacacttcaagattcaagaggaaagttgaattcaagaatcaagaatcaagagatcaagattcaagacttaagattcaagaatcaagaaaaggcttaa

SEQ ID NO: 74873 - DNA, 443 bp, Glycine max
  Peptide Sequence Number=SeqID_166558
gaatctcatggagagttcgatcctggctcaggatgaacgctggcggcatgccttacacatgcaagtcggacgggaagtggtgtttccagtggcggacggccacactgggactgagacacggcccagactcctacgggaggcagcagtggggaattttccgcaatgggcgaaagcctgacggagcaatgccgcgtgaaggtagaaggcctacggttcgccgtcaaatcccagggctcaaccctggacaggcggtggaaactaccaagctggagtacggtaggggcagagggaatttccggtggagcgtgaaatgcgtagagatcggaaagaacaccacggcgaaagcactctgctgggccgacactgacactgagagacgaaagctaggggagcgaatgggattagataccccagtagtcctagccgtaaacgatggatactag

SEQ ID NO: 74874 - DNA, 264 bp, Glycine max
  Peptide Sequence Number=SeqID_166559
atgcggggttaccttatggttacccgcacctttcgtcaaccaggggaaaacgagccgattgacgggcgaagactaacatcgtcttctgcaccttttgtcgtcctgaccatgaagtcaggtgacatgcggagttaccttatggttatccgcacctttcgtgaaccagcggaaaacaagcccgttgacgcgcgaagactaacattgtcttctgcaccttttgtcgtcctgacccttgaagtcagcttttgtcgtcctgacccgtga

SEQ ID NO: 74875 - DNA, 201 bp, Glycine max
  Peptide Sequence Number=SeqID_166560
atgatgattcttggtgatgcttgtcaaaaaggaaaacaagtatacatattcatggtgaagagcacaaaggcaaaggaaagggaaatgatgcagactttcaaattgatgaaacaaaaacaagtacagatcttccaagagaatgaagaacttcaagataccatcctcttgataacatcatcggtgacatatctaaaggggtaa

SEQ ID NO: 74876 - DNA, 362 bp, Glycine max
  Peptide Sequence Number=SeqID_166561
gttacaagcattggaatatctcaacctctatcaggaagtgttgatggcatcatcgaccctccatcccccgtcagacgccacgtgaagtggaagatggcccgcaccaagaaaacaagggagatgacgattgaggctgcaaaggaaatcgttgaaaagatcgcaaagcaccctggacgtgtccgtgctgctggagccgctgacccagcaaatcagggaccagctagaggagtcgatcacataaaaagtgactcgacagcttatgacatcattcggccagatgcagtcccagtttcgtcccagatgcaatctcagggacttgcactggcttctggagcctctgaatggtcccttcaggtcctcga

SEQ ID NO: 74877 - DNA, 580 bp, Glycine max
  Peptide Sequence Number=SeqID_166562
atgaacggggctaagcgatctgccgaagctgtgggatgtaaaaaagaatcggtaggggagcgttccgccttagagggaaggacccgcgcgagcagtgctggacgaagcggaagcgagaatgtcggcttgagtaacgcaaacgttggtgagaatccaatgcctcgaaaacccaagggttcctccgcaaggttcgtccacggaggcctaaaccgtgaaaacggggttgtgggagagctatacaagtgtcgtgctgctaggcgaagcagcagagaatgctgcaccctagatggcgagagtccagtagccgaaagcatcactagcttacgctctgacccgagtagcatggggcacgtggaatcccgtgtgaatcagcaaggaccaccttgcaaggctaaatactcctgggtgaccgatagtgaagtagtaccggaaaccaccggagccgtagcgaaagcgagtcttcacagggcaattgtcactgcttatggacccgaacctgggtccgaaccgactgatgttgaagaatcagcggatgagttgtggttaggggtgaaatgccactcgaacccagagctagctg

SEQ ID NO: 74878 - DNA, 240 bp, Glycine max
  Peptide Sequence Number=SeqID_166563
atggagaagatggatttccacataataacaagggggacccctgaggctcgcccaggcgagctgaaacttagtgttgaagcaatgacctcgcccaggcgagctggagctcgcctaggcgagccaaaggctagcctgggcgagctagggtctaggaaaaccaaggatcatttgttttgcactgtaactggcgttcaacaccgtaagtcgactagcaaggatcaaaagatcaatgaacgatag

SEQ ID NO: 74879 - DNA, 186 bp, Glycine max
  Peptide Sequence Number=SeqID_166564
atggctagcatgtttgatatgccttttagaggcttgaaaagtgaagaaaaagaactgcgttttttgcatttttctggaaaatgcgatgaactcgctaagcgagcatgctgcgctaagcaaaagtgtatggtgccgctaagcgctattggacaagtggcatcagatatcttaagaagggggggttga

SEQ ID NO: 74880 - DNA, 189 bp, Glycine max
  Peptide Sequence Number=SeqID_166565
atgggagaaactctgatggaatgtgctttaaaaggacttgatgatactccacaacctaaatccaaggctgctgctaggtggattgttgttaagtattttaatgttgttagaccattggaagcaaagagattcaaggcgcttcacatccaatggacacagtattatctaaaaattagaaatcaaacatag

SEQ ID NO: 74881 - DNA, 303 bp, Glycine max
  Peptide Sequence Number=SeqID_166566
atgaagaacggcgatgtatttgtgcctaaaatcaaggacaaggagaggaaagatgccatcaatgttaagacacttgtctcctctaacacacgaagaagaacggttgaaaacgacagaaacaaacaaataaaactggacacaacaaaggaatattaccatcgtatcctcagacagtttcagaaagcagcacgggatatctatctatcattctcggctttgttgttccaccttagaatgtcttacaaggactttcttgttaacatcattcttaggggaaaactttcgaagcccttcatatggtaa

SEQ ID NO: 74882 - DNA, 747 bp, Glycine max
  Peptide Sequence Number=SeqID_166567
atgttcgtttcttcttcatcgcatgttccccgttggcttcaagtcctcctcacagagaagttctacaacgcttgcataattcacgaaggggcaaagaagaacgagaagaacgtgtattgcttggattgttgcatcagcctctgccctcactgtttgtcccctcaccgctctcacagactcttgcagattagaagatatgtgtatcatgatgttataaggttgggtgatgctgcaaagttaattgactgcaattccgttcaatcctacacaaccaacagcgcaaaagtggtatttttaaaccaaaggccacagacaaggaacttcagaggctccggcaatttctgcggcacctgtgacagaagcctgcaagacccataccacttctgctccctctcttgcaagatcaattatctcgtccgaacaacgggctctctctgcaactatctcttcgagtgcaactacctgccactaccggaatctggactcgacgacggattgatgacccctgactcggttctcgaaccggccggttcggcccgaacctcgtccggttcgggagggtacggaggggtggattgcagaaccaccttggcttgcactgccaccaccgaaattgtgagaaagaagaggaccggcggctccactttccggccaccgtgccggccggcgtgctcgccagtctcggaaatctcagcgggtctcatgaaccggaggaaagggaacccccagcgggccccactctattga

SEQ ID NO: 74883 - DNA, 363 bp, Glycine max
  Peptide Sequence Number=SeqID_166568
atgggctcagaaatctacccagaggttcatgagaaccctagggccttctttagcagctctaactcaatcctcttggagtcttctatccaagacccttgggggcatgagattgaagctatcaagaagaagatgactcatatgaatctagattgcacagtagtgcctcaaccctttcaagcttatgctaaagctctggaagccaaattgttgaggacaagagaggctcttaggcaagcccttgaagacaagaattcaatggcagcggaagggagaaggaagaaagatgattggagacgccacttcaaggagaagatgagtcaagaagaagctcaccaccataagaagccatggataagagcttga

SEQ ID NO: 74884 - DNA, 348 bp, Glycine max
  Peptide Sequence Number=SeqID_166569
atggctaccattcagcattggcctcttgaccagctggacatcaaaaatacattcttgcatggtgagttgcaagaagaagcttatatggatcaaactcctagttttacagcttcaagtaagtctcgattgcttcacaattctaccccaactcccgcatggtcgcagattctaaactacttcccgatatccaatcccttggatatagcgacacaagcaatcagcattaatggtcgagaattagcaaggcttaaccaagaccattatatccctagagataatcccaagtacatacttaattctgttggatcgagtgccctcagaataattaagaagggggggttgaattaa

SEQ ID NO: 74885 - DNA, 222 bp, Glycine max
  Peptide Sequence Number=SeqID_166570
atgggcaaacacagagaagaaatcaaggcccagcccaaatcatgcactcagcgcgccacccgagctaagcgagcagcacgagaaggagacgcactaagcgcgcgatgccagacaacaagcgctaagcaagaggagctcgctaggttacgagaatttatccttaacaaaacctcaaagagagtagtgcttgatcctcaagagaaaacaacgctggagacttaa

SEQ ID NO: 74886 - DNA, 618 bp, Glycine max
  Peptide Sequence Number=SeqID_166571
atggctacattccttcaaaggaaacaacttgtgaacgtggaaagaagtgatgaatccctcagtgaggcactcgatcgcttccgtgggttgctaaggaaaatgcctacacatggatacagtgagccggtgcaactcaacatcttcatagatggcctaagacctcaatcgaagcagctactagccgcatcccctggagaagccctgaccgagaccctcagcaagctaccacaacaactacaagcggattcaaccaaggaaggaactttacacaaggctcaagttggaggaatcacccagagaatcaatacgacaaggagcacaaaaatttcaatgtctaattaccgaagcacagaaacctccatcatgaacttggaaatgaaggtgggacaattggccaaacaggtggctgaaagaccctccaatagctttggagccaacatggagaagaaccccaaggaagagtgcaaggtcatgctgaccagaagccagaagaaagtacaagaggaggaagaagcaaaggaagaccagtctggggaacgaaggatagacggagaaggagagagagaagaagagaagagagaagaagaagggagaagaagagacagtcttaactcctaa

SEQ ID NO: 74887 - DNA, 345 bp, Glycine max
  Peptide Sequence Number=SeqID_166572
atggatatggacctgggcagcttcatttccttgcagatcagccagattgctcagtcaagcacatccaggttagggttcccatcattgatcacaacgctttgtgacatgcaaggggtcgtctctaacaccctaatttttgagtcactgacccctgtgatcaacctggcatacataaagaagaattgttggaacctcgcagacctgtccatcacattccccggggcccgacgcactcgctctagagctgtaacaccagcaccagaggcctctcttccttctcagcttgatcctcgtccaccggcgtctacctcagcaccacttgacatgcacatccagatgctttag

SEQ ID NO: 74888 - DNA, 720 bp, Glycine max
  Peptide Sequence Number=SeqID_166573
atggccagaaaccccgccaaagctaagaagaaagtgaaatccttgaaaaggaagcaaggagagtgctctcaagtagctctcaacaagctgggtatgtggttcatagatgaaaacaagaagtctgacttcaagatgatctatgctatgaagaatggatttaactttcccaacctgctcaaagcacaagagatgatcattggtgctgcagtttggaaagaagttgcaggaatagatatgggtggagtccgcaaatttgaagaatcaatggatggctacagtaagatggagacatacaaaggtatgcttattgacccagcaaggaatctgagaaaccgccttggagttggtggtttaacagctaaagatagaatgttagtgtatctcattacctacattctagcaccaaggtccaaccatcatgctcaagtcactgacgacaacttagaaattgtatatgggctaaaatcagagccaccaacaacagaaaacatcaatcaaatggaagaagatatggaagaagaagctcaacaagagcctactcaacaatggaacccttttgagtctcttatgattcaaaagttggatgctatccttcatctccatcaagagcaccaagccaaagttctcaactccttagaaaatattacaactaggcttaaaaacatagaaattaggctatccttgagtaaccttctgaacccagataaggatgaggcgtag

SEQ ID NO: 74889 - DNA, 634 bp, Glycine max
  Peptide Sequence Number=SeqID_166574
gaatttacaagatagtggaactctcaagcgggttgcttggggactggacgtaggcacaagggagaagaaagttgaagtttcaatggagaaatgcaagactctaattcttttttcgaagaatgatgggcttaattcttattgtaattctctttgtgcatctaaccatgcaaagtcttttgttttaattcctaaggaggaattgtacatcaaggatcaatgggcacaacaatttggaaaagaagtggttgcatataaggaacaagacatccattgggcgaagattttttatcattacatctctaggcctaatgttttgattgatatgcaacacgtgttaattcttgatttgcatgatacttttgatgttcatgatgcatatgctttgcataatctcagtttagacaacgagcatgatggattctttagtcacggggaacatttgtgtaaaaacatgatattttatgtgcctaaatttgccctacatgatccattaatgagaggaactcatggtgagagtttagtgaggcatgatgggcttaagtttaaggatagatggattgtgcatataaggggtaaagaggatttcaattcaaggacaaatcctctcaaaaaaggaggggatgatgagtattaa

SEQ ID NO: 74890 - DNA, 495 bp, Glycine max
  Peptide Sequence Number=SeqID_166575
atgagacctctctcgttcacgttcgtcagtccaaaagcaaggttctatatatgttcgaatccggcaagtgcaccggatcgtgcaagtagtataaaacgcctaatcctgatcaagcatcgtcctcaaattcctcttgttggactaaactcgaccagaaccgcattaagacaaacatacaaacaactaggtggccttgttggtgcttgtgcgcttagcacaactctggctcgcttagcgcgcattagtgaatttcggcttagcgctcgtcttgtcgctcagcggatggactcaagcagtgcgcttagcgggattagcccttgcttagcgaacatgcacaactcatccttcttccagattcttcctcgcgctcaaccaaggaatgttgtgctcagcgaatggctcactaagccaaaagattggcttagcgagcggatgaaaatcagcacttcacaaatatggctaattaacctgaaattgagaggaaatgattattaa

SEQ ID NO: 74891 - DNA, 276 bp, Glycine max
  Peptide Sequence Number=SeqID_166576
atgactaagttacctaggcttagcgaatcagcctcgcttagccacaggcatctcaataggaggatgagtgtttatcctcaaaagatgaactcgcttagcacgaagatgcaaaaagaacgcaagaatacaggttgcacagatttgggcgagagagaaaatgcaggaaatgctctgagaattttggcaaagcgaacttcagcgctaagcgagtcggagagatgtttagtttctcaaagaggttcgcttagcggaactgcgtgcttagcccaagcttga

SEQ ID NO: 74892 - DNA, 519 bp, Glycine max
  Peptide Sequence Number=SeqID_166577
atgaatgtgaattttcacaattcaaaaatcgatgtttgggtgatgagagagtataaccgtggtgacagctggtgcaagttgttcacgctggaggagtcgcgtgagttgagatcattcaagtgcgtgaggcccttgggatactcgagcgatgggaataaggttctattgaaacacaactggaagaggctgtgttggtatgacctgagaaagaaagaggttacccttgttagaattcagggttttcctaatttgaacgaagccatgatttgtttgggaaccctcgtcacaccgtatttcttacctcgtgaaatttgtaggaagttgcggactttaggatgcgaacatcccagtatatgcaccggtaaagattttacattaacatttaattacagactaacgtgtatggtaatggtggagtctaatgatggttcagctacagtagcggcacctggtgaatctgtgacagagtctctgaaaacaaattgtggtcatcggatggttgcatgcccctgtaggtga

SEQ ID NO: 74893 - DNA, 48 bp, Glycine max
  Peptide Sequence Number=SeqID_166578
atgctctctggtaatcgattaccacaatgtgtaatcgattacagcaag

SEQ ID NO: 74894 - DNA, 192 bp, Glycine max
  Peptide Sequence Number=SeqID_166579
atgggtagttctacaagaaaattggtagagaggatggggagagttaacttagagttaaatgtgagaatggtagtgttggaagtggaaaagtgtgagattttgagggttagaaaagccaaattcggggttagtggaaattggagtctaaagaaagcttgggcagagcaaatgagaaaaatggggatcctctag

SEQ ID NO: 74895 - DNA, 579 bp, Glycine max
  Peptide Sequence Number=SeqID_166580
atgtatgaccagttaaatgaagcttctcagagcactacacgacagattgttgggtaccttactttattacaatgttggatatataagcactttcccagtgtgcatgactgcgtcactgatgatggctatgatgagacgtccccacgtgcctgccggtggcttactacgaaggcttatatgaagggattaccagcatcgttgtaccaaacatgtttagatgctttgacgatcactaacgtttcaagagattacatggagtggttcttcctgatatctcatccattcataacacccacacaggcaagtgatcagcccagacatccatctgttccacagcatgaggtatacatggagccagatattccggaggtcccagtggtagcagaaggtcgatcgtcacaggcatttcgtccccccatacatgaagtggatgcttgtgaagcgatcgcagaaaggttggagtgtgtgctcaacctaaggatggtcactgaaggcacagagttacatgagatcatggaagactgcctcaggatcgttaggggtgtcacctcagatggaaatgtgtatgttagggcatga

SEQ ID NO: 74896 - DNA, 450 bp, Glycine max
  Peptide Sequence Number=SeqID_166581
atgggcataccgaatcgtcatagattccagggctacaaccagggaaattcatccagattccatcaaggggcagcaggattcaatcatgggccaccgggatttaatcaaggaagaaacttcacgcaaggctcaggatggaggaatcagggaaatcaatataaggagcaaaggaaccaaccaccataccagccaccataccaacaccctagtcaaggtccaaatcagcaagaaaagcccaccaacatagaggaactgctgctgcaattcatccaggagacaagatcacatcaaaagagcacggatgcagccatacgaaatctggaagttcaaatgggccaattggcacaagacaaagccgaacgacccactataactttcggggctaacacggagaaaaacccgaaggaagaatgcaaggcagtgctgactcgagggcagagaagagcatag

SEQ ID NO: 74897 - DNA, 213 bp, Glycine max
  Peptide Sequence Number=SeqID_166582
gcactgttcggtggagtggccctcgagggaaagttccttatcgcgttggaaccggcgccaaagtgggcattgccggccgggcgagtcggggttggagtcgtagcttggggggtctccctctggattggcggaggcaccctagcttgtattggtgctgagttggaagattccccgacgcgagttgagaagctcgggttatgttgtgcatactga

SEQ ID NO: 74898 - DNA, 468 bp, Glycine max
  Peptide Sequence Number=SeqID_166583
atgtcttccccttcagagggccgcatgtcctcgccttcgttgggatacacacccttgccttcaaagcactacacgccctcgccttcagagggctgcacatccttgctttcagagggctccacatctatgccttctgagaactcaagggatcgcgcccacaagacagccagtggacccgaagaagtccaacagggccctggggttctagctctaattatgggactctgtcagttctacagagtgaccaccactccgatctccccctgccaaagtgatcgcgcccgcaagacacccagtggacccgaagaagttcaacaaggtcctggggttctagctttgattatgggcctctgtcggttttacagagtgcctgccgcccccaacaaggtcatcaggccccctattaaccgggctttcatcaagaagtattgcgcccccaggcaggcgcagggcgaggcaccacggtag

SEQ ID NO: 74899 - DNA, 946 bp, Glycine max
  Peptide Sequence Number=SeqID_166584
tacgacagtcaccgctttaggagcgttgtacatccagcagcgcttcgaagccatcaagggatggtcgtttctccgggagcgacgcgtccagctcagggacgacgagtatactgattttcaggaggaaatagggcgccggcggtgggcaccactggttactcctatggccaatgatcccgttcgatgccgacgctatcagccagctccgggatatccgatggtgttggaagagggccaggaatgcgagtatggccagaggaggaaccggtctgatgggttcgatgaggaggccatcgcccagctgctatgtataccggggcaggattttgcccggaccgctgcagggaggcgagtgcgaatcatgcgcaccaacatgaccaccctgacccagatatggatgacgttgctcctcagcaacatcctgcccaccgatcataattccgacctccccatgcctaagtgccagctggtgtacgccatcctgacacggatgagcatccatgtggctcagttgatcgctgatgccatctatatttttgcaggtatggcgcccactaggcaccctttggacccagataagtccaacagggccctgggattccccgcactgatcacaggactctgccagtcgttcggagtccccgttgcacctaccaaggtgattcggccgcccatcacccgggcttttattgagaagtactgtacccagagacaggctcagggtgatgctccacaggccgcaggcgcgcccccaccacctcatcaggctggccaggctggggcatttgacatggagcagtatttacggcatttggttcgccagcaggcggccaaccaccgagcacatgtacggacccatgattgtctgtaccagatgagccttagcatgcagagccagggcttcgcttctttttcatgccctactccagaccagttcagggcagag

SEQ ID NO: 74900 - DNA, 867 bp, Glycine max
  Peptide Sequence Number=SeqID_166585
atgtatctggcgggcgcggcggcctttgtgctgtgcggcctgctggtgtggaagcggctgccttcgatgccgaaaaccgcggcgacgaacgcgcccctggccgcaccgcggcagcatcgccgcgattcgctgctgctgttcgtcgcctgcaccctgatgtggaccgccaacagcatgtacctgatcaacatgccgctgtatgtggtgcacgagctgcggctgccggagcggctggccgggatattgatgggcgccgccgccgggctggagatcccaatcatgctgatcgccggcatggtggcgaaacgctgcggcaagcgttgtttgatgcgcggggcggtggtcgccggcgtgctgttctattgcggcctgctgtttatcaccggcagttggccgctgattgccctgcagctgctgaatgcgcgtttatcggcgtgctggcgggcatcggcatgctctactttcactggatttgatgcccggtcaggccggcacggccaccacgctgttcaccaacaccattcgggtaggctgggtcatcgccggcgccatcgccggtgcggtggcggaaatctggaattaccatgcggtgttttacgccgcgctggcgatggcggcaggcgcgacgctgtgtctgtggacgttgagggaagcttaaggcgcagtgtccgcttccagcctggcgagataaatcagcgcctgatcgcggtgatcgtggcacatgtcgcggctcggctgcaggctgccgcacaccttcggccgcagcggcgaatgaaacaggccacagcgcagccgttcatccagatgaatgcagcgggtattggcgggcttgccgttcggcatgccggggatcgggctggatattga

SEQ ID NO: 74901 - DNA, 1727 bp, Glycine max
  Peptide Sequence Number=SeqID_166586
atgttatgctgggcgcaggttgtactttattccacagcaggagcttaccgtctgatgtccgtgcgcattttcgctgctctggtgctctcggcactgagtttcggtctgcgggccgaagccctcaacgaaagctacgctttcgcccttctcggtgaaccgaaatacgccaccgacttcagccatttcgactacgtcaacccggcggcacccaaaggcggcgacgtgcggctggcggccatcggcacctacgacaacttcaaccgcttcgctacccgcggcgtgcccggcgaacgtacgatggagctgtacgatacgctgttcaccaactccgacgacgaacccggcagctattatccgctgattgccgaatcggcccgtttcccggccgacatgcgctggatggagttggatatcaacgcccgcgcccgcttccaggacggcagcccgatcaccgccgccgatgtggccttcaccttcaataaattcatgaccgaaggcgtaccgcagtttcgctcctattacaaaggcgtcacggtcaaggccatttcccggctgacggtgcgcatcgagctacctaaagccaaccgtgagcaaatcctcagcctgctcagcctgcgcgtattgccggaaagtttctggaaaaaccataagctcaacgaaccgctcagcaccccgccgctcgccagcggcccgtataaaatcgccgattaccgcctcggccagtacatcacctaccagcgagtgcgcgactactgggccgccaacctgccggtgaaccgcggccgctacaacttcgacagcattcgctacgattattacctggacgataaagtatcgctggaagccttcaaggccggcgcttacgatttccgcatcgagccgtcacccaaaagctgggccacccagtatcagggcggcaacttcgcgcgcaactacatcatcaagcaggacgagaccaaccaggcggcgcagaatacccgctggctggcgttcaacctgcaaaaaccgctgttcgccgatcgtcgggtacgggaagcgatcggcctggctttcgacttcaactggatgaacaaggcgctgtattacaacgcctatcagcgcgccgacagctatttccaaaacaccgcctacgccgcccgcggctacccggacgccgccgaactggccttgctggcgccgctcaaaggccagataccgccggaggtgtttaccagcatctaccagccgccctcctccgacggcagcggcaacgatcggcaaaacctgctgaaggcgacccaattgctgaaagaagccggttgggtggtcaaaaatcaaaagctggtcaacgccaaaaccggccagccgttcaccttcgaactgatgctgctgagcggcagcaacttccagtacgtattacccttccgccacaacctgcagcggctgggcatcgagatgcaaattcgcgaaattgacgcctcgcagtacacccgtcgcatgcgtgaacgcgatttcgacatgatgtcgaccgtatatatggcgatgccgttccccagcgccgatctgcaaatcctgtgggattcgcagtacatcgattccagctacaacacggccggcgttaaagatccggcggtcgacagcctggtgaggcaaatcgccgcccatcagggcgacgaaaaggccctgttgccgctcggccgcgcgctggatcgggtgctgacctggaacaattacttgctgccgatgtg

SEQ ID NO: 74902 - DNA, 67 bp, Glycine max
  Peptide Sequence Number=SeqID_166587
atggaaaagtgcaaagaagcatcaacacctatggcaacatccacttatcttgacttagatgagaaag

SEQ ID NO: 74903 - DNA, 243 bp, Glycine max
  Peptide Sequence Number=SeqID_166588
atgttggccatcatcagcaaatacaaagaagaattggacttggccaccgcccacgagcacaaagtggcggacgaatacgctcgagtgtacgcgaaaaaggaggctaggggaagggagtcaagatcttccccgattactggtaaaggccaaagcaatggcagacgcatactccgcccccgaggaaatccgcgggctcctcggctattgtcaacatatgatagacttgatgacccatataattag

SEQ ID NO: 74904 - DNA, 360 bp, Glycine max
  Peptide Sequence Number=SeqID_166589
atgggcccttctagaggtttctgggcaatttcttgcttaaggttgaagcaacctcgagctaggctgaagggggctgttctaaggatcctggatgtgcctggtgaggtatttcagctgttttgggtgaaaaacaattgtttccgtgaagaaaatccaagccgaggtgcttccgtaacgcttccgagaggtttccataagcaaatccgtgaaggttttcctccgttattcaccgttcttcatccgttcttcattcttcgttcttcgttcttcgttcttcaacggaataggctgttgtcctttgagacaaacgtgagaggtgctaataccttcctcaagcgtaaatacaactcccgaacttag

SEQ ID NO: 74905 - DNA, 311 bp, Glycine max
  Peptide Sequence Number=SeqID_166590
atggttcgatgttctggtgtcctaggcgtaggaggaaccacaccaatccatcccgaacttggtggatactccggggaacagatatccagtggagatgacggggtgggggctgtagctcagaggattagagcacgtggctacgaaccacgggccccggactgtggaacaaaggagtatcccgaacctacaccgagtcagttaacagccgaccgctctaccactgagctactgaggaacaacgggaaattcgagctcatagagttcaattcccgttctcaacccatgaccaatatgagctcgaagtttccttc

SEQ ID NO: 74906 - DNA, 549 bp, Glycine max
  Peptide Sequence Number=SeqID_166591
atggcagaaccatcgaagaagcgaaagggttcttcgagtagaagccaacagagctttgggtctcaagatactccaattccatcatccatttcgtcctccacgctattctcatctgaagagcaacgtatccagtacataactctcttctcttctcactctataatagatcctaagttcatggacatggagttcttttctgatgaaatgtttgagtgtgttcaagcatttcagaactctgatctcatttcgtttatgtctttaaaaattcttgtttatcctaagttagtgaaagttttttattcaaacttggaaattcaagaaggttccttgatttctaagaagttcgatttttctgtttctgatgcccgccggttggtttgcatcaaccaagtggatatgaccggaaggcttcttgccagctcattgacatttgattgtcgcatcctccactatcttattgttcacattttacttccaagatctttaaaccttgcacgggtttttgaagaagatctcattatcatgtgggcatttcttaccgattgttaa

SEQ ID NO: 74907 - DNA, 399 bp, Glycine max
  Peptide Sequence Number=SeqID_166592
atggggacaaatcaaactggcaaaaggttttatcaagtcaaggttaaaggcctagatgttaccagcattaaggaattggggcggttgatgggacctctccaaatgcaagccttccgcaagacttacggaaaaatcttagatttgaacatagcagagaattgcaactgtggtcaaggattcagcaagaggtttggaccgcgtaaaacaaactcgaaacgacatagcgggcctaccacgaaagtacctagaagacaaggcgagggatatggaaaatcaagaatagtgggtcccgtttatggatgtgttagcattgctaatctttggggtcgtcctctttccaaacgtggatggtttggtggacctagccgcaatcgacgctttccttgcataccaccatag

SEQ ID NO: 74908 - DNA, 208 bp, Glycine max
  Peptide Sequence Number=SeqID_166593
ggatcacacccgcaaaacacccagtggacccggagaagcctttgttagttctacgaagcgctcgtctcccctaacaaggtcattaggccccccattaaccgggctttcatcaagaagtactgcaccccctgacaagcacagggcgagacaccacagcagcctggggatggccggcagcgggcaacagacgcaccgccaccacctctaa

SEQ ID NO: 74909 - DNA, 689 bp, Glycine max
  Peptide Sequence Number=SeqID_166594
gaattcgatcgcaatcgtcccgagctgaacaccgctttcgcgtttgaatctgcggctgatgagctggtctatatttccggtgcctccctttccgtggccctggcggtttcgctgtttcccgaagctggaatgctgatcagcacggccttcctcgccgtggggacggttgccttcctcctgcagcgttccagcgagccgccggttcgtgcgctcgaccggaaccacccgcaacgttcggcgatctggtcgcgtcccgtgcaaatcatcacgcttgctctcatcttcgtcggctcgaccttcgcaacggctgaagtcagcgccgtggcgatcacgcgtgagcttggcgagcccggcgccgccagcatcgtcatcggtgtctatgccatcggttcgtttcttgtagggataacgcttggcgcattgtcgatccgcattccattgcagcgccagttgctgatcgccgtcagcgtccttgccctgactgcgctgccgctgcccttcgccggtacatcaaccgcgcttctggcaacggcggtgttcgtcagcggtgttgcgatttccccgacatttatcacggccttcggcctgatcgaacgccgcgtgcccgaggcgatgctgaccgaaggcatcacctgggtcatgactggcattggcatcggcatggcgctcggggccttcgtttccgctgg

SEQ ID NO: 74910 - DNA, 736 bp, Glycine max
  Peptide Sequence Number=SeqID_166595
gtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatcacgatcatcttttccctttcctcggactggcgatctatccaaaggatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacaggaa

SEQ ID NO: 74911 - DNA, 324 bp, Glycine max
  Peptide Sequence Number=SeqID_166596
atggcgaaggatcaatacatggggttcttctttggagggttgcgtgaagatatcaagatggaagacgttctacccgggatcgacaaccatgaaatagcctgtcaagttctggattataatgccattgattccactgagttgttaaaatctaaaaccatcaagctggaaggggtggactggttagaaaaacatggcaacactacaatggattggaaaatgaggaccttaaactttgaggataatggggcaatcatcaccttcaaaggctaccaattgagtgatggtgttgtctcctctgtgttggatcgagtggcctcagaataa

SEQ ID NO: 74912 - DNA, 180 bp, Glycine max
  Peptide Sequence Number=SeqID_166597
atggacattttgcttcccattgtcctaaaaatttgtgcaattactgcaaaaaaaggtaaagcttttttacccagctctccttggtattttaactctagcgcatccaatcatatgaccaacaatgttgctgcacttaccaaggatcaacactcagggaagatcatcgcgaaaggggcctaa

SEQ ID NO: 74913 - DNA, 996 bp, Glycine max
  Peptide Sequence Number=SeqID_166598
atggaggaaaatctgcctcccggattcaggttccaccctacagacgaagagctcatcacatgttatcttacaaggaaggtttctgattctagcttcacatccaaagctatagcagttgttgatctcaagaagtctgaaccttgggacctcccaggtaaggcctcaatggggaagaaagagtggtacttctttagcctaagagaccgaaagtatccaacaggacttcgaacaaaccgagccactgaatcagggtactggaaaaccacagggaaagacaaggaaatttttcgtgctggggttttggttggaatgaagaaaaccctagtcttttataggggtagagctccaaggggcgagaaaagcaattgggtcatgcacgaatatagactagaaaacaagaatcactttagaccttccaaggacgaatgggtggtttgcagggttttccaaaagagcttgcaaatgaaaagaccacagcaaacacccccctcacaaccagagtccccatgtgacacagcctcaatggtcaatgaatttggtgatgttgagcttcctaatctaataaataacattgcaaattcttcatcagatggaatcactaacaacatttcaggacaaaccttcttcaatgctgatcttattaatagtgttaacacaaacatgaacttgaccatgaattggccagttgcaagtgaggtaattcaggttcccactcttccatcacttccatggccttctgggttgttaaatccaagtatttctgtaaattctttgcttctcaaggcattgcaacttaggagctatcaacaaatagaagcagcagcagcagcagctacagatcatttaattgcatcatatatgcctcaaggagtgtcccagcatgttggaactaacctaattagttcaagtctcactgcatcttcttcttctaaagttttagaatgtgttccacagcaacagcaggagcaaccattcaacttggactccatttggtga

SEQ ID NO: 74914 - DNA, 258 bp, Glycine max
  Peptide Sequence Number=SeqID_166599
atgaacaattgcttgttggcaaagtctatgaatacgttagaggtgtcaaacctactgaaatctctccaagtttgggctcacattcgtgatttggctcctttccgcaggcgtttcacttctttacaacgcattactgactctttaattaggggcagatccacatcaagtgttcaagaaaaattacgttgtctggctatagcaattacagtctactgcatttggctgtctaggaacaagctgatttttgaagatttttaa

SEQ ID NO: 74915 - DNA, 129 bp, Glycine max
  Peptide Sequence Number=SeqID_166600
atggagaggagtattactcatatgatgaaaaagaaaggtttttcacgtgccaaaggaatgggaaaaattgaagctgatacaaactcctacgtcagatgcaaaattgacatgattttgaaagaaatgtga

SEQ ID NO: 74916 - DNA, 2373 bp, Glycine max
  Peptide Sequence Number=SeqID_166601
atgagtgacagcaccaacacaaaccccccaccacctccggtggcggagccaccgccaccaccgcaatccggttcaccggaaaacgacgtcgcaatgtccccccaaaactcctccgaggacccagactcctccctccccacccaaacaacacccgagcccgccgttccagactccccggactccgccacaacccgacccgacccgaatcctccgcctcgaaaacgccgccgccgcaagaaattcttcacggaactcaccaccgggccatccacgcgccgaaacgacgtcgccaaggactgtgacgtggaagccctaatcgcgatctcggtagggtttcccgtggattccttaaccgaagaagagatcgaagcgaacgtggtttccaccgtcggaggctccgagcaatccaactacatcgtcgtccgaaaccacatattggcgcgttggcgttccaacgtttcggtctggttaacccatgaccgggccctccggtcgatccggtccgagcacaagggtttggtcgaaaccgcttaccggttcctgctggagcacggttacattaacttcggcctcgcgcaggagatccaaaccctaaagctgaaacctttcgatgggtccgaccgaggaacggtgattgtgatcggtgctgggttcgcgggtttggttgcggcgagacaattggtgttcatggggtttaaagttgtgattttggaaggtaggacccgacccggtgggagggttaagactaagaagatgagtggtgatggggttgaggctgcagcggatttcggtggaagtgtcctcactggaataaacgggaaccctcttggggttcttgctagacaattgggtttgcctttgcataaggttagggatatttgtcctctctatttgcctgatgggaggagtgttgactctgaggttgactctagggttgaggtttcgtttaacaagctgctggagagggtttgtaagcttaggcaggcgatgatcgaggaggtgaagtcggtggacgtgcccttggggacggcgttggaggctttccgaagggtttatatggtggctgaggataaggaggagaggatgttgctgaattggcacctcgcgaatttggagtatgcgaatgcgacgctcatgtcaaatttgtcaatggcgtactgggatcaggatgatccctatgagatgggtggtgatcattgcttcattcctggggggaatgagaaatttgttcgcgctttggccgaggatttgccaattttctatgggaggactgtggagtgtgtcaagtatgggagtgacggggtgctggtttatgctggtgggcaggagtttagggggggcatggtgctgtgtactgtgccgttgggggtgctaaagaagggagatattgagtttgtgccggagcttcctcagaggaagaaggatgctattcataggttggggtttgggttgttgaacaaggttgcaatattgtttccttataatttctggggtggggacattgacacgtttggtcatttgaccgaggatttgagtatgagaggggagttttttctgttctatagctactcctcggtgtctgggggcccgcttctggttgcgcttgttgctggggaggctgcgattaggtttgaaatgatgtcaccagtggagtctgtgaagagggtgttggacattctgaagaatatttttaatccgaaggggattgttgttccggatccagttcaggccgcgtgtactcggtgggggaaggatcactttgcgtatggatcttactcttatgttgcagttggatcttcaggagacgattatgatattcttgcagagagtgttggagatgggacagtgttctttgctggagaggcgactagcaagcagtatcctgcaactatgcacggggcgtttctcagtggaatgagagaggccgcaaacattttgagagtggcaaagaggaggtcttcaatgcctattgacacatcaaaaagtgtcaaccaggagaatgatgatttgaacaaattgtttgtgaaacctgatctgacatttgggagcttctctgccttgtttgatccaaatttgaatgatcttgattccagttcattactgagggttaaaattggaggagctgtgttggactctggcagtctttatctctatgccttgcttccaaagaagtgggtcattgagttgagtcagttggagggagatgagaacaggatgagaatgttaaaccgcaatttcggggtgagtttggttgggaggaagggtttaagtagtgctgctgaatctcttattgccagcataaaactgtctagacccaacttaaatgaagcggaaaatggtcttattatgactgggaaggaaaactcgcagtag

SEQ ID NO: 74917 - DNA, 2133 bp, Glycine max
  Peptide Sequence Number=SeqID_166602
atggaggctccaccaggtggatccggatccggatccggacccgagcgagataaatccaccgctccctcctcttctccgatctccgtcgtctccgccttctggaaagattttgagttggagaaggagaaatctatattggatgagcaagggcttcgaattgcagagaaccaggaaaacagtcagagaaatcggcgcaagcttgcagagaacactagagacttcaaaaaggcttcgcctgaggataagttaagtttgttcaattccttgcttaagggctatcaagaagaggttgataatcttactaagagagcaaagtttggagaaaatgcttttctcaacatctatcaaaagctctatgaagctccggatccttatccagctcttgtgtcgattgctgagcaagatctcaagatatctgagcttgaatctgaaaaccggaaaatgaaagttgagcttgaggagttcaggacagaggcaactcacttgaagaatcagcaggctacaatacgaagacttgaagagagaaacaggcaattagagcaacagatggaagagaaagtgaaagaaattgtggagattaagcaacgcagtctggcagaagagaatcagaaaacaatggaagttttgaaagaaaggtatctgtttcttaccattgccaaagtggactatagaaagaagggagggaaacataggatggagaacccatgtgagccaaagaaatactggctccaagcactacctgcacacatggcaggggaacaggcactgcaagatcagttgcagcatgccaaagacagtgtttctactatgcagaaattgcatgaactcgcacaaaaccagttgtttgaactccgcgcccaatctgaggaagagagggcatctaagcaatcagaggtcaatcttctgatggatgaagtggaacgtgcacaatcaatgcttcttagtttagaaagagagaagctgctgagtgctgatgcttttccatgttcaataagacttgctgtttattgtagcgatacttctgtgtctatgcagggggttctccgaaatcagttgcaaacggcaaatgaagagactgaaactaagaatagtgataattttgactcaaatagcgcgctggagaattctttaaatgccaaagaaaaacaaatctctgatttgaacatggaactacacaatattgaaacagccttatcaaatgaaagagatcaacacattaatgaagtcaagaaacttacggccatgctcaatgaaaaggaggctgcccttgaggagatgaagaaagaacttaaagcaaggccaacagaaaagatggttgatgatctgcgcaagaaagtgaaaattttgcaggcagtgggttataattcaatcgaggccgaagactgggaagtggctacaagtggagaagagatgagcaagatggagtctcttcttcttgataagaaccgtaaaatggaacatgaactaacacagttgaaggtcacgctttctgagaaaacgtccatactggaaacagctgaacagaagatagcagaacttacagcaaagtctaatgaacaacagaaattgatacagaagttggaagatgatatattgaagggatatagttccaattcaaaagaccgtaaagggaacttccttgatgattgggatctttcagaagctggtgggggtgaggtttctgagaatactgaccaaaggcaagtatccttagaccaagatcagagctcaatgcttaaagtgatttgcaatcaaagagatcgatttaggacccgcttgcgagagacagaagaggaaataaggcagttgaaggagaagattggggtattaacagtggaactggaaaagagcaaagttgataatgtcaaactatacgggaagattcgttatgtacaagactataatcatgagaaagtggtttctaggggttctaaaaagtatgctgaagatcttgaaagtggtttcatgtcagatgtggaatctaaatacaagaagatatatgaggatgatataaatccttttgctgcattctcaaaaaagcttgacaaaattgatagcgcttgtcccttgaattcgagaccaagggaggaatctcctaaaatacgaagaagaagaaggataaaaataaactga

SEQ ID NO: 74918 - DNA, 198 bp, Glycine max
  Peptide Sequence Number=SeqID_166603
atggcgagtcccatgaaggaagatgagaagaacgagcgcgtgattcgaggtcttctcaagcttcaacataatcgcagatgcgttaactgcaacagtctgaatgattcagtgctctcagaaagtggatcaaaggcttcctattcaacggattcagattattctactttagatgcttctgatgcttccctatttagctag

SEQ ID NO: 74919 - DNA, 1311 bp, Glycine max
  Peptide Sequence Number=SeqID_166604
atggagactggtgaaaacaacagtactagtagtagtaaccaaagttgtgcagtgatgaaggattctaaatggtacactcaattcagaaatgtatccaatccttggatggcaagatatgtgtatggcttgattttcctagtggccaatctgttggcatgggctgcccgtgacgaactttctagtcttagtgctttaacagaaatgaaggcttcaattctaacgtatattgaacccgcagggttaaagggatgcaaggttggaaaaaactgtttgggtgcagatggtgttctgcgtttattttatatgataatgttttggtcgactgctggcacttctaaattgaaggaaggcagagatgaatggcactctggatggtggttagtgaagattgttgtcttggtccttgtgacaatattcccatttttacttccttctgagttgattgatctctatggacagattgcacattttggtgctggggttttcctcctaattcaactaataagcataatcagcttcattaactggttgactgattgttttggctctgaaaaatatgcagaaagatgccaaatccaggtgatgttatttgcaactatttcatattttatctgcttggtggggatcattttgatgtacatttggtatgcgccacaaccatcttgcctcctcaacattttcttcatcacttggaccctagtgcttctccaactcatgacaagcgtatctcttcacccaaaagtgaatgctggcattttaagtccagggttgatggggctctatgttgtcttcctttgctggtgtgcaattagaagtgaacctgagggagctgaatgcatcaggaagtcagaatctgcaaacaaaacagactggcaaagcatcattagctttgttgttgcaatactagcacttgttgttgcaacattttctaccggcatagattccaaatgctttcaggttctccaatgcatatctaacaaatccttacagttcaggaagagtgatccaccagcagaagatgatgttccatatggttatggtttcttccacttcgtttttgccacaggagcaatgtactttgcaatgctattgatcggatggaatagtcatcattctatgagaaaatggacaattgatgtgggatggaccagtgcatgggtcagaatatggactcctccagatactgctcttaggaaaaaggaatcaacaccctgcaaatttgatgtcagaagcaatggttctgccaaaaatgcacataagctgttgggtttgttacttgaagctacacagtacctgttcatttatccctga

SEQ ID NO: 74920 - DNA, 1032 bp, Glycine max
  Peptide Sequence Number=SeqID_166605
atgggttccattggtaacagcgaggttaaaaatcataatcagcaccatgaggatggtggtgataatggggtgaatttctcgatccagagagggtttgggacgaaactgaaggaggcgttgaaggaagcgttgtttccggacgaccccttcaggcagttcaagaaggagcagaagccaatgcggagagtgatgaaaggggtgcaatactacatcccaatctttgagtggctccctacttacaattggcgcctctttgtctctgacttgatcgctggcctaaccatctcaagccttgctatccctcagggcattagttatgccaaacttgctgaccttcctcccctcgttggcctttattccagctttgtcccacctttgatctatgctgtttttgggagttcaaggcacatggcagtcgggacgatagcaggagcatcgttgcttattgctcaaaccatacaaaccgtggcagacccagtagaagatccaacgttgtatcttcatttgattttcaccaccacctttatcaccggtgttttccaggcttgtttgggattatttaggctggggatagtggtggacttcttttcccatgctaccattaatggcttcatcggagggacagcagtagctctcatcctccaacaactaaagggcgtatttggaatgaaacatttttcaactaaatcgaacatggtcgaagtggtgaagagcattgtccgcaatagacacgagattaggtgggaacctgcggttcttggcgtcatcttggttgctttcttgcaatttaccaagcacctgaggaataagaatccaaaactcttttgggtaacggctatagctccaatggtgactttagtagtttctggggttttcacctacctcgtcaagggccaagatcatggaattcaaattgtgggccatctagataaaggactaaatcccttgtccatccactatctgaactttaattctaaatatttaccagcagttatgcaagctggtcttatcacaggggtgttgtcattagcg

SEQ ID NO: 74921 - DNA, 210 bp, Glycine max
  Peptide Sequence Number=SeqID_166606
atgaatgatgtagagactaatgcatcatcagggacaaacttgaggcttcgtaagaaaaatgatatggaacagtcttttcaatggcatctgattctcttgtatttgaaaatgaggagatatgatcttcgaaagggtggtgatatctggatagagtgcaccagttttggaggaaagattgtctacaggctggaaaagagctgcacccagtaa

SEQ ID NO: 74922 - DNA, 3369 bp, Glycine max
  Peptide Sequence Number=SeqID_166607
atgcacgagcttatccaggttgtgtttaccaggttaccagagattgaggccaaggatagagaaggggactcagaatcagacatggaggatggtgatgagggcggtggcttggaatctggctacggtgttcgttgcgccattgatatctttcacttcttgtgctctttgttgaatgttgtatccatagttgaggcagatgggtctacttctcacacagctgatgaagatgttcagatttttgccttggttttgataaactcagccattgaactgagtggggatgaaatagggaagcacccaaagctcttaaggatgatccaagatgacttgtttcaccatttgatttactatgggacatggtcaagctcctttatcttgtccatgatttgcagcaccgtcttgaatgcctatcactttctccgaaggtttattcgattccaactagaagcattctttggatatgtgctgtttagaattgcaagttttgggagcacaattccacttcaagaagtggcagttgaaggaataataaatttctgcagacagccaacattcatcgttgaagtttttgcaaactatgattgtgatccatgttgccggaatgtgtttgaggaggctgggaggttgctttgcaagcactcatttgcactaaatggccacctcactagtttgcacattcaatcctttgaaggcctattgatcatgattcacaacattgcagataacattgacaaagatggtcatcatttaggtccacacacaattcaattgcccacgtatagacccttttgggaggagatggataaagaagaagaagacttggaagattgggtgaaacatgtaaggatgagaagacttcagaagaagaaacttttgattgctgcaaaccatttcaacagagataataagaagggtcttgagtacttgaaacatgcaaagttaatctctgatcctcctgatcccaaggcttatgcttacttctttcgttacactcctggcataaacaagaaagcaataggggaatttcttggagaccctgatgctttctacctccaagttctcaaagaattcactgcaaccttccatttccaaggcatgaatcttgacactggccttaggttttatctagagagtttctggctgccaggagagtcacaaaagattcagcgtgtgcttgaagcattcgcggagaggttttacgaccatcaatcctcagacatgtttgcaagcaaggacactattctcatcttgtgctactccctcatcatgcttaacactgatcaacacaacccccaagttaagaagaagatgacagaagaggaattcatcaggaacaatagagcaatcaatgcgggaaaggatttgcctagagagtacctttctgagcttttccaatccatttccacttgtgcattttccctagagaaaaccactgtttcactagacatgaacccgagtaggtggattcagatcataaaccgatccaaggtggtacaacctttcacccaatgcgacttcgatcgtagaatatgtagagatatgtttgcctgcattgccggtccagcagtggctgctctttcatcattctttgagcatgctgatgaagaggagatgctccatgagtgcattgaagggttattctcagttgcaaggatttgtcagtatggactagaagatacccttgatgagctcataacatcattttgcaaattcacaacactactaaatccttatgcttctatagaagagaccatgttcacctttagtcatgatttgaagcccaggatggcaacagttgctgttttcaccatagcaaactacttcagagactcaattcaaggaggttggaagaacattgttgattgcttgttgaaactcaaaaggcttaaactactacctcaatctgtcattgattttgagtcggtggatgtcccaacaacacctgaatcaggtgtcgtgtctccaactgatgatcataaatttggaagccagagagtcgctagcatgatctctcggtttttgcatctttcgtcagaaagcatggaagatggtttgacccttggtagtgaatttgaacagaacaccaaaatgatcaaaatgtgcaatattggtagcatcttcagcaattgttcaaacatccccaaagaatgcttacaaagccttgggaggtctttgatatttgcagctgctggaaaaggccaaaagttcagcacaccggtggaggaagaggaaacggtcgagttttgttgggatttgatcactgcaatatcaatagccaatgttcatagattccacatattctggcccaacttccatgagtaccttctttcagttgctcagtttcccatgttctccccaatcccatttgtagaaaaaggtattttaggccttctcaaggtctgtctcaagctcttttctgcaccaagagacgaaaaacaagccgaggaacttattttcaagtccgtaaacttaatgtggaagcttgatatagaaatcctcgacacgtttcacgatgtcatatcacattcaagtagcaaaatactgattgaataccatgcaaatttgcagactcaaataggatggaagtcagtgctaaatctgttatcacctgtttggaggcatcctgagaactatgatgtgggatttgaggtcctgatagcattattttctgatggcactcgcttatcacgcacaaactatggagattgcgtagattttgcctttgggtttttcttagccaagaacattccaggggaaaaaaagaagatgatactagacctattggttggttcagtaaaaatgttgattcaatggcacagaaatcaatacacggatccgggaagcaatgccagtatagcaagctactcaagcaattcctccatagaggactattcaagaggtactgttgcttctgcaaacttcatgagccaattatcgaaacttggagaagtattcagaaggacatgcttatcaagacaggaggagatccatgacaagatgttggagtactcaaagagggaaaatgctgagagggaaacaaggagtatggaagggacccttaagcttgcagtggagttgttgtcagatatgtacttgcagtcattcagacaattaaccgagattccgggatttaggggaatctggttaggcttattgagaaggatggacacatgcatgaaggctgatttgggacagtatggttcatcaaatttgggtgaaatagtccgtaatttgttgagaaagatcataacacaaatgaaggatgagggaattttggaaccaagagaagaagatgatatgtgggagattacatatattcagatacaatggtcatgccctagtctcaaggatgagttatttcccttatag

SEQ ID NO: 74923 - DNA, 156 bp, Glycine max
  Peptide Sequence Number=SeqID_166608
atggcatctcaaggtcatggtaacaagctcatcgtttccacatcaccaaagagtgacagtggcagcggcggcggtggcgcctcaccaacaaattggatgaaacgctccaagtccatgcctgctaataagcctgtggtttctgactccacatgctga

SEQ ID NO: 74924 - DNA, 195 bp, Glycine max
  Peptide Sequence Number=SeqID_166609
atggagaacacaaaatatgatggaatgatagatgaaaggtacattaataacaccttgacgatgcaacaagggagatgcacttccacaaaggaggcgtggcccctaacaccaccaggtgcagggcctgattgcacgaggctgccacagggtcacaatgatgaaagtggtggcacgacgcgaccttgccgaagttga

SEQ ID NO: 74925 - DNA, 2373 bp, Glycine max
  Peptide Sequence Number=SeqID_166610
atgccacgatctagttccgccgtgcaccaccaccgtcagagctccgataacttcatgttcgacgctcacggaaggtggttacactcttcggcttacgcgcaggagctcgggactcgatcttcgagcttgaggagaaacgacgatgatcgcgttttaaccagtggcttgcttgatctgcattctttcgataccgagcttttacctgagggacaaagttttgatggctacgagtcgattctctctggcaacaaacttgtaccaaggtctcggggcttgcctgagagccatctccttaaaagtgtctcagcagataaagagagagcaaacaatgttgccaagatcaaagttgtggttgacttaacagaatatattgagaaacatgagtttgtttttgatgctgtgctgaatgaagatgtttcaaatgatgaagtgtatgctgagactgtggagccgattgttcctttgattttccaacgaacaaaagcaacctgctttgcatatggtcaaactgaatatagagtatctaaagttgagacaatcaaggaatttattgagagaggtaattccacaagaagtactggtacaactggagcaaatgaggaatcctctcgatcgcatgctatacttcagctttgtatcaagagatcagctgatgggactgaatcaaagcctacccgacttgtgggcaaactatcttttatagatctggctggaagtgaacgtggtgcagatacgacagataatgataagcagactaggattgaaggggcagaaataaataaaagtttacttgctctgaaagaatgcattagagccctagacaatgaccaagggcatatccctttcagaggaagtaaattgactgaagttctgcgagattcttttgttggtgattcacgcactgtaatgatatcatgcatttcacctagctcaggttcatgcgagcatactcttaacacattaagatatgctgacagagttaagagcctgtcaaaagggaacacctctagaagggatcctctttcttcctcaaaccttagagactctactgtgttgcctggctcttcagttttatctcatgatgataccttggaggatgaaacaacatatgtttccagtgacaagaatcgatttggttggcccaaacagctagaaagggaaccctctcctccgaataatgtggaccgtgttccaagtggtagaatggggggaaatttgataccatctgtgtattctgatccacaaaatggtcaaagaggcagtcaaaaggccagaactgcaaatgaatatgattacctaggaccaacatatgaacaggatagaacgagaaaaacaagtaagagggtggataacaaccaattatctgccgtgggggacaagaggaagatagaatctcgtgttaaacttgtggatgaattgcattttgaggctaatcattctgatcctgacgataatttaaatgccctcctgaaggaagaggaagatctcgtaactgctcaccggagacaggtggaggaaacaatagacattgttagggagagcctgtcaaaagggaacacctctagaagggatcctctttcttcctcaaaccttagagactctactgtgttgcctggctcttcagttttatctcatgatgataccttggaggatgaaacaacatatgtttccagtgacaagaatcgatttggttggcccaaacagctagaaagggaaccctctcctccgaataatgtggaccgtgttccaagtggtagaatggggggaaatttgataccatctgtgtattctgatccacaaaatggtcaaagaggcagtcaaaaggccagaactgcaaatgaatatgattacctaggaccaacatatgaacaggatagaacgagaaaaacaagtaagagggtggataacaaccaattatctgccgtgggggacaagaggaagatagaatctcgtgttaaacttgtggatgaattgcattttgaggctaatcattctgatcctgacgataatttaaatgccctcctgaaggaagaggaagatctcgtaactgctcaccggagacaggtggaggaaacaatagacattgttagggaggagatgaatttactcgttggagctgaccaaccaggaaatcaactggatgattatatttccaagttgaatactattttatcactaaaggctgcaggaatctttcaattgcagacacagttggctcaatttcagagacgcttaaatgagtataatgttgtcgtaacgtctggaattctccgttctcttaggtattgcttctatgatttcattgccgtggattgtttctcaattgtgaagaattttgatgttgacaagattctccgttctacacttgattga

SEQ ID NO: 74926 - DNA, 447 bp, Glycine max
  Peptide Sequence Number=SeqID_166611
atggacctactcatcggttccccaaccgtgccgccaatcgcgccgcaccttatgccaccgctaaggtaccttttactttcatctattgcgtcaaaggtgacgtggcaacatgatttatatgcagatcagcatgtggctgcggcggggtaccctgctcaaggtggtcgtgcagcttccatagaaattgggatcaagctttacatttcaaacttggattatggtgtttccaatgatgatatcaagctagcagaagaccttgggacattgccgatatgggtgtttaacgctggtttcagccttaatgatgaaattgatacatcatccatagaatcctatgtgcaaggagctttcgatggcattgaatttgcaagaggctctcctacatcacaatgggaccgtcttagaaagttaagacggttgttagttggaaccgtattagaaagttag

SEQ ID NO: 74927 - DNA, 3141 bp, Glycine max
  Peptide Sequence Number=SeqID_166612
atggccaccaccacccaatggagttccctttctctctctcttctccttctctccatcgccctcttccaaaccctaacccccaattcctcgccgtcgccccctcctcccaactacatcgtcgccttcagccactacgccgccgccgatcgccaccgcgcctacctcgaatccgcactccgcccaggaggctggcggtggatcccgcggcagaacccggcggcgcagttccccaccgatttcgggctcgtcgcgatcgatgattccgcggtggttgacgagattcggaaactggggtcggtcaagtacgtgagcttggacatgagctacaacaggggtttgatggcaaagaaggatcagagacgcaacgacaagaaggttggtgcgtttgaggatgggaagaagaagcgccccgggaagatcttcactgcgatgtcattttgtgaggccgaagaaggaggaggagaagaagaacatgccagtaatcgcagcagttctgtcaagtgggggcgggaattgttgatgcagagatcacaagttacttcaatgtttggggctaaggatctttgggcgaaagggtacactggtgcaaaggtcaagatggccatatttgatacgggcattcgagctgatcaccctcattttcataacatcaaggagcgtacaaattggacaaatgaagatactttgaatgataatcttggacatgggacatttgttgcgggcgttattgctggtgtagatgctgagtcccttggttttgcaccagatacagagatttatgcatttcgtgtgttcactgatgcacagaaaagtttgcaagattttgagaagatttcattcagcctactgcaggtgtcatatacatcatggttccttgatgccttcaactatgcaattgctaccaatatggatgtgctaaatttgagcataggtggacctgattacttggatctcccatttgttgaaaagatatgggagataacagcgaataacataatcatggtttctgcaattggaaatgatggaccactttatggaactttgaacaatccagcagatcaaagtgatgtcattggtgttggtggtattgactatagtgaccatatagcctccttttcctcgcgtggcatgagtacctgggagcttcctcatggttatggccgcgtgaagccagacatagttgcatatggacgggacataatgggatcaaaaattagtgcgggttgtaaaagtttatcaggaactagtgttgcaagtcctgtagttgctggtgttgtctgtttgcttgtcagtgtcattcctgaacctgatagaaaaaatatcttaaacccagcaagcatgaaacaagcattggttgagggtgctgcaaagctttctgggcctaacatgtatgagcagggtgctgggagagttgatctgttaaaatcatatgagattcttaagagctacaaacctagggcaagcatctttcccagtgttcttgattatacagtttgtccttacacatggcctttctgtcgtcagccactctatgcaggtgccatgcctgtcatcttcaatgccaccattttgaatggaatgggtgttgtcggatatgttgatagtccaccaacatggcatccttctgatgaagaagggaatcttctaagcatacattttacttattctgagatcatctggccttggactggttatttggcccttcacatgcaaatcaaggaagaaggtgcacagttttctggaaagattgaaggtaatgtgactctcagggtttctagccccccggctcatggagagaaggaccctcgaattagcatatgtgtgcttcaattaaagttaaatgtggtgccaacaccaccacggtcaaaacgaattttgtgggatcagtttcacaatatcaaatacccacctggttatattcccagagattccttggatgttcgtaatgacattcttgactggcatggggatcatctgcatacaaattttcacatcatgttcaacatgttacgggatgctggttactatgttgaaacacttggttctcctcttacatgctttgatgctcgacagtatggaacacttctgttggtggatcttgaggatgagtactttaccgaggagattgaaaagctgagagatgatgttgtaaatactggattgggattagctgtcttttctgagtggtataatgtagataccatggtaaagatgagattctttgatgacaatacacggagctggtggaccccagtcactggaggtgctaatgttcctgcacttaatgatcttttggccccatttgggattgcttttggagataagattctgaatggtgatttttcacttttgggtgagcagaatcgttatgcttctggaacagatatagtgaggtttccaaggggtggctatgtacatagctttcctttcttagatagttcagaaagtggagccacacagaatgtgctgcaagcttctggctcaaccaaggcagattctccaattcttggtctcacagtgatgggtgaaggtcgcatagctgtgtatggggactccaattgtttggacagcagtcatatggttacgaattgttttgcccttctgaggaaattgctagattttactaatgaagacgttagagatccagaacttttctctgactcaaataaacaagattctcctttgtatgaacctgacaatcagttgccatcccgcagaactgatgtaaatttctctgcattttcagctattgtggggaaggaattgatctgcaggactgacacaaggtttgaaatctggggaactaagggctacaatttgcaagtcaggggaagaaacagaagattgcccggatatcctgccattgatttggggaggggtttaaattcaacctctgatgcttccaacattaggcgtcctaggttgactgtgagaagtaataaggatgattttctggggaacaggtatttaggcctgttctatggggatgagcctgatgcacctatgctggttggtggtcactggctgattccatttgttgttgcagtaactggtattttgcttttgagtttttggcgcattcgccaaaagaggcgtagacgaaggaaaggatcaaattctggtagattggccaatatatag

SEQ ID NO: 74928 - DNA, 579 bp, Glycine max
  Peptide Sequence Number=SeqID_166613
atgggggaaggtggtgaaggagaaggtgattgcgctccgaagaatgcgtcgttgtcggaagttgttgctccggcgaagaagctggcgcggcagcttgattttaccggcgcgccggagcatccgcagctgtcgcaaccgccgcagctaccggtggctgtgttgccgttgcagccgcaggcgcctcatgcgagggttggcggccatggtgccaccatgtcagaatggcgtgttcagtgttatcaatggcggaatgcaaaacatagcggaaggccaaaattctgccatataaacatgccattgtgccttatggagccgctatggaaaccagaatctccaaaatcaagatcaagacctaactttgaaatcaaagatgctactccaaagaagcaaaaacagtgcaattgtaaacactctaaatgcttaaagctgaacgaagttggaacacaagctttgaagctgaagcagaggagtacaaagctcgaaagccttcaaacagaggagatggttctgtttgaagctttggatcccttccaaagctgtcagcttacaaatcaagaagaggagaggctgtttggatga

SEQ ID NO: 74929 - DNA, 204 bp, Glycine max
  Peptide Sequence Number=SeqID_166614
atgaacataagtgtcacgctcaacgtgacctcctcactcaacgagtcagaatcgttcgacccaagcaaacctcttagagcaaggagccacattgatatacagctgtcacgagcaagtgcgcatcttgcgcttaacgcgtggtcacttgatctagttgaacatgtgcgctcagcgcgagggtcacgccaagcgcacaagatataa

SEQ ID NO: 74930 - DNA, 282 bp, Glycine max
  Peptide Sequence Number=SeqID_166615
atgtgtttctttgtgaatgctaatggtaattgggactgtgagcgcatatctactgaaattcctgatgagattgttcaatgtatcaatcaaatgaaacctccatgtagctctagtcgaccagattatatggagtggattcattcggatgacgggcaatttactacccatgatgcttatagtaaactgtcattaagagtagcttcaagtggtgttgtcataagaggtaatagtggtagctttgttcgggcttacctagaaggttggggcacaattcaattttag

SEQ ID NO: 74931 - DNA, 678 bp, Glycine max
  Peptide Sequence Number=SeqID_166616
atgaatgcttcaaagttcattaaatgtgttactgttggagatggagctgttgggaaaacctgcatgctcatttgctacaccagcaacaagttccccactgattacataccaacagtatttgacaatttcagtgccaatgtagctgtggatggaagcattgtcaatttggggctatgggacacagcaggccaggaagactatagcaggttgaggccactgagctatagaggagcagacatttttgtcttagcattctcactgattagcagagctagctatgaaaatgttctcaagaagtggatgccggaattgcgtagatttgcacctaatgttccaattgttcttgttggtacgaagttagatcttcgtgaagaccggggttatgtagctgatcacatgggatctaatgtcataacatctgctgagggggaagaactgaggaaacaaattggtgcagcagcttacattgagtgcagttcaaagactcaacagaatgtcaaagcagtgtttgacactgcaattaaggttgttctccaacctcaacctccaaggaggaaagaaatggcaaggaagaaaaggcatagaaggtctggttgctcatttgtgtgctggtacccaaaaaaggaaagaaaagaaaaatactgcaccaaagaccatgctgctgctgaaaaagcatga

SEQ ID NO: 74932 - DNA, 1059 bp, Glycine max
  Peptide Sequence Number=SeqID_166617
atgtctgtgtcattggagcaagaaggctatgtaggcttatcagaggttcctgcaatggaaggttgttctgagaggactggtggtggcttgaacctcaaggctactgagctgaggcttggtttgccaggttctgagtcaccagagagagaagagggtgtggaggacaagaatgtgcaccctttaggcatggtgaagtgtttggtgtcaggggccaagaggggtttctcagacaccattgatgggggttctgggaagtggcttctttctgggaatagtggatctgaggtgggtttggggaaagatggtggcttcttctctccaaggggtgttggtgttagtgttagtgctgccaaggctgagtgtaccaaccaacaaacttgtgttgtaaaagataaagttcctcaatctccaaagccgttgaatgagaagaagcctcagatatctgctcctgctgcaaaggaacaagttgtgggatggccaccaatccgttctttcagaaagaactcaatggccactcagccacaaaagaatgatgataatgcagaagccaagtcggtatgcctttatgtgaaggtcagcatggatggtgctccatacttgaggaaagttgacctcaaaaactttggcacttacatggaactgtcttcagcactggaaaagatgtttagttgttttacaatcagtcaatgtggttcccatggagtttgtggtcgagataagttgactgaaaatagattgatggatctcctccatggttcagaatatgtgctcacctatgaagacaaggatggtgattggatgcttgttggtgatgttccatgggagatgttcaccgactcttgcaagaggttgaggataatgaagagttctgaagcaattggactaggtgaggccgacacattcaacaatcaccaagagccatggaaaaatgcaaaagtcgcaactagcaagatggtgttgatacagaaagatgaattattattattacctttaaacacgtacatcatacaagagtccagaggcaagtgcagggcacaagctggggcttttcttgcttga

SEQ ID NO: 74933 - DNA, 207 bp, Glycine max
  Peptide Sequence Number=SeqID_166618
atggcacaaattgagaaattgttggtagctttgttcctttttgcagtggcacaaagcataatcctcgtagatgccaccttttccaaaagcatgtacatcacttggggttctcaacatgcatcaatgcagggtgaagacctccaacttgtgttggatcaaacctcagatatatttgtcttggacaatagaaaacatttgcatttatga

SEQ ID NO: 74934 - DNA, 876 bp, Glycine max
  Peptide Sequence Number=SeqID_166619
atgctccaaccatatgagatcagcataggcttaaaggagcactcaaacccggtgacccccaaggcctacactctaaagagtccgtcagggcctcttcctcctgattcagacagctctgggtttctgcgggaaagaaaaaggctacaatacgaaggatttttctctcatttcagacatgatatcgaaattcccgacggtgataattctcggaattatgttgcgaacatgatactcaaatttcacgacgatccaacggtgaacgggttcaagatcgtcgtttttctgagactggatttcctcgcgctcgctctgccgccgccggatgaggaagaggttgaaccgaagaatccagttgagcatctatgcaatgaacctcttgacataagcattttatctaattcagatgatgtcagtttgcacaaggctgtgtcttgtcccactgaaaatagcaatctatcagtgcctgtggttactgatgctgcatcacttcctatgaaatcctgtgaagctgaaaccacagaagatgtcatggccatttctcgcgagccacaaatgttgcctggaactaataacaattctggcagtaacatagtagatctttattctgacaagttttcaggagcagcagatgttagcgagacctcaagatctgcactttgcatggaaggaattttatcactgttggagcaagctgttgagaaaggcagtgcacttgttttagacgatgaatatttggatgatgactacatttatcaaatcacagtggcttttggtaaatcagctccaccagagcctgtttataagctacctagacaggggaaaaaatggataagagttctaaaattagaagaaaagaatatggttagggatctctga

SEQ ID NO: 74935 - DNA, 345 bp, Glycine max
  Peptide Sequence Number=SeqID_166620
atgacgcctaaatacctaggtggggatatggtattattgatggggctgactgacacaagagctgaagaaatgtgcagggagggtgctgcgaatggaacaacattattctactcgctggagaaatggcagtcaagtatgaggactaggttattgatcttcgacgactggacaaggctcaggagacatgctacagtgcagacacttgtaaatggcggtctaggagcatggtggggtcgtcggaggaaatcagttccgatggtggggtcgacggaggaaatggagttgccattaacagcggcgtttgagttatcagtttccaaaacaacaacagcgaaaatggagtag

SEQ ID NO: 74936 - DNA, 105 bp, Glycine max
  Peptide Sequence Number=SeqID_166621
atggctggagaattttcagcatttttgtatatattgaaatcacttgctccacatcgtggggttgaagaaaacgaggagattcttctattaggttgggctgtctaa

SEQ ID NO: 74937 - DNA, 345 bp, Glycine max
  Peptide Sequence Number=SeqID_166622
atggaaggtgaactagagccttcttggcatctgctacactctagtggcaacatgcactctgtcacatataaccaagatctagtgagtccaactctacttgctggatggacagaacttagagagttctatgagctcactagaaatcatcagatcaccttgacccaccatgaacagagtgttttcctcctcaccatcttcaaaagcagctctgaatcaaaagatatgtcgagtaccatgtactcatttatgaaagttgttgcaggattcatccatctgaacttggaagggatagagtgtaggatagtttataatcatcataggaagacaaaaattggaaatggatga

SEQ ID NO: 74938 - DNA, 581 bp, Glycine max
  Peptide Sequence Number=SeqID_166623
atggagagctataacaaggaatggaatgattctaaggttcagattgacgaagaaattctagaatttgtgaatagaccaaaaaagttgaaagtttggaagtttcaccgaggagtgctgcagctttggattttgaaaggaaagttttcatgtgaaggacaagacatgtgggatatgctaggtgcacccagcaatattgctggtgcacccagcaattcaatgaaagcttcttctcttctctcttccccgacaagcttcttctccgcgagcttctccgacagcccttggacgaggagtcttccggaagaccccttaggggttcttccggaagttccggaagaacgttttccggaaagtttccggaagaagtgttcttccggaagtaaccaaacgtcttccggaagaactcttcttccggaagacttccggaaaacgtcttccgggaactttccggaagaagtggttcatccggaagaattccggaagactcgcacttccggaagaagtttcaaacttccggaagacctttccggaagaacccttcttccggagtgtttccggaagaaccacttcttccggaagtg

SEQ ID NO: 74939 - DNA, 1134 bp, Glycine max
  Peptide Sequence Number=SeqID_166624
atggggtttataaagctgttttctgttgcctctttcccggttatcaaggtcttattgattactgcacttggcttgtttcttgcactggataacatatcaatattgggagaagatgcaaggaagaaagtgaatcagcttgtgttttatgtgtttaatccatcgctggtgggtagcaatctggccaaaaccattacttttgagagtgttgttaagttgtggttcatgccggtgaatattcttggaacattcatattaggctcggccttgggatggattttgattaagatgacaaggcctcccaaacgcatggaaggtctaatcttgggttgttgttctgctggaaatttagggaacctgcctatgatcattattgcagctatatgtaaacaggaaggcagcccttttggagaacctgatctctgcaatcaatatgggatggcttatgctgcactttctatggcgattggagcagtttttctatggtcatatgtttacaacttaatgcggatttcctcaagtagaatccaaaatgaagaccgtacaagcaatgacagcagcatgttgaaggcttcagcagacatatcagtttcacacccacacaatttttcaaaaacacttaatactacaaaaggcaccgtggataatgcatataccatactgctacctgaaacaaattcggaggaaaaagtttcattcccaagtaaaattaagcactacgttaggatgatctcaagccacttaaatttcaaatccatgtttgcgccatcaaccctcggagcaattgctggttttatcattggtgtagtcccccaaatacgtaatttcatgataggcaataatgccccgcttcatgtggtcgaagactcagcttccatgttaggtgaggcagccatccctactgtcactctaataatgggtgcaaacctacttaaaggtttgaaaggaacaactgctccagtgtggaccattgtgggaattgtagtggtcagatatattttcctgcctcttttgggtattgcagttgtcaaaggtgctatgcacttgagtttggtgcattcagatgccttgtatcagtttgtgcttctacttcaatatgcacttccaccagccatgaatatagatgtaatgttataa

SEQ ID NO: 74940 - DNA, 2367 bp, Glycine max
  Peptide Sequence Number=SeqID_166625
atgaaagcaaatgcttacctcgatggagcagcaccaacagagaagaagaacacgcaaagtcgaggtgatgaagaagaacgcgcaacaacaatgttgaagaagaacatgcagcaacaaccacgttgtcggcatccgaagaacgctcagaagaagatgaagacgaacggcattcgcagaaggaagaaggaacatgcggaagaaagagtactgggagaatcaccaattaaaatctttctccaactccgttcatctaccatgacccttcaagctgattcagcaccagtaccaccaccgccaccggattccgcagccaccaacggcatctcccccaccgcagaggaagccccacaaccaccgtcaccaccaccgccgcatccaaccccacctccagaactgcgcgtcccaatatggtggccggaagacgggaacctcagcatggattgggtggacaacctgatgcggtgcttcgattggtcctctcggaacgtcccaccctcggagctcccttcggttctccccgtcggagtcttcgattcgctcatcctcgtcgcctccaagatgctccacaaggagcccaattgcgtcaccgtagaccccttccgccctagctccgatgatgataacactccctccgctgcctcctctgttgtcgtcgtcggcgatgttcacggccaactgcatgatctgctcttcctcctccaagatgccgggttcccctcgcgggatcgcatctttgtcttcaatggggattacgtggatcggggagcgtgggggcttgaaaccttcttgctcttgttggcttggaagaaagaagtaatggtaaagtatggcgataaaggtaagcatgtgtaccggaaatgtttggggtgctttgaaggtcttcctttggcttctataatagcagggtgtgtatacacagctcatggaggacttttccgcagtgtaactgtgacgccatcaaagaggtttaaaggaaagaagaaccgtaagattaatgttaatcatgagagcaaaattctctctcttggttccttggaagaattgtctaaggctcggcgatcagttctggatcctccttgggaaggcccaaatttgattcctggtgatgttttgtggtccgatccatcaaaaaatcctggtcttgctccaaacaaagaaagaggcattggcttgatgtggggtcctgattgtactgaagaatttttgaagaaataccaactaaagttgatcatcaggtcacacgaaggtcctgatgctagggaaaaaagggatggtcttgagggaatggatgaaggttacactattgatcatgttgtagattctggaaagctggtcactgtttttagtgctccagattacccacaatttcagggcattttaactggttacatactgaaagtctacacagattttgcagatgttgaaaataaaatctttgttttgggcaggggagggctagtggtgattgccatgctgttagttcaaacttggcttatgctggcactgctagctctggtactagttctgcaactagtgtcttttagattgccaaggaatgctcctggaaacacgagtgatgtggcatggaaacatgggatttcagttgaagaaactagaaggattcaatgcaaatattgtccgaaggaaggaagtgtgggacattgtctaaggtgtgaaagcaaaactgaacaaaagataaagttcaacataacaggaatcttgaaactagtgagaaaagaaaaaaagagtaatgaagtggttgatgttgagaagtctggaaacatttgcagaattaagggtatgagcacccaaaccacaatcaatatcttgtataagaggaatataagagaggaaacttgtttagcaattgtgagatttttctccaatgatgccatacctttcaatgtggcaagaggtgaagaattccctattatgtgtgaattaattgctaaacatggccaaggatttatgccagtgtcctatcacaagattagagttaagtatttgaagaaagaaatagggttgacaatgcaagaaagtcagatgcctgatgaagtcgttgaagagattggtgaggaaaatgtagttcaagcaacacaggagaggtataacaacaaaggcgcctatgttgtccttcaaccaccgaattttgaaaatcctatatttcatggattttcagcagttactccaaggccgaaggtgaatccctattatgattacaaagaggtgatagactccgatgaagaattggatttggcctccatggactcacggcagagcaaccttggaggtggtgttgctacctccaagtatgataaagtgttaatctttggcaatggtggagatggcagagctttgaagcgatga

SEQ ID NO: 74941 - DNA, 669 bp, Glycine max
  Peptide Sequence Number=SeqID_166626
atggaagcaataacaaacaagaaaagggacaatagaccttacctcgatgaagaacagaagagcagaacctcgtggaagaatggaagaagcgcactcgaagaagggagaagcagtagctcgcgctggagaagcacaaccaccttgcgccggagaacgactcgcgaaagaatgaggaaggaggaagaaagggccctcggcagaagaaagaaggagaagaggctcgcagaaaagaaagaagaagaagaggctcgcggaaatgctggctcgcgggaaagaaagaagaaagaaggaaaagaggctcctgggaagcttgtggttcttgtgattgaggcaaagaacttgccaccgacggatcctaatgggttgagtgatccgtacgtgaggctacaattggggaagcacaggttcaggaccaaagtgatcaagaagtgtttgaatccaaagtgggatgaggagtttagctttagggtggatgatcttaatgaagagttggttatatctgttatggatgaagataagttcttcaatgatgactttgtgggtcagcttaaagtgccaatttcaattgtttttgaggaggagatcaagtcccttggcactgcttggtattctttgcaacccaaaagcaagaagtccaagaacaaggaatctggtgtgttacgctgctga

SEQ ID NO: 74942 - DNA, 240 bp, Glycine max
  Peptide Sequence Number=SeqID_166627
atggggtggttcatgatgagccagaagaaccaacttggcaccaccgttgacatgtccctgtcgacaaaaaatggtggcgttggaaggggagttcggtgcgagggaacaattggtggtttgaaggagcgcaatgatgagcttgttgaaggggggagggtgtggagatcgaaccaagagaggaactcgaggaggacattgacgagggaggccggggagaggtggttgtcagcggcaaggtag

SEQ ID NO: 74943 - DNA, 1215 bp, Glycine max
  Peptide Sequence Number=SeqID_166628
atgcttaagctagcccggcttcatcgatcagcttctaaatcctctcgctcaagcgcccaaagaggctcgcatgagcgaggcttgtcggtgatagtgaagactgaagagttgattcgtggatggaaggcatgggaggcggagacttcatctcatgggtacgagttcgccaatgatccttcaagattccggttgacacatgaaacatcatttgtgaaagctcacgcttctttttggacaagatattcaatcttcttctatataggatgcttctttagacaattttataggtctgtaggcaaggctgactacttggctttgcgcaatggatttatcacggttcacctggctcctggaagtaaatttaacttccaaaagtatatcaaaagatccttggaggatgacttcaaggtagttgttggagtcagtcctgtcctctgggcatcgtttgttgtttttctgctcctaaatgttaacggatggcatgctatgttttgggcatccttaattcctgttgtgataattttggctgttggaacaaaacttcaagctgcactggcaaacatggctattgaaattacagaaagacatgctgttgtccaagggattcctcttgttcaaggctcagacagatatttttggtttggtcggcctcaattagttcttcatcttatccattttgctttgttccagtattcttttgggctgagaaattgtttccatgctgactacaagcttgcagtagtgaaagtagctttagggcttggggtgctatgtctctgcagctacatcacccttccattatatgctcttgttactcagatgggctcaagaatgaaaaaatcaatatttgacgaacaaacatcgaaggcgttgaagaaatggcacatggctgtgaaaaagaagcaaggagtgaaacttggaaattccaaggtgcgagccatggatggaagcagcactgattcaacaatacactcttctggccccacactacaccgttacaaaactaccggtcactcaactcacttcgtatcaaactacgatgaccaagatgattaccattctgataccgagttgtcttccatttcaccaacaccaaacttgatagtaagagtggaccatgatgaggaagaagcaaaagaaaatgaacaccacccaacagccaacaatcaagaggcccctttacatttgtcaagcctggaaagaagcatgaaatag

SEQ ID NO: 74944 - DNA, 1044 bp, Glycine max
  Peptide Sequence Number=SeqID_166629
atggggtggtttatgcccgttaacattggatgtaccttcttaattggagggattctcggatggatacttgtaaaagtactaaaaccaaacttgaaagtgcaagggcttattattgcttcatgttcaacaggaaacatgggtaatcttcctgttgtaattatcccagcaatctgtgatcagaaaggaggtccatttggtgcacctgatgattgccgcaatagggctctctcttattccttttgctctttggcgcttggtggtgtcttcatctggacttatacttaccaactaatgcaaaacacatccttgagatacaaggcatttgaggctgctgagatcttaaagattcccagcaaagacattgatgctaatgcagaagctcgccttctcaagcaaaatgatggttacgccgtagacactgaaaatcagattcttgtagaccaaggtccttctattgcaacgaagaatatggaaaaatgcttttgtcacagaatgatggaaactcttgtccaaatcctggcagaactaatgtcacccccaacaattgctacaagaaattttacctgcttccatgatcagtttttaggtttcctctttggtggagttaaatggctaagaaacctaataatagggcacgatgctccactgaaagtgatccaagactcaattcaattgttaggggatggtacaattccttgtatcacggttttgcttggtggcaaccttacacaaggcatgcgatcatcaagtatccaaccattgatcctcatttgcatcatcatagctcgacttttcttactacctgccattggattttttgttgttaaagcggctgcaaattttggtttcctcccattggaccctttgtttcagtatgtgctagtgatgcagtatgccatgccacctgcaatgaatatcagtaccatggctcagctatttgatgtaggcactgaagagttttcagttattctcttgtggacatatggagcttcaactatagccctcactctttggtcaacgttcctcatatggatattttcttaa

SEQ ID NO: 74945 - DNA, 351 bp, Glycine max
  Peptide Sequence Number=SeqID_166630
atggttaaaatgattcttgctaataggcaatcttctgcccaattaatgaagatgaggattcgttacataattgagtggaggaagctaaagaagctcaagattaaagtcgctaagctcatagcaaagcttgccatgcttaagagagactgtatagaattggctgaagagaataaggagagcatgatgcgtctagaggctctgacgcaagaagcacaacttcaagatgaagtctaccaggcacaactggaagaaatacagagcctaaaggaaaaacttaattggacaaaactgcccccaaatttatggacatctatcagcggagaggaagctcgtaataacagcagtaattaa

SEQ ID NO: 74946 - DNA, 1584 bp, Glycine max
  Peptide Sequence Number=SeqID_166631
atgttgaagtcagggggtacttgcaaaaaggattccgacaagcaagtcaatgatgctcagagttcctcgaccaaatccaactctactgccaaggattctgagttgttggccgcattgaacatgcttatgcagagtgaaggttcgccgatctccacaggatgtgaaatgcttaacactaagctacttgaggaactcttcgtagtccttttcgatgaattgtcttccgttgtccgtcacgatggcttgaggggttctgctttaatccacttagtgaagtattccaccgtgatgaggaggaatttgacctatcctttggccatgggaaatggttcaaggatgtccattccacacatggcaaaaggccaaggagacgtgatgctatggagtgcttctagtggtaggtccaaatgggagacatccatccactgggagcaatcagacttaagcatacctcgcatcaactcaatcgttctattccctgttgacacggaccaattctttctactcgaaatgttccaagagttgtttgacaaagtggtagtacttctgtatttgtgtctctttggcttagaagaccttgttaacctgctccgtgatgagcttagagttgttcctgcacctaaacttctccttcctgtcaaactttacttactactcgatggagacgtaatctggtccttcaaaggttatgcttgtgctgctgcccttgctattaggggctttgtccatatacaacatccaccagtcttcactgttgtcctcggtaagggggagagaattgagcttattgcggagtctaaaatagatagatatagcaacaactcgactcccgatgtggaccaagatttgctggctgcgcatggcaatgactgcttcacacttgtttgggttggcctcgactcccctacaggaaactcagaattgggtatccataagtgtcatcagcaagttgatcgatgcaaggaagcagtacatgacttctttgatgaaactgacattgataaacttctcagtttcttcctttacaacttgttggcgctcttttctgagcttctgttgccattgtgccacgggtttggctttaggaaaaataaagagtttgtgtcgttgaggatgtataggacaagtaatgttctcgacaactctcctctttcaaaggtggttgccaactttactgcatcatgggactttcctgatgtcctaattggcgatgctaaccgtaatcaccattgggtcatcttactcgggatcaattcaatgaacgttatgtggttcacgcttttgattgcactaaaccatggaagtgatcaagagctttactcaatgattcatcatggaattggtggaatgaagagatctccatttttccctcaacagtcttggactctggaaaatacatcttcaggaacttctccaccacctcttcctatgtctgccatgaaagagattgccttgaatcaacaggatgagggaatgtggatatgtaatgttggctgcttgaacttctggtcgggctatgctggtaaaatattgagaaagaacgaggaagatttagaggatgagggtcttctctctcctagatga

SEQ ID NO: 74947 - DNA, 657 bp, Glycine max
  Peptide Sequence Number=SeqID_166632
atgaagatgaatcttagtctaatgtcaggtcatcctactccactgatacggcccatgagcaaatgctggaccagaatcactgtggtccaagagattggagggcatatcaagaagagggaagggggcatgtggcagccagtcagcggagcagatggggtgcataggagagatgcggataacagagggaatcatgggtatttcgggggtgaagggataaatcgatgctatgaaaaccagaccaaaccacaaaatggtaaagtttcagggtcaactaataaaaacaatggaaaacaaaatagagtaacattaaaacatcaagcagtcaaaagtaaagattttgcgggagagacacttttacttcagcatttagctagtcatacaaaaggattaaaaacatggcattcacaacccacaacaaaagatggatcttacgggattgagcaggagttcggggctggtcctgcacatagaccaacaaattcaaaaactcacgcgagagagcgagaacgaacgaggatctgcaacaacgcgtccacgagaggggggttgcgcgagagtctgagagtgagcgagctacagcaacgcgtccgcgcgagagagaggtccgtctccgtgagatcgaacggggattttagatttcctttcttattagattag

SEQ ID NO: 74948 - DNA, 972 bp, Glycine max
  Peptide Sequence Number=SeqID_166633
atggaaaatttgagagggactaaagattttggaatgaaaattgtgttcctttcgtttggaagccataaaaaagagaaggaaagattcacctttcgcgtaatcacagcgctggatccgtaccgtgttcctccgtctacggaagcgccttttgctcggtccttcgctgaacacggaagcatgtacggtccccgaggggcaatgttgggaagcgggggggtttcagacgggtacgaggttggctcaaagagacaaagaatgatggaatccaatccatacttcgcagtgagcagcggaacaggcaacttaccttatggatatgctggtggcttccagccccctccctttcctgtggttcgtctcagggggcttccattcaactgcactgacattgacatcttgaagttctttgctggactgaccattgtggatgtgttgctggtcaacaagagtggacggttctcgggtgaggcctttgtagtctttgcaggagcaatgcaggttgagtttgcgttgcagagagatcgccagaacatgggtcgccgatatgttgaagtgttcaggtgtaagaagcaggattattataatgctgttgctggtgagatcaattacgaaggaatatatgataatgactaccatggtagtagccctccaccctcccggttgaagaggttcaatgataaagaccaaatggagtacactgaaatattgaagatgcgcggccttcctttccaagtgacaaaatctcaaattgttgaattctttaaagatttcaagctgatagaagatagggtacacattgcgtgtcgtcctgatgggaaagctactggagaggcatatgtggagtttgtttctgctgaggaggctaagagggcaatgtccaaggataaaatgaccataggatcaaggtatgtggagctgtttccttctacaccagatgaagctagacgggcagagtcaagatcaaggcagtaa

SEQ ID NO: 74949 - DNA, 234 bp, Glycine max
  Peptide Sequence Number=SeqID_166634
atggacacccgtctccgtgtgattggtgatcccatgaatggagttcaacggagcaagagcattggtgttcataaggttcggggatcctttcgctgcacacgatcggaaccaacgggttgtcgtatcttgggagaggagcgcaatcagaatttcttacccgtgcagtgggggcgttttctctctaaggatagcgtttacgcgcttcaacccaggctatttaattttttcccttaa

SEQ ID NO: 74950 - DNA, 1566 bp, Glycine max
  Peptide Sequence Number=SeqID_166635
atgagtgaaaaaaagaaaagcgtacctcagtacctgaaaggggaggggttcctcagtgtgcatataggcattttgaaggtggcatgtttgggatgctcatacttagaatcggcagtaggcaagtggatcacacttagttatgtgatgatgggatgcaaggcccttactggattactggtgttagagtttcatgctgatatctttcgtgcagagaagaatattattgacctatatgtcatgcttttaagattttctagtttggtgtctgagacaataccacgccaccgagactatagatcatctccacaaaggcagaaagaatcattgaaaaagaaattgttaatttcgttgaatgaactggagaacttgaaaccagtggtccaacagaagatcaatgagcttaacaacaaatttgcataccaacaaaatggacagggaaaatttatttcaaataattcactggatttttctcctgtgaaaaagctaacttcggctagttatggcctaataaaggcagtcagacctactgctggggagtttgtttaccaaggatcaaggagccaacagttctcttatgtcaggcctgtggaagagcatgtacgaagactatctctaactcttccacctccaaaggaggaaactctctcaagacattctatccttggtcccaacgggctaaaagggcattggagaccacctatcattgataaagggatcaagtatccaagcaacatagatctatcccctgttgaattaccgagcctacaacagtccatggaagatgaatctctgaaaaagaaagataacagcattgcagaacaccataaatcagagttagcttcaattctaacccaaagtgaggactgccagctgcagccccatccccagcctgagcctgaccaggagcctccttctcttatttcttttgaaacaacagaaacctctgctcaaatagaagttatcagacaaccttctcctccacctgtacttgctgaagtacaagatttggtccctgcagtgtcaccttgtgttaatgaggcagggtgtaagacagagattccgtcattagataatagtgttcatgccgaggatcctctacaactgcacatttcagctgctttgatggagagttttatgaagcttgccaagtcgaatacaaaaaaaaatttagagacttgcggtgtccttgctggtttgcttaaaaacagaaaattttatattactgcccttataatcccaaagcaggagtcaacatcagattcttgtcagactacaaatgaagaggaaatatttgaagtgcaagataaacggtctctttttccccttgggtggatccatattatgctgccagaatctgttgcaatagtcatggcgccaagagatagttcgagaaaccatggcatttttcggttgacaacccccggtggaatgtctgtgattaaacaatgtgatcaacgtggctttcatccacatagtcagcctccagatggtggtcctatttacaagacatgtacagatgtatacatgaacccagatttaaaatttgaggtcattgatcttcgatga

SEQ ID NO: 74951 - DNA, 1896 bp, Glycine max
  Peptide Sequence Number=SeqID_166636
atggagttcccttcttcctcctccatcttctccccgcgcccatcagacgacaccgttttctacgccatataccccgactcccccaccacaacctccaccgccacgctccgctccctccacctcaaaattctcgaaaccctatctcccttcaccgaagactacatatggcagcaccaacccttcaccctctccgtttcaactcctccgaacccttcctgcccctgcccctcctcctcctcccacctcctccacctccacggccgcctccgcttcggcgacaacctcgacgacgagtggttcgccgtcttcctcctcttccgaatctcacaacgcttcccttcactctccattcgaatctgggactccgacggcgacttccttctcatcgaggctgccttccacctcccccgctggctcaaccccgacactgcgcaccaccgcctcttcctccgcaacggaagcctccacatcgtgccgcgtaaccgcctcaccaacccctccctcattgattccctcaattttgtcgctagttcccctcacgaatccctcgcctcggacgcaatccagcgcgccatcaaaaaacgcatcagtaattaccctgaacaagctaggaataacatgcatagggttagggttagggttccggtgtcggcggcgtctattttaaagcacgagccaaggttaatttcgctggcagtggaggggttctatgatagagatatagacacgatgaagttcgcggcgaggatggagaggtttgtggagagagggaaaacagaggagttggtgtgtgtttcggtgaagatgtcgagggcgatgtacgcgcagttggcgcagcagaggtttcaggctccgaagtgctaccctgagatgccggctcggagcgagagggaagggtttgcggaggcggagctggggatgaagatagcgtgtgggttggagatgatgtatcagcagcggaagcgagacggggaggaagggaaagggagctcttgggaggcgtttaggaagagtttggagaacagtgggtacttccaaggacagcttccgggttcctctgagtaccagagattgatgcagagtgctcaggagtattataggagcacttctctgcactccaaggccagtgacttgctgaatgctcctgttagacgcatagatgaaattcttgctttgcctcattcggtggatgattttaaggatcaggaggttcctccatctgatgatgattcctggctttacggtggagaggaagagttgaactctgttcttatggaaagacaaaaggagatggaactatatgacttaaaacacaaaaagaaagggaaagcaaaagagggtcaagatgctggtccatcatctgcttcaaatgctgacgagtttgatcccagtgatatagcaaaaaccatgcaggcatttgtccataagttgtcaagttacaagggtgctgaagctcctgaagataggaataaggaagtgaaccttgatgtggaccaatttattaaagacatggaatcaataatgatgcattcagacggtgaagttgccaacagtaatattgaagaaggatcgtcgtctgatctggactttgataattctgatgacagtgatattgttgaattggatgaggataatgaggacagagaggatattttcatgcggtcctattctgatgctatgaatgaagagctaaaggcaacaacccttcagaaaagttttgttcgtgctaatgaacaaattccaaagaaggatcagggaacgtcaaatgcatctgaacatattatggacgaggatttttctcctgtagacgtggatcaagggcttcctggtccggcttccaatttgcttggcctcatgggggtgcagttgccacaagatggcaagaagggcaaatga

SEQ ID NO: 74952 - DNA, 1797 bp, Glycine max
  Peptide Sequence Number=SeqID_166637
atggctcgtgcttcgaccaactggctatcgttctctctctcccccatggatatgctccgaacccccgaacctcagttcgttcaatacgacgccgcttccgacacttcctcgcatcactactacctcgacaacttgtacaccaacgggtgggggaacgggagcctcaagtttgagcagaatctgaaccacagcgacgtgagtttcgttcaatcgtcgtcgcagagcgtcagccacgcgccgccgaagctggaggattttctcggcgactcctccgctgttatgcgttactccgacagccagacggagacgcaggactcgtcgctgacgcacatctacgaccaccaccaccaccaccaccacggttcttctgcgtacttcggcggtgaccaccaggatctcaaggccattactggattccaagctttttcgactaactctggctccgaggttgatgattctgcatcgatcggaaaggcgcagggcagcgagttcgggactcactctattgagtcctccgtcaacgagttcgccgcgttctccggtggcaccaacaccggtggaaccttgtcgctcgccgtcgcgcagagctccgagaaggccgtcgctgctgcggcggagtccgatcgctcgaagaaggttgtggataccttcggccagcggacttctatatacagaggcaccgatggacaggaagatatgaagcgcatctatgggacaatagttgcagaagggagggtcaagctagaaaagggcgtcaagactgaaaagtggcttgcatgcattgaaggtgcaattaatgggttggagtatgggaaagctgcgtttgaccacatcacaacccatcactccctgttattgaaacttgtacttgctcacattgaggtggtggagcgtccactgttgcatgaagggtttgtggcagtgggtggatatgataaggaagaaaaggccgctagatcttatgatttggcagctctgaagtactggggtcccactgctaccaccaacttccctaaatatgctttacttggtacacaaaaagtggaggctaaggtaccgcaaaaaggaaatataggatcttcagaccaacgtggcatgaatgaaaagagggtggttgtgtggtgggtttccaattattcaaaggaagtggaggagatgaaacatgtaacaaagcaggaatttatcgcatcattgcgaaggaaaagtagtggtttctccaggggagcttccatatacagaggtgttacaaggcatcatcaacagggtaggtggcaagcaagaattggccgtgtagctggaaacaaagatctttacttgggaacattcgcaaccgaggaggaagcagcagaggcatatgatattgcagccattaagttcagaggtgcaaacgcagtaaccaactttgagatgaatagatatgatgtggaagctataatgaagagttctcttccagtgggtggggcagcaaagcgcttgaagctttcccttgaatcagagcagaaagctcttcctgtgagcagcagcagcagcagcagtcagcagcagaatccacagtgtggaaacgtgagtgccagcatcaatttctcatccattcatcagccaattgcttctatcccttgtggaattccctttgattcaacaacagcatattatcatcacaaccttttccaacattttcaccctaccaacgctggcacagcagcgtctgctgttacttctgccaatgcaaatgcactaactgcactgccaccaacagcagcagctgagttctttatttggcctcatcagtcttattga

SEQ ID NO: 74953 - DNA, 1287 bp, Glycine max
  Peptide Sequence Number=SeqID_166638
atgatgaccgggaagcaaggtttcttctctctgcgaggctcactcctcttcctcgcagtcctcacacttttatctttcacctacctttccctcaaatactccaccccaacaccccaggttaccaacctctcggtcgagaaactcaacgacgcgccgggaaccgagaaggaagaggagggaggaggagaagaagaagaggttccggacacgttccactcgccgcgcgtattcaagctgaactatgaggaaatggagaagaagttcaaggtttatatatacccagatggggatcccaacacgttctaccagacgccgaggaagctcaccggaaagtatgccagtgaaggctatttcttccagaatatcagagacagtcgcttccgcaccgaaaatcccgatgaggcacacctcttcttcattcccatctcgtgtcacaagatgcgtggcaagggcacgagttatgagaatatgacaataattgtgcaaaattatgtggagagcttgatatccaaatatccttattggaatagaaccttgggtgctgatcacttctttgtcacttgtcatgatgttggtgtgagggcaacagaaggacttgagtttcttgtgaagaattccattcgagcggtgtgctcccccagctatgatgttggattcattccacataaagatgtcgctctccctcaagtgctacagccatttgctcttcctgctggtgggaatgatatagaaaacaggactactcttggattctgggctggtcatcggaactctaaaatcagagttattcttgcacgtgtgtgggaaaatgacacagaacttgatatttcaaacaatagaattagtagggctactgggcatctagtgtaccagaaaagattttacaggagtaagttttgtatatgtcctggtggatcacaggttaatagtgctcggatagcagactctatccattatgggtgtattcctggtttgattttattttgcatattaagcctcttaaaactgtatacttatgtcagttcagtgatattgtcaaattactatgaccttcctttcaatgatattcttgactggaacaaatttgccgttgtactcaaggagagtgatgtttaccagcttaaacaaatcctcaaaaatatatcagatgctgagtttgttacacttcataataatttggtaaaggttcagaaacacttccaatggaattcgccctcaatcagatttgatgctttccatttggttatgtatgacctctggttacgccatcacacgatcaaatactga

SEQ ID NO: 74954 - DNA, 1854 bp, Glycine max
  Peptide Sequence Number=SeqID_166639
atgcaagaccccgccacctccgacaccaccgatcaccaaacgacgccgtccccgtcgccctcgccgaagcgcaagaccacgacgacgacgacgacgactaaccgttctaacaacaagcgccccgtgttcaaggtcctcccggggcagatcgcgttccgcctcgtgtgccacgcgtccatcgtcggcggcctcatcggcagctccggctccatcgtgtcgcagctccgccgcgagaccgcctgcaaaatccactgcgaggactccctctcctccgccgaggaccgcgtcatcctcgtcatcggctccgtctcgccgcgaaagggccttcaactcggcgacggcggcgaggtcgaggtctccagcgcgcaggaagccatcgttagggttttcgagagggtttggggcctcgaggccgagaaaggcgtcaattctaacagagccgttaacagcgaggttttctcgaagttgctagctcacacttcgcagattggtgctgttgttggcaaaggagggaagaacataaccgccattaggaacagtaccggtgccaaaattagggtttgtcctcctccgcaatgcgccactaaagacgaagagttagttctaataactggtggaattttggctgtaaagaaagcactgatttctgtatctcattgtcttcaagattgtccgccattatgcaaagttcccgtttcttctagtatacccactgttagctcttttgataggtcgtcctctgatccaaatgctgaactttttcctcgccttaattcattgttaacctccatggaaggtttatctatatatgaacggaccacaaactccaatgaatcctctaaccgtgactcaaaaggtggagaacacgaagttgtgttcagactactttgctctaataatgtagctgggagcgtgattggcaaaagaggggctatagtcagagctctggaaagtaaaacaggtgcttctattatctttgcagctcctttaagcgagcatgccgagcgcattgtcaccatttctgctatcgagagccttgaatcttgtaattctcctgcacaagatgctgttattcttgtctttgctagaattattgaagatcacattggaaagggttttctccaagtctctagtatggaatcacctgtaactgcaaggcttttagttgcaacaagcacggtaaatagctggagtggcaatgaaggtcaggtgattttagaattgagagaagtaactggggctgacatacaaatattgcatggagagtcagttcctaacggtgcttcagatgacgatgtggtggtgcagagaagtggtttcgtgcagatcactggagaatacagatgtgtacaaaatgccctatataaaattacttctagaatcagggataatctttcacccaatgaggcggttactgaagcaagaccgaaatccaattggaaagtgaataaggatcctgtaaagggtaaacctttttcccgtggaaaatctgcgtttccttctgggaggtttctgccacggaatgcaggggtccatgctgaaacaatattacaaaatggagaattacatacggatttaagtgagaatttggaacgtgggagaggaaacatgtttgctacggtgacaaatactactgtggagataatagtttctgaacacgtctttggttctgtttatggtgaagatggtggcaatttggatcgaatcagacagatttcaggtgcaactgttacggtttatgatccttccgttggtacaagtggagggaaagttgtcatatctgggacaccagatcaaaccttggcagcgcagagcttgcttcaagcctttattcaaacgggagaagtaagctga

SEQ ID NO: 74955 - DNA, 672 bp, Glycine max
  Peptide Sequence Number=SeqID_166640
atgaaggagacccaagagatgattgactttgctgcggaacactatgtaaaacctgacattgaggttattcctgttgattatacattcggatgggcagctagggatactttgggtcttctctcccctttcaatttctccataaggaaaactggtgaaaaagatgtgagattcaaagttttgtactgtgggatatgtgactcggacctccacatggtgaagaacgaatgggccttttgcacctatccagtggtacccgggcatgagatagttggtgtagtgacagaggtgggaaaccaagtagaaaagttcaaagttggggacaaggtgggtgtgggaggcatggttgattcatgccgcagctgccaaaactgtgatgacaatcttgagatttattgtccaaaatacacgttcacatttggtgccaagcataaagatggcaccaccacatatggaggcttctctgactcaatggttgcagacgaacactttgtggttcgcattcctgatggcttaccacttgatgctgctgcacctctcctttgtgctggcatcactgcgtatagccctctcagatattttgccctagacaagcctgcaatacatgttggtgtggttggtcttggtggactagggtcatatggctgtcaagtttgccaaagcttttggggctaa

SEQ ID NO: 74956 - DNA, 852 bp, Glycine max
  Peptide Sequence Number=SeqID_166641
atggctttctccaactcaaaacctaacctccttcaatctctaagtccccttataaaattcctcatccctttcctcttgctacaacatagtgtcaattcacaacaacccccatccccaatgtcagcatacgaaaccgttggcttcggcttcggttttttcgacaaagatgacccaaacgtatttttgttgggcaatgcctcagtatctggtggggcactaaggctaaccaacaccgaccaacttggcaaaccggtcccacacagtgttggaagagcattgcatgtcacaccgatacacctctggaacaaaaacaacggagaactcgctgacttcagctctggcttctcctttgtcgtgaaccctaagggttcaacccttcgtggtgatggctttgccttctttcttgcaccagccaaccttaacttccccaaaaattcaagtggagggtatcttggacttttcaacccggaaactgcactggacccttccaaaaaccaaatagtggctattgagtttgatagtttcaccaatgattgggaccccaattcaccaaaccagtctcctcatgttggaattgatgttgactctattaagtcagtggcaactgtgccatggcctagtgaacttgaacctgataacgctgtagcacatgcgagcctgaactataactccgagtccaagagcttgagtgtgtttgtgggttaccctgacaataggaatgccactgtctctactattgttgatttgaggaatgttttgcccgaatggatcagagttggtttctctgcctccactggtgacttggttgaaacacatgacattcttaactggtctttcgaagcagccttgtag

SEQ ID NO: 74957 - DNA, 816 bp, Glycine max
  Peptide Sequence Number=SeqID_166642
atggccaaccatgcagctcaaaaccctatatctgttttccttatgaccttcctcttgctaattaccagctccaaatcagactcattttctttcaacttcccaagttttgagcctggtgttagaaacatactagtcggtgatgatgccaagacaacaggtggagtgctacaactcaccaaaaaggaccaaagcggaaaccctactcaacacagcgttggcctctcagcatactttggaccacttcatctctccgaccgaagaaccggtagagtcgcggacttcgccaccgagttttccttcgtcgtgaacacaaagggtgcgccactccacggcgacggcttcaccttctttcttgcatcaatcgattatgaattcccggacaagtcaagtggtggcttcctcggactcttcaacaaaaaaacagccttcaacacttccctaaaccaagtggttgctgttgagtttgatagctttgcaaatgaatgggaccctaattttccggagtctgattctcctcacataggaattgacatcaactccattaggtctgtggcaactgcgccatggccacttgatattcaaccacaaggatcaataggaaaggcacaaataagctatcaatcttcctccaaaatattgagtgtgtcggtggattatccaaatagtcctgtcaaattaaaacccactgtgttatcgtatcccgttaacttaggggctgttctgtcagaatgggtcctaatcggtttctctggagccaccggtgacttggttgaaacgcatgacattctttcatggtctttcaattccttcttgtag

SEQ ID NO: 74958 - DNA, 1548 bp, Glycine max
  Peptide Sequence Number=SeqID_166643
atggcaatggcaatggcacttggcaggctttcatcttccttcaacaagcctttacgtcctctcttcaatgctggctcagtttactacaagtcctctttgcctgctgaagctgcgtacgacaatgagaaaagctgtgatacggaattgaatgctccacttgaggttgttgatcctgagattgctgatataattgagcttgaaaaagctagacaatggaagggactggaactgataccctccgagaatttcacttctgtctctgtaatgcaagctattggctctatcattactaacactcggaatgaaggatatcccggtgcaagatattatgggggaaatgagtatattgacatggcagaaacactatgtcaaaaacgtgccttggaagcatttcggttggatccggctaaatggggagtgaacgtgcagcctctgtctggttcttctgccaattttcaagtttacactgcattgctaaaacctcatgatagaatcatgggacttgatctaccacatggagggcatctttctcatggataccagactgacaccaataaggtatctgcagtctccttattttttgagacaatgccatatagactgaacgaaaacacgggacacattgactatgatcagttggagagtacggcgaaactcttcaggccaaaattaatagttgctggagctactgcttatgcacgtctgtatgattatgcacgcattcgcaaggtgtgtgataaacagaaagctgtgctgttggcagatatggcacacatcagtggattagttgcagctggtgttatcccttcaccttttgattatgcagatgtagtgactaccacaactcacaaatcactccgtggccctcgcggagctatgatcttcttcaggaagggggtaaaagaaattaacgaaaaaggagaagaggtgatgtatgactatgaagacaaaatcaatagagctgtgtttcctggactgcaaagtggtcctcacttccactctattactggtttagctgttgcattgaagcaggctacaactccaaactatagagcataccaagagcaggttctccgtaattgctcaaaatttgcacaggcactgagtgagaagggctatgagcttgtttctggtggaactgagaatcatctacttttggtgaatctgaagagcaagggtattgatggctccagagttcagaaggtgttggaatcagttcacattgcagctaacaaaaacacagttccaggagatgtgtccgctatggttcctggtggtatcagaatgggaactcctgctcttacttctaggggatttgctgaggaggattttgttatggtggcagagttttttgatgcagctgtaaatttagctgtgaagatcaagtcagagacaaaaggatcaaaattgaaggacttcttggccacaattcagtcatcttcttactttcagtcagagattgcaaagcttcgccatgatgttgaggagtacgcaaaacaatttccaaccattggttttgataaagaaaccatgaagtacaacaaatga

SEQ ID NO: 74959 - DNA, 321 bp, Glycine max
  Peptide Sequence Number=SeqID_166644
atggaaattagcatttacaccaatccagctatccttgccagtactcaagttaattggaaaaagataaaaagtgcagagtgcagagtgcatcagcattggatctggaaacgcgtgaaagaagacatggctcgcgcgggagggataacaaacgcagtgaacgtgggaatcgcggtgcaagccgattgggagaaccgcgaattcatctctcacatttctctcaacgttcatcgcctcttcgacttccttgtccaattcggtacatacacttctccttttctctctgcaaaacgacccatcacgtgtcgtttcatctttccatga

SEQ ID NO: 74960 - DNA, 330 bp, Glycine max
  Peptide Sequence Number=SeqID_166645
atgaatgcaaagagaaaagaatatatgatttgtgtgctttcaaagagaagaatattgatgcgacatgaggagtcgttggggaatcgaaacacgacggcgtacaccaccatatccgaccacaacattcagtcaacgacacaaggcatgacccagaccctccatgtcagcgagcatcttcactacgtgatagacaacgacagatgctcccatgactggcgggtgcagttctacgtgttcccctacgcctacatccgatcgacgctctgcgagctcagatggtgtttcttgaagaaatggatcatcagcgtgagggaagagtcacgaatttga

SEQ ID NO: 74961 - DNA, 183 bp, Glycine max
  Peptide Sequence Number=SeqID_166646
atggggggtgatggtcttgggattaacatgggtaacaagtcaacggcctccctccatggaattgtgcaaagactgtctcattctcacgttatggtcaccaccgacccatgcaacagtgtgaggtcgagaaccgtctccatctctgcctttgcactcacagagcttcattcatggttactctga

SEQ ID NO: 74962 - DNA, 2448 bp, Glycine max
  Peptide Sequence Number=SeqID_166647
atgcgtcgggagggattggcaaaagacagtgatatttggaccgacaaacttagagatttgaggctctgggcttcctacagaggtcagacgttatcacggacagttagaggaatgatgtactactatcgtgccctcaagatgttgacttttctggattctgcatcagaaatggatattcgggaaggtgcccgcgaacttgtttcaatgaggcatgatgatttagagagttccaactcaaagtcgccttcctccaagagtttaagtagagcaagcagttctgttagtttgttattcaagggtcatgaatatgggactgctttaatgaaattcacatatgtgattgcttgccagatatatggaactcagaaggaaaaaaaggatcctcatgctgatgaaattttgtatctaatgcaaaataatgaggcccttcgagttgcttatgttgatgagaaaaccactggaagggatgagaaggagtattactctgttcttgttaagtatgaccaacagttgcagatggaggtggaaatttaccgcgtaaagttgcctggacccttgaagcttggggaaggaaagccggaaaatcaaaatcatgccatcatcttcactcgcggtgatgcagttcagactattgatatgaatcaggacaactactttgaggaggcacttaaaatgcgaaatctcttggaagaatacaggagttactatggtatccggaaacccactattttgggagttagggaacacatttttactggttctgtttcctctcttgcttggttcatgtcagctcaggaaacaagttttgtcaccttaggacagagggttttggcaaatcctttgaaggttagaatgcattacggtcacccagatgtgtttgacaggttttggtttttgactcgaggtggtatcagtaaagcttccagagtgatcaacataagtgaggacatctttgctggatttaattgtactcttcgtggaggtaatgtcactcaccatgagtacattcaggttggaaagggaagggatgttgggttgaatcaagtatcaatgtttgaagcaaaggttgccagtggaaatggggagcaagtcctaagtagagatgtgtacagattgggtcataggctggattttttccggatgctctcattcttctacactactgtggggttcttcttcaacactatggtggtggttctgactgtatatgcatttttatggggtcggctatatcttgctcttagtggtgttgaggagtcaatggaaagcaacagcaatgacaataaagcacttggtaccatcttgaatcaacagttcatcatccaacttggacttttcactgcccttccaatgattgtagagaattcccttgagcatgggttccttcaagctatctgggatttcttgaccatgcagctccagctttcatcagttttttacacattctcaatgggaactcgaagtcatttctttggacggactgttctgcatggtggggcaaaatatcgagctactggtcgtggttttgttgtagagcacaagagatttgctgaaatctatagactctttgcccgtagccattttgtgaaagcaattgaattggggctgatacttgtaatttatgcatcacatagtcctgtagctactgacacatttgtttatatagccttgaccatcactagttggttcttagttgcatcatggattatggcaccatttgtgttcaatccttctggctttgattggttaaaaactgtttacgattttgatgactttatgaactggatttggtacagtggaagtgtatttgctaaagctgaacagagctgggaaaggtggtggtatgaagagcaggatcatctaaaggtaactggcctttggggaaagcttttggagataatcttagaccttcgattcttctttttccagtatggaattgtctatcagttaggcatttctgatcataataccagtattgctgtttacttgttatcctggatttatgtgtttgttgtatctgggatttatgctgtggtagtctatgcccggaacaaatatgcagccaaagagcatatctattatcggctggtccagttccttgtcataattcttgcaatacttgtgatagttggtttgctggaattcactaaattcaaattcatggatatttttactagcctgttggcgttcatacccacaggctggggtctgatatcgattgcccaagtattccggccatttttgcagtccactatcatttgggatggtgttgtttcagtggcccgtatatatgatataatgtttggagtcattatcatgtcccctgtggcactactatcatggttgcctggatttcagaatatgcaaaccagaattcttttcaatgaagcattcagcaggggcctccggatattccagattgttacagggaaaaaatcacagagttga

SEQ ID NO: 74963 - DNA, 834 bp, Glycine max
  misc_feature (821)..(821): n is a, c, g, or t
  Peptide Sequence Number=SeqID_166648
atgactggcaaagacatcctccatataatgaaggtgaaagcagggtttgcaccaccagacacagggaaaggaaaaggcaaaatatcaaaacacatcacacatggctttcacttgatgaagggcaaatcggcacatcctatggaagattatttagtttcggaatttaagcaagaaaaggatagagaattaggcttgtttgcaatatttgatggccacttaggccatgatgttgccagctatttgcagaaccaccttttccaaaacatcttgaaagagcatgacttttggactgagacagaaagcgcggtgaagagagcttaccttgaaacagatgagaaaatattggaacaagcacttgtgttggggcgaggagggtcaacagctgtgactgcaatacttattgatggtcagaagcttatagtagcaaatgttggtgactcaagagctgttatttgtgagaatggaaaggcaagacaactatctgtggatcatgaaccaagcaaggaaaaaaaatggattgagaggcgtggcgggtttgtatcaaaaattccaggagatgtccctcgagtagatggacagctggcagtagcaagggcttttggtgacaggagcctgaagatgcatcttagttcagaacctgatgtgcttgtagaggaagtagatccacatacagagtttcttattctggctagtgatggaatatggaaggatttcattggaaatcatggttatgtcaaacgaagaagcagtggaatctattcgacaaataaaggatgctcaagctgcagcaaagcacttgatagaagaggcagtttccaggnaaagcaaggatga

SEQ ID NO: 74964 - DNA, 1477 bp, Glycine max
  Peptide Sequence Number=SeqID_166649
tgtgttgattttgggattgatgcttgcggtgtcacctttgaggagcaatatcaaagatgaaaagaagcaaggagagatggagggtaatttctcaatggcaacaacaacaaccgatgatgttgtctttggtgacctttctgaagggaacttgttggagagcatcaacttcgacgaactcttcgtcggcatcgacatccacggagatgtcttgccggacttggagatgttcggcgagttctccgtggatgtcagcaccggcgaggaatcgtcggagatgaactcgtcggctaaaagcagcaaacttgagaacgatcagaatgtcatcgccactacttcaaagaaagaagaggaagaagataaaacttcttgcaatgcttctggtcaagacttggggtcaaaccgtggagaggagattgtgagcgagagagatgaatccgtggtggtgaatccagcaccaaaggatggtggaaaaggaagaaaatcttcttcggctcaatcaaagaataatagtagtagtaataataatcctcaagggaagagaaaagtcaagttagctagtttcagtgaagctagcaatggttcatgtcatgagacatatgagtcatgtgccactgagctaactcttaaggtggattggaccccagaattgcacagacgattcgtgcaagctgtggaacagctaggagtggataaggcggtgccttcaaggattttggagattatgggaattgattgtctcactcgccataacattgctagccaccttcaaaaatatagatcccataggaaacatttgctagcacgtgaagctgaagcagcaagctggagtcaaaggaggcaattgtgtgctggtggagggaagagagaagggagtccatggttagcaccaaccatgggtttccctccaatgactcccccaatgcaccattttagacctttacatgtatgggggcacccttccatggaccagtccttcatgcatatgtggcctaagcatcttccaaattcaccaccactctcatggccgccgccggctgcaccgcctcaagagccttcattttggcaccaactgccatacatatatctcatgaatactcctttgaaacaggttcctaacgcactaatcccaggaacagcttgttttccacaacttctgacaccaacggtaactactcattacaagccttactactattttggaaccattggaaatgcaaatatcatgcagagatttggaagtccccctgtgcccggcatcccaccccatgccatgtacaaagcagatcacgacattggcctccctggtccccttttcgacttttatccgtcaaaggagtgcatagatgcagctattggagatgttttatcaaagccttggctgcctctacctattggacttaaggctccagcgcttgatagtgtgatgagtgaattacaaagacaaggaattccaaacattccaccctctagtgcttga

SEQ ID NO: 74965 - DNA, 180 bp, Glycine max
  Peptide Sequence Number=SeqID_166650
atgggttgggaaggagaagggaagggttggaagggggactgtgggcgtagaagagggagagaaggagaagggaaggaaagagttttgggggtagaatggtatttttctctagagtcaggaggcaagtctctacaaggagcaatggagaagacgaaagaagttgcaaaggaagaggtatag

SEQ ID NO: 74966 - DNA, 243 bp, Glycine max
  Peptide Sequence Number=SeqID_166651
atggtaagcactctgtctggccttagacgcaagacccttttcgaaggcttcaacccttcaatagcagttatgacagacatagatactcttcagcaactccaaaactgcattgcagagatggagcgacaccatgaggaggagctgagaaagctaaaggctaaccacaatcatctggaagctcatggtggactactcgtcaatatcccttcgttgactgcatcatggaagttgacatacccttag

SEQ ID NO: 74967 - DNA, 545 bp, Glycine max
  Peptide Sequence Number=SeqID_166652
atgcatggcgccattggtgatggcgccttcgacagggacgagccacgtggctgtgtcgccactgtgactggcgacagcagcgatgtcgccacctgcaatggcgctttggccatgcagggtggagtcgctggtcaaaccagcgcttccctacgcgtttgctttttgcaggtgcagctttgcagctttgctttttgcaggatgaattcggttataacagtgttgtatttcaatggaaggatatatgaagataatgatggtgtaatatttgaaggaagtaaaaaagcgattcagattaaacgtggaattagtttcaatgctttgaagaaaaaaattggagataaggatgtcgctggtggttcaatgtttcattctgcaaattcgcttacatcatgtggaaattatttatctaatgatgagacacaaccggcaacaaatatgagcaatttacacattgacgaagacgatgatgatcatgatgatgatgattatcttgtgtctaactcatacgttgaagagtctgtagacgaagatgacagtgttgaacg

SEQ ID NO: 74968 - DNA, 819 bp, Glycine max
  Peptide Sequence Number=SeqID_166653
atgaggaaagattcatatgctggcaaagctaaagatgttatggagcttcttgaggcctcacatttgaatggtccatgccttggagcttccttcccatgggagagtaccatatggtttgaggttaaatggcacatcaagcaatacaaaattgagaaatacatggacccaattttacttgaattggatacattaaatttcaacatgattcaggccaaacttcaaatggagaatcttggcataaaagaagacttgagcttagcaagaaataggttggttgaaagcttcttgtgtgcagcaggagttgcttttgagccgaactatacatctggtaggaaatggctcaccaaagtgattattttcgtgttagtcattgatgatgtttatgatatatacgcctcatttgaagagttgaaaccgttcacaatgacgtttgagagtgattctacgatccattcatattttgtcgcaaagaatcaagtaacggatatggaagattttctacccacatatgaggatttggtctacaatgtatctcttctgattcaactgtgcaatgatttagggacaaccgtggctgaaagagaaaggggtgatactgcttcgtcaatcctgtgctatatgaatgagatgaatgtttcagaggaaaaagcaagaaagaaaatacaagacatgataaacaaagcatggaaaaagataaatggacactgctccactcaagttgcttccatgaagccatttcttaatcaagccataaacgcagctcgtatggctcataccctttatcaaaatgaagatgcatggttttggtacccaggatag

SEQ ID NO: 74969 - DNA, 318 bp, Glycine max
  Peptide Sequence Number=SeqID_166654
atgcaacatcaacaaccccatacaaaagatggacggtgtggtgattcaaccttccaactttccaattctggccttttttacttcataagtggcaaccttaacaactgcaaaaacggtcaaaagctcaatattgttcttgtcatggctgtgaggcaaccaattcctaaggctgcgccgccgccggcaagcatcctgccactgcagaagattccggcaaccgatttgacttcttcggcaccgacaccgacgacggacaaatcgggttcagggagggttggtcctatggatgaggacttgtggtttgaactgatggtttaa

SEQ ID NO: 74970 - DNA, 1593 bp, Glycine max
  Peptide Sequence Number=SeqID_166655
atgctcagctactcacccccgcgtttcagaatcgccgccgtcgacgctcaccacgatcctctcttaccctttctccggtctatcaagaaagccctagaagcttccgacgactccgcttcgagtctcagtaacttactcaaagattgcatcagaaacttcaagaacaatgaccgctaccgaaacgacgtcagattcctcaagatctggctcctctatatgggagttagtgatgattttgatagtgttttcaaagaaatgctggacagtaatgtatgtaccaataattcttcactttatgtgtggtctgcaagtttttttgagttgaagggaagattgcatgatgctctcaccatctatcagcttggcatttgcaggaatacggagccaattgagtggttgaagaaggcacggaccttatttctcagtagaatttctgaaatacagaatgctgcttcaactcagaaggttgatgataaagaatccaagaatttggaagataatggcattaatccttggggcacttccaccatggatagccttttaaagaagatatatcctttaattatgaaatttgatgggtatcgttcaagcactaaaccatacacaggaaaagtggccttatctaccttgaagaattcatcaaggaataaagttttagagatagataatcatgttacagaatggtttatactagaactaggtggaatgaagtaccatataaagggctgtgctggacagggtggttttgcccaagtatataaggctaatgtcgacagtgatcctgacaatgttgttgcactaaagatacaaaaaccagctttcccttgggaattttacgtttatcgtctgcttgataagcgcatcttagatagagagaggtcaagttatggttttgctcaccgaattcatgtctattctgactgtagtatactcatctgtgactatttagctaatgggacactacaggatgtgataaactcatatgtggtcataggaaaatccatggaagaagtgttatgcatttactacacaatagaaatgttacacatggttgaaactttgcatggtgttggcttgattcatggtgatttcaagcctgataatctgctaattcgctatgctaggggtgaccttacagaagatgggttcttgagccgaagtggtccttggtgtgatcagggtctttgccttgttgactggggaagagggattgatttgcatctctttccagatcacacactatttaagggagattgcaaaacttctggttttcgctgcattgagatgctagaggataagccgtggaaatttcaggcaagtcacctcttaaattacactacaaatgcaatggaactcattatttaccgtcttttgagtttccgttctctatcacctgccaacagttactggaacattgagctctggaagactttcttcactaagatgctaaaccaatacccccatgatgatgataggagtttgctgcaggacctgaagaagtccttccaagactacttgagctccaatccgcagcttataaagaaactaaaggagttactctcaaagcaaagggcttccttgtgctctgcttaa

SEQ ID NO: 74971 - DNA, 150 bp, Glycine max
  Peptide Sequence Number=SeqID_166656
atggtcagtgaatttttagtggttgaagatgacattattgagaccgagaatggaaattctagttataacgataatttgagtatggatgataggaagaggatggtgagaaaggtagtgacggtaaaggttatggaagaaggaaaagaataa

SEQ ID NO: 74972 - DNA, 693 bp, Glycine max
  Peptide Sequence Number=SeqID_166657
atggcaatattccataggtttctggggctcttgattttgatggctcctatgttgttgcttcatgttgtggctaggcaatttgatgttggtggcaaagatggttgggtgctgaagcctaccgaagactacgatcactgggctcaaagaaacagatttcaagtcaatgacactcttcatttcaagtacaataaagggattgattcggttgtggtggtgaagaaggaggactttgattcatgcaacatcaacaaccccatacaaaagatggacggtggtgattcaaccttccaactttccaattctggccttttttacttcataagtggcaaccttaataactgcaaaaacggtcaaaagctcattgttcttgtcatggctgtgaggcaaccaatttctaaggctgcgccgccgccggcaagcatcctgccaccgcagaagattccggcaaccgatttgacttctccggcaccaacaccgacgacggacaattcgggttcagggagggttggtgtgagtgtgagtgtggggattgtttttatgttcattgcctttgttggcgtgttggtgtgcgtgctgtttgccattgagagtggtagttcatcactgcatcaaaagaagaaatatcaggagctttggcaatctgtggccacaatgcctcattcctacgtgtccatatgcaacacaaaagagtga

SEQ ID NO: 74973 - DNA, 175 bp, Glycine max
  Peptide Sequence Number=SeqID_166658
caaggagcagaatcgtctcaggccacggtcagaagtcaagacaagtcaatggcagaaatcaaccaaggtacttagggatggaggcgaatggagggttgcgaccaaccaatcgtcaccccttcccggcgctgggccagcggagaacatcgctgcaaggcagtccagtatcctttga

SEQ ID NO: 74974 - DNA, 255 bp, Glycine max
  Peptide Sequence Number=SeqID_166659
atggacatgcacattggtggtttgatctctggacagatgaccatgatggctcagtctaactcttctcacttaggctttccagctttaatcacagccttatgtagatcgaggggagttggatctgatgctcttacctcctatgagaacctaagatcggtcattgacttagcctatatcataaggaactattggaatgcgaatgaccaaacaattaattttccagaggcaaggaagaccaagctcagagcagctgat

SEQ ID NO: 74975 - DNA, 113 bp, Glycine max
  Peptide Sequence Number=SeqID_166660
gaattcgatagcagaataccctgatcaacgaaatcttgaatcatctatctcaaaccaagaaaaagatattgaaaacgattatgtaggatcagacagtgaaaagaatagtaagg

SEQ ID NO: 74976 - DNA, 1422 bp, Glycine max
  Peptide Sequence Number=SeqID_166661
catgtcgttgtaggcggtgatgatggcgatatcgctgcgcaccatgtttttcagcgccgtcttgtcatcgggctgacaggcggcgaagccgtgggccaggttgccgcaggccagctgcgcgcggtggacggtttgggaacgggccgcctcgatgcgcgccagataggcggcgcggctggcctgggaacggtggatgatgcgctgcgtgacacgggacaaggttggttcgttggcgccggtgaatttgccgaacagccaaaaaccggcgtcgttgacgtggctcagcacgatggagccgccggcgatgcagatagccagcgcggccagctgcccgccgttcagcccgagctggctggtgaccggcagcaccaggccgacggtggtcagacaggcgacggtggccgagccctgaatcacccgcaccatggcggagagcgcaaaggcggccacggcgatcggcaggccggcgccgatcatcgcgtcacccagcgccggccctacgccggaatccaccaggatctgtttgaacaccccgccggcgccggtcatcagcaggatgatcccggccggttgcaccgcggcggagcagatggccagcgtctgttcgttgctcatgccgcgcggcttcgccaggccgtaaatcacgatcaggcaggccagcagaatggcggtgaacgggtggccgataaactccagccactgctgcagttgcgagccgggggtgaccagccgcgcgccgatggtcttcatgccgaccagcaccagcgggcacagcaccagcgccaggctgaagccgaacgacggcagattgcccttggtcaacgtcggctcgttctcttccggtggcatcggccagttgacgaagcggctgataaagctgccgtacagcgggccggcgatcagcatgccgatcaccgccgccaccaggccgatggcgatcatccagccgaagtcggccttcatctgcgaagccagcagcatcggcaccggccccggcagcaggaaggaggcggcggcggccacgccggcgaacagcggaatggccagcttgacgatattgccgtcggtgcggcgcgccacggcgaacacgatgccgatcagcagcaccaccgccacgtcgaagaacagcggcagcgcgcagatcaggccggcgatgccgagcgcgtagtgcgccttgctttgtccgaatcgtttcagcaattgcgccgcaatttgatcgagcgcgccgacctcatgcaggatcttgccgaacattgccccgagcgccaccacgatcgccaggaagcccagcgtgtcgcccatgcctttttgcatggtgtcggcaatatggtccagcggcatgccggagaagatgccggcggcgatggacaccagcatcagcgcgacgaaggcgtgcatgcgcgccttcatcaccaggaataa

SEQ ID NO: 74977 - DNA, 981 bp, Glycine max
  Peptide Sequence Number=SeqID_166662
atgctggttcaacacctggtagctgacgcggttggcgtatttgcacacctgcgccagggaggagtaagtcaggtagctgcgcacgtgcttgctggagttcggcacgttgtggcggtgatagccgttggcggcgatatcgtgcagcaacgccgacagcgcgccgtcgccggcgccgttggtgttcatgatcttctccggcccgcccatatacggcgcgatgtgcgaataaacgcgcagcggattttcacagtgttcgcggcgcatggcgcggctgaattcgtagcggttgaactcggcgatatgccccggcagcagcgggtgctgggtctggcgcttgttggcctcttcggtgtagcccgccatatacaggccgttcggcccggcggtgcacagcaccagatccacccactccagcgccatgtccgaggcggtcagcggatcgctcagcccggtcagctccagcgcttcgtcttcgttcatcgccagaatcgtcacgttttccttcaggaagtcgcgccaccactgcgggttgtcggcaatgacgtacttggtgcccagcgtcaacaccaccggcacgtcgtgctttttggcgtattcgatcgcctgcagggtggcggccttcatcggctccccttccttgcagcgcaccagataagagctcagcaccagcgccgacgcgccggcgatcacctcttcaggaatgctttccgggcgcagctgattcatttggcccgggttgatggcgaaggtgcgctcgccgctttcgccaatcagcgtgaaacagcggccgatggcgccgtctacgccctgcagatagttgagatcggtacggctggaggtattgcacaggtaacggtaggcgtagctgccgattttcacgttgctgcacatcacgccgagcagcaccgagcggatcgtccgccagcaccgaatagttgtgcatgggtattgccgatggtgccgccggcgactgatgggtaa

SEQ ID NO: 74978 - DNA, 195 bp, Glycine max
  Peptide Sequence Number=SeqID_166663
atgccgctctccatgtgtcggagacttggagagctggagataatgtctactcggatgaccttacagttagctgatcacttcatcaccagaccctatggagtgattgaagacgtgctagtccgggatgtatgcttacaggtgaaggagttggataagaaggttctgaaggagagaaccaagattgatccaggataa

SEQ ID NO: 74979 - DNA, 261 bp, Glycine max
  Peptide Sequence Number=SeqID_166664
atggcttacacccacattccggatttacacgcgattctctcaaattcagccaggcatcaattagaccttgcaccttacgcttcagagccctacatgctcaatgggacacgcccggggcttctccgtgacaagcacacgttgcattcgagtcgtattctcggagaaatggaggttgatgaaccttggctggggttatggctaccattgaattatcaagtggtgtttgtcattggaagtgcggtaggtaggctttgtggttga

SEQ ID NO: 74980 - DNA, 534 bp, Glycine max
  Peptide Sequence Number=SeqID_166665
atgtcaatccttgccctcgaaaaaaaaacacaaagagaaggaaaattcccaatccaagaaagggagaagacacaaaaagaaaagaaaattcccaaaccaagaaagggagaagacacaaaaaagaaagaaaatcccaatgaaagaatgggagaaagcaaagaaaagaaagaaaaattctcgatcaaggatcggaagaaaaagaaatatgcagaaaggtctttggaccagacaatatctgaacagtacagaattgtcaccaatgtttcctctaaatggtcatttagaaatgaaatgctaaacatccaaaatctcatttacggttatgagaaaatttcatcagcatactctccttccccgatagacacattgtttttcatccaaaaagcatatgttgctctgatcagctggaagttttgtctctttactaaagcatgttcgcattttggtgaagaaaacaccgagactatttttagtctcacaattttcaagaactacgtaggtctgagttcctcatcacaaattgaggatacgtag

SEQ ID NO: 74981 - DNA, 312 bp, Glycine max
  Peptide Sequence Number=SeqID_166666
atggagcttattgagaacatggcagccagtgatcatgctatcttgcgtgataggacacataatgccacaaaaagaagcctgttggagctttcctcacacgacacattgttggcacagaataagctgtcaaccaaacagcttgaatcgctcatggagacacttagcaaattcccaaaacatttgcaagcggctcagccttctcattcaacagttatgcaaataaggatttcactcaggcggtttttcaggttaccagcaaggaggaaacttcaatcaaaatcaagggcaagagacgagatcacacccaggtaa

SEQ ID NO: 74982 - DNA, 345 bp, Glycine max
  Peptide Sequence Number=SeqID_166667
atgaaggcccaagtggagaaagatgaaggcccagaggcagaggcactatcaagaccattaatgttgctgaaggcccaaactaatttgaaggcccaaacttatcaaggtaatccttgtggcgtctacccagacttatcttccttcattggaagtggcgtctacccagacttatcttccttcattggaagtggcgtctacccagacttatcttccttaaccggaagtggcgtctacccagacttattttccttcactggaagtggcgtctaccatgacttatcttccttcactggaagtggcgtcatccaaaccttcgtagcctgtatcaaacgatccgccccgtaa

SEQ ID NO: 74983 - DNA, 231 bp, Glycine max
  Peptide Sequence Number=SeqID_166668
atgttcttgcttagggctgttcatgtgtcctccactttcaagtttggagctgagtttcatgattgcctaagtgcggaccctcaaggcaatcctccatactccacctttgctcggagcaccatgaataagaaaaaagaagaagtagagatgagagtcgtcatcgcgaaaagggcaggacggacgaaatcagtgtcctatcttggctttcctcttatcttcgatgagaggtaa

SEQ ID NO: 74984 - DNA, 470 bp, Glycine max
  Peptide Sequence Number=SeqID_166669
ggatcagtcgaggattgaaggcatgatcttgaaggacgagttaaaggcttgccttaggtcgaaaagaaatttgtcccggcagttaagcaagactgaagggaatatgtgggccatcatcgatgagtacaaagagaagctgaacctagcagcgactcacgagcaaaggctagaggatgagtacaccaagatatcagcggaaagggaagcaagggaaagggtaatcaactcattacacagaggggcaatggtgtggatggacagattcgcctttactttgaatggaagtcaagagcttccccgactgctagctaaggccaaagcaatggcggatgtgtactcggcccccgaagaaattcatgggctcctcaactattgccagcacatgattgatctagaggtgcaagaacagatgaaagccaacatgttgactctgaaagatcaaatggcttccatgatggaagccatgctag

SEQ ID NO: 74985 - DNA, 135 bp, Glycine max
  Peptide Sequence Number=SeqID_166670
atgaagagtaaagaatacctcctagatgtggaagcaatgtcttccaagatgaatggcaacagaatggagaaggaagagagagaggagacgtcacttcaaggagaagatgagtctagaagaagctcaccaccatag

SEQ ID NO: 74986 - DNA, 240 bp, Glycine max
  Peptide Sequence Number=SeqID_166671
gtgcttccagtggcttctgtttctatcagctgtccctcctgttcagctactgacggggtggtgcgtaacggcaaaaagcaccgccggacatcagcgctggcaagtgtagcggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 74987 - DNA, 138 bp, Glycine max
  Peptide Sequence Number=SeqID_166672
atggtccgtggtgccatggtattcgaagtactggttgatcttgaagatccaaccaagaggtggatggtggtggtggtggtggtggagtggaggattggcagtggaagggaaggtgacaagggtaactcaatgaagtaa

SEQ ID NO: 74988 - DNA, 258 bp, Glycine max
  Peptide Sequence Number=SeqID_166673
atgcccagggcacagaattccagagcacaccacagtgcctatttcgggaaaagagctctggaggcagcaagaggagcagcttttgaagaaatacctagagaaaatgtattgttgcttgagaacttgaatgatgcagaattgaaacttagtcttacaagaaggatctacggattaagttttggttttaagtatgctgttacaataatgttgtttggtctaagtctagtccaacaagagggatctaaggaaaaagcttag

SEQ ID NO: 74989 - DNA, 727 bp, Glycine max
  Peptide Sequence Number=SeqID_166674
ttgcagccccggctgcgccagccggcagccgttgggtttcggaggcctttaacaaatccgagcgtccaccattggctgctgccaaagtcgtggtctctggtggccgagcactaggcagctccgaagcctttgccgaagtattggcgccattggccgataaactgcatgccgcgattggtgccagccgcgccgccgtggatgccggttatgcgccgaatgacttgcaagtcggccagaccggtgttgtcgttgcgcctgaactgtatattgccgtgggtatttccggcgcaatccagcatgcctatggcatgaaagatagcaaagtcgtggtggcgatcaaccaggatccagaagcacagatcttcaagatcgcagattatgggctggttgccgacctcttcaaaaccacacgtgacccgggcttgcgctttgaaaacggccagtttgtcatgatcggcctcgaagtggatggcctgccgctgacccgtgcttacagtattgccagccctaactatgaagagcacctggagtttttcagcattaaagtgcctaatggcccgctgacctcccgcctgcaacacttgaaagtgggtgacccgctactggtcagccgcaagcctaccggcacgctgatcacctctgacctgaagccaggcaaaaacctgtacttcttctctaccggtactggcctggcaccgttcatgagcctgatccaggacatcgaagt

SEQ ID NO: 74990 - DNA, 541 bp, Glycine max
  Peptide Sequence Number=SeqID_166675
atgtctaatattcaaactggcgccgagcgtatgccgcatgacctttcccatcttggcttccttgctggtcagattggtcgtcttattaccatttcaactactccggttatcgctggcgactccttcgagatggacgccgttggcgctctccgtctttctccattgcgtcgtggatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccacccc

SEQ ID NO: 74991 - DNA, 537 bp, Glycine max
  Peptide Sequence Number=SeqID_166676
atgatagatcgaggccgactggaagtcgacgatgaggggagtgaagagcagcatatatgtatgcagtccgtagatgagagaagttttggaaggcctaagcctttggtggtatatttcaccaaagacgcagctccccaaatgccccgatacccctcggtagttaaacctgttccgtttccgtatcgaaacagccacgcagtttcgtggaggtatgcacctccaaacgaaaggaagaaagaggccaccgacatcagctcgttgtcagtcaaggtaaccaatatcatgtggctgagcggcgtgacccgcagcggtcgcgtgtttgcaccctctgatttgttgacacaacccgcaaatgttaaagggaagacaaagatagtggaggaacaaaatgacaaaacgaccctcactccgaatgaggatattccagtgaaaggtcatccggagaaaaggtatggttgtggcaagaaagaagtatcgctagaggaggcaggcaagttcctccgcattattcagcaaagcgagttcaaggtcatttaa

SEQ ID NO: 74992 - DNA, 286 bp, Glycine max
  Peptide Sequence Number=SeqID_166677
atgagagaggctcttgaaaagatgggtgctaaaaagattcctgcaaacaaccttccagcaagagaaatctccaccattttcgattggaaccaaaattctgtcaactatgaagaagattatgtcaagtacatcgaatcaaagaaagagcttatggaagccaacaaaaaagaattaaagccagttgttgatacactctctagaatggaatcaaacagcgaggtttatgttgatcaagaaagtggtcttatttatgatgtacttttaaccaaggttgatgctggttatg

SEQ ID NO: 74993 - DNA, 669 bp, Glycine max
  Peptide Sequence Number=SeqID_166678
atgactgaaaatccatcactcattgaggaccccccatctcccattcaaagacatgtcaagtggaagatgacacacacaaaccgatataggaagatgacatctgaggctgcaagacaaattgctgataaaattgacttgttggaagaacaagtgacacatggtgagtttgtcccccagggtcgtcaagatatacttaacacggccaaaggaagaccagatcatggaggtcgtgttcatgcagctgggtctggggtcacaattagtcaatactatgggaggacatcacgtgcctcaactacctcatcaatatcattcaccaaagaacagttggctgaaatagtagtaaccattagggaacaagtcaggaatgatattgaagaagaaaataagcgaagtctacaggcttggaaaaatgagctgaaggatgccatcattactgacatatttaacacagataaggtctcagcaccgactaattttgacttaaatgtgttaggtgcacgcgtgagcactaaggagagcaatgcagaaattgctgtgaacccgtctggggaagaacatgttggtcgtgtaacaccgcctatggggttgtacgtccaaagtcaagattgtacaaagctggtggcgttgggaaaaattcatatggaccatctaccatacattgcatag

SEQ ID NO: 74994 - DNA, 315 bp, Glycine max
  Peptide Sequence Number=SeqID_166679
atgtacaataggttagcggtgggtttggtccaacaagatctgttgttgttggaagagaagcaaggagagtgggacacatgtttcaaagtgttttctgaagtgtcgttattggtaatcgattacaaacatctggaaatcgattacaagattcaaaattcaaatttcaaaatcctttttgaaaagcccatttgcaatctgtctctgatttacactctttatttcgcatctccctttgttgtcgaagacgaagatggagagagtggaagatcaaaagaacaaagcaagggtcctagggttcgtgaccaaatcaaatga

SEQ ID NO: 74995 - DNA, 126 bp, Glycine max
  Peptide Sequence Number=SeqID_166680
atggaccttaaaactggcttgcaacaacctatagctttgattgatgaggcagggtgctattttttccctgaaatctatgttgcttctgatgaagaaccttataatttgagcaaacagtttttttaa

SEQ ID NO: 74996 - DNA, 426 bp, Glycine max
  Peptide Sequence Number=SeqID_166681
atgtattctctagactctcacaccgcaattgataaagggcagtaccggtcatcaaaattttctacttttggtatttccgggaagctcatcttccatgttgtttgcataatgtttatgtggattgaactaaccctgttaacagatattggttcaagggcttgcgtttctgttgatgctgtaaatatgcatgttgattttgtaagggagtacaatcaagattttgaatgtgatcttgatccagaaagcactgctactttcccatccactttgtctcaactgactgagcggttgaaacactggaaaaatgttcttcaaaacaatgttgaggatagctttccagcagtattaaagttggaaaaagaaagcaagaaaattgcaccagatcataccgtgaagttggatagggttgctgctgatattccaatt

SEQ ID NO: 74997 - DNA, 537 bp, Glycine max
  Peptide Sequence Number=SeqID_166682
atgacagaggagaacaacactctaagaatgatgcttcaagttctaagcagcaagtacacaaagcttgagacccatcttcaagaaataaacaagacacaacacaaggacatgagttcaaatgaaataggtttagtaacagtaccacctatgtttcatacaaacaacagagcgagagtagatttcacttcatggataactaccctgacctcatcattggaaattacactgatggaaacttgttctctaaatgcaactcaatgttgtgtaatagagttagggctgtcgacattacctatttcacgacctgagttagggtttgaggtagagactgtagctatgggccgcttcgctgcgcctgactttgacggacacaatatgcacgagctcgaggttcagggtgcgcgagctcgaggtttagggttcgcgaggtttagggtgcgcgaggttgacggtgcgctaggttcagggtgcgtgatgttcagggaaagcgaggatcagagacacaatgtgcgtgacgttgacagagagaatgcttga

SEQ ID NO: 74998 - DNA, 474 bp, Glycine max
  Peptide Sequence Number=SeqID_166683
atggagatcactaaagttagttcgatcctaattgtggtgttattgtttgtgtcatgtattagtcaggccaatgcatactattaccagcaatgtagcaccaaaggaactcgatgctatgaaaagtatgttagatggccaactgagtgtccaagcaatgaatcaacagatcctaaggctaaggtttctcaaattgattgcgacaaatctatatgcagggctgtatgcagaaagtgttctacttccacgaagagcaatgaacacttcaccttagtctcagacttcgccattcaaatcaatgctcgcttcattggatacaggccagaaggtagtggcagagactacacatggattcaagcccttggaatcctcttcaactccaaaaccctctcacttgaagccgtcaaaacaccccaatggagtgaaaatgtggaccatctcaaattcacatacaatgacaaccccaatggagtttaa

SEQ ID NO: 74999 - DNA, 132 bp, Glycine max
  Peptide Sequence Number=SeqID_166684
atggctgaagagaaatctggggatccacctcaacagaagcgaagtcaaagaatagagataaagaaagagttcaacaattttactcaagatttcaaatggggtgtatttttccatttagatgatttactttga

SEQ ID NO: 75000 - DNA, 501 bp, Glycine max
  Peptide Sequence Number=SeqID_166685
atggatgaaggctcgcaaatattgttcaattatgcaattcaaaacctctgtctgtccatcaatttaggggtgatacgagaagctcatccgcaaaagtgtcacactcgaacggaagagttcttgcaagaatctgctgatgaaaatggggtctcggtcggagaccaagctccggagaatcccatggattttgacgacaatgtggatccatttggaaaaatgatcaacgacgaccaagatggtggtgttaccctggtatggtggaaggccgacgatgaagtccaacgagaagtcctcccaggggccaaggtcttagtaactccggcatcgccaccagtaggcgtggcatggtattcagtgagcaaagtggaatatcgcaaatggattggcgaaggcccgtgtactcagggtgagcttccagctgtttacgaatttcctcaaggaaggtcaacgatggtactgacagaatcaaggacagggatgagcctgtctcaggtaatctag

SEQ ID NO: 75001 - DNA, 609 bp, Glycine max
  Peptide Sequence Number=SeqID_166686
atgaggacagagacacagtggctaggcaagaggcccgctaagcgtagcgcttttggtgctaggtggcccgaaagtgagtttaaacttatttgggcctggcgcttcactggtggtggcagtggtcgaggaggcgacgacaagagaggtggaagtggagtcgggcgaatagggagtggagctagtggcggtaggcatgcatgcgagggtggcgacaacccgagagcttctcctcctgaaggcgggccagagatgaagcaagccaagagaaagggtggcaacagctcgattatcctgttggccagcattgttggtcatatacttaaaccaagcaagagctctaccttccatgtagaaggaggcaatggtgagacaatccttgtctggggtattgtgggacaaagggttggtggtgatgagctggtgttggagttgcaatggagaccggggagactagtaaaacgtggtgaaggagtttgtccatcttcaaggtcatgggacatggaggcaatgagagcaccaaatgttagggacgcagtaagctggttttcgaggaaccagtacctccagcaattcaataaggaaaaagaacaacaaagagggaaggagtga

SEQ ID NO: 75002 - DNA, 234 bp, Glycine max
  Peptide Sequence Number=SeqID_166687
atggcagaagaggaatccggactacctataggcgatccacctcagtgggagagaagtcaaataatcgagataaagaaaaaactcaagaatattacaaaagtggtggtgttgcattgtccgtgctggtggcgagaggatggagtgggaactaggccagtgagaacaaagagtgggatacaactgtcacaggtggtgatggtggcagcgagagtgggagaacaagattttgattag

SEQ ID NO: 75003 - DNA, 969 bp, Glycine max
  Peptide Sequence Number=SeqID_166688
atgcaaaagcgccatgtgccatctagtttggttacaagcaacaccgacgacgagaatgggctcgtgctggtagggacacacattgaccggcaaagagtgaggaagcaggtgaatatggtgatctatggttcttgccggaggcagagcatgtggctgttggaagagaagcgtgaacttcgtgaacacctcgggcatcaccgtaatgtggaagtagaaagtgtcggcctagcggcgataaagacggcagaactggtgctgagtaagggtccccaaattggtgttgtgctcgccctggagctcaaccaagcggtcctgataaaaaagctgcatggacaaagtattatagttggtcaacactggacacaaggtcttaagccattggacaccaaatacgatattggcaccgaaaattggtcgttacctaccattacacggagtggtgtagacatcgtccagcaaggcaagcacaagcaggtgaccaccgaaggttgtacgaaattatgtgtacttcctccgtcgacgaggacagtgacacggtggctgggcaagaggcctgctaagtggcccgaaagtgagtttaaacttatttgggcctggtatggatccgggttgtcgggcaggtcgggtgtcggcataacccatgctcacggcgtgaggttagctcctctggtgtcaggtgcttcattggtggtggtggtggtcggggaggcgacgacaagagaggtggaagtggagtcgagcgaagaggtagtggagctagtggcagcaggcatgcacgcgagggcggcgatagcccgagagcttctcctcctggaggcgggtggggccggtagcctggaccagcgtgagaggttggtgagcctgcacctcgcgacgaatcttctaggacaggccagagatgaagtaggccaagagaaagggtggcgacagtccgattatcctgttggccaggtcttcgaactccgacag

SEQ ID NO: 75004 - DNA, 345 bp, Glycine max
  Peptide Sequence Number=SeqID_166689
atggcgggaattgcctggcacaaggagttactcaacgaccaacccctcgtgtttccattaggtatcttggattaccgtagagcatccaccgaggatccctgggagctgtgtgaaaactaccaccttgaggacaaggtggtcttacaagggccgaggaatgatacgagcttacaaatagaggtattggttcctcgaaaaccagcttattgcattccaaacacatgtccaacacctgaaagcagcattcatgatccgtgtatgtgcttcctagatcataaacctagttgtttacatgattggtctcctctaaggtgcaatcattactttagaactatgcatatctaa

SEQ ID NO: 75005 - DNA, 190 bp, Glycine max
  Peptide Sequence Number=SeqID_166690
atgaagggtgcccaagcctatgatgccatgatgcagaggattctgttcgaaccgtgtgggcggagggtgaggtggcgggccagagatagagtccatccacacatgagcctttatgggttgtgtgacccgtctgcaagtccgtcacataaaaagagtttggcaggaaataacagcagagttagtttgttgg

SEQ ID NO: 75006 - DNA, 54 bp, Glycine max
  Peptide Sequence Number=SeqID_166691
atggactgggttttcactgatcaagcattgcccaatgatcttgtcaagaggtaa

SEQ ID NO: 75007 - DNA, 396 bp, Glycine max
  Peptide Sequence Number=SeqID_166692
atgatcaacaatggtcaagatggtggtgttaccctggtatggtggaaggccgaaatgaagtccaacgagaggtcctcccagggtcggcatgccaaggtcttagtaactctggcatggccaccagtaggagtgtcatggtattcggtgagcaagatggaaggtgagcttccagttgttgacgaagttcgccaaggaaggtcaacgatggtactgatagaatcaaggacagagatgagactgtctcaggcttcgatggtcagtgaggatgatgaagcggtgaacgagaagaggaccacaccaatgcccatccccaaagcatccatctcgacggtgaatggcacaataaagttgggcaaggccaggattggtgctaaagacagggcatgcttgagttga

SEQ ID NO: 75008 - DNA, 457 bp, Glycine max
  Peptide Sequence Number=SeqID_166693
atggcatccttcagccagatgcagtcccagtttcaatcacacatgcaatcacaaggaattgcattgcctctggagcctgaggttggtccctcagggcctcgtgtcagcacaaaggagagttgtgttgatccctcagggaacaatccagagacgggggactcaggcaaatgcacaactcccattcttgtacccattgatgaggttacctttgtggggcagacacttaacacctttcttgcttggccgacacatctccaagcagttgtttctccagcaaaacctccacaatggccggatcctaaagtcgatgatccgctatattcgataacattgaccatcctagagcttttcttgaagcctttccaggttaactgggatgctaccgtgttcggagtgtttaatctagacttcccactgtacataaagcacgaagatctctccgaaatcgcacacgatg

SEQ ID NO: 75009 - DNA, 138 bp, Glycine max
  Peptide Sequence Number=SeqID_166694
atgggatccttctcttcttcttccctctttctccttttcttcttctcttcttcacactcaaaggtatgggagcggtgtatggcatcactaagagcagcgtcggggttgcgtcgatgggtcacgccggagctggattga

SEQ ID NO: 75010 - DNA, 408 bp, Glycine max
  Peptide Sequence Number=SeqID_166695
atggtgaatattttatcacttgtgagtgctgccctggttgtcccttgggcaaatgtggctaactggaaagactctgcaatgaggaaacgaaactttcacagggatgagttcctacattgcacgagttgcaggaaggagcgcaggttccgtctcaagaacagaccagatattaagaactaccatgaagctttgaacaacaaatcctggacttgttctctttggccttaccaaaatataacctgcgatgatgatgaagagagaccaagtctgagagcaagcaggggctgttctcgttcttcaacttgccaaggctgctcagcttgttactgtgaagggcgcatcaagtgccgctttgaggattgcaattgtcaagaatgcagagactttatgctttatgctgaaccttaa

SEQ ID NO: 75011 - DNA, 228 bp, Glycine max
  Peptide Sequence Number=SeqID_166696
atgatcggaagagatgatgaaggagattggaagcatgggagaaaaattccgaggaaggcacagcaccgcaagttctcaggaacaagagaaaattttagggttcagagaaaaatgaggagggaggatcctcaattaagtgaacgtgggattattttctgtgatctatctgcaatattgagtttgtgctgggacgacgctggatttggttcaattcttggtgattgttga

SEQ ID NO: 75012 - DNA, 495 bp, Glycine max
  Peptide Sequence Number=SeqID_166697
tttttcaggagacctactcttggtgactattttcaagagaaggtcttcttggttgcaaacactgaatacaagggaccaacgttccttgggttcattgcaagaagcaggatttgcttcttggttgatcactggacacaaaaagttggtatcactgaacacaagggaccaacgttccttggggataatggaaatctcaagcgggttgcttggggactggacataggcataggttgtggccgaaccatacaagtagagggtacatctacttgggttgttgtaactgagaacaagggagggtacatctcttctggatcagttcaagtggagggcttttacaaggttgacaataaatctcaaggaccgcaagccgcttggggactgaatgtaggcacggagcgtttgactgattatgaccagcaccagccacttgctgctaaatggaagccattgagaggaactagcaaggctggcaggactagggagcaactcgattag

SEQ ID NO: 75013 - DNA, 258 bp, Glycine max
  Peptide Sequence Number=SeqID_166698
atggggggggagggggaatacggggaacctttgggaacaacacttgaacataacactttaagaagggatttggcagatgttttgataaattggggagtaaatttggatcctctaagcaaatggtcaaagggagcaggagaactatttggagctgcaattatgagtgttcaaagagcagggacaactacttctttaatactaatgttattccttctcacaagtggctactatatccaggggacaccacatcccttttga

SEQ ID NO: 75014 - DNA, 159 bp, Glycine max
  Peptide Sequence Number=SeqID_166699
atggcacaaagctgcatttctcgtggatgtaggcagattgcagaaccacgtaaactcatggttctagaacataaagaggtagaagaaccaacaagtggcaccgactgtggggacaagatcaagatcaagaaagatgggaacaacaaagtacgatattga

SEQ ID NO: 75015 - DNA, 498 bp, Glycine max
  Peptide Sequence Number=SeqID_166700
atggaaattaaaaagtgtagggaagaagaagacaaacacaagagttttatactggttcggcaacaacccatgcctacatccagtcccaagcgacctgcagtccttgagatttcttttcaaccttgtaaaaacctttacaagaaaagatccacaagggatgtaccctcccttgttctctttgaacaaccaagtggatttacaacaacccaagtagatgtaccctctacttgtaccacaaaggatgtaccctccaatgtgttgagacaaagttctcaggcgggagaagggagacacaaaagaattcaggcggttagtcctttgttcttttggaaaagggagaagagagacacaaaaagaattcaggcgaaacaaagtttggaaactagaaaactcagaaagcttttggcaaaggaagaagaaaaagaagttcaagaagatgttcaaagagattcaaaggttgtaaaagaatatatgaaaaagttgtgtaaaaagttgtaa

SEQ ID NO: 75016 - DNA, 171 bp, Glycine max
  Peptide Sequence Number=SeqID_166701
atgacaggtatgaagaggatgagggaggatggaggaataagaggtatagggagagaagaagtcatagaagatatggagaactacaatgaagagataaagatcaaattggtctccatggagtttgagggatatgcctcagtatggtggaatcaagtgaggagtgatgtttag

SEQ ID NO: 75017 - DNA, 265 bp, Glycine max
  Peptide Sequence Number=SeqID_166702
atggaagaagaaaaagcagtggcatactacgacgagaagacccgtaagggtgagagagctacgaggttcaagcaaggtctcgatttttcctcttcaacaccaaatgacaacgttccaaaacactcctcctccttcctctccaaatttgtcaaagcctcctctgagtcgaagaagcaagcgcaactccaatccatccacgaccagctcaaggaaaagccttctttcgagtctagggtttcgagcagggatagggatagcaatagaa

SEQ ID NO: 75018 - DNA, 316 bp, Glycine max
  Peptide Sequence Number=SeqID_166703
atggaagaagaaaaagcagcggcgtactatgacaaggtgactcgtaagggcgagagagctgcgaggttcaagcaaggtctcgaattttcctcttcagcaccaaatgacgatgttgcaaaaccctcctcctccttcctctccaaattcatcaaagcctcctccgagtcgaagatggaagcgcaactccaatccatccacgacaggctcaaggaaaagccttctttcgagtctagggtttcgagcagggatagggacagtaatagaagtagaaggagaagcaggagcagagaaaaacgtaggaaaaggagcaaaagcg

SEQ ID NO: 75019 - DNA, 1047 bp, Glycine max
  Peptide Sequence Number=SeqID_166704
atgactacaggtgatccaccccaacagaagacaagacaaggaaatgagaaaaagaaagaagatgagaatgttactcaaggcgattcacctcaagaggagagaattctaagaatcgagatagaggaagaactcaagaatattacagaagggccatcaaaacgaagaaagcaatttagggttggagatgatggtaaaatattatttgatgaagatgagctcaaaataatcctagattttaagagaggtgaggactatattgaggttctttgtggcgctacaaacaaaaaatatggagattatgttgggaggctaaaaattaataacgaaggtcaatatttcatcacttgtgagtgttgccctaagtgtcccttggctggagttgctgcacatgatgtccaacgttatgtcaaggaatcagatcgggctgcacaatgcacaaggcaagataaaatgtcaaatgaagaattgaagctgcaggatccacgatgtcggatacaatgtccaggacatcctgcccgaaaatactggagttgctgcacaatgcacaatgcaggatccacgatgtcggatacaatatctttaagtgcagattttcaggagaatgatagatctcatccagcacaagtagttgcagcccagatacgcacactgctatataaacatgaaggctgcacgagttttgtaccaagtccgggattgaagagttatttttgtgtggagttgatctctattgttcagagagcaatctctgaatttcaagaagcatttaagaaacatgctttaagggaagggagtggaaggtggaagacaaacatttgggttcattgtgaagacgaagacaaagttccactctggaagacacctctgataaaaataacatgcgatgatgatgaagagagattaagtctgaaagcaagcaggggctgttcttgttcttcaacttgccaaggctgctcaacttgttactgtgaagggtgcatcaagtgccgctttgaggattgcaattgccaagaatgcagagactttatgctatatgctaaaccttaa

SEQ ID NO: 75020 - DNA, 135 bp, Glycine max
  Peptide Sequence Number=SeqID_166705
atggaaagaacgtacaacgtgaacgtaacgtgcacgtccaacataaaattcatgtttgctggcatgtttatggtctcctttatcggtcagacagagaataccgggaggcgatcaagtgttatcgaaatgcactga

SEQ ID NO: 75021 - DNA, 408 bp, Glycine max
  Peptide Sequence Number=SeqID_166706
atggctattgctctctctggccaacttcttcttggacaacctgtaatggtgaaaccttctgaagctgaaaagaaccttgttcaatctaatgcttctggtggagcagccggtgtaactggctcctatggagctgtggaccgaaaattgtatgtggggaatcttcacttcaacatgactgagagtcagctgcgggagttttttcatgcacaacccatgcctactactgttcctactgctccacatccaccagcagtgcgacctagagtgcgggctagaagaggacagactacagatccgcatagtatagctgaaaggttgcacagagagagaatagcagaaagaatcagggctttgcaagaactggtccctagtgtcaacaagtttgacacttatctatggaagttgtga

SEQ ID NO: 75022 - DNA, 460 bp, Glycine max
  Peptide Sequence Number=SeqID_166707
ggcgagggagctgcaaggttcaagcaaggtctcggcttttcctcttcagcaccaaacgaagatgttgcaaaaccctcctcctccttcatctccaaatttgtctaagcctcctccgagtcgaagaaggaagcgcaactccaatccatccacgacaggctcaaggaaaagccttctttcgagtctagggtttcgagcagggatagggacagcaatagaagtagaagatgaagcaggagcagagaaaaatgtaggaaaagaagcaaaagcggtgatagatacagggaaacatgaagacgaaataggagtagagagagacataaggatagtcaaagagggagacggaaattgggagcttctttcatttggtgccgcaaatctaggaccaaaggaaaattgggatattcaattattttccttaattgttatttgtaagttcttacacggagtattaggtttttag

SEQ ID NO: 75023 - DNA, 403 bp, Glycine max
  Peptide Sequence Number=SeqID_166708
atgccacaacaacatatgccaagtctctatgaccgaaccacgaagctggaagagactttagctaaattcatgcaagtgtcaatgtctaaccaaaagagcactgagtctgcaattaagaatctggaagtccagctggctgatgaactggcgctggaaccggttgatgatttagttgaacttgaagaaattgttgaggaagcagaaggtgatgaagaaggagagacaccaataagagactataaagagcaacatttggctagatttcttgatatcttcaagaaactggaaattactttgccatttggagaagcacttcagcaaatgcccctctatgccaaatttttgaaggatatgttaaccaagaagactcggtacatccatagtgacagaattgttgtggaag

SEQ ID NO: 75024 - DNA, 249 bp, Glycine max
  Peptide Sequence Number=SeqID_166709
atgggctcaaaaatctaccctaaggttcatgagaaccctaaggccttctttatcaactctagcccaatcctcttggagcctcttgctcatggctctgggtacatctacttgggtttgactgagaacaagagagggtacatctcttgtggatcagttctagtggagggtacatccactaggttcaaagagaacaagggagggtacatcccttgtggatctttgcttgtaaaaggatttttacaatgctga

SEQ ID NO: 75025 - DNA, 333 bp, Glycine max
  Peptide Sequence Number=SeqID_166710
atggagcgatcagctaactgcagagtcattctggttggcattatctctagctctcccatcctccgacacatagagagcgacatcaaatttatgctggctcctaaatcaataagagccttaccaactgagactgcaccgatcgagcaagccatggttgccatttttccacggtgtcataccctaatttcgtctggggaccatcagttgttgggatgcgaccctcgtttgaccacttcgaggtacttggcacccatcgttagacaattcgtgaagttctgtgacatgccggaagtcaaaagaaagcattgtagcacaatccgtgaagttccgtga

SEQ ID NO: 75026 - DNA, 276 bp, Glycine max
  Peptide Sequence Number=SeqID_166711
atgacagtcactagggttaggaaagagtgtgacgagctaagggatgtcaacatgaccacggccgagcggcagcaacaacgagctcaagctttgaagggccgaaagggacaagtcaagggtggaaaggaagcaagacagagggtgatagaatcattgcccggtgaagctgtgaaatggatggatagattcactctcactctaaatgggagtcaagagcttccaaggttgttagccagagcccaggcaatggcggatgtatactcagctcccaaggaa

SEQ ID NO: 75027 - DNA, 141 bp, Glycine max
  Peptide Sequence Number=SeqID_166712
atggctggtatactcttccttttgaaacagcaaaatagtttagcgattacgagcggaattaatgaagcattgggattgaatctagaattgggcttgggcttgaatccagaatttggcttagacttgaagagggcagactaa

SEQ ID NO: 75028 - DNA, 240 bp, Glycine max
  Peptide Sequence Number=SeqID_166713
gcaggcagagggcgagacaccacaacagcctggggatggctagcaacaggcaacaaatgcaccgccgccacctccagagcccctcagctcatccacaaaaaggttagagtattgcctacgacacatggccgaccaataggtgaccaagtccaaagccaaagtaggacacgcctagttgctcatgatcctaggaatctgaataaaacaagcacaagctcggaaggtagaaagataccttag

SEQ ID NO: 75029 - DNA, 369 bp, Glycine max
  Peptide Sequence Number=SeqID_166714
atgaccggccctttcgatgagtcaatctcttgctttctcataagggtggacccttggggctacacgccctcaccttcagagggctgcacgccctcacattcagaggactacacgtccttgccatcagaggactacatgtcctcgccttcagaggacttcacgtccttaccttcagagggctacacgccttcgccatcagagcgctgcacaccctcaccttcagaggactacacgtcctcgcctacggagaactacacgtcctctccatcagaggactacacgtcctctccatcagaggactacacgtccttgccttcagaggacttcacgtcctcacctttagagggctacacgccttcgccttcatag

SEQ ID NO: 75030 - DNA, 258 bp, Glycine max
  Peptide Sequence Number=SeqID_166715
atggctaccgtagatattactggctcaaacaacaatgacctcaacaaaccttttaggaatagtgggggtacttcatctagtcatcttcctactattagtagtgaaaatcttgcacaaccagaaccagatatcgagcctcgaagaggtaagaaagcaagaattgctaaagagtatgggcccgattatatgacctatacattagaggaggatccatcaaacctccaagaagctttgtcttctttggatgctgacttgtga

SEQ ID NO: 75031 - DNA, 287 bp, Glycine max
  Peptide Sequence Number=SeqID_166716
acttatcaaggtaatccttgtggcgtctacccagacttatcttccttcaccggaagtggcgtctaccctgacttatcttccttcaccggaagtggtgtctacccagacttatcttccttcaccggaagtggcattcgacatcagccaggaaacatgaccgatcgaggtctaaaaaagaagcttcacaagatgatgcggatcgaacttttcctaaccggcatcatgcaaatttcgttcacggattggattgaaaactcaatagccgacatccgtcgtgaagaagcccc

SEQ ID NO: 75032 - DNA, 297 bp, Glycine max
  Peptide Sequence Number=SeqID_166717
atgggtgactcagacaaatgtgggttgtatgtcaatgacaatcctcctcaactgattactcttggaagggtttatgaggggtcgatgaccatccacaatgttcctttgggcaattatcaagtgaaggtcggtgttgaggaagttcgagatgctaatgttcgccttcctgtaccgactcaaaaggataaaaagggagctaagggatcgacgaaacttgtagatatgtcggatcctaacgtcgatcccttgtacctgatgacattgaccatcccacaacttttcctcaagccattgtag

SEQ ID NO: 75033 - DNA, 243 bp, Glycine max
  Peptide Sequence Number=SeqID_166718
atgggggtgcaaatagcacccaggcccacttgggccctccggaatattcctccagaaggctggttgcttctggaggaagcaacccctgctcgcctgggcgagctgggcgggcaaccaccctccccctattttgctataaatagggggaggaagtgtagaaaggaaggggtccagccccctgaggcactttctctctctttcgaatttgcttgggaaaaaattgtttccgtgaaggaaatctaa

SEQ ID NO: 75034 - DNA, 180 bp, Glycine max
  Peptide Sequence Number=SeqID_166719
atgtatgatggaatcatcaaagattttaccttttcgaactctgtctggacggaagaagattatgtaaacaattacccggaatctcacttatcagattccatatctcacttatcagattccattgtggaagacacaatggaatctgacgaattcgccataatatatctgacccatgcataa

SEQ ID NO: 75035 - DNA, 246 bp, Glycine max
  Peptide Sequence Number=SeqID_166720
atgtctcccaatagagtggtttttggtaaggcatgccaccttctggtagagactgcacaccttgcttattgggcagtgaagggttgtaacatggcatttgatgaagcagttgagattaaaaaggaatttactagcaaagtcttcaaagtgaatggtcaccaactcaagctttggtcttgccaagtagaggaatttgtggcaaacctctctttggtcttgccaattttatgtgatgatgtgccttga

SEQ ID NO: 75036 - DNA, 303 bp, Glycine max
  Peptide Sequence Number=SeqID_166721
atggaagaagaaaataaagatgaaatgattattgacgaaaatgaagaaagacttaaatcaaacaaatcaaaaaaaatcaaaaatgctcaaccagaaataaatagtcttgaagatgactacgaagcaattgatcaattggaaaacgaagaattaattcaagaggaaaacgaagacgatattgttgctaattctgacaatgagacatcgtcaaaaccctttgatgccaataataatattgatagtagcgacgatgaaggtatagaaagtcctctcgtggaatctaaccatgatgattttttttaa

SEQ ID NO: 75037 - DNA, 240 bp, Glycine max
  Peptide Sequence Number=SeqID_166722
atggcggaagcaatggactccccgggctatgcagtcgaagagcttggtgttacgagactttctcaagaatggcagtgcgggcaccttttctgccgcaaagacatcacgaaatggattcaagagggggtacgtcttcctcagatcgcgtgcacctacgaaatgtactgcctactgagacgccgagtagaagaagacttgccctacctgccgccgcccaatagcgaagcccgggaccgatga

SEQ ID NO: 75038 - DNA, 996 bp, Glycine max
  Peptide Sequence Number=SeqID_166723
atgcaacaatcattccctgctcctccccaacagcggcaacctcgccagcaaggtttccaatctgagtcatacaatactcgtcccccaggtccaccggagcagcagcctctcagccccgaaccagcgccatactcaccttctcttcgtctggtagaagatcaagactcaccatttaatgccatcacagaagacctccgcaaccgaatcatagactggaaaggacacccactatctgacctgggcccgctccagatgtacgacctcctctctgtccgacgagactcgctcgttcgcgagttttatgtctatcttttcaaagaagccattatatgcgtcgtcgaagagaaaaagcgctctctcggccgtctcctctccaacgcctctggcctgactgactcttcttcagttacatccgccagccattcctccaaaggcgtcctccgtctgaaaggaaggatatatgtcaggcacatcaagaatgtgactgcgactagtgccgctggggagatgagcctgaccattgatatggaagatgagttggcctcgttcattttgattttcaaggataggggatcgatggagtcgtggagggcgaccattcaagggttggtagcgatgttccagcagcagaatcctgcttggatacaacaacaggcggagaaggagaagagagaggagggtgaacgaagggagctggagggcggcgcgggtagtatggggatgggaatggaagagtttggaggagcgataccgcctgggagcaacgcgaaggccttgaggatgttgagcgggagcacagggacaagcgtgagcacagtggacagcctattaaatggaagctcgaggtctacgatgtcgagttcgacgtcgaatgcttcaatgggtggcaatggcaatggcaacggtggtggggatatcacgggaaggatcagaaggccagcctgcagcataaactctccactctcggcgagggacgacgaactcctcccactatga

SEQ ID NO: 75039 - DNA, 225 bp, Glycine max
  Peptide Sequence Number=SeqID_166724
atgtcgcagggtggggggttcaagtgggggcaacccaacaatagggctggggatgtggaggggaggactccccggcgcaccaaaacaagacaacagcgacgagttgggctggtacgcgatggaggccatgaagcaaatgaggagcaagcccgcgtctgccgtttgaactgctgtcgaagaagctgtcgtgtcgcagttgctgaagttgtattgctatttttctaa

SEQ ID NO: 75040 - DNA, 668 bp, Glycine max
  Peptide Sequence Number=SeqID_166725
atgtttagcgcgataaatcgcgccgctacggttgggtgcggtttgcggaatagagcaacaggcacggcacagttgcgcgataaatcgcgccgctacggttgggtgcggcacggttgcgcgatgaatcgcgccgctacggcacggttgcgcgataaatcgcgccgctacggttgggtgcggtttgtggaattgagcagcaggcacagttgcgcgataaatcgcgccgctacggtctctgggatggagcagcaggcacgattgcgcgatgaatcgcgccgctacggtttgccacatccagcctctttccgcgattgtgctggcgtcactctgatattcggcaaacgggctcaaccccgcgccgcgattcgtggaaaggcagtgatggcaacgaaaaaaattgatacccggcttgtcaccgcgggacgcagcaaacgttacactcagggctcggttaacagcgtcattcagcgcgcatcctcactggtttttgactccgtcgcggacaaacaacgcgccaccgccggacgcgccagcggtgaactgttttatggccggcgcggcaccctcacccatttttccttccaggatgcgatgaccgaactggaaggcggcgccggctgcgtgctctatccgtgcggtgcggccgcagtcgccaatgccatcctcgc

SEQ ID NO: 75041 - DNA, 246 bp, Glycine max
  Peptide Sequence Number=SeqID_166726
atgcatgatgcctcatttatggagccacatatccctcaggtcccaaagccaccagcaacaacaccaacacatgctcgctcttatgtggaccagtctagacatgcagtggatgcttgtcatgcgatcactgaaaggttggagcgtctgctcaaccttaggatagtcacggcaggcacagagacacacgaggtcatggaagaatgcatcaggattgccaggggtgtcacaaaagacgacaatgtgtat

SEQ ID NO: 75042 - DNA, 415 bp, Glycine max
  Peptide Sequence Number=SeqID_166727
atctttgattgtggttggtttggcaaaagtgttttctaatctcttgagtgtagaagcaaagcttcatgatgaatcaagattgattcaaagatgttttgatgataacaaagatgatgacaaaggtgatgacaaaaagctcgaagactcaagaggaaagttgaagaacacttcaagattcaagaggaaagttgaattcaagaatcaagaatcaagattcaaggatcaagcttccaagaatcaagatcaagattcaagactcaagattcaagaatcaagagaagacttaaccaagataagtatgaaaaggtgttttcaaaaactaagtagcacatggatttttctcaaaacatgtttaccaaagagtttttactctctggtaatcgattaccagattgttgtaatcgattaccagtag

SEQ ID NO: 75043 - DNA, 599 bp, Glycine max
  Peptide Sequence Number=SeqID_166728
atgggacctctccaaaggcaagccttccgcaaagtgtacggaaagatgctagatttgaccgcagcggaggtatttacggaagctgtcgtatccctcgcccaatactacaaccagccgttgaggtgtttcacgtttggggacttccaaatggtaccgactattgaagagtttgaggaagtattaggatgccctcttggggggagaaaaccgtatcttttctccgggtttcttccctccttgagcaagattgccactgtggttggagattcggcaaaagagttggatcacttgaagcaaactcgcaacggcgtagtaggcctgccacataaatacttggaaggcaaggcaagggatatggcgagccaagagaagtggggcccgtttgcggatatactagctttgttgatttttggggttgtcctctttccgaacgtggacggtttggttgacttggccgccattgacgctttcctcgcgtatcaccatagcaaggagagtccagtggtggctatcttggcagatttgtttgatacctttgaccggagatatgagaaaaacagtgcacggattgtctgttgtttacccgctctctgtgtatg

SEQ ID NO: 75044 - DNA, 762 bp, Glycine max
  Peptide Sequence Number=SeqID_166729
atggggctaacgattgccaacattggcggcgttcctgcggctacctggctgggtgaagtgattggctggcgaatgtcgttcctggcgacggccgggctgggcgtggtcgcgatggtggcgttattcttttctctgccaaaaggcagtgccggtgaacgtcctgacgtgcgcagggagctgtcggtgctgatgcgcccgcaggtgctttccgcactgctgaccaccgtgctgggggcaggcgcgatgtttaccctctacacctatatttcaccggtgctgcatgacatcacccacgcgacgccactctttattaccgcaatgctggtgctgattggcgtgggcttctcaattggcaactatctgggtggtaaatttgccgaccgttccgtgagcgggacgctgaagggcttcttaaccctgctgatcgtcatcatgattgctattccgtggctggcacgtaatgagtttggggcggccgttgcgatggtcgtctggggtgctgccacctttgcggtggtaccaccgctgcagatgcgcgtgatgcgcgtcgcccatgaagcgccgggcctttcatcctcagtcaatattggtgccttcaacctgggcaatgcgctgggggcggcagccggaggggcggtgatttcaggtgggctgggctacagctttgtgccggtgatgggggcgattattgccgcgctcggcctgctgctggtgatgatgtcgggtcgtaaacagccagaagcagcctgcgctgcagagtaa

SEQ ID NO: 75045 - DNA, 246 bp, Glycine max
  Peptide Sequence Number=SeqID_166730
atgaccaaacttggtctctgcttgtcatcgggcccgccgcctctggatgacaaaagggtgcggataaccgtaaggtatctccgcgtatcatcgggcccgccgcctctggatgatacaagggtgcagaatgaccaacttggtcttgagggtcagtatgacaaagattatggggcgaccgacaaaagcaaggctcttgctcttacgtatcctccaatgaggaattcagacctacgtagttctgggtaa

SEQ ID NO: 75046 - DNA, 207 bp, Glycine max
  Peptide Sequence Number=SeqID_166731
atggcatacctattgtcaatccatattggacttacggattcacaatctatatcagctttacagaagggtttaccagcactatatatgatgcaatcctaccccccaagggcattggatagaagacttcaagaagattgggccaaagatgcaagagaaagccctagggttctcatgagccttagggtagatttcaggcccatgggctaa

SEQ ID NO: 75047 - DNA, 222 bp, Glycine max
  Peptide Sequence Number=SeqID_166732
atggaaatgccacactctcaaccagtgacttcaagtttagaacaggagaatctcacactgtctccacaccagccacatgggaaggcaaaatctggggctgcactcgttgttccatcaactcagccattggaagtttctcatgtgttactgcaaaaaagacaaatcgccacaggtggccatgacggtgatgatcaatgtaagcaacaacatgggcggatgtga

SEQ ID NO: 75048 - DNA, 123 bp, Glycine max
  Peptide Sequence Number=SeqID_166733
atggaccttgagattgatgttgtcaatgaggttgaaggtggagacaacttagacagggtttgggaaaggtgggatggagggaggtacgcaatcaaagaggggaatggatttaaaaatttctaa

SEQ ID NO: 75049 - DNA, 681 bp, Glycine max
  Peptide Sequence Number=SeqID_166734
atgtgtgctccttctgaaaaggtcaaaacaaaaggagctcaaaagaaacagatcaccaaacaacaaagatcaatgaagcatgatccatcttactgggagtatgtagatgcattacattttgtgcaaaatagcaatttttcagtgaaacgttgtgcatcatcatctgaacaaccaaaatcaaagaggaagataccaatgttggatcaatttcatccatgcattcatcatttcattgaaaacattgtcgatgtcaaagttgatggtatgggtgaagattcatggtctttggttcgtcaccatttgctgaaagaacttgcacaatggtctgatgagtatatacacctgcttggtggcatagacatatatgaggagttaaagcagtcggtacttgttgatggattatccatggttaccatggataagtggatgaatattaccgatatagtttatgtgattgcatcaagtgaagatcgacctcgaaccctagctagtgaccttgcatgtgttcttcttccgttcatcgtctttgaagaatccctcgaagtgaagccttcaccgttccattcaatctctgtgaaggaatgccataaaagttcatctgtgaagtctccgtgtaatgcaggatatgtcctgcattccgtccaatgccccaggcaaaggctaaaaaattgcaaaccctag

SEQ ID NO: 75050 - DNA, 918 bp, Glycine max
  Peptide Sequence Number=SeqID_166735
atggaagaagaaaatgaacgcaggctacagatatttaaacatgagttgaaggaacaaatcatacatgagatgtcacgaaggggatcacccgtcttagctcctattcagccagatatacaattattaggtgcaagagtcagcacaaaggggagcaatgcggaggttgttgtcaacccatctccgccagattatgttggtcctgtcaagccgactatggggttgtatgtccataggcaactttgtacagagttggtggccttgggaaaaacatatgacggaggctctaccatacacggtgtggcttatgcagatgatgtcgtcaagcttacaagcagtactccaaataaagacaatgaaccttttgaaccagtcaatgatgttcctgtagaggacccgttgcgcgagttgattaagagcctagttgacatttatgagaagcctgtagagttcgtgtgggatcctgctaaatttggaattccaaatggagttgcatcgttgtttgttacctgtgctgatgtcaacaaaatcatatcaggcgtacaatgtttgaacataactatactacagttgtggaccatgggccattgtcagctcattgttttgtgtccagcagagaaccatgttgtgtggttttgttctttgcgtagaaagccagatgttcatataaaatctgcaattaacactgcatttaagacattaaattcaacttctgaggggaaatttgatcaaactacaccaaggtggctagaaattaagagtcacgttcaaagcggaggctatgagtgtggctattatgtcatgcattggatgtggaacataatcggcggggaggtgaagactgattggatgatgtggttcggtgatggcacgacacacgacatcgagattatcacatcattacggaagaaatgggcttaa

SEQ ID NO: 75051 - DNA, 396 bp, Glycine max
  Peptide Sequence Number=SeqID_166736
atgggctcaaaaatctaccctaaggttcatgagaaccctaaggccttctttatcaactctagcccaatcctcttggagcatcttgctcatggctctggtaactggtcctttcctaaggaggattgcatcagcttctctgttatggtgtccaacataggtttccaaggctgcactttagaagggcttttccctccaatattcatcataccaacaccatactgctctgccaccccaactctaccaagactcctggagggtgaattccaaaatgtttgggtttggcttgacaaaggacctgattttgctattgcagtgagtctctctgcaaggcaagccaggtccaccggggaaacatctgcatgtagtaccgagtatggtagcatgaaatacacttga

SEQ ID NO: 75052 - DNA, 663 bp, Glycine max
  Peptide Sequence Number=SeqID_166737
atgaggtcctgggtgaggggtcagtggatcccgttcgatgcagatgctatcggccagctcctgggatatccgttagtgctagaagagggtcaggagtgcgagtatggccagaggaggaaccggtccgatgggttcgatgaggaggccatcgcccagttgctatgtataccggggcaggattttgcccggactgctgccgggagacgggtgcggatcatgcgcaccaacatgaccaccctgactcagatatggatgactttgctgctcagcaacatcctgcccagcgatcataattccaacctccccctgccgaagtgtatggcacctaccaggcaccctctggacccggataagtccaacagggccctgggatttcccgccttgatcacaggactctgccagtcgttcggcgtccccgtcgcacctagcaagagacaggtccagggtgatgcaccacaggccgcggacgcgccgccacctcatcaggctggtccagtcggatcgtttgatacggagcagtatttgcggcatttggttcgccagcaggcggccaaccaccgggctcatgtacaaccaccggatctttctaaatcagttgtctttaacttttacaaaataagctacccatttgttgcgaattgttgttatggtctccatgtctaa

SEQ ID NO: 75053 - DNA, 642 bp, Glycine max
  Peptide Sequence Number=SeqID_166738
atggcgaagaggaagaggaaagggtggtggagatttgtgtccctgaccgtggtgacacacacaatagaaagggagaagcagatgttgaagggaaggattccgcggggctttgtgtgggaccggttacttgcggccgggagggggtcggaggagagtgtgtggtgcttattaacgggaaggtgggaagttgccataggaagtggaggcggcatggtttctgctattggtggtggcttagcagaggaagaagatgtgttggttatcttgggaagcagaggcggcatgggtggtgactttgcaaaggcaaaagatggagagggttgtctgggtaccatggtattcaatatccaaataatggcatcaagtttggaagccatggaagtttgggctgcagcagtggaagtttgggctacagcgagtttggccatggtggcctcgagacgatctacacaggcggcggaaagttcggtgtccgccattgaagaccagcaggtcagaccaaatgttaggttgctcgcccttgtattcgagatcaagggaatctccattaaacaaagaaagcaagaaagcgagaaggaaagaatagtgaatatatttctgcctgttttattcaatacaaagggaattatttatagccaatga

SEQ ID NO: 75054 - DNA, 1062 bp, Glycine max
  Peptide Sequence Number=SeqID_166739
atggtgtggtgtctcctctcaactcttcttcttctctatttcgctgccattaaaattcaagaagcaaatgactcaattgatgaagaagatccaagaccttcaagctccaatggagctacatcattatgtggggagaatttagagctcaagagggggagggagattcatgggatggtgataactaatgggtttcggtccagtttgtttgccatgacatctgtggtgaatttgtattccaagtgtaggcagatcgaggatgcgtgcaagatgtttgagagaataccgcaaagggactcagtttcgtggaacacggtggtgatgcaggaggctggccagaagtcggattccatcacattggtcagtgttttgcctgctgttgcagatgtgaaggctttgaggatcggaaggtctattcacaattatgctttcagtgttgggtttgaatctatggctaatgttgcaacagcgatgctggatatgtactttaaatgtgggtctgtcaggaatgcgaggttcatgtttaaggggatgagtagctgtagcagaaatgttgtttcttggaatacgatgatcaatggctatgagcaaaatggcgaatctgaggaagcatttgcaacatttttgaagatgttggatgaaggggtggaaccaacaaatgtgatcttgaatgagggagtaatgaattctataatatccacgtattcaaagtgtatgatggttaacattgcggcctcagtgttccataatttaaaacaggaaacaaccgtcacatggattgccatgatattaggttatgcacataatggatgtgtaaatgaagctttaaatctattctgtgagatgcaatctcatgacatcaaacctgattccttcacattagtgagcgtaattattgctcttgcggatttatcagtcacccgccaagctaggtggattcatggacttgctataagaactttgatggacaagaatgtctttgtctgcgcagcactcattgatacatatgcaaaatgcggagccattcaaactgcaagaaagctttttggcatgatgcaagaatga

SEQ ID NO: 75055 - DNA, 321 bp, Glycine max
  Peptide Sequence Number=SeqID_166740
atggtgaagtgcaaatgtgaggtatctgctattatgttcacgtcgcatagtgtgaaccatccggggagaaggttttggagatgcccacactggaatgaatcaagttcttacagattttttcaatggattgatgatactgaggctgacaataatgtgtctgcaaaagggagtgagttggtccggtatgttcaggaaaatgaagagctgaagctgaaaattgcttcattaatggaggaagctaaggcaaatgcagaagaaataacagtcttgtgggaaaaaaattgttgcacaagaggaagaatgtcatgcaccctcagttga

SEQ ID NO: 75056 - DNA, 285 bp, Glycine max
  Peptide Sequence Number=SeqID_166741
atgggatataattccatgaggaacaaacttatttatttcctcttgatgcaacctacccttttacgggcgagcgaggcggggctcacgggtgcgtcttccaaagaaggaaaatgcgcggagtcgccaccaaggtttatttgtggaaaacgtcagaaaaaccaaaggaaaccggtcatgaagaatattccagattcgggagttgtatttacgtttgaggaaggtcgacaaaagcgaggctcttgctcccacgtaccctccatcgaagaggaaaccggacctacgtag

SEQ ID NO: 75057 - DNA, 498 bp, Glycine max
  Peptide Sequence Number=SeqID_166742
atgaagctttgcttctacatccgcgtgctaccggacccttgggtcacgatagcgaaattgagactttttcatggtctcggccagaagacgttgacatctccagaaatggtgcagatgaccatattggtctctgtgtgtcaacaggctcatttgcctctagctgatgaaagacccttgggtcacgatagcaaaatgagactttttcgcggtgtcgaccggaagacgctgacatctctggaaagggtgcatatgaccacattggtctctgcatgtcaatcggacttggggtcttcgaatgacaaggtgtttctgcgtgccatcagactcacaggtcacgatagcaaaatgtgtgcgcagataaccatcgggtgtctttgcgtgccaccggattcacaggtcacgatagcagaaggtggggtgattgacaaaaacggggtttttgctcctacgtatcctcaatttgtgatgaggaactcagacctacgtagttcttgctaa

SEQ ID NO: 75058 - DNA, 147 bp, Glycine max
  Peptide Sequence Number=SeqID_166743
atgtctcggaactttacggattccatcgtgatgagtgttaagccttctaaatttctccccgaaacatcctggaactttacggattccaccgcgatggatgttaaaaattttgaggtggtcaaacgaaggtcacatgccgataaataa

SEQ ID NO: 75059 - DNA, 375 bp, Glycine max
  Peptide Sequence Number=SeqID_166744
ggaggcaagtgtcctcaaaatgatgagattgtggagctagatataaggagtggagctcgtgtgccagatcgttgtcgttcaatacctagtgcagcgaaacccaacaatgacaaaggaaggacaatcctagtagggagggttgttgaggagtcaatcctcagaagtcacagagccagcttggcaacccttactgattatgagcaattatctgttggtgagagtctgacattgcaccatggtgaaaagtcattttgtgtggatgcaccatatgagttaaaggagatggaaaagagaggccatgacaagtgctatcgatgtggatggacgtttcaagagaaagaaaaggagtcttccaaagatgccttgtgggtttaa

SEQ ID NO: 75060 - DNA, 117 bp, Glycine max
  Peptide Sequence Number=SeqID_166745
atgatgaatatcatggttaggaccagaggattaggtcgtgccttaggtcacgttactggcagaggtgtgggcagaggagatcgtgatgatttcgattatgctccgcagcatcgatga

SEQ ID NO: 75061 - DNA, 204 bp, Glycine max
  Peptide Sequence Number=SeqID_166746
atgatgcctatgatgaagttaggttgtggtgccgagttgtggctgtgtgacctacgagttaggcgcggtgaaggtgaaggtgcgttgcggtggtcggcgacgacaaacgaggtacgcagaaggtggtggctgtgtcacaaacgtacagattacttatggatcaagttgatccataagtcacttatagatcaacttgatccgtaa

SEQ ID NO: 75062 - DNA, 449 bp, Glycine max
  Peptide Sequence Number=SeqID_166747
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccaggcgtttccccctggcggctccctcgtgcgctctcctgttcctgcctttcggtttaccggtgtcattccgctgttatggccgcgtttgtctcattccacgcctggacactcagttcccgg

SEQ ID NO: 75063 - DNA, 264 bp, Glycine max
  Peptide Sequence Number=SeqID_166748
atggcatatcaacttgctacttcaagaaaaattacagtaattaaaatgatatgggtcccaaaaggatcctcagtttatactaacatgcaaggacccaataaaatttgggtatctttgagaaagaagtggtacatagatagcggatgctcaaaacatatgactggagatgcatcaaattttacacacatatctccaaagaaaagcgggcatgccttaagcacagcctgcttagcgttagtcaactatgtgacaaaggctatctag

SEQ ID NO: 75064 - DNA, 475 bp, Glycine max
  Peptide Sequence Number=SeqID_166749
aatccgggctagaagcgacgcgtgcgcccgccgtccgtttgcgggaccagcagtagggggcctcggccccccaaaggcacgtgccgttatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacgggggcggagatttcctggaagatgccaggaagatacttaacagggaagtgagaggccgcggcaaagccgtttttccatag

SEQ ID NO: 75065 - DNA, 1143 bp, Glycine max
  Peptide Sequence Number=SeqID_166750
atggcgaccaactacgctgacgccgcacgagccattgtggcctcgctcggcggattagagaatattgaagccgttacccactgcatgacacgcctgcgcttcgtggtgaaagacagcgcgcgcgtcgacaacgccacactgaaagccattcccggcgtgatgggcgtggtgcacaccgacagtcagtgtcaggtgatcatcggcaacaacgtcaatctcgcctttcaggaagtgatgaaactcggcacgccgggcaacagcggcagcgcgccggtgaaacgtaaaatcacgctgcgcagtatcggcgcgggcattctcgatgcgctggtcggcaccatgtcaccgctgatcccggcgatcattggcggatcgatggtgaaactgctggcgatgatgctggagatgagcggcgtgctgcccaaaggctcgtcgacgctgatcatcctgaatgtgattggtgatggcgccttcttcttcctgccggtgatggtggcggcttcggcagcgctgaaatttaaaaccaatatgtcgctggcgattgccattgccggcgtgctggtgcatcccaattttatcgacctgatggccaaagcggcgcagggtcaggtggtggaattcgcctcagtgccggtcaccgcggtgaaatacacctacacggtgatccccgcgctggtgatgacgtggattctgtcgcacatcgaatactgggtcgatcgctttaccccggcggtaaccaaaaacttccttaaaccgatgctgattgtgctgattgcagcccccatcgccatcgtctttattggcccgctcggtatctggatcggtagcggcatttcggcgctggtgtacaccattcacggttatctcggctggctgtcggtggcgatcatgggcgggctgtggccgctgctggtgatgaccggcatgcatcgtgtgtttaccccgaccattattcagaccatcgctgagaccggcaaagaaggcatggtaatgccgtcggaaattggtgccaacctgtcactgggcggctcatcgctggcggtggcgttcaaaaccaaaaatccggaactgcggcagacggcgttcgcggcggcagcttccgccatcgtcgccggcatttccgaaccggcgctgtacggcgtggcg

SEQ ID NO: 75066 - DNA, 653 bp, Glycine max
  Peptide Sequence Number=SeqID_166751
ttggaacctctacgtgccgatcaacgtctcattttcgccaaaagttggcccagggcttcccgctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttggggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacaggga

SEQ ID NO: 75067 - DNA, 960 bp, Glycine max
  Peptide Sequence Number=SeqID_166752
atgggtgaagtagaggaggtgcaagagcagatgaaggccaacatggaggccataaaagagcaaatggtcacaatgatggaggccatgatgagcatgaagaagataatggaagccaatgcgattgcagttgccgctaccagcgctgttgctaaggtgaacccgatgcccccatctggcctcaaccaagtgaatcatccaacctcagatatggtagacaaagattcgggaagtacgagcagcccccattatatgaaaattcaaaacaagcacgccttcccgtcatatggcttgcctcccaactatacaccacccaatgtgacgtacactcccagtgagattgtcaataactccactcccatactcattgagagccaacaacatcaatctgatcatgcacgtgtctctcaaaccatgggggagatgcatgaaattccccaccacaatctagctgacttcgagccttgcctcggatatgccactgaagggcaagcagttggtggtatacccctgcaaaacaatttggaggggcctcaatttcgcccccaaccacaacccttatatggaaaaatagtgggttacacaccttcaagctttgcggatttggtcttcgccggtgaaaggatcaaagtgggtcaagaaagaggcaaatctgatcatcttgctttgatgaatgcgaaaactggggcaaatgaagagggtgagaatgaaggagaaacccatgttgcgactgtcgttcctacatggaaaatcccccaccagctcaacaacaacattactcaaccaatatcagcccttctcataccaaccacccaatcatccataaaggccatccctaaatcaaccacaaagcttgtctaccgcacgcccaatgcccaaacaccacctttagcgaaaaccaaaaaggaattttgcaggaaaaagcatgtaggattcaccccaaattccggtgtcatatgctaa

SEQ ID NO: 75068 - DNA, 174 bp, Glycine max
  Peptide Sequence Number=SeqID_166753
atggcttacgaacggggcggagatttcctggaagatgccaggaagatacttaacagggaagcgtttccccctggcggctccctcgtgcgctctcctgttcctgctttcggtttaccggtgtcattccgctgtatggccgcgttgtctcattccacgcctgacactcagttccgg

SEQ ID NO: 75069 - DNA, 189 bp, Glycine max
  Peptide Sequence Number=SeqID_166754
atgaccaagagcaagggcaaggatccacttgaaggacttggaggacctatgacaagggctagagcaaggaaaaccaaggtagctcttcaacaagtgttgtctatactatttgaatacaagcccaagtttcaaggacaaaagtcaaaggttgcatcagccttttgggagaccaaatggtggctgacttga

SEQ ID NO: 75070 - DNA, 99 bp, Glycine max
  Peptide Sequence Number=SeqID_166755
atgcatctaggatacacaaccactaacagggttgagagtgctcattggtcattaaagagactccgacaaaactctattggtgacatatgcagtgtttga

SEQ ID NO: 75071 - DNA, 156 bp, Glycine max
  Peptide Sequence Number=SeqID_166756
atggcaggacatggtagggatcagaaccgtgatgtggagccggcggagtatcggggactcatggctttccgtaagaaccacccgccaaagttcagtggagactatgatctggaaggtgccaggtatctccgcctgccacctgacttcatgggttag

SEQ ID NO: 75072 - DNA, 306 bp, Glycine max
  Peptide Sequence Number=SeqID_166757
atgtcatctattgtttactgggatcgcgcccgcaaaacacctagtggacccggagaagtccaacagggtcctggggtttctagctctgattacgagcctttggatcacacccgcaaaacacccagtggacccggagaagtccaacaggggcttgggcgctcgtctcccctaacaaggtcattaggccccccattaaccgggctttcatcaagaagtactgcaccccctgacaagcacagggcgagacaccacagcagcctggggatggccggcagcgggcaacagacgcaccgccaccacctctaa

SEQ ID NO: 75073 - DNA, 295 bp, Glycine max
  Peptide Sequence Number=SeqID_166758
agggctacacgctcttgccttcagaggactacacgtcctcaccttcagagggctgcacgccctcgcctttagagggttgcacaccctcaccttcagaggactacacgtccttaccttcagaggactacacgtcctcaccttcagaggactacacgtcctcgtctttagagggctacacgccctcaccttcagaggactacacgtcctcacctttagagggttgcatgtcctcgcctttaaagggctgcacaccctctcctttagtgggctggacgccctcaccttcaaagggtga

SEQ ID NO: 75074 - DNA, 135 bp, Glycine max
  Peptide Sequence Number=SeqID_166759
atgtcccatgctgtcaaggacaatcgagggaagtgggccctgaactacgaagggcctttcgttgtgaaaagggcttttaccggaggagccctgggattcctcgtctactatatatctctcgtcacaatcttttaa

SEQ ID NO: 75075 - DNA, 399 bp, Glycine max
  Peptide Sequence Number=SeqID_166760
atggagtgcctagagggagtttgggagaccctcgaaggaaatgcgaggtgtcgattccgtggcatgattcgactcacggctacttcattggtacatccaggggaacccgcacgcacgcttcagcgcacattggagtggatattacctacacctactccatatcgactagtggagcccgtccaagtgatagaggtgtcatcatctgaagaagaccctgaggaggacccagaggtgttacctcctgagcctactgtggatgccattgactttccagagggtgatgaggacccacttcctgatgtggattctccagaggacgtcatgtcagcatcagaggcaaactctacggaggagagcggccctggagggatagtgactagtggagactcttcctcataa

SEQ ID NO: 75076 - DNA, 519 bp, Glycine max
  Peptide Sequence Number=SeqID_166761
atggtagcccgggtgatgttggggaatggttacgagcccagaatgggtttaggaaagaacaacggcagtagaaccagcctgataagcaccagaggaaaccgtgggaagtttgggttaggctataaacccacacaggcggacataagaaaaagtgttgtgggaaggaagagcggaagccaaggctcgcaattgggacgaaaagtcgaagggggcccgccctgccacatcagtaggagctttataagcgcgggtctaggacacgaaggccaagtcgttgcgatatgcgaagatgattctccaagtagatccaatgacgagtccctcgaaggtaataatacctgggacccatccatcgatttcaagcaagaaacagatcagacgaagggtgaagaggacgaagatgtgggacttcccccggaggtggagaagatagtcgcccatgaggaccaagagatggggcctcatcaagaagagacaacactagtggacttaggacacagcagtggggaaaggaagtaa

SEQ ID NO: 75077 - DNA, 249 bp, Glycine max
  Peptide Sequence Number=SeqID_166762
atgagagaaataaatggagataagcaagcgagaggcacgaacatcggagcgttgggattcaagctcgaagcggaaatcacttccatggaagcaaacaggataaggattaggaataatgtttgtgcttatccactccctgttgggtggataaccctggacacggttttctcagattcagcttatgggttagctattgggtatgggcctagaaggctagacttcacaacaattccattatttcattgttga

SEQ ID NO: 75078 - DNA, 646 bp, Glycine max
  Peptide Sequence Number=SeqID_166763
atgggatcaagtcaaaagccttcgcttaaaaagaggttctatcaagtcaaaatcaagagcttagaggtcactagtttacgagagttggggcaattaatgggtcaacttcaatggcaagccttccgcaaagcctatggtaagatttgggacctagctagggtagaagtctccatggaaccgattgcatccctttcccagtattatgaccagcccctaaggtgcttcacatttgaggacttccagctagtgccgactgtggaagagtttgaagaaatcctgggatgcccactgggaggaaggaagccatatcttttctttgggttttatccctccacgacaagagttgccaaggtagtgaaaatctcagcacaagagttggaccgtgtaaagcaaaacagaaatggagtagtcggagtaccaaggaagtttgtcctctttccgaatatggaagggttagtggacctagcagtgattgacgctttcctcgcctttcatcatggcaaggaaagcccggtcgtcgccattttggccatgtatgacacgttcgaccggggatgcccgtctatccgctacaaggtcaccgctcgtgcgtcgaaaaaggaaaggcgaattgggaccaactcttggctagcatggaggggcgtct

SEQ ID NO: 75079 - DNA, 405 bp, Glycine max
  Peptide Sequence Number=SeqID_166764
atgatactcggagataccttacggttattcgcacccttgtgtcatccagagtcgtcgggcccgatgatacgcggagataccttatggttattcgcacccttttgtcatccagaggcggcgggcccgatgacaagcagagaccaagtttggtcattctgcacccttgtatcatccagaggcggcgggcccgatgatacacggagatacttacggttatccgcacccttttgtcatccagaggcggcgggcccgatgacaagcagagaccaaatttggtcattctgcacccttgtatcatccagaggcggcgggcccgatgatacgcggaaatacccgagtggttatccgtataaacattcttttgctatctgtaagacagaacgcttgatagcatgcagaggctga

SEQ ID NO: 75080 - DNA, 159 bp, Glycine max
  Peptide Sequence Number=SeqID_166765
atgtcattgcctagcgttgttcatgtgtctccattatcaagtgcgaagcttctgaagaaaaaagaagaagtagagatgagagtcgtcatcacggaagaggcaaggcagacgaaatcagtgtcctatctttgctttcctcttatctccgatgagaggtaa

SEQ ID NO: 75081 - DNA, 903 bp, Glycine max
  Peptide Sequence Number=SeqID_166766
atgaagttcggcaatcaagaattgccagtacttacaaatgagtttcactaccctggtggagaagctgttaatgacgaatgcaattatctaattgacaatatttggaatattccaaaaaatacaaataataatgaacagtttgtctgttcagtaaaaaagggcacaatttgtgctctatacaatttctgcataacagataaccaaggagtttcttttcttacaaaagcctctccttctagaaaaggctatacagcttttgtcctattatcaggacctcataaaggtgtttataccaacttcaaagacctttgtcttgcaaaggaggaaattcaaaacccaatctataaaggtttctattcaagagaggaagtagaaaaagtccttgaattgaataccacatacatcaataagataaaaatgtctcttgaaccagaaaacccaacaatagtgataaacactggccaaaccaagactagccaaaaaacctataaagactcagttagcccaaatatcccaggctcaataaatgacctaaacttagacaattttaagaaaatacagaccttattatttaagatacacaataaccaaacccaaattccgggactctacataggcgtacatgcttattttaaccagaagtttgtctgcatcaataaaactccatactgccaagacaaaaccaattgccattgcaaaataaaattcctctctagaaaggccagactagatatggatcagtttaagtctttcggatatgaagacttagcaatttctgcaaagagtctattggactatggatgtttggaatcaatcctgattcctccatctgatagattcgagggatttaattcctcaatcaatgaggccataaatttaatccaggcagaaatgatggactaa

SEQ ID NO: 75082 - DNA, 300 bp, Glycine max
  Peptide Sequence Number=SeqID_166767
atgggagctggccatgcccgaagtcgttaccttaaccgcaaggagggggatgccgaaggcagggctagtgactggagtgaagtcgtaacaagggctctcagccacatggatagtttaatgtgctcatcggcgcctgaccctgagatgtggatcatccaaggcacattagcatggcgtacttctcctttatctctcgagcacaggtttaggtttggcctcaatggaaaaaacggagcacctaacaacgtatcttcacagaccaagaactacgagatcgcccctttcattcctggggtgacg

SEQ ID NO: 75083 - DNA, 264 bp, Glycine max
  Peptide Sequence Number=SeqID_166768
atggaaatatcctctttccatcagttccccgacaaatcactcagtgaggcactcaaccatttccacggactactcagaaagatgcctacaaatgggtacaggggatgccacatctacggtgaagcatatgagctagggcaatgtatacctcaagaagattcttccatggaggtgaactacataggagctcagaatcaccacagattccaaggctacaaccaaggaagaccgccaagattcaaccaagggaggaatttcacatag

SEQ ID NO: 75084 - DNA, 540 bp, Glycine max
  Peptide Sequence Number=SeqID_166769
atggcgccatttacatgtgcatgcggcaaatacaataaggaagttgtgcttagctggtataggcttgaggtgatgatcaaccagggaaatgaaagcacaaaattcctgctttgggaccgtgaatgcagtgaattaattggtcaatcagctgatgaagttaataagcttaaaattgaagatggtgatgttgatttgaatgcttcaccccaagtacttgataagctgctgggttatgaatttgctttcaacataaaggtgcaacccaagttcaggaattctgctgttttgaagtgttcagctgactcgagcttaataaatgttgtgatggatatgctagctgatgctgagacatcttcaaaaatgaatatcccggtttctgattccaatcattctgctcaacatgaatctcaatccctgtctgtgacagcagaccatgatccactgcttggaggctccccttgtgatgatgaagcagggacctctcaaatttcacctgcacagctttcatccaaaaaattaaaaaaacatggtgcaatttag

SEQ ID NO: 75085 - DNA, 791 bp, Glycine max
  Peptide Sequence Number=SeqID_166770
gtttctattcaacgggcgtggttattggcaagaacttattgaatccattgtttgggctcataataaattaaaagttgctcatgctactcagcctagagccttgagcattgtacaaggacgtgctgtaggagtaacacattaccttctaggcttagctcaagaccccactactcgtcgtatttggtttggtattgctaccgcacatgacttcgaaagtcatgatgatattactgaggaacgtctttatcagaatatttttgcttctcatttcgggcaattagcaataatttttctgtggacttccgggaatctgtttcatgtagcttggcaagggaattttgaagcatgggtacaggatcctttacatgtaagacctatagctcatgcaatttgggatcctcattttggtcaaccggctgtagaagcttttactcgaggaggtgctctaggcccagttaatatagcctattctgggcatttagtccatgtcgctattccgggatccaggggggaatacgttcgatggaataatttattaagtatattgcctcaccccgaaggattaggtccatttttcacaggaactgctattctaacacttctcgggggatttcatccgcaaactcaaagtttatggctgaccgatattgcacaccatcatttagctattgcatttctttttctagttgctggccatatgtatagaaccaacttcgggattggtcacagtataaaagatcttttagaagcacatactcctccggggggtagattggggcgtggacataagg

SEQ ID NO: 75086 - DNA, 147 bp, Glycine max
  Peptide Sequence Number=SeqID_166771
atggagtcgtcatctgtcgcaacctacactacgacggaagtgcgagcgaaaagccaaagtgcatcttctcatgaagaaaacgcgtggagtcgccaccaacgtttattgaaaggaaacggtgttgtccttactcctacgtatcctcag

SEQ ID NO: 75087 - DNA, 678 bp, Glycine max
  Peptide Sequence Number=SeqID_166772
atgttgataatcatttatccatataaggagaaggtgaacctggctgctagttatgggcagatgctggaagatgaacatgtaaaggtatcagttctacagattgaaagggaagcgagagagagggtgatagagttattgcaccgggaagccatgaaatggatgaatatattcgctcacactctaaatgagagtcaagagcttccgaggttgttagctagagccaaggcagtggctgacactcattgtcatcataaaaaagtaaccatagtaaccaaaaagaacgaatgcgctctacggcaccattaccaaacacgtgccaaggctaaaatcatgagcgagatagaggaagttcaggaacacatgaaagccgatatggaggccattaaagaccaaatgactaccatgataagcatgaggaaaatgatagaggtcaacacagagctagtcgccactacaagtgtcgctactgaggtagacctgactcacccatctagtgtgaatcaagggggcgaagtattgggaagtacgggcgacccccattttgtgcaggtccagagcaagcattcgttccgaccgtatggccagcctcccaactgtgcaccgcctaatgttgtacatgcgcccgatgagaacatcaaccactctgcccttataccccttgagagccaacaaccttag

SEQ ID NO: 75088 - DNA, 978 bp, Glycine max
  Peptide Sequence Number=SeqID_166773
atgggaacaaggggctgtattaattataatcccatcctcgccataagacagcttggataccccatgagaggagcgccatcgaaggaaagcatcacgcctttcatcgcacggggtttcagtgaccccaacacaagggtacttcaaggagttcgcaaggcatgggatacggtgcgaaggaaggacaaagagcttaggggaagcagtaatgggatcatcggtggctatcataaggggatgagagttcggacacaaggattggattggctcccaaagctaaaggctgtgagagacgaagaggctgaagctctagaagaaagtgaggaggtacaagccctaaaggcggagcttgaaagagcccgggtagtcaaagagaagttcaagtcaatagccatcaaagtccaaagagagtacgatgaactaagggatgtcaatatggccaccgccaaagccttggaacgagaaaccaagagggcccgaaaggaagaacacgaccgaaacaagttccaaggggctttattcgatagcaacagtgagctcaagctccgaagagatgaaagggatcagtcgcaggtcaaaggcatgatcttgaaggacgagttaaaggattgccttaggtcgaaaagaaatttgtcccaacagttaagcgagactgaagggaatatgtgggccatcatcgatgaatacaaagagaagctaaacctagcagtgactcacgagcaaaggctagaggatgagtacgccaagcaatcagcggaaagggaagcaatggaaagggtaatcgattcattgcacagaaaggcaatgatgtggatggacagattcatctttactctgaatagaagtcaagagcttccccgactgctagctaaggccaaagcaatggtagatgtgtactcagcccccaaagaaattcatgggctcctcagctattgccagcacatgagcaacctaatagctcacataattaggagttgttaa

SEQ ID NO: 75089 - DNA, 360 bp, Glycine max
  Peptide Sequence Number=SeqID_166774
atgggatcaaatcaaactcctctgcttaaaaaaaggttctatcaagtcaaaatcaagagcttagaggttgccagtttgcgagaattggggcaattgatgggtcagcttcaacgacaagccttccccaagaattatggtaagatttgggacctagctacggtagaagtctccgtggaagcaattgcatcccttacccagtattatgatcagcccctaaggtgcttcacattcgagaatttccaactagtaccgactgtggaagagtttgaagaaatcctgggatgtccactgggggagggggaaggaagccatatcttttctcgggtttctatccctccatgcccagagttgccaaggtag

SEQ ID NO: 75090 - DNA, 204 bp, Glycine max
  Peptide Sequence Number=SeqID_166775
atggcgactcctcgcgttttccttggaagacgcacccgtgagcctcgagtcgccctcctgccgaaggaagatgaccatatcaaacaaggattgacacaagatgttccccttcgcactgcatggttatcgaacttctatatgcacatctactggggcaaccccgttctctttggtgtatgggatggaagttgtgctcctgtttga

SEQ ID NO: 75091 - DNA, 453 bp, Glycine max
  Peptide Sequence Number=SeqID_166776
atggtcttgcggcaagcaacacagctcgtggcaatcaccgatggttggtggcggtggaggaggagattgggggtgttgggtgagggtttggggaagaagatggaagcaaaatggttgttttacgctattggacgtatttgtggtttgcaaaactcactcaagaaaagtgttgctcgcataggcgagctaatccaactaagacttgcttgggcaaaattttgctcgcctagcaaaattctactccaacaagctttactacttcgtggtcttgcgacaagtaaccacaactcgtggcagtcaccgatggtcggtggcggtggaggaggaggttgggggtgttgggtgagggtttggggaagaagatggaagcaaaatggttttttaatgctgctggatgaatttgtggtctacaagactcactcaggaaaagtgttgctcgcatgggcaagctga

SEQ ID NO: 75092 - DNA, 819 bp, Glycine max
  Peptide Sequence Number=SeqID_166777
atgttaaaaaggggctcctttgtttcagtccgtacgacgccgccacaaaccaagcttcttcctccttcatctgtgtctgttctctaccatgttgtcgtcatcctcagcttccattgctgccgttcaggccatctccaccaccgttgtgtcatttccatcgtcgagattatggttagaactaaaggtttggatcaggctttagacaggattataggaagagccatagggagaaaggataatcgtgattcaaatgaagctctccagcgacgaaggcccatagcatttacacgtaggcaacgggaagttgtccctgttgctgaggatgttcatcatgtggatgacgcagctgacgaggaacatcctaaattgaagctatcctcctatggaaggaaggttcagaaattcaggaggcctgctgcaaagattgaagggttaattgtttccacaggattaagtcctctgatcgcatgttccttggacactggcaatcgaggacttatattgacttttgcagagaggtggcataaggaaactagcagtttccatcttcctgtaggagaggaaaccatcaccctcgatgatgtggcctctttgcttcatctgcccatcacaggcgccttctatagctttgagactcttcatgttgaggaagtagtgttgctgttagtggaattacttgaagtgagtgcagatgaagcgagagttgagacagtacagtgtcatgggacatatgtacaactatcatggttacgagacatttatcgtagtaaatgtgatgtcacacactggactatagcagctcgagcttatctgtcatag

SEQ ID NO: 75093 - DNA, 741 bp, Glycine max
  Peptide Sequence Number=SeqID_166778
cgcaaccctcgggctaagcgctatttccttcatgcgctaagtgagctgttgttcgtgctaagcgccttgacccctgatcattggttggatggtcccactaagcgagtgcttagcgctaagttactttggagagttctatctttttctaacttagccccgacatctcatacttcagatattactttggatagggctaagttaatctacgggctcgtcatgctaggttttccagccttgattgttgccttatgcaaggcccaaggagtcacatctgattctctgacctttgaatctctaagcccagtcattaatttgacttatattaaaaagaattgttggaacctggatgacccttcggtcacttttcggggaacccagaaatccaaggctaagagatctgaggccccatctacatcagctccccctacatcagctctttctacatcagctcctcctacctctcctctccctccagcaccagcagctctagctcctccaattcttacagagcctacatcagggccagctcctgatcatgtagagcttgtagaatgtggtccattagtggccggccaccgcagcccaggagccttagcctgcacaggagaggatgttgcagtaccagagccatctcctcagcctgagcctgagccatctgcaccagtgcatgacttgcctatttctcatgatctaccatttgcaccagcactggacctgaatgacgctgcacaggatgattga

SEQ ID NO: 75094 - DNA, 639 bp, Glycine max
  Peptide Sequence Number=SeqID_166779
atgcaatcacaaggactcacagtgtctcctgagcctgagattggttctttagctgctagtgtcagcataaaaaagggttatgttgatccttcatggaacaatccaaacacaggtgactcagagaaatgcaggttgtacgtcgaagaaaatcctccccgcctggttgccctaggaagactttatgaggggtcgacaactgttcacaatgtctttttgtgccatgatcaagtcaaggttggtgttgaggaagttagagatgtagatactcccattcctgtgcctactgaagaggttcagttagtggggcagacacttaacaccttcattgcttggctgacacatcttgtcaagcttttatcaaaacagatttttcttaagccattgcgagttatgtgggatgctaccgtatttggggtgtttaatgacaacttccccttgtacataaagcatcaagatctctctaaaataacacatggtggtcaatgtctcagcatctctattatacagttgtggattttgcatatgactaagacaagtatgcgagcggggaataccgatgtgtatggattcctcgagccacagttcatacagagatctgggcaatcgcaatttgaatcagaaagttatattaagaattag

SEQ ID NO: 75095 - DNA, 447 bp, Glycine max
  Peptide Sequence Number=SeqID_166780
atgcatgatgcaaccaaagaacaagctagagcaaagggtcagtttggggcagttacagcttgctcaggcgagctgaaacttaaccctgcagtagtgagctcgcccaggcaagttggtttcttcaccataaagctatttggtggcccaggcgagccagaggctagcttgggtgagccagaggctagcctgggcgagctagggtccaggaaaacccacgaaaagacccttttgccccctttttttttggattttcaaggtgttttgagagcttttcaacttaggaatttacaaaatgaaagcttgaagaagaaagccaaacataatgatgatgatgatgatgacgatgacgatgatgacttattcccctttcataaagttggcttaaggaagggattttgtctctacaaagagcttcctaacaattcccttttcaaagagttgggttga

SEQ ID NO: 75096 - DNA, 150 bp, Glycine max
  Peptide Sequence Number=SeqID_166781
atgcacttccaaaatcgattcccaccctttctaggactctttcctttcctagatttcttcgacctgcgaaagcgagcaaattcacggaagcgcaacccagtttgcgacaaagacgaactcaagcagaaggagaaagaagaagaacgatag

SEQ ID NO: 75097 - DNA, 996 bp, Glycine max
  Peptide Sequence Number=SeqID_166782
atggcctccaggaaacataagagcattggggcaaggacaaatgctcagtatgatactagacggttccattcacttgatgcttggaaccgttatataaataatgtcttgggaatgagcattttgccagagaggaaggttgagatataccacatagagttcgatgacttcaagacaaagttggagaggcataatcttcacaaacgcctcaccaacttggctgatgggaccattgatgttgctttggtgaaggaattttatgctaatctctacaactctgagggtccttcaccaaagcaagccagggttaggggccacctggtgaagatagacgccgacagcctcaacacatatcttgagactcctgtagttctagaagaggcggagactttacccacctactctaggtactacaggttgcccatagatcacagagagatagaggttgctctctacatacttgggagggggttcattttgaatggtaaaggccatccggggaggattctcgggaaggatctgactaccttggcccaggtgtggagtgttctgtcttactccaacctggcccctacatctcatacattaaatctcactatggatagagccaggttgatctttggcctggtctctcatatggatatgaacatcgacgctctcatctcaagacagatgacttctattgcccaatctaactcttgcagacttgggtttcctgctttgatcaccgccttatgccgagcccaaggggttgtctctgacagcctcacatttgagtgcctgagcctggccattaacttggcctacatcaggaagaactgttggaacattgatgatctaacagttgctttccaggggactaggagggcgaggccaacgaatattccatcttcttctacagctccagcacatactccaacatctacttttgcagctccttcaattccagctcatgttgactcgcagcgctttgaagctatgcttcaaagtatccattag

SEQ ID NO: 75098 - DNA, 536 bp, Glycine max
  Peptide Sequence Number=SeqID_166783
gtggccttgttggtgcttgtgcgcttagcgcaaatctagaccgcttagcgcgcattagtgaatttcgacttagcgcgcgtcttcttgctcagcagatggactcaagcggtgcacttagcgggatgacacctcgctcagcgaacatgcacaactcatccttcttccagattcttcctctcgctcagcgaatggaatactaccttgggagcttgtctgatttttgttcttcttcatactgcaccaagcttatgaaggagtcacctcaatggagggtcaaaccgattgctaagtgccaagctagaaggaaacattattcgtccattaatggctcccttggagctgcccttctgaacctattaaggtgtaacaaagagggaagtggacacggttatgggattggtgcagacttatggagtggcatgagaggagtgtcatcagtgaattatcttctgatgaggaagaggctagatcttctttgtttccttccttatcttgacaatggaagaacagacgctagaggttcagctacagattga

SEQ ID NO: 75099 - DNA, 1959 bp, Glycine max
  Peptide Sequence Number=SeqID_166784
atggcctctacaaacaccctcgtcactacgtctatcccaaccatggaaatcaccaccatccatactgacaatgagccttccattcacgagaagaactatgactcacacgtcactaaagctctctacaaagacaatgctgacaaggctagcgatcagaagactatcatctacaacctgatgtgtaagaaggcaaaaatactagccaacattctgaataagagtgtgcttcacaaagctggctttaagacaaccttctctgatctccacaagtttatactgtttcacttgatggaaaacctccaatttgaccttccacacacagtatacagcaacatcttgaggagtctcaagggcttaggtggagtctatcatgtgttcaacaagatcgacgaggattccaagcacactttaatagttaagggttcagtggttgctaaacaacaaaagctttgcaagactaacctaaaggctaagaaaatgaccttggaacaaagcttaaaggagactccagaagtggaaatggaagccatcaacaagagaaaacataagaggctggacaagtccattgctgatgaaggcctagaagaagaggagcttttagccaaggaacataggaccaagagaaggcacaagtctgttgtgttcgctcctaagtgtcctcccacagtgaacctaaaagttgtcgctcttgatgcacctactcccaagagagccaagaaggctcaacttgtagctgaacctcgtgcgaagagtcagtcctcctcctcatcagatggtgaatccactaatgacactccaattatacccctccacaagtctgcactaaccactttgccacatccacctccctctcctttacacttggaaaggttcagaagggaaactccaagggagccattaacggatgaacaacgtttctctcaagatgctatagtccattttcctcctccaacttggactcgtccagttcaatccactattgccaagatgcctcctaattggctggcacttggcacttggcactcattaaccgacatccaactctctgatgaagatcactcatcccttggaaagttacatgaaaaaatgtacttggatgatcaagccacaacgtacccttctagtctgcatatatctagggcaactgacatcatgatggttgctgatcgggaccttctggagtcaaatagtgtggatggattcccaaaaagcttccacctttgggcaatgatggaagtgatattgttgttccatgaaacgttgttcaagtgttacaacctgccaagacgtatcactttgatgatgcttgtgtctgcttcacaagagatgatgatagctactccttcatccaacgtcttctttagcttctttccattccataaggggaacttacaacttgaggctcaacagaagatgaaagttgtttttggttctgctactgttgagagtgttgcaaaagaagctattgagaaagaagctaacgccattgttcaagctgaggcatttgccaaagttgtggacgacagtgttgtcgacgacactaatgtcataaacgagactagtgaagcatccaatgcaactatggccaatgaagttgaaccacttattccaaatcttgcatcaataaagacacttcttgagataagggcaaaaatggtgttgatgtcgttattgtatattccacaagttctggccccactcctctcaattatgcacaacctgctgccatcactcaatgccactataagacagttttccaaccttgacgtcgtcctcttacagaacattcaacaagctcaattgtcaatgcttggagctattgctccccctacacctacacctataccaccctttatacctgcttctcttgaacctccaccacaacccttggctccgataccaccaccaccttcatcctctccaccaccttcccaacctcggccaccaccaacctcttaa

SEQ ID NO: 75100 - DNA, 546 bp, Glycine max
  Peptide Sequence Number=SeqID_166785
atgaacccaaaagacgttggtcttctgtgtccattgatcaaccaagaagcaaatcctgcttcttgcaataaacccaaggaacgttggtcccttgtgtttagtgtttgcaaccaagaagaccttctcttgaaaacagtcaccaatagtagttctactgacaaatctggaaatggatatgaggggaaggtacatgttcatgataaagatgcaattgtatgctacttctatggaaaaactagacagatgacgttcaaatgcaaggatcgtcctaagaaggaaagcaaatacatgccatgctacctagacagtggctgctcacggcacatgacgggaaaaaagtctatgttcaaatgcttgactccctatcatggtggaacaatcactttcagagggaataaaaaaggcagaacaatcggtggtggatatggtgtatccttcaataaggatgagtgtgtcatccaatgtgaggatgggtcccctctattctctgcaaagagaaaaggcaacctagatggacttgtcatagtggaggattactctagatag

SEQ ID NO: 75101 - DNA, 1299 bp, Glycine max
  Peptide Sequence Number=SeqID_166786
atgacacaaccatctcctcctccgccgctggcaccaccaccaccgtcgactccaccacctcctcagccggccgagagcgtccgcgttcgctgtgccggctgccgcatgatcctttctgtggctcccggcctcaccgaattcgcgtgccctacctgccgaatgccgcagatgcttccgccggagctcatgcccaaggcggtggcgggcaacaacgcggcagcgccgcttcctcctcctccgtccgctccggcatcgcagctgtcgcaggctccggcgcacggcattgatcccactaagatccagcttccctgcgcctcgtgcaaggccatcctcaacgtccctcacggcctcgcgcgctttgcttgccctcagtgcggggttgaactcgccgtggatgtttccaaagtcaagcatttcttccccgttcaggaagaagttaatgagttcgtcatgatagatgtgaagacatacaatataaagtgcgatcgtgattgtggtaaagctgttagcaaggatgaacgtgaatttcaaaaaggaagtagaatgtgcttgatggttgataaggttgctgttgaagtggagcgggatgaagatgaaggtggcatggttggagaaacatttacagattatcggccgccaaaaatatctattggacctccacatccagatcctgttgtggagacatcttcgttgtctgcagtgcagcctcctgagccaacttatgatccaaaaattaaagatgatttggaaagttcaaaggctttatcttgcttgcaaattgagacattggtctatgcttgtcagagacacctccaacacctctcaaatggagctagggcagggttttttattggagatggtgctggtgtagacttgaagtttgatgctagaagagacttggatgatgtaggtgcaacatgcattgaagtgcatgctttgaacaaactgccttattctaagcttgattcaaagtctgttggggtcagggagggagttgttttttcgacgtacaatagccttatagcatcttctgagaaaggtcgttctcgtctccagcagcttgtacagtggtgtggaccagggtttgacggtcttataatttttgacgagtgtcacaaagcaaaaaatttggtccctgaatctggcagtcagccaacacgaaccggagaagcagtggttgatatccagcctttcaccaggcttcctcagccaatgcaatctgacgagcaagttcttgtctctgtcgtacttgctgctcgtcatgctcagctcatttgcagtcctctttgccttttgtag

SEQ ID NO: 75102 - DNA, 216 bp, Glycine max
  Peptide Sequence Number=SeqID_166787
atgatgaagcaaatacttgaggcaatccaaccatcaacaacatcgtcaaccaatgaacctttggaggatcaaggtcacgctgatgattttactagcttaggttatttacatattagttgccttttctttttgcaagacatcgatcaatttggttttgataggatagggattagtaatcgctcaattatatcttgcaagggattggcaaggaactag

SEQ ID NO: 75103 - DNA, 561 bp, Glycine max
  Peptide Sequence Number=SeqID_166788
atggcataccatgctagctcaaaagccaatcaaaattcaatgaaaaatcatgaaatgcattttggcacgagctactcaatagaaaactttcaagggggaccagagttacaaccctactatcaaaatgaagcagaaagaggttccaatttggataatttgttgatgcaattcaaggaaacaactaaatcaactcaacgagtactccaaagtgtagaaatccaggttggtgagctggcagaagaagtgactcaatttatgtccagacgagaaaaatactttgtaaaggttgaagctcaagaggaaaaccctgtaaaagagcatgagtcaagagaaaaagatgaggagaaagatgaggaacaagcacaacaacaatgggagaagtactcaacaagaaatcctttcgctaagcgcatctttggtcatgcgctaagccgcgagtctcaagcgcttagtgctcaacccttgcatcttaggctgatttggtccgctaagctggccaaggctgagctaagccaatttcaatttgatctgaattcgactaagcaacggcctgaccgctaa

SEQ ID NO: 75104 - DNA, 396 bp, Glycine max
  Peptide Sequence Number=SeqID_166789
atgcctggagctagtgagaaagtagttgatcctaccctgtctgatgaaatggatgaagacaaactcaataggatggaagatgagtatagagttccagagtatgtatccattgatacaatgaccaagagtctggagaaaaagaagaaggtctacaatggctttcacctttcaatgaggggaatcagtgaagacatgattaatgtggtggtggcaacttgtggtgatggtggtggtactcatcttctccttgaagtggcgtctcctctctctcttcctttctccattccgctgccattcatcttccaagaagcaaaggaatccattgatgaagaagatcctaggcctacaagctccaatggagcttgcatcacaaataggtctagcgatgccatgtag

SEQ ID NO: 75105 - DNA, 411 bp, Glycine max
  Peptide Sequence Number=SeqID_166790
atggcccatcttgttcgctatcgtatgcataagacattacgggtaaatgcacctctcccatatccccatctggttactctgattctgcagcacgtcaacgtccctgttgctaatgaacattttgtcaaggttaaacattcatttgccattggagccactggaattgcatataggaaagatattgatggccaatgggttcgtaaacaggatattaatgctcctgacaaatgcactccatctccaccaccaagggatccctcctctacattactaactgatgtcctcaacgagcttcgggatcttcgttcttttgtcggagaaagatttgattccatggattctcgtatcactcgtcttgaggatgacatgggatttatccgtcgttgctttgatcctccgaccgattcttag

SEQ ID NO: 75106 - DNA, 408 bp, Glycine max
  Peptide Sequence Number=SeqID_166791
atgcaacagggacaaccatacatccccatagttgggttccctgaccccaactacggtttgaaagcggtaaaccaaaataaactcccctcacctatcatgagctctccgtcagctcctctctgcgttgctcagagacctctctcattcacgttcatcggtccaaacacagtgttctatataccaaatcgaagatgttcctctctgtgtgctggtccgacggcaagcaacggcggctcgtggtggccaccgcttgtcgtgggtggtggaggagtagtttctagggtgatctcgcttagtgagctcatctcgctaagcgggaatccacttttggcattaagcctgactttttgcattgagcgcaattcctctcgggttggtatttgcattgagcgcaacatttcacgctga

SEQ ID NO: 75107 - DNA, 429 bp, Glycine max
  Peptide Sequence Number=SeqID_166792
atgtgggctggaagactcattcgcaccagcacgtcttcaatgactccaagtggaatcgcaacactccggttggctagatggatgacaacactagtcaagcatggcatttgtaaaagtgaaatctccaatggtacaagggacaataaaagtgccaggatctttgcacttttgtggctaggtggatggtggaatggaaacaacaattttgctccatataagtgcagaaacatttctgcccaacttcacttgctcatttcccttcagcttcctcttatgagtgcacaaatccttcaagaactttgcatattttggaatctatttgatggcatccaagagaggaatattgacttccaccctcctgaaagtctcaagaagatcagaatcaagttccactttctttgcaggaatggatctagaaggaaaaggtag

SEQ ID NO: 75108 - DNA, 927 bp, Glycine max
  Peptide Sequence Number=SeqID_166793
atgggattggctttaaggggctcccgtaactcttcgtgcttggctcctgaaaaccaagagcagttgacacaaaagatcagagaccaactaaagatgtcgatcacacaaaaacctcttgaggctgaggttggtcattctgttgctagtgtcagcacaaaggaaagttgtgtcgatccctcaggagtttatgaggggtcgatgaccatccgcaatgttcctttgggaaatgatcaagtgaaggtctatgttgaggaagttcaagatgctgatgctcgcgttcctgtacccactcaagaggttcagttagtggggcaaacacttaacaccttccttgcttggccaacatatcttgtaaagattttttcaaaacaaggagttgagggactggtgaaacctatagatatgctagatcttggcatcgatcccttgtacctgatgatactgaccatcctgcagtttctcctcaagccgttgcaagtgtcgtgggatgccaccatggttggggtgtataatgataacttcctattgtacataaagcatgaagatctttctgaaatagtacataatggtcaatgtctcaacatctctgttatacaattgttgatttttacatattggcaaatagtcattattttgccgaaggacaatgttgtcatctggttttgttctttgcacaataggcccgacatctacttgaaaggaattattgtagaagcaaagcttcatggtgaatcaaagaacaattcaagagttcaatataagaatcaagaagaattcaagactcaagaagaaagtttagagtcaagaatcaagattcaaggttcaagatctcaagaatcaagatcaagattcaagactcaagattcaagaatcaagagaaggcttaatcaagataagtatgaaaagtttttctcaaaaattgagtag

SEQ ID NO: 75109 - DNA, 309 bp, Glycine max
  Peptide Sequence Number=SeqID_166794
atggctcatcaactcaaggtcagcgctaaggctaccttggaaaaattgccttggcatttgatcatagtctcaggggaggaagacattcttgtgagctatccttcttctacgccctatgtggaggccgcggaggagtcattggagatggcctttgaagcattggaagtgacgagcaattcttatgtggactctcccccagttcaaccacgctcatccagagctgccttgattgtagcccgtgtggtgttgggacataggtataagcctggtatgggtttgggctggaatgacgatggtgtggcaagctag

SEQ ID NO: 75110 - DNA, 395 bp, Glycine max
  Peptide Sequence Number=SeqID_166795
cttgggaggatttatggggacccggtgttgagaggaacgaggataagggctacgtgggagtgcgtgagctcagtgaaggtgggcaactggggatggtgggtttatgtgtgatttgtggatgtggagagttgactcgcaccatcgcccgaccgccacctatggtacctggagatatgtcgcgggggtcaggagaccttggggacgtcaggcgagctcctggcagtcaaccgataaaagaacaaagaccacaaagcaagggggcttgtgtggtggctggccagctgcgaatcttgtgtgatatatgggatatggcctctggtaatcgattaccaagggaagtcgagatggcttttggtaatcgattaccaaggggtgtaatcgattaccaggcttag

SEQ ID NO: 75111 - DNA, 627 bp, Glycine max
  Peptide Sequence Number=SeqID_166796
atggcggctggttttgctgccctcatcactgccctgtgcaaggccaaaggagtaacttctgatttgttatcttttgagagccttagcccaaccattaatttggcttatgtgaagaataattgttggaaccttgacgaccccacagtcactttttgggggccccgcaaggctaagggcaagaggtctgaggctccaccatcttctgctctccctacctttgctccttctacttctactgcaactccatttgctgtagcttcatctttaccagctctagcttcagccccagtttcttccggaccctccacattcagctctgagactttatttgccatattgcagagcctgcataaaggccagattataatcatgcagagctccagccagaagcagccagtgctgagcatggaggagttccttagtcaggtggcctggccaggagtccggccttctcctttgggagggggtgaggcctccgcagcccaggaacctgtgccagaggaggacgagcccatccctcctgagccatttttttatgagactgatccagctagtgctcaggaggaggtagcatcaccaaagcccgttcctcagtcatctccagctctagttcttgatgatccatag

SEQ ID NO: 75112 - DNA, 114 bp, Glycine max
  Peptide Sequence Number=SeqID_166797
ccggcaagggttcagcattggctttcacgaccgcaaaggggccatctctcagtcggagtgcaaaatcaataggtgccggagctgctacaattgcttcagcgggagctgctgtag

SEQ ID NO: 75113 - DNA, 516 bp, Glycine max
  Peptide Sequence Number=SeqID_166798
atggctccttctgataaaaatcaatcagtttatgcaactgtttgtgccgaaacaaaccgccaagaggctatgcttgatagtgagtctactatggggactacctttgctgttaagaagtattctaagaaaggaatccgcaagtgtacccactgttatggggataatcatgtcttggagacatgttttaaactccatggctatccggattggcatccaaaaggcaaaactactccaaataccaaggtagacgctacttccaagagccatatttctactgctgctggatttgtgaccaagtcaagtatatctaactctgctcttaatctttctgttgttactaggggtagtgagtggataacttattcaagtgctactgatcatatgacttgtgatactcataaatttactagcttttcccataattgttctaaaaattttattattaatgccaatagggtctcatcacctattgaaggtgtagaccatccattccaaggagaagatgggcagtggtag

SEQ ID NO: 75114 - DNA, 869 bp, Glycine max
  Peptide Sequence Number=SeqID_166799
agcataagctcctggctgagaagaccaggaagaagctggaggaagctgcacaatcaggaatcgttgatggcgtcattgaccctccatcccccgtcagacgccacgattcctttgaggagcaggcgtcacagggatccttcgtcccccaaggacatcaggatgttctcactactgctattggatgtccagagcaccctagatgtgtccgtgctgctggagtcagtgtcaccatcaagaaatacttcggatcggctccacggacgtcccgcaactcttcctcattgcctcctgcagaattgcagcagctaacccagcaaatcagggaccagttagaggagtcgatcacagaaaaagtgactcgacagctcatggcatcattcagcaagatgcagtcccagtttcggtcccagatgcaatctcagggacttatgccacctctggagcctctggttggtccctcaggtcctcgagtaagcacaaaggagagttatgttgatccctcaggaaacaatcctgagacgggtgactcagacaagtgcggcttatacatcgaagcacaggtgggtgtggaggaggttaaagatccagatgttcccgttcctgtacccactgatgagacggttgtgtctctggaaaaaccacctcaaaacccagatccagaggtcgataatctgctttatcttatgacattgaccatcccagagcttttcttgaggccttaccaggttacatgggatgtccccgtgttcagggtctttaatccaaacttcccactctacataaagcatgaagacctcttcgaaatcgtacatggtggtcaatggctcagcatatcagtgttacattatggattctgtaagtcattttag

SEQ ID NO: 75115 - DNA, 156 bp, Glycine max
  Peptide Sequence Number=SeqID_166800
atggagaggaggcccccgaggacgaggagatggccgatttgcttgacttcttgggagggagtggagctacatgactgggagatccccagattcatggtgaatgctgtgaaattttcccgagtacccaaaatggactcggatgaatgcacaaattga

SEQ ID NO: 75116 - DNA, 117 bp, Glycine max
  Peptide Sequence Number=SeqID_166801
atggaggagaagaagaagaaagaagagaaaaatgaggctgaggcgctaccgaattgccaccgtaatcgacttttacatcgttcatcgttcggtgttcttcgttcaccattcagttag

SEQ ID NO: 75117 - DNA, 168 bp, Glycine max
  Peptide Sequence Number=SeqID_166802
atgggtctatttgcgaaggtgaaagggaagcagacaagattcaaaggtccccaagcagttggacaagtcatacgtaacaatcttccacaatctaaaatgatagaatcttgctctgtagttggtcctgggtgtgtgaatattgtcttgtcgaagaagtggatagcatag

SEQ ID NO: 75118 - DNA, 453 bp, Glycine max
  Peptide Sequence Number=SeqID_166803
ggacagcgagtcaggtggcaggcggagataccttatggttgtccgcacctttcgtcaaccaaggcaaacgagtttttactctcgtcctccggagacattcaagcccgatgacgcacgagattcttctctgctgggcggggacgaccaagtttgatagcatgtggaaacgtcgtggtcccgctggttgggatattggtcggcctaatgatggaccattgtttgttggcatgcgacttttgcttgaccatctcaaaatgtttaacatccatcgttgtggaatccgtaaagttccaagatgtttcgagaagaaaccggtcaaaaacacgaaattgagagtgtatttagcaaagtggggaagcaactgggtggcaagctcctccacgttgttgaaaaatggttcccaaggcttccgtggcttccgtaatgcttccgtaaaatttccgaaaaccttgg

SEQ ID NO: 75119 - DNA, 411 bp, Glycine max
  Peptide Sequence Number=SeqID_166804
atgggtgccaagcacctcacgaggaccaaagaatggtcgcacgtcatcgagcaaaggtccccggacgaaattaggcttgtgctgtttgaatgtgttttgcatggatgttgtggaagcttgggaggattgatggggacccgggttgagagaaacgaggatatgggctacgtgggagtacgtgagctcagttggaggtgggcaacaggggatggtgggtttatgcgcgcattgtggatgtggaaaacttgttgtgcaccatcgcccgaccgccacctagtaccacatgtgatggagtggtacctggagatatgtcgcgggggtaaggagaccttagggacgtcaggtggggtgctattgcccaaaaccaagcttgaccaatctcgacccaacccgggcatagtcggtcagtga

SEQ ID NO: 75120 - DNA, 348 bp, Glycine max
  Peptide Sequence Number=SeqID_166805
atggagacacttcagaaggtccgtaaggcatgggaggtggtgcaaaagaaggacaaagaactcaggggcagtaacagtgggcccatcggtggctaccgaaggtggttgaaagcccacgtgcaaggtttggattggttcccgagtttgagaaccactaaaagggaggaagttgaggcaccggaggaaaacgaagagctaccaccaaggccttggaacaagagaccaagagggctcgtagggaagagcacggccggaacaagttctgaggggctctatggggctgcaacagcgagcttaagctccggagagaggaaagagaccaatcacgagtacatggcatggtcttaa

SEQ ID NO: 75121 - DNA, 612 bp, Glycine max
  Peptide Sequence Number=SeqID_166806
atgttggtccaagcaggcccatatgttcctcctccaatgcagcaacagcagcaacaacaaaaacaacaagcaactgaggccccttctcaaccttccttagaggagttagtgaggcaaatgaccatccaaaatatccaatttcagcaagagacaagagcctccattcagagtcggacaaatcagatggggcagatggctactcagttgaacaaggctcagtcccaaaattctgacaaattgccttcacaaactgtgcagaacccaaaaaatgtgagtgtcatcaccttgaggtctggcaagcaaattgaagtgcctccaccagtagcagcacctgcacctgaacctgtcaagcttcattctacacctgaaaaagaggatgagatagttgcacaaaaaagaaagcttcctgatcatgagagagctaacaaaaattttcatgcaggtggaccttcttctagtagttctgacttgcagcagcctcctatccctcttccatttccacttagagcaattccaaacaaaaagatggaagaagtggataaggagatcttggagaccttcaggaaagtagaggtgaacatacctctgctatatgcctcaaacaaattctaa

SEQ ID NO: 75122 - DNA, 207 bp, Glycine max
  Peptide Sequence Number=SeqID_166807
atgatattgcacgagattagaaggcctaactctctaaaaacagtccccagtggagtcgccaattgtcgcaagctaccctttggcgggagggcaacgcgagggctcacgagtgcatcttccatgggaggaaaatgtgcagagtcgctaccaacgtttattcgaggaaaacgtcggaaaaaccagaaaaaggtggtctacgaactttaa

SEQ ID NO: 75123 - DNA, 117 bp, Glycine max
  Peptide Sequence Number=SeqID_166808
atgggaaccaccacgggggaggagcttgccacccagctcgcccaggcgagcaaggttgtttcctccagaagcaaccgccttctggaggaagaatttggaaggcccaagtgggcctga

SEQ ID NO: 75124 - DNA, 282 bp, Glycine max
  Peptide Sequence Number=SeqID_166809
atggcacgcagcgtgcccgctacgtgcctctattcaagggacctatatgagagggagctaactaggcttttagtgataattcccaaggtggtcatatttctcttgatggtctctagagtcctaagtggagtcgccaactgtcgcaacctacccttcggcgggagggcgacgcatgacttgcgggtgcgtgtcccaagaaaggaatacgcacggagtcgccaccaacgtttatttgaggaaaacgtcagaaaaaccggaaaagacgtgatctacgaactttaa

SEQ ID NO: 75125 - DNA, 539 bp, Glycine max
  Peptide Sequence Number=SeqID_166810
atgatagaagtgtccgttgaagcgatcgcatccctcactcaatactacgaccaatcactcagatgcttcacttttggggactttcagttggcaccaaccatagaagagtttgaagggatcttaggatgcccattagggggaagaaagtcatgcctctttgccagattctatccttctagggcaagaatagaaaaagtggtcaagatcttggaacaagagctagaccaagtgaagcaaaataggaatggagtggtagggataccaaggaagcgcttggaggagaaggcaaaagctttggcaaatcaaggggaatggacctcgttcattgacatcttagcactgttggtgtttggaactatactatttccgaatgtagatgggccagtggatctagctgcgatcaacgcctttcttgcttatcaccacagcaaggaaagccccgtcatcgctattttggcggatgcgtatgatacattcgacttgaggtgcgaaaagagcagtgcgagaattctctgttgtacgcctgctctttacgtatg

SEQ ID NO: 75126 - DNA, 294 bp, Glycine max
  Peptide Sequence Number=SeqID_166811
atgtcgtaccgtgtcagtgaaaaatctcgtcggacgcccagaaggagaccagtcaatgtctctttgttttgcgagaatgctccaatcatatgggatcagcataggcttcaaggaacattcaaaccgagtgtatttacccccaaggcctacactccgaagagtccgtcagggcctctccctcctgattcaggtccaacccagaaaaagtatgcagaccttatctttgaactgtataaaacacacgactcctcaattgttctcaaaataattttttctcatcgcgcgtcaaagtga

SEQ ID NO: 75127 - DNA, 495 bp, Glycine max
  Peptide Sequence Number=SeqID_166812
atggagaaagagaagggagaggaagaagtgaagtaccgcggagtgagaagaaggccatggggtaagttcggagcagagatcagagatccaacgaaaccgacgggaagacaatggttagggacatttgacacggctgaagaagccgctagagcttatgatcgtgcagccattggtttgaggggtgctcttgcaatccttaattttcctgatgagtactattctcatcttccttttgtattatcaaattcttctactaagggaaatgaaagttcttttgatacggaagttattgagttagagtatttggatgacaagcatggttgtgaagccatgcacgttcttatattacacggtattgttgaactgcattatgtcgagtgggctatggagactacactgaaccttttcttccacaatgttgtccaagcgtgggagaataactccaagtccgcattgtcttatttcatgatatcatcctggagtgtaaaggcttaa

SEQ ID NO: 75128 - DNA, 402 bp, Glycine max
  Peptide Sequence Number=SeqID_166813
atgttattttcagtggctggtcggggtcggggtcggggttggggcgaatataggaatctcatacccgtacccgtacccgacttttggtcatcgggaaaaatccgaatccgaacccataccctatcaactcgggtattacccgtcaaagtcgggacggattcgggcgggtacctacggaatactgacaatggcaatgacaaagatgatgaaggaagtagaatggtggtgacaccgctagcagtgatagtgactatagtaatggtggcgatcacaatgacggtaggatggaatagtagttgtagcaatgacaatggtggtgacgataacaataatggtggaggtggatgcaacaaaggcgaggtgcggtggtggtggtggtggtggtatgatgatggtagttag

SEQ ID NO: 75129 - DNA, 1206 bp, Glycine max
  Peptide Sequence Number=SeqID_166814
atggctagaacacgaggtttaggtcgtgctacaggtagagttataggcagagatagacaggatgaccatgatgatgttcccgagagacgtaggcctactgcatcagcccgtaggcaacaggtttatcagatgattcaggatgttcctgacatgactgaggatgtccctgatatggctgcggaagcacctgagatgactgcggatgtacagggtcatgatggtgctgaggggtcacatgctgatggattcccaggtgggccacgtgacccattagtgctgacatcattttcaaaccatgttgcacacgccgtttggagtggacaggaacgtcctgatttgaagttggtgtcacatgggaagaaggtgactttgattgggaggtcagtgcctgagattgaaggactagttggtgccacaggattaagttcactaatcgattgttcagttgttacaggcgatcctggacttatatccgcatttgtggagaggtggcacagcgagaccagcaccttccaccttccggtaggagagttgacgatcacattggatgatgtgtcgtcactccttcatttgcctatcactggcgcgttgcacagctttcatgctctttctacggaggaggcgatatttttgttgatcgagttgcttgaggtgtctgccgaggaggctagagccgagacaacactgacatgtggggcatacgcacaactgagatgggttcgagacatttatgagatgagatacgcttttcgcgacctgggtcagagtggtggttatgcttggggagttgccgcgctggttcatatgtatgaccagttagatgaggcttctaggaccaccacacgacagattgcgggtgctggatctatgagtactttcctagcgcatatgaaggaaatcataggagcaccttacagggcacgttgtgatgctttgaccgtcacaaatgtgtcttggttgccgtacagtgagcatcggggggttagggcctttgagctgatttcatcattccagggtcagctgagatggggtcctatggtggttacagctcgaccggagagggtgatacggcagtttggttacattcagagcatccctccgccacctgttagtgctcgattgtcacatgatgatataaatgataggtggatgcattttgcggagcacgtactacctgtgggtgagctttgtctagtgtctgggcag

SEQ ID NO: 75130 - DNA, 366 bp, Glycine max
  Peptide Sequence Number=SeqID_166815
atgacgatttggcgatgcatggggaaccgccagtcaaactggcgagttccacaacataggagtaggctcaggctttgcagggatggcaagcgcatgcagctaaagggaaatcgccactcctatgggcgagttagcctaaattggagttgtcaatggtattggcgagttaggcacaagggaggtgccaacaacattggcgatttagtgtgtttatatacgtccctcttccttcaaacgcaatgtagtggaggaacttatgaagaagaacgcaatgtagtggaggaacttatgaagaagaagaaagcaatgcaaggaacacagctgtggagtcatggagcttcttcttttataaggccaaaattttga

SEQ ID NO: 75131 - DNA, 243 bp, Glycine max
  Peptide Sequence Number=SeqID_166816
atgcatgcaccacgcaaaccgccagtggaactggcgagtttgttgtttgcaaagaagtcgccagtggtaatagcgatatcgccatgcattgggaaccgccagtcaaactggcaagttccaacagatacgaaaaatgagggtacattaagcaaaagtggcaacagaaaggaagaaaaagaaggaattctaaagcaggcccagcccaacagtgacgctaagcgagcaactaactgcaggcgctaa

SEQ ID NO: 75132 - DNA, 270 bp, Glycine max
  Peptide Sequence Number=SeqID_166817
atggaaaacgagggaggaactaagtgcggttttgtttccggttttgcccttggaccttttgttgaattccaactgggtccgttgtacttccacgaacaagtttgttgtactacacgttacgtagaccgtgtctcttgttccaaatttccgatgcaacttgcacattgctgttatttggtacactatcaagcgaagggtggcgatggaggtgttgtgggggatgttgcgggagagtacaaagaagaagtggaaaaaattggagactcttaa

SEQ ID NO: 75133 - DNA, 735 bp, Glycine max
  Peptide Sequence Number=SeqID_166818
atggctgccattactgatcaatggatgcagttctatcaacaacctctaatggatagccatggccatgatcatcatgctttggcaccaatttccacagaattaggcttctctgatgcaaccgtgactacgacaactagttctcccacccccaccatgccatcatcagagagcaatagcatcttgagccaattgagtccaaagggtaatgtgtccaaaccaataagaagaaggtctagagcctctaagaaaaccccaaccacactcctcaatgccaacaccaccaattttagagcattagtacaacaattcacagggtgtcatagcacaaccatgccaacactaggggtccaaaagggccctattaccttgaatttccaacaaggaaatagtagtggacaaaaggttcaccacaacacaagtagtagggtagtgctaccatttagtggcagaagccacaacaacagcaacagcaacaacaaccaggttcatcaagtgccttcaccgtttccaaatgggcagaagcaagaagatgaagaacaacgacaactgcctcagcagagtggttactcttttgattatgtgaagaacagtggttttcttccaagttcgggtaactcaataaggcctaccactactagcatggatcatgtctctgatggttgtattttcctcgttatgatcacaaagcttctatatattcctgccaccatttttatattatctgtttttaactag

SEQ ID NO: 75134 - DNA, 1158 bp, Glycine max
  Peptide Sequence Number=SeqID_166819
atggtggctgatattcagagcagtaaggagaagccaaaggagctttcctcttggctgaaaacctttgggagacatctacaggataaatccttgtatgcgttgggtatctcttcagagttccagttagggatggatgatactttactttttggcttagatgcatatgaagatacagaaaagcctcgtgggaaagcagtctttcatcataagaattttatggcagtcgtgttggatgaggagctacctgttaaatgggccattttattgttatatcatgatctaacagttgaggcagtttatcctggactttttgttgatacgactggtaattactgggatttaccattttcaatggcagttgatcttgcttctgtgactaccagtgattcttccaccgcttaccatttgtgtgcacgctacacttcggggtcacccaagcagtttgaaaatgttcaaaatcaaaatgatagagtaccaccacctactctacttcctggcttggccttcaaaagtgccttttcttacaggaaaaaagttgatatttggagaagtgaagctaaaaagttgaaattggtacaaccgtatgacatatttctttcgaatcctcatgtgtcagcctcggggattattggtgctgctgcaaccactgcttttggggataattcggcaagagcacaagtagaagatggtagtccaggattttttctccaggcttctggaataaagtcttcctttctggcagatatatttgcatccgtttcatttacagcccaacatggaaatttccaaaggctttttctagatcttacccgatttcaggcccgactggattttccttctggtttcaaatttctttcagccgcaactggtttaacacaagatcttctcaattctcaaaagcccagcatggatgctgttcaggcgattatacccaatgctacactatcacttcagcagcagatcgttggtcccgtcagttttagagttgattcaggaattacagttgatctgaagaaccctgattggccgatacatgcactggaaccagtatttgctttggaatatgcattgcaagtacttggttcagcaaaagcagttgcatggtattgccccaaacgccaagaattcatggcagaacttcgtttctttgaaacataa

SEQ ID NO: 75135 - DNA, 315 bp, Glycine max
  Peptide Sequence Number=SeqID_166820
atgttggaaagggagagtgcagggtataatatactcttaactggggaatcattatcgattccaattgcacgcgcaaatgcagatgctgatgctgatgttgtcacgacaaccgctcaagaccactacctccctgtctccttcaaccaggccatcagtgcaacgatgccgttcttcaccgcgatttttgcatttttgatcacatgcaagaaggagactggggtggtgttcggtatcgttgtgacgggcaacagtgaagcggagaagacatcaccacctctctctctggcgcgatggagacgacggaggccttggtag

SEQ ID NO: 75136 - DNA, 219 bp, Glycine max
  Peptide Sequence Number=SeqID_166821
atggagtttgaggccatggcaaggcaaaaagttacggagcggttgggggagagtgcaataggagaagatagttttataagaaatgagtgtgtaccaaactgtgagttggagggtcgtgagtttgagtccaagagacgtaagggaattggagcgattggtgtgagggacttttcttttagtttggcttgcttggactctaaggagagaagtcttttctag

SEQ ID NO: 75137 - DNA, 288 bp, Glycine max
  Peptide Sequence Number=SeqID_166822
atgggtttacccgaagagccgtcgttctacacagagcatcttctccgacaaagaccatcgtctccgacaaccaccatctcgtgtccgttgcgtctcgttccgtttgaagccgccgccgacaaagctatgggttgtaaattttttttttttttgcgtttcagtggggtttatgtggggctcgttgatgaagctgacttgcgggcagtgagtgaacgactttcgggaacagcctgctgccatccttcatcagtggtgtgtcatcctgtgccacattatcagtttcgttga

SEQ ID NO: 75138 - DNA, 117 bp, Glycine max
  Peptide Sequence Number=SeqID_166823
atgggttctaccaatggtaaagtgaaatcgaatgatagcacaggagatgttctgggcaataagcaaaattctgcacacaaaaatggttctaagaaaagccaacaagatagatactag

SEQ ID NO: 75139 - DNA, 276 bp, Glycine max
  Peptide Sequence Number=SeqID_166824
atggattctatgaattccatgatggagaaactcttcaaacaagttcagttgttgggtgccaaatcaaatttagaagaagaagaagaagaggtgggcagcaaggcaggttccgacaagattttggatagtgcacaaattccattccctacttttgatggcatgaattatcacgaatggagagccaaagctgaacagttctttgaattggagaatacgccacaagctcaacggcgaaagcttttgttattgtcaatggaagggaaagcatttgtttag

SEQ ID NO: 75140 - DNA, 489 bp, Glycine max
  Peptide Sequence Number=SeqID_166825
atggcgcctaccaggcaccctctggacccggataagtccaacagggccctgggatttcccgccttgatcacaggactctgccagtcgttcggagtccccgtcgcacctagcaaggtgattcggtggcccatcacccgagcttttgttgagaagtattgcacacagagacaggcccagggggatgttccgcaggccgcagacgcgccgccacctcatcaggctggtccagccggatcgtttgatacggagcagtatttgcggcatttgatgagcctcagcctacagagccagggttttacttcttttccgtgccctactccggaccaggtcagggcagaggtcgcatggcctggagattggcctgaggcccgggcagtagaggcacctgcagagacaccagcagaggctcccgacgaggcagatgaggcccgcgaggacgaggagatggccgatttacttgatttcttaggagggagcggggccacatga

SEQ ID NO: 75141 - DNA, 552 bp, Glycine max
  Peptide Sequence Number=SeqID_166826
atgtggatctccccctgcggaagtgtcagttgggatcgcacccataagacacccagtggacccggaggagcccaacaaggccctggggtttccagctctggttacaagtctctgtcagtcctacagggtgcccgtccctcccagcaagggatcgcacctgcaagacacccagtggacccggagaagtccaacaggttcttggggtttccagctctgattacgggcctttgtcagttctacggagtgcccgtcacccccaacaaggtcattagaccccctattaaccaggctttcatcaagaagtaccgcgtcccccaggcaggcgcagggcgagacaccccagcagcccggggatggccggcagtgggcaatagacgcaccgccgccacctccagaatccctcagctcatctacaaaggctggagctttgcctatgacctgtggccgaccagcaggcaaccgagtccgaagccaaaggtaagcaaaagtactaggtccgtgaccaacaagtcatcacgcgtccagctccagacattaaagaagcgctactaa

SEQ ID NO: 75142 - DNA, 937 bp, Glycine max
  Peptide Sequence Number=SeqID_166827
aggactacacgtcctcgccatcagaggactacacgtcctcgccatcagagggctaaacgccctcacctttagaggactacacgtcctcgccatcagaggactacaatctacacctttagaggactacatgtcctcgccattagaggactacacaggactacacgtcctcaccttcagaggaattcacgtcctcaccttcagaggactacacgtcctcgcattcagagggctgtacgacctccccaacagagggcaacatgccctaacctttagaggactacacgcccttaccttcagaggactacacgccctcaccttcagaggactacacgtcctccccatcagagggctacacgggctcacccttagaggactacacgtcctcaccatcagaggactacacgtcctcgccttcagaggactacacatcctcgcctttagaggactacacgtcctcgccatcagagggctaaacgccttcacctttagaggactacacggctacacgccctcaccttcagaggactacacgtcctcgccatcacagggcaacacgtcctcaccttcagaggatttcacgtcctcacctatagggctgtacgacctcgccatcagagggcaagacgtcctaacctttacaagactagacgcctttaccttcagaggactacacgccttcaccttcacaggactacacgtcctccccatcagagggctacacgccctcacccttagaggactacatgtcctcgccatcagaggacttcacgtcctcgccttcggaggactacacgtcctcgccatcggaggactacacgtccacaccttcagaggatttgacgtcctcaccttcagtggactacacgtccacgccttcaaagggctgtacgacctcgccatcagagggcaacaggccctaacctttagaggactacac

SEQ ID NO: 75143 - DNA, 210 bp, Glycine max
  Peptide Sequence Number=SeqID_166828
gattgtcatcatcaaaaagggggagattgtggaagcaatgtctttcaagattattttgatgatgccaaagaatcaagagttaagcaaattccaaagattcaagaatcaagtttcaagaatcaagattcaagattcaagattcaagaatcaagtttcaagaatcaagattcaagaacagtcaagatcaagattcaagactcaaaattctag

SEQ ID NO: 75144 - DNA, 405 bp, Glycine max
  Peptide Sequence Number=SeqID_166829
atggcttcccgcaaaagaaaggcaccagcctcagcatctcaggcccactatgatagatcgagattcacatcccaagaggcctgggattgctattctgacattgtgattggcaagaagattcttcctgagaggaatgtaatgatatatcatacagaatttgatgaattcaagactaagttggaaagaaggaattggcacaaggagctgaccaattttctagatgggagcaacgatgtagctttagtgaaggagttttatgctaatttgtatgaccttgaagataaatctcctaagcaaattgattcaaggtgttttgatgataacaaagatgatgacaaaaatcccatgagaatgatttcaagattgagtcaagaacaattcaagaatcaagagagtagcacatga

SEQ ID NO: 75145 - DNA, 279 bp, Glycine max
  Peptide Sequence Number=SeqID_166830
atggctgaagatcaacctagaagagtgacccttgaagactactctagttctgctatgccgcagtttttcactagtatagtgcggccagaggttcaagcacataatattacttatcctcattctatgattcagctaatacaggacaagacccgtgtgcacacctgccaacttacattgaaatttgcaataaagtcaagcttgcaggttggaggttgcagtatttgcgggggagcccatgagtctagatgttgtattcccttagatgacacagctcaagag

SEQ ID NO: 75146 - DNA, 105 bp, Glycine max
  Peptide Sequence Number=SeqID_166831
atgaagaaattgattatggaaaggatggaaaataaggttaagtggtggctagacagaaatatagaaatgacaataactcaagctacagggctccaaatgaggtga

SEQ ID NO: 75147 - DNA, 108 bp, Glycine max
  Peptide Sequence Number=SeqID_166832
atgatgcagagaagcaaaacacacatagcagaaacacacagttgcgctttgcgtgccaacgtgacgtttgagtttaaaacactagtgcttagcctagccccacgctaa

SEQ ID NO: 75148 - DNA, 354 bp, Glycine max
  Peptide Sequence Number=SeqID_166833
atggggtacccatcacatgtggtacttggtggcggtcgggcgatggtgcaaaacaattctccacatccacaaatcacgtataaacccaccatcctctgttgcccacctccaactgagctcacgtactcccacgtagcccttatcctcgttcctctcaacgccgggtccccatcaatcctcccaagcttccacaacatccagaacccatgtgcactaccctttccacagccagccatacacaagcatttttctgcacttatgcaaaattctgctgcacatttccacagcaaaattctgcataaggtgcagatttcgaaaaccactcttgccttcatccaattttgcccaaattga

SEQ ID NO: 75149 - DNA, 285 bp, Glycine max
  Peptide Sequence Number=SeqID_166834
atggcggaaccatcgaagaagcacaaaggttcttcaagtagaagccaatggcattccgaggttcaggacactccaattccttcctccatttcctcatcctcatggttttcatcggaagaacaacgtatatggtacacaaacctcttctcctctcattctatcattgaccctaagttcatagatatggatttcttttctgatgagagtttcaaatgcattgaagcatttcaaaactcaaatctcattccctgtatgtctctaaaattgcctgtgtattctgaattg

SEQ ID NO: 75150 - DNA, 201 bp, Glycine max
  Peptide Sequence Number=SeqID_166835
atgtgggatgtagcatggaaaggcttgtcaaaaacatacatggacgaaatgactctgagaaagctttccgcgaagagatctaggagggacgccacggctgaagggaccagtgtcactcccgagtttgatagccactgtttcaggagcgccgagcaccagcaacgcttcgaggccatcaaaggatggtcgttcgttccatag

SEQ ID NO: 75151 - DNA, 594 bp, Glycine max
  Peptide Sequence Number=SeqID_166836
atggcagggagaagggtgcagatcatgcgcactagcatgacccccctgacacagacttggatgacattgctgctcagcaacatcctccccagcaatcataattccgacctccccctaccgaagtgccaactagtctatgccatcttgacccaggtgagtgttcatgtggcccagttgatatcagatgccatatatcaatttgtagggatcacacctcctagacacccagtggacccagagaagtccaacagagcactggggtttccggctttgatcacgggcctctgccaattttatggggtaccggttactcccaccaagcttatccggcctcctattaatagggccttcatagaaaaatattgcatgccaagccaggcagagcagcaaggtcaagcacaacagcaacaagaggagcatgtgactgaccggcagacggctaatcataggggtctggtgcaactgaatgagagcttttaccggtacaccttgcaccagcagagccaggaccctagccctttcccgtggcctacccccgagcagatcagggccacaattgcatggcttggagataggcccagcattcagataggg

SEQ ID NO: 75152 - DNA, 507 bp, Glycine max
  Peptide Sequence Number=SeqID_166837
gaagttttcgtaagtctcaactgtgaattgagtgtcgttgtctgttacaatggtgtatgggaggtcatacctgcagatgaggtatttgattgctcctggggcctttggcaatggtcccaatatgtccgtaccccacatggcgaagggccaagtggagctcaaactttggagattgtcaggaggagtatgtggcacatctgtaaactcttggcattgtttgcatctcttggtaaagtcgagggcgtctgccctgagtgttggccagtagtagtcggctcgcaccactttggtggcaagggagcatcctccagtgtggagaccgcaaatcccttcatgaagttatcttatgacatactcgccatcaaggatgacgtagtaactggccttctgtttgaggcatcgggattcgtcctccgtttcttggttgatagtcttgaggtgtccggccttcttggtgctagccagcttggagagcaggtctgctatggtattgctttccttggggat

SEQ ID NO: 75153 - DNA, 387 bp, Glycine max
  Peptide Sequence Number=SeqID_166838
atggttgctggaaatacaacaatagaaaagcctagggaagattggagtgaggaagaaagaagactagtacaatataacttaaaagccaaaaacatgattacatctaccctaggaatggatgaatactttagggtatcaaactgtaaaagtgaaaaggatatgtgggataccttacaaaaaaagaagggaattgctcttaaagcttcatcttcaatccaagaagaaagtgataaggaagacttaattgatttgaatgaagatgatgatcttagcctttttttaaaaaggttcaacaagttcctgaaaatcagaggaaatcaaaggataccaaattttaaacctaagagaaggacagaagattcatcctctactccaaaatgcttttga

SEQ ID NO: 75154 - DNA, 228 bp, Glycine max
  Peptide Sequence Number=SeqID_166839
atggaagaggcagagaaggagatcttggaaacatttagcaaagtagagtcaactgatgtggtaattcatttagctaatagaagtgttgcctatcctgttggtttcatagaggatgtcttagttagagttggtgaactgattttccctgttgatttttatattttgaatatggaggaggaattttctcaaggatcagttcccatcattctaggtagacctccctcctga

SEQ ID NO: 75155 - DNA, 261 bp, Glycine max
  Peptide Sequence Number=SeqID_166840
atgctgaagtcggactccaacggaccccagcgatcacgaaccccgacgacggtcacgaaccccagcgacgatgatggtgtggaggagaccacagtgacaggtcttcacgtagttgtaaaacgtgtggggcaggtgaggcatccaagtggtttgactctatgttataatggagagttggagtgggagacaaattcaagttttgggaggatacatggaacaggaacagtccttagcgatcaaattcccaagaatttatcttaa

SEQ ID NO: 75156 - DNA, 780 bp, Glycine max
  Peptide Sequence Number=SeqID_166841
atgaccaaagcaacacattatcacaatgaaagcgacgatgtatccgttgtagatttcaataacctgacccaaatcatcaataaccttgggaaaacttttgagaaattaggaccaaagaattttacaccaaaatataacgataaaatagcttccttaggaactatccttccggtcctgggaatgcttttcggaacaataaaaccgcagaaatatgaatctgcacctgtgtattcaggagatgttattgatttcttttcctacataaaagactattccaattattatgtacaaagccttgttactgagtatggttcgctgaaagtacttgcatggctttgcgttgtcactgcttttatgtttctcttaagaaatgcgttccgttatttcggatcttttcttttaattaattaccgggtgggagttaccaaggatctccgtggtgcgatgtaccgcaaaatactttcattgcctgtgtcattctttaccgaaagcagaaaaggtgatctgatgtcccgtatgtccaatgatgtcggtgaagtggaaggtaatatcttaggtagtttaattgacctgatcaatgcaccgtttatgctgatcagtactttgatcacccttttctttttaagccctgaaatgacacttttttcattacttattttaccggtaatgggaacaatgatcgctttaatcggaaaaagccttaaaaaagactctcatgaggctcagcatgaattaggaaatatattctctatcgtggatgagacccttaaatcatcaaag

SEQ ID NO: 75157 - DNA, 303 bp, Glycine max
  Peptide Sequence Number=SeqID_166842
atggtgactgcaaagtgtgttatggacatgggaaagggcaacttagagatgagtgtggaagaccagaaagccaccttcaacttgtttgaggcaaatgagcatcccgagcctccaccatctctccctccagcagccggtgatgacaccagaggcattctagcccaggttgcttggccaagagtccaacttccttcttttagggggggtgacacctttggtgttgctaatgatgatgttgcagatgttgaagctgatgatgattatgttgtggacatcagtgatgctacagagcttgggatctaa

SEQ ID NO: 75158 - DNA, 750 bp, Glycine max
  Peptide Sequence Number=SeqID_166843
atgaatgtaggagctctcatctctggccagatcacatctatggcccagtctaactcctctagacttgggttccctactcttatcacaactctatgtaggtctagaggggttgcttctgacagcctagtctttgaacgcttgagcccggtcattaacttggcctatatcaggaagaactgctggaaccctgatgatctgacagttactattaaaggggctaggagagcgagggcaaggctagctgaggctccttccacatctgcaactcctcctccagcacgtaccttagcagctccttctaccccatcttctacagactctcaacatcttgaagccatgcttcgaagcatacatcaggggcatattgttttattacaaagtttacagctggtagcacctccagactctatcccttctattgaacagtttaatgaatgggtaccacagccgagggaggatgagtcatccgagacttctactctaaagcccctaattagaaggaagagggtagttgaaacacaagaagctacaaccacttctaagaaatctcttgagaccacttctgagcctttagaaccaatgctagagacaacttcaattcaacaggcagtagacccctccactcccgaggatcagactacaccagtcctgtctccgaacacctctcctttagctacccctgtgcttcacttaacagatgaggaggatgttcagacacaggatactcaggacagatcacaggatttttaa

SEQ ID NO: 75159 - DNA, 279 bp, Glycine max
  Peptide Sequence Number=SeqID_166844
atgtataatagtataataacctatattggtctccactgcagtgcacattggcaaatggtcatcattttgcctaaggaaaatgttgtcatctggttttgttcattgcatactaggccagacaactacctcaaaggaataattaacagtgctttgaaggacttgacgatactccacaaagtaaatccaaggctggtgctaggtggattgttgttaaatgtaatagacaaaaaggaagcaccgagtgtgggtattacgtcatgcactggatgtcaactataa

SEQ ID NO: 75160 - DNA, 1710 bp, Glycine max
  Peptide Sequence Number=SeqID_166845
atgatcgccgggatccgcgccattatcgcttcgatgctgcaatcctttaatccggatcagctggaagaggaagcacgccaggcgggatcgctgtcgcgcctcggcctgccgggcagccgcaaagctgcgctgtgggagcattttgttgagcgctacggcgagacggcgggcgagattgaggacgatttccataccctgttcggcgaagctttcctgcatgcctacgacctggaaggcgatcgcgccagcaatcaggatcaaaccggtgaggtaatcggcgaacgctcagcctgcttcgtggtgtgcgacggcgtagcaggatttcccggcggcgacgtggccgcccgcatcgcgcgcagcagcctgatggaggcgttcgacggtaacgcgcacctggatgcgcagtcgattcgcaactacgtcaaccacgcgaatcacgcgattcgtcagcagcagaaagccagcagcgagcacagccgcatgggcaccacgctggtcagcctgtttgtcgaccgcgactacgagctggcctactgggcgcacgcgggcgatagccggctgtatctgtttcgccgcggctacctctatcacgtgactaccgaccacagcctggtgcagcagatgaaagatgccggccaccagaccgaaggtatcaacagtaacctgctctattttgccctcggcatgggcgatgagcagcgcgacgccagctacagcgatgtggtggaaatagaagacggcgacgcctttttactgtgcaccgatggcttctggcacggcgtgacgctggagcagatgcagcagtcgctgcacatggtcaatacgccggaagagtggctgacgctgatgcagcaaatcatccgcaacttcagccggttaacggtcagcaggataacttcagcgcgctggccgtctggattggctcaccgcaggacaccaccttactgcactcgctgtccgaagcggcgcagtttttccctcttcgagattgagaacgccaacatgaaacatggattactgggtctggctgcgctgctgctcagcacgcacgcatttgctgagaactatcgcatcgtgcagtccccggcacagaaactggatgtctggattgatgacgtgaaagataaccagctggcgagctggtgtaagcgcaatgttgatctgcgcatcgtcacccacggcgctaaaaacgtcgcggcgctggaggattttctgccgcgcgtcgccgggctgatggcatcgcagtgtaaagcgctgcagcagctcaactggacgctcaatgatgatgacggcaacccgatcgccagcggcagcgctgccaaagcgcagcagtggcaaacggtggtaacgccgccgcccgcgcccgtgcagcagccagagaccgctgcggttgcccctgccgcgccggtgctcaactcgccgcaggccgataccacgccgtggctgcagttcagcctgctcgacggctgtcacttccgtacctggtggcagcatccggcgcagaccagcgcgctgttcgtgccgtcaaaacaggggctgagctgcggtcaggatggctggctgagcggccgcagcagcctgacgcagatgggcaacggcgcggcgaaaagcgtagtggtgacgttcctgcagggcttcccgattgctggcctgaataataaacagcagagcgccgagctcagcatcactaccgtcaacagcgaacgcatg

SEQ ID NO: 75161 - DNA, 761 bp, Glycine max
  Peptide Sequence Number=SeqID_166846
acgttggtggcgactctgcgcattttcctcccttggaagacgcacctgtgagcctcacgtcaccctcccgccgaagggtaggttgcgacactcctgttcctatacccactaatgaggtttccttagtggggcaggcaattcacaccttccttgcttggccgacacatctgcctgttctgtctccggcaaaaccacctcaaaagctggatccggaggtcaatgatccgctttatctgatgacattgaccatcctagagcttttcttgaggccttaccaggttacatgggatgccaccgtgttgggggtctttaatccagacttcccgctctacataaagcatgaagacctctctgaaatcgcactcggtggtcaatgtcttagcatatcagtgcatctgactgaaacaagtatgcgagcggggaattctgatatcaatggattccttgagccacagtccattcagaggtgtgggcaatcgcaatttgagactggaagccagacaactacctttaaggggatcattaacagtgctttaaaaggtcttgatgatgctctacaatctaaatcaaaggcttctgctaggtggattgtcgtcaagtgtaatagacaaaaaggaagtactgagtgcggctattatgtcatgcactggatgtccaccatcattttaggaagtttcaagaataactgggaagcgaccgttagagccagagagattaaaggcgctgcaaatccagtgggcacaatattatctccgagttag

SEQ ID NO: 75162 - DNA, 156 bp, Glycine max
  Peptide Sequence Number=SeqID_166847
atgtcaaaaggggtacggaaagaaagtgagggaggagcttgccactcagctcgcccaggcgagctaggttgcttcctccagaaggcaccgccttctagggaacttcctggaaggcccaagtgggcctggttgctatttgcaccccctggttactaa

SEQ ID NO: 75163 - DNA, 267 bp, Glycine max
  Peptide Sequence Number=SeqID_166848
atgacgggagtcatggttttaaatagaggtcaacaacccaaattggggccacatcaatcgcatttttttgcagttgctcgcaatgtaaaggttttctggctgacagcaactgcaaccgcaattttaaaccatgacaggagtctttggggattcggaaattcagatgttttgaagaaagcctccctttggtggagagatttggcaaagctcgagagcattggtgttgtaccgacgaatctagagagagacgagcaagggcttgagtag

SEQ ID NO: 75164 - DNA, 213 bp, Glycine max
  Peptide Sequence Number=SeqID_166849
atggactcaagcgatgcacttaatgggatgacccttcgctcagcgcaaatgcacagctcatccttcttccagattcttccttgcgctcagccgtggagtgttgcgctcaacggatggctcgctaagccagaagattggcttagcgagaggatgaaaatcaacacttcacaaacttacctaattaatctaaaattgagaggaaatgattattaa

SEQ ID NO: 75165 - DNA, 378 bp, Glycine max
  Peptide Sequence Number=SeqID_166850
atggatcattttaaggtccaacgccttaaaaggaccaccttccaagtgttaataccttccttaaacgtaaatacaactcccgaatctggaatattcttcatgactagtttccttcggtttttccgacgttttccacaaataaacgttggtggcgactccgcgcattttactcctttgggagacgcacccgtgagcctcgcctcactcacccgcaaaaggtttttcctagaacttgaaatcattcagaaagataataggattttcatccatcaagagaaatatacaaaagacctactaaaaaggttcagaatagatgaagccaaacctatggcaacccatatgcatccttccacagtcattgacaaggatgagaaatga

SEQ ID NO: 75166 - DNA, 462 bp, Glycine max
  Peptide Sequence Number=SeqID_166851
atggtgggttatcctttcacttggtcgagtagcaagggtattgttaatggtgtggaagagagactcgatcgtgccatggaagatgttgaggagatggtaaaaggtagttggaacaattctagtaaggttgattttagcgctgatgagagagaagttgtggttagaagatttttggatgactatgttgcaacatctgggaaatatatcaatctacagaaatctgaagtcactattagtaggaatgttgatcaaggagcaaaaaaggctatttttaacttcatcaaggataagcacaagggtcatctagtgattcgaacaccacctataaatgacttggagaatttgaaagtgagagttttgatgtataaagaggctttgtgttggaactacacactccacgagcaaattttgaaagtggaggatgttaaggctattaggtctagaagatcccatgatcactag

SEQ ID NO: 75167 - DNA, 1176 bp, Glycine max
  Peptide Sequence Number=SeqID_166852
atggcacctttagtttccacagctcctcaaagttggatgattctaacttcctactatggaggcaacaggcagattgtgaagttggaaataaaaatccagcatacaccgattgggaacaacaagatcagattcttttatcattctattcttccacatgaacatcttgacgggattcttaaaggcctaccaaaggagtacggtccagtgatcgaaagtatgtttgaaccgctttcgattggagaagtagaggcactgctgctcgtacatgaggcacgcatgaaaaaatttcagaagcgcttcgctgattcaccatcggttaatgttgctcaagtttacaattcatcttcgaatcttacaattcatcctcgaataatttcagttcacaaaatcgatccaattattctggaaatcgtggtgacttcaatcgtggcagtggctacattcatggaggcaatgattttgaccacagcggtggctacagtcgaggaggcaatggctttggccgtgctggaggtcgtcgtggaggcggcagaggctgcggtcattatgcaaatttttagtgctaagtttgcttcaaattgggtcacacagcagcagtgtcatttttgcaatgactctaattttcagccaaacgcatctctcatgcagatggaaccagtgtttcaaagcaattcttcaaacacctttggttcagaacagaatcagggaactaatactcacaaagactcccaacctagtgcaatgctagttgattctgaaaatcaagatcctaactctactacttggatacctgattcgggtgcatcattccacgtaactggagagtctcaaaacatccagcagcttggtccatttgagggaccagatcaaatatacatagataatggccaaggcctttctattaagtcttctggttacacaaaggaaccaatgaagtcctacttcaaggttcactgggtcctgatggcctctacatattttcacatcttgcactcagattctacctcagccacctgcttactttcaagttccagtccaaagaatgaaaattgcatcttcaaagactttgtttgcatcgaaagaggcattagagaatactatgctattccttgtcttccaaatggaccagctccttttatatttatccatgacatagcttcgcaccataaaggttga

SEQ ID NO: 75168 - DNA, 379 bp, Glycine max
  Peptide Sequence Number=SeqID_166853
gacaattgttagcactgccacacctcttgggcttgaggttattcctcaagtaaaggtgtttttggatgagggtttggtttgtattgttaggcaccaaatccctaagataggtggtatgatgaatgtgttgagtggtgcaaacctcttttgtaaaatcacccatgcacccaacatcttcatgattcacgtacatagggaatttttaggggttcctatggaacctaagagaataaagggaagaagcccagagtttcaagaatatctaagtatgagcccaagggaattggatataagactccaagaagattggaccaaagattctggagaagtccctagggttctcatgagccttagggtagattttgagcccatgggctaa

SEQ ID NO: 75169 - DNA, 432 bp, Glycine max
  Peptide Sequence Number=SeqID_166854
atgactgttgcagacaatattaagataactcttcctaagaccgataatactaaaatgtttatggggttagtgggagaacactctcaaacaactgataagtctcttgcagggacattaatgagtacacggactatcatgaagtttgatggttcacatactacacatgagcttgtcattgagatggcaaattttattctgaactcactatcatctgagtatgatccgttccaaatgagctataataccatgaaagataaatggcatacgcatgaattgcacaatatgttagttcaggaagaaacaaggcttaagaatcaaggaagtcactcggtctattatgtaagccaccaagggaatcaaggagctggaaggaagaagcatgataaaggcttaggaccattaaagatcaatgacgatcctgtgcaaatctag

SEQ ID NO: 75170 - DNA, 156 bp, Glycine max
  Peptide Sequence Number=SeqID_166855
atggctacaccaatgagtactgcttgctatttagataaagatgaaactgatcagtcaatagatgttaagcaatatcaagagtcatacccaaatcaaataaacattaaaatgcagtatctaggaagtgatcctaggtcgtctcccggtgagcaatga

SEQ ID NO: 75171 - DNA, 255 bp, Glycine max
  Peptide Sequence Number=SeqID_166856
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagcaagcaacggtggctcgtggtggcaaccagtggtcatgggtggtggagaagaaggtgttagggtttgggtggtcgtttggagaggagaagagtga

SEQ ID NO: 75172 - DNA, 120 bp, Glycine max
  Peptide Sequence Number=SeqID_166857
atggtgattcgttctcagttcttcatacggatgaacccacctttttctcgatcgtcgttgcagtgcatagggggattgtctggtcagatgatccgttcttcaaaaagagaaggaaactaa

SEQ ID NO: 75173 - DNA, 304 bp, Glycine max
  Peptide Sequence Number=SeqID_166858
aacttgtaaatggcttttgcaagatagtggaactctcaagcgggtttcttggggactggatataggcacaagggcaatagatttaaatgtctgggatgcaatagaagtagggccttatattcccaccatggttgctggaaatacaacaatagaaaagcctagggaagattggagtgaggaagaaagaagactagtacaatacaacttaaaagccaaaaacataattacatctgccctaggaatggatgactactttagggtatcaaactgtaaaagtgcaaaggatatgtgggatactctacaa

SEQ ID NO: 75174 - DNA, 510 bp, Glycine max
  Peptide Sequence Number=SeqID_166859
atgttatcttcaatgagcttaaatatcctttcaatgatccttttccacctttatctaactgtcacttcttctaagagtgattttctacctactgctcatattcctcttgtcttaccttcccataatgaactcactcattcttctcaacatgccaaaactaattttacttctgtaagtgctgatccctctagatcccttaatactgaattccctaattctcaaaatgtcacatcacttctcctctttcaaatgctgaaccaaattttgttactaatgaacactctaacacagtttttgactaacaaaaatccaagtgcattgtctggtacctcttcttctcagtctcacactgtcagttctccttataatcctgttcttccctctcaaaatgtccatcctgtgcaaaccagatccaagtctggaattcatcaatctaggctgcatccttcactgtttttggcacattgtgaacctaagactgttgaagaggctcttgctgaccctcaatga

SEQ ID NO: 75175 - DNA, 255 bp, Glycine max
  Peptide Sequence Number=SeqID_166860
atgacgaagaacggtggaaaatcctcgcggaatcacccacggaaacgtctcggacgcgttacggaagcgcctcggcttggattttcttcatggaaacaatttttctcagtaattttaaggaaaagagggagaagcttgccacccagctcgcccaagcgagctaggttgcttcctccagaaggcaccgccttctggtggaacttcctggaaggcccaagtgggcctagttgctatttgcaaccccttgtttactaa

SEQ ID NO: 75176 - DNA, 375 bp, Glycine max
  Peptide Sequence Number=SeqID_166861
atgaccggccctctcgatgagtcgatctcttgctttctcataagggtggacccttgcgtactagtacctatcacctatagaagactacacgtcctcgccatcaaaggactacacgtcctcgccatcaaagggctgtacgccctcaccttcaaaggactacacgtcctcaccttcagagggctgcacgttgtcgcaacctaccctttggcgggagggcgacgcgtgactcgcgggtgcgtcttccaagaacggaaaatgcgcggagtcgccaccaacgtttattcgatgaaaatgtcggaaaaaccggaaaggtgtggtctacgaactttaagtgaaaggttcgggagttgtatttacgcacggggaaggtattag

SEQ ID NO: 75177 - DNA, 285 bp, Glycine max
  Peptide Sequence Number=SeqID_166862
atgcatcagggacaatcatcggaaccagtgcacctaggacataaacgtggccaagatcttaaggacaaacaaagatcagatttggacagaccagcaactggcaagtttgtcagtgatgtcaccggcaaaaaaggatatcacgcactgacaaaaggcctaggatcttcttcatcaatggattcctttgcttcttggaagatgaatgacagcgaaatggagaaggaagagaaagaggagacgccacttcaaggagaagatgagtctagaaaaagctcaccaccatag

SEQ ID NO: 75178 - DNA, 99 bp, Glycine max
  Peptide Sequence Number=SeqID_166863
atggatagttcatggctcatgtcgatctccccttcctccacctgtgatatgacagtattggtgatcaatggtgatagtggttgtgatggtagagactag

SEQ ID NO: 75179 - DNA, 852 bp, Glycine max
  Peptide Sequence Number=SeqID_166864
atggctagaagtctggggagaggggatggtgatgattctgacgtacccacggactcgcctgcgaactcgcctacgatactagaggcagaggctgctgtagctggggataagcccatggtagatgcagatgcacaagacatcggtccagagacaaacacacagaatattggtgcacaagatgctgcaaatgagcctgagggatttcctggtggacccaggaacccatcagtgcttacagagtatgctgaccatgttgcggccagtgtatggtctggacaggaacgtcctgagttgaagttatcctcccatgggaggaaggtgcataacttgggcaggcctattcctgcaattgaggacatggttgctgggacaggattaagtcctttgatcgcgtgttcaatagacaccggcgatcgaggacttatatcctccttttttgagaggtggcaccgggagacttctagttttcatcttcctgtgggagaggtttcgatcacgttggacgacgtcgtgtctcttctccatctgcctatcgttggcgcattccatgacttccaacctctacgcaccgacgaggcggtgctgctgttggttgagttactgatggtctcaacagaggtggccatggccgagataggccaatgtggtggaccatactccctgcgtgacctcactcttgctgggcggtatgcatggggagctgctggccgcatccatatgtacgatcagcttaatgatgccagtctcagcaccactcgacagctttctagttacatcaccttgttgcaatgttggatatatgagcactttccgtcagttgcggagtgcaatgctgatccagactatgactag

SEQ ID NO: 75180 - DNA, 319 bp, Glycine max
  Peptide Sequence Number=SeqID_166865
atggcccttgcaaaagaacttatgggtttttcctcatttgattctgcttcctacaaagtgtttctgcacaacaagcatggcaccttctggttcaatactatcttgcttccttcggataacacaagagttgtgaggttgaggaagggagcaaagtttccgatggcagctattagtgaggatttgataaagaccacactgacagtgcatgcagagaaaccagatttcaaagagactatcttgaagcatttggatgccatcaatgataggataggaacaagaaacattgtgctggagcttatgagcaccgagattgatccaa

SEQ ID NO: 75181 - DNA, 1572 bp, Glycine max
  Peptide Sequence Number=SeqID_166866
atgggggcgccggggattcccagtgcgggcatggtgaccatggtgatggtgctgcaaagtgtaggcttgcctgcagaagccattgcaattttattgccgatagaccgtttgctggatacggtccgtactactgtcaatgtagaagatatccctgttttatgcgcattggttaatgcggcttataggggcgagaccagtcgcgccggttggaccactgaagctgatctgctgaccggtgtgcgtaccagtgaacgtacgatacaggcgctgatggcgcgcgaggatgcctgtatcttgattggtgaagaggccggtggcgtgatggctgccagtatttgtcttgagcggcatcctgcgcaggaagataccgtccagtttggcatgattgccgtttcaccgctcttgcaaaaccgtggctacggtaaaaccatgatacgcgctgctgaaaagctggccatgtcgcaatgggccgaccggggagacgctgcctttcccacaccagccagatatgtggcaaccgcagcaattcaatcaatctactgttgtgatgatgaaccgaaaggcattgtggctggtcgccacatcgtgccgcgggctcctatgaaagaatctacccacccgtattacggcgccatgctggtgctgctgtcgtccatcgctttttcgtcaaaagcgattatggtcaagctcgcttacgtttaccatattgatgcagccaccttgattgcgctacgtatggcatttgccattccattttttgccggattgggctggtgggcaatgcgacaggggatgcctgcgtccatgacaggtaaggactggatgacactcgtgctgcttgcggtcctcggtggttatggttcaatgtggctcaactttgaagggctacgttatgtttctgccggattggaacgggtcatcttatttctttacccgacgctggtggtcgccatgagtgccatattcctgaagcaccagattacccgccgtgagtggtttgccatggtcaccagttatgccggtgtggtgatggtggtatggcatgacgttgaacttgctggtctggcatccaccgaaactttgtatggtgcatggttggtattactgagcgcagttgtgtacgcagcttacctactggtgagtggccaattgattcccaaattaggtgccagccggtttactgcgcttaccatgagcttggcggcattcgctagtgcgtgccatttcggtgcgagtgaatcgctcagcggagtcatgggcttgcctcatggggtgtatgccttggcttttttgatggcattgatcgctaccgtattaccttcggtactgatgaatatggggatacaccagctcggtagccgtaaagcgtcgttgattagcgcgataggcccggtgtcgaccatcgtcctcgcctacctgtttcttggagagagtctttcctggattcaagcgattgggacggcattggtactggcaggcgtcatggtgcgccgtgatgagcatctgcaaagtaatatattgaatatcttcaaagacttcgatgtcactgccttcaagttctataccgactga

SEQ ID NO: 75182 - DNA, 1104 bp, Glycine max
  Peptide Sequence Number=SeqID_166867
atgacgctgctgagtgacggcaaaacgcgcagccagacggtaaccttcctgcagggttatcccatcgccgatcttacgctgacccgcacgccgctggaggtggtagcggtgaacaaacagcgcatgattgtcacgcggcccgatgccagtgatagctggctggtgctgccgtttgatgctcagcagcacgtctggcgtttcagcggcacgctgctgattaaaatggataaaaacaccggcacggatagcgaagcggtgaaatcgcgggttgatagcttacgcggcatctggtcgccgcagtttatgccacagcaaaaagacgtgttcagagagctcactatgtcggcaaacgaaaatcatacccccaatgccctgcctgcgggctaccggtttaacgagtttgaaatcaaggaagtgatcgggggcggcggctttggcattgtctatcgcgcctgggatcatcagctggaacgcaccatcgccatcaaagagtacatgccggtgtcgctggcggtacgcggtgcggatctggcgctggaactgcgcggcgagcgcttccagaaactgtttaatgccggacgcaacagctttattcaggaggcacggctgctggcgcgtttcaatcatcccggtctgctgcacgtcctgcgcttctgggaagagaacggcacggcttacatgggcacgctctattacagcggcatgacgctgaaagagtggcagctcaccagcccggacagcattgacgaagcgtggattcgccgtctgttaccgccgctgtttggtgccatcaacaccattcacaccgccggttacctgcatcgtgatctttcgctcgataacattcagattcaggaaaatcagctgccggtgctgctcgactttggctcggcgcgcaaagagattggcaacctgtcggatgaaaccgagatcatgctcaagccgggcttcgcgccgattgagcagtacagcgaagagggagaagtcgagcagggaccctggaccgatatctacgcgctgggcgcggtgctgcatacgctgatcaccggccacgcgccgccggtcagcgtggtgcgctgcattgaagataactaccagccgctg

SEQ ID NO: 75183 - DNA, 314 bp, Glycine max
  Peptide Sequence Number=SeqID_166868
atggaggtcaacacagctacaattgttgccgcaagtatcgccactgaggtggacccgactcacccatctagcctcaatcaaagcaagcatcccctcccaccatatgacttgccttccaactatacaccacccaatgttgcgcacactcttgatgagaatgtcgataactccgcacccatacccattgagagacaacaaccccaatctgatcatgcatatgtctttcaacccatgggggagacacatgaagcacctcgagaccacaatctagctgacttcaagcctcaccacggatatgccgctgaagaccaggc

SEQ ID NO: 75184 - DNA, 306 bp, Glycine max
  Peptide Sequence Number=SeqID_166869
atgacgagtagtaagtgcagaggatctagttccacaccaatctgcttatcctatataagatataaacttagcgtacctacaatcgcgtgcttgattgccctcttgctttattactcgggaactagcttcgcacctcaccccgggaaactcaaagctttacttacctaccttatgactttcttcttttctgttagcacgcatccagtgaccgatgaatctgttgtcggaataagcgtaaacgcagcaagagaattcgcagcttttgtgccaaccttctcgcctagaaagaatcagggagtgaagtga

SEQ ID NO: 75185 - DNA, 1083 bp, Glycine max
  Peptide Sequence Number=SeqID_166870
ccgcttgccggtcggcagcgcgcagaaccagtcgctcagcctgccaaaaaacgaagcgcacaagctgaaggcgcagtacgtaatcaataccgcacggctggaagcgccgattggcaaagggcagaccgtcggcgagatccgcatcagcgacaatggccaggtggtgaaaaccctgccgctggtggcgctgcaggcggtgccgcagggcggcgtaacgggaacgttcacttcggccgggcggcggaagccagcttcgtcagccagccgaccctgtccatgcgattgaaaaatctggagaaagagctgggcgtttcgctgattaaccgcggcaaccatttcggcggttttaccgccgaaggcgagcgggtgctggcgtgggcgcgtgagatcgtctcggtctaccaggggctgaagctggaggtggagtcgctcaagcacggcttgcacggcacgctgcgccttggcgtggtgccgcagtgcagtatctcggtatcggaaatgctcaaggcggtcagcgcgcgttacccgcatctcgattaccggctggcggtgctgagcgccgatcaactgctggaggcgctgacggcgcataccgttgacatcggcatcggctttttcgagctgtcgaccttaaaggagctgcatttccaatcgcaaccgctggtggaaaccggcgtcgagctggtatttcatccgcaacacttccctaagctggtgggcgacacgccgttgccgctggaagcggtggccgctttgccgctgtgcctggccgagccgacgcgttatttccgccgctatctcgatcaacacttccgcgacgccgggttgacgctgcacacacggctggagacggcctcgatcttccaactgctggaggggattttcgtcggcctgggctgcgggctgttcccgcgcggccaactgcaatcgccactgatgccggcgttgcagcggcgcccggtggccatcggcgccatgccgcgtcatgcggcggtggtggtcgatatggcggagcgcgccacgccgttggcgcaaaaattcttcgacgccgccagcgagtggctgcgtcggcaaaatgaatag

SEQ ID NO: 75186 - DNA, 372 bp, Glycine max
  Peptide Sequence Number=SeqID_166871
atgaatgaaaaagtaaaggtgtgtctatggatgaatgctctcctagaacctaagcttttgaatcctagaaaaaccatgatttactggcagcccaacctcattacaagcctagaaactatctctagaatattttccattggatttaatgatgaaatttgttcaatttcagggagcagttgcgctcagctcaccatttgggctcagcgtgcatccatcactaagcgcagcttcaacgcgacagaagaatctggtagagcatcaatatcaaggtcgcgccctaagtgtgagatccgcttgctaagcacgatggttgtctttagccaggctcagtgcatgactagcactaagctcaaatccactaactcgcgctaa

SEQ ID NO: 75187 - DNA, 468 bp, Glycine max
  Peptide Sequence Number=SeqID_166872
atggttaggactagaggattaggtcgtgccttaggtcaggttactagcagaggtgtgggcagaggagatcgtgatgattccgatgatgctcggcagcgtcgatggcctactgcatccgcacggaggcagcgagtcgttgtgactgcggatcacatcgatgagtcagtcatccctgcgccagatgttcaggatgacacaatggaggcaccagctgctgtggaggacattcctgcagacgcaggtgcagaggcggctgaggatcagcctcagggatttccgggtggtccgagcgacccatctgtgttgacagcgtatgcggctcacgttgcttgcagcgtatggacgggagaggagcgtcctgaattgaagctatcctctcatgggaggaaggtccacagtttaggcagacaccggcgatcggggacttttgtccgcgtttgtggagcgatggcaccgggagacgtctag

SEQ ID NO: 75188 - DNA, 1221 bp, Glycine max
  Peptide Sequence Number=SeqID_166873
atgcagctcaacggagaagagcagggcgcctttgatcgctggtatcgtcagcaaccggaatgttcactggattcagcggcacactgtgccgatggcgcggtgtatccgcagcgcgcgctgtttggccgctatctggctcagcagtttgtcgccgccgctgaggcgcatccgcatgtcactctgcgtcacgttcaggcgcgtgcgctggcatgggaagggcaacaactgctgttgagtaacggtgaaaccctgactggcgacatcctggcactggccatcagccatccaccgccgtcgctgccacgcatgctacagccgtttgccgaccatccggcgctgattgccaacccgtggcagccaggcgtgctggatagcgttgagcctgacgcatcggtggcgattgtcggcaccggcctgagcatggctgacgtggtggcttcgctggcgacgcgtcagcatcaggggccgctgctggcgttctcacggcgcggacaactgtcacgcgccaatctcagcggcgaatggccggagtggacactggccacgcaacctcagcccagcgcgcgtcgctggctgcggcatattcgtgatgaagtcgctcgcgctgccgcgcagcagctgccgtggcagcgtgtgcttgatgaggtgcgtgtgcaggggcaagccatctggcagtcacttccgctacatgaacagcagcgctttgcgcgtcatctgcgttcatggtgggatgtgcatcgctatcgcattgccccgcaggtcgccgccgtcatcgcccggcgacagcagcaaggtagtctgcaggtattggccgctcgcctcgtggcgattcacgctcacccgcagcagctggaaatcaccctgcgtcagcgcgatggcacccggcaaaaccatgtgctggataaactgattgtcacgaccggaccgggacatgaagcgctgacgaccagccagccgctgctgcaatcgctcagcgagcagggcctgatccgcgccgatgcgctcggcttcggcattgatgtggatgatcgctcgcgcaccctcaaccggcacggccagcccaacgcacgcctgtttgtcgtgggcccggcggcgcgcgcccgctttggcgagctgatggggttgccgcaggtggccgatcacgcggccgccgtagcggatgaaattcttaaggtattgcctgtcgctcacgctgagcgatgtcccccttccgcctcctga

SEQ ID NO: 75189 - DNA, 198 bp, Glycine max
  Peptide Sequence Number=SeqID_166874
atgaatctgatcaagccctttattttgctttgttttctgtatggggtgatcctcatcgctgcggtggtggctggtgagccatggaaagatgaggaaaaaggaacaaacggaattcacgaagaatttagtggatgcgatgaagtgcagggaatccgtaagtatttccttttctcttctcatgtttccttttataacaag

SEQ ID NO: 75190 - DNA, 1281 bp, Glycine max
  Peptide Sequence Number=SeqID_166875
atattctcgcaattgttgatcttcggaggagtcctctttccgaatgtggatgggttggtggacctagcagcgatcgacgcttttctcgcctatcataaccacaaggaaaacccggttgtcgctatgctagccgacctatatgacaccttcgaccgaagatgcgagaagagcagtacaaggattgtttgctgtactccagctctttatgtatggttggtttcgcacctttttcgccaagaggtaaggcatgcttgcccgctagaaagtcaccgctcatgcacagagaaaggaggggcaaattgggaccaactcttatcaagcaaagaaggagcgtctgtcaactggttccctcgatggaaagaaggaagaaacggagttcttatttcgtgcggaggatttccaaatgttcacttgatggggacgagaggttgcatcagttacaatcctgttcttcctataaggcaacttggttaccctatgagaggggcaccactagaggaagagctcgcacctgtcatttcacgaggtttcgataagaccaacatggagacacttcagaaggtccacaaggcatgggaggtggtgcaaaagaaggacaaagaactcaggggcaaggaagacaaagaggtgcagacccttagggcggaactcgagcaagcccaaacaatcaaagaaaggtttaaatcagcatctctgaaaattcgaaaggagaatgccgaactgagagatataaatgtggctaccaccaaagccttggaacaagaaaccaagagggctcgtaaggaagaacacggccggaacaagttccgaggggctttgtggggcagtaacagcgagcttaagcttcggagagaggaaagggaccaatcacgagtagacagtttgatcttgaaagatgagttgaaggcttgctcgagttccaagagaagtttgtctcagcggttatgcgagacagagaccaacatgttagctatcatcaccaagtaccaagaagaactaaatctagccatggcccacgagcatagagtggcggacgagtatgcccaagtgtacgtggaaaaggaggctagaggaagggtgattgactcgctacatcaagaggcaacgatgtggatggaccgattttcccttaccttgaacgggagtcaagagcttccccgattactagccaaggccaaggcaatggaggatacctactccgcccccgaggagatccacggacttctcggctattgtcaacatatgatagatttaatgtcccatacaattagaaaccgctag

SEQ ID NO: 75191 - DNA, 183 bp, Glycine max
  Peptide Sequence Number=SeqID_166876
atgtggaccatcacggctttcgaagaagttacgaaaactcacggattgcgaaaaacacctcctttcgatttccgtcacattacggaattttcacggatcgcgtctcgggacttcacatattgtgcaccaaagggtgccaagaatctcgaagcggccaatcaaaggttgtatatcatcaaataa

SEQ ID NO: 75192 - DNA, 216 bp, Glycine max
  Peptide Sequence Number=SeqID_166877
atggattccttttcttcttggaagatgaatggtagcgaaatggagaaggaagagagaaaggagacgccacttcaaggagaagtgagcctagaagaagctcaccaccataggaggccatggataagagcttggaggaagaaggagacgaatgaagggagagggagagaagagcacggaatttggtgttctaaaagagctctgaaatctgaagtttaa

SEQ ID NO: 75193 - DNA, 978 bp, Glycine max
  Peptide Sequence Number=SeqID_166878
atgagtcccgcgtcgccctcccgccaaagggtaagttgtgacattgccgcctccacttccaccattccaccactattatcatcgccaccactaccaacaccactgctatcaccaccacaccctgccactacctccaccaccatcattccatcacaactattgtcaccaacaacaacattgttaccgccaccatcaccaccattggcacaaccaccaccaccattgtcgtcgcccccattgttgttgtcaatgttgctgccactgtttcaccccaccaaactcattcctaccaccattattccaccactattaccgtcactgtcacgattccaccaccacctccacctccgtcgtcaccactattccaccctcactaccgtcgtcgctgtggggaagaagatatcatcaggggcacgacgccctatcaaaggagcatgcaaatatccatacgatggagaatggcagatccagggaataactccaaatgtggcattgttgggaagcattcagaaaaaggaaagcaatgatgggtttagggaggttccaattctgtctattgaaaattgggatgagaatttcaaggagctcaaatgtagggtaaaggactcctctacaacggagtcaggagctatttgcatgcaaaggacttccagaataggcgacggtaacctctcaaccgattatgataagcacaacctttgtaatcatgagacatgcacaacatcttcttctaggggtgggcattgtccatccacttctaaggaggctttgtggctgaaggatgattctatggtggcagacaaattgtgtgagataggtaaggtgatgtcataccctaatttcgtctggagaccatccattgttgggatgcggcccttgtttgaccacttcgaggtacatggcacccatcgttgggcaattcgtgaagttccgtggcatgtcggaagtcaaaagaaagcattgttgcacaacccgtga

SEQ ID NO: 75194 - DNA, 172 bp, Glycine max
  Peptide Sequence Number=SeqID_166879
gagaatgacagatctcatccagcacaagttgctgcagcccagatacgcacactgctatataaacatgaaggctgcacgggtttgattaccaaccaccttgatgttactctaacatcaagtgttggacctgagtgtgtagagttgatctctattgttcagagagcaatctctg

SEQ ID NO: 75195 - DNA, 405 bp, Glycine max
  Peptide Sequence Number=SeqID_166880
cttgagaggattgatggggacccggtgttgagagaaacgaggatatgggctacgtgggagtacgctgagctcagttggaggtgggcaacaggggatggtgggtttatgcgcgcattgtggatgtggaaaaacttgttgtgcaccatcgcccgaccgccacctagtaccacatgtgatggggtgaaacttcctgcttttattgttgaccacagagtggtacctggagatatgtcgcgggggtcaggagaccttggggacgtcaggcgagctcctggcagtcaacagataaaaggaaaacaagaccacaaagcaaggaggcttgtgggggctaagatggtctctggtaatcgattaccaggggatgtaatcgattaccaggctttgaaaacgaggtcaggaagctaa

SEQ ID NO: 75196 - DNA, 97 bp, Glycine max
  Peptide Sequence Number=SeqID_166881
gacgacgcgaggctcacgggtgcgtcttccattggaggaaaatgcgcagaatcgccaccaacgtttattcgaggaaaacgttggagaaaccagaaag

SEQ ID NO: 75197 - DNA, 183 bp, Glycine max
  Peptide Sequence Number=SeqID_166882
atggagaacttccctgtgatcaacttggagaatatcaatggtgaggagagaaagactgatgcaatcctccctaggaagggaccaatcactagaaccatgagcaagaggctccaagaagattgggctagagctgctgaagaaggccctagggttctcatgaaccttaggggctccatattgtag

SEQ ID NO: 75198 - DNA, 876 bp, Glycine max
  Peptide Sequence Number=SeqID_166883
atgactggccctctcgatgagtcgatctcttgctttctcataaggttggacccttgggtactagtacctatcaccttcagaggattgtacgtcctcgccttcagaggactacacgtcctcacctttagagggccacacgccctcgccttcagaggactacatgtcctcaccttcagaggactacatgtcctcgccttcaaatggtcatgtaccttcaccttcagaggactacacgtcctcgcctccagaggaatacatgtcctcgccttcagaggagtacacgccctcgccttcagaggactacacgccctcgccttcagaggactacacgtcctcgccttcaaagggtcatgtaccttcgccttcagtggactacacgtcctcgcctccagaggactacatgtcctcgccttcagaggactacacgtcctcgccttcagagggccacacgccctcgccttcagaggactacatgtcctcacctccaaaggactacacgtcctcgccatcaaagggtcatgtaccttcacctttgtagggctacacgccctcaccttcagaggactacacatcctcgcctttagaggactacacgtcctcgccatcagaggactacacgtccccacctttagagggctacaagccttcgcctttaaaggactacatgtctcccttttcaaagggctacacgccctcgcccttagagggcgacacgccctcacctttagaggactacacgtcctcgccatcataggactacactccttcgccttcaaaaggcgacacgtcctgaacttcagagggctgcacgccctcgcctttagagggctgcgcgtgctcacttttagtgggctccatatccacaccttaagataa

SEQ ID NO: 75199 - DNA, 297 bp, Glycine max
  Peptide Sequence Number=SeqID_166884
atggaagaggtttccttgtatcagttgtatgagagagtgaggataatatatgttggccgcttgaacctccgaccttgcaatactggtcataaatctccactatataaacaaaatgttaacctagagcagcttttacaaaacacttctgcccctttttcttttctgacgcacaagaaccctaacagagcaaccagaggaggagctctagagagcaccagagacgccaccattgctaacagagaacatttaagcgactacctcgaagtaagggatgagttactcacgcttggggattag

SEQ ID NO: 75200 - DNA, 1062 bp, Glycine max
  Peptide Sequence Number=SeqID_166885
atgaacaggccagatccttgtctgcaagatttgagggataaaattttcccattagaagaacaaaatgcttcagtcaagttgaacatcaacagaaagaagaattctccatctttgttaaaaaacaatacaaaaatagacaaagctgcttcaaaacctgataaagcagaagatgaaaagcgtggtgaagtagaagctctggaagaagtttctagttatacaataggatccgcaagaagagccaaagctgcagctagattaaaatttactcgctctgcaccacctccttcttgtcaacttgacaaagtagggggagaagaaaagaaagatggtggtcttcccccaggtgaaacttccaacggaagtctcaaaatcaaaattccgaattcttcgaaagcaaattcaagtcaacaaccagagaccaacaagagggacaattctgagcttaggaatgaaatggctgatatgtttgagccattaaattccctggtggaacctggaagcaaaaagcctcgtaaaaagtccaccatgcaagaaaatactgtcactccaatagtgcgctcccatgacaatgctgctgatcaaaatgaatcaactccttcaaactcagattcagtccaacaccaaaggcctctgagaactcaagagaaaacattcagaatctctgaggacttgaattttcctgcacaacctgagattggttccaacatcaaaagcaacaaagaatttggtccaatatggttctgcttggttgctgcagaagagaagaaagcaagtgcacgattgccacagttatcctccagctacctaagggtcaaggatggtagtgtaactgtttcctatattaaaaagtatctcgtgaagaagcttggtcttggtagcgaagcagaggtggagatcacattacaaggtcgggcacttttatcttcattgcaactacgaaatttagtagatatgtggttgcaaacagtgccaaagaatgggattcaggcatctgttggaagctcagccaaggattttattatggtcctttcatatggtcgaaaggcttgtgacacctcataa

SEQ ID NO: 75201 - DNA, 513 bp, Glycine max
  Peptide Sequence Number=SeqID_166886
atggctcgtctaaggctaggaaagaagtttgatcctgccaagaagacttggaagagaatctccaacaaagtgcaatcaaaagttcacaaactctacattccgaaagccatagaagccaccttcaaacgcctcatcaccatcttgcacacccttccttacctcattccctcaagggatcgtcgctctctctcttcgaagaagaacatatcttccgtacgcatagataacctcttttgtcatgagccttcttgttcttgttcttgttcttcttctgtgatgaatgtgcatgcacatgcacatcaagaggaaagaagcagaggcaaagaggtgatgattgacaatggtatcatggatactatagaggatgcatggaaggctttggttgctaagacaaacgagatgcaggtggatcagaaggcagaggaattcatttccaagttccgtgaagaaatgaggcttcagaaagagaggtctttgcaggaatttatggaaatgctagcccgaggttgctga

SEQ ID NO: 75202 - DNA, 813 bp, Glycine max
  Peptide Sequence Number=SeqID_166887
atgcccatgaatatgaacaacatttttaacaatagcaatcagccaagttttttcaactctggacaagaccctcaccagaacaaccaaaatggttttaggtgtagattgtgcaaccatgttttccctagctaccaagcactcaaagcccattttgagtctcattttactctagaaaaccctgccattagaaatctattttcatcaagtcatgccaactctcaaagagaaatgattcccaaccctttgcagcccaattttcccaggccaatggtgatgcaggaaacaagaaactttgtcaacaggaatttccaggcaccaccacaacaacctatggtcatgcctcaatatagagcaaacctatttccttgtgctatccagcataatgttgctgcttcacaaccacttcaaggtccaccagagccacaggctacacaatttgtcaataataatgttgaaatggctcaattgcttgctccaccagcaatccaccaaatggagatggagcgttgtccgtcgttgcacaaatcgcacccgattgccctgaaatttgatgcgtcgtcgaccaagatccaacccaactgcagaacatcgtcacaagatccagatctggaggcgtttcgatatttcgatttttctttctgttgcattttgagatccagatctcttgttgttattgttgtgccatcggaaaaaaatgaaacaccgtcgtcccacggcggcacacggtggtcacagcgccgatggggtaagaaagaggaagatgaatccatggagggttaccgatgcacagttaggagactgaggatggagtag

SEQ ID NO: 75203 - DNA, 900 bp, Glycine max
  Peptide Sequence Number=SeqID_166888
atgggtagcttattcctaggacaaataaaaaagcagacatcaactttcctacaagaaaagttcaaatctgctaggatgacgtttactgatgttactgaagcagaaatgctggctgaggaagcaacaaataaggatgattgcagccctgatgccaaaactatgactagaattgccgaggcatcatttgacatagatgaatattggaggattgttgatgttcttcacagaaggttgtataacattgattgggatcaatggaggcaatcttacaaagcactagttcttctggaattcttgttgacccatggtcctcgagagtttgctccagaatttcaatgtgatgcagaagttattgaagaactaggaatttttactcatattgatgaaaaagggtttaactgggggtcaagaatgctaaaactgtcagagcaaatactcaagcttttacaggatgaagaagctctcatagaagcacgtttgaaggctctcaaaataacaaatgaaatacaaggctttggaagttcattcaactctccaacttcatcatcatcatcatcatcatcaccttggtctttatcatctgaagcgtcacaaggatcttcatctttctattcattttccaccacaagtacccctgcttacacatttgattccaatgatcagctaaacaaacaccactcaccaacctccatagcaaatgatggtgaagagaataacattttgattgattctgatgaggatgaagacatggaaaaaccaaaagggcttctaagtgaaatttgctcaaagattattggtggtagtcccataaaaggagataatcgtgaaaatattgaatttagatgcctatctgatgttgggagcaagggagagaatgtaatggcaggagggaaaagctag

SEQ ID NO: 75204 - DNA, 207 bp, Glycine max
  Peptide Sequence Number=SeqID_166889
atgacattaggtgctgaattcaatgtggaaagcttaacatgtagagattggaacacatcatcgaaagtatcccaaaaggaatgtgttcggttctcatttacaggtgcaagaaagaaaaggactacctatataagcatgaagtttagccgcttcaagaagctgggacttggctttgatatgcttatgaaggatagggacacaggctag

SEQ ID NO: 75205 - DNA, 150 bp, Glycine max
  Peptide Sequence Number=SeqID_166890
atgcaagaaaatagtcgattgtgtggtgggtccggaggagcaagaaaggatgaaatgaagcagggcagcgcacgaatggggttggatggagaccaaaaggacaaacataagaaaagtgtgtcattgctaagacgatttatgattaaataa

SEQ ID NO: 75206 - DNA, 255 bp, Glycine max
  Peptide Sequence Number=SeqID_166891
atggcaaaagcgacggcgatggttgcgcgagggaagggccgcgatggtgccaacaacaactatatggaaacaccactaggtgtagccaaagaagaagagtggtacatcgtaattgtgaagaagtacacaactgctatttgtatattggcttatggatcatctgctgacaatgtggatgaatacgttcaaattggagatcaaataacgaagacaccaaacgactactacaaatgggagtggcatgctaatttccag

SEQ ID NO: 75207 - DNA, 738 bp, Glycine max
  Peptide Sequence Number=SeqID_166892
gtcagagatgagcttgaacaattgctggatgatgatgatgatatggctgacctatacctgtcaagaaaggctggttcagcatcaccagttagtggatcaggtgctgctaattggtttgctgcctctcctaccataggatcaaagatatctagagcaagtttagcaacagttcgtttagaagaaaatgatgtggaagagcttgaaatgttactcgaggcttatttcagtgaaatcgaccacacattgaacaaattaaccacactgcgagagtacattgatgataccgaagattatattaatattcaacttgacaaccatcgtaatcagctgattcaggtgccttttcacgtttctgcacctggcatgttgcatgtcatctatcggtattctataatgttttttttttttcacaagttcgctaaatggtcttcaactcttgtgcagttggagctctttcttagctcaggaactgtttgtctatctttctactctttggtggctgctatatttggcatgaatatcccatatacttggaacgataaccatggttacatgttcaaatgggtagttatttgtctcaggagtattttctgcggtgatgtttctcattattacagcctatgctcgcaagaagggatggttcaacatcatgttgagttattggacatgcttcatgttgagttattggatctgccatttcctcacagctattctgttctctggattcagtcattataa

SEQ ID NO: 75208 - DNA, 801 bp, Glycine max
  Peptide Sequence Number=SeqID_166893
atgaatggcaagtttgaatacgcctccaacgctggccccaacagcaatagaagagccccagtggtgggcacacagaaaaaggaaggggatacccacgtggtcaccaccgccccaacgtggatgaaaacaccccaaaatgctaaaatctcataccaacacaaccacccgaacttttcgatccgagctggaagttccctcccaaatcaagtagaagggcctgccacaatagaaaaagcgcctgcacaacacgcggctccagccacaccccggccagccaataatacgactcctggcatgagctatgacaatccacgacgccccccgagagaccagttctctcctattcccatggcatattccgagttatggccctcattattggaaaaccatttgctggtggccatacccggaaaggtcttccaatcaccataccccaagtggtacaactcaatgccacgtgcgcataccatagtggagcccccggacacaacattgattcttgcctaccattcaaaagagggccccaacgttaagaccaatccaatagccagtcatggaggagctagcgtaaacgccatcgaaaaggataggccgtcagggtcaaagagattagaagatgtggctacatccagaagattcatctaccagtcgctacaggcagcatgcatggtctctcgtggcggagacaaaagcgacgaatgtctgtttcatctcagggaattacacgacatggaaaccttccccacggtggaagagctacttcaacggctcatggtttgggggcagctcgaagtgtcatag

SEQ ID NO: 75209 - DNA, 724 bp, Glycine max
  Peptide Sequence Number=SeqID_166894
atggttagaacaagaggtagacctcgtgccttaggtagtggtacaagcagaggcatgggtcgggatgagcatgatgttgatgttccccgacgtcgtaggcctaccgcttctgcccgtaggcaacgagttcaggttgatgtcgctgaggaagttcctcaggtgactgaggatattcctgatgtgacagaggatgttcctcatgtggaagaggacattctgactgcggacgtagatgctacggacgtagctgctgatggtgccgagggatcacctgctgagcatggtgagggaatccctgcgcctgagattgaaggcctagttgccggcatcggattaagtccattgataaggtgttctgtggtcactgatgatcctggacttatatccgcctttatggagagatggcataggcagaccagcaccttccatcttccagtgggagagttgacgatcacactggatgatgtggcgtgtctcctccatcttcctatcataggggcattactcaggtttgagcctctgggcatggatgaggcggtcttgttgttgacgaagcttttagaggtatctggcaatgaggctcgagctgagaccgtatgtgctcatggggcttacgtgcgactgtcatggctccatgagtgcaacccatgctcatgtggtgcatctggagggtttttgagacctgggttagtctgggggctatgcttggggagttgccgcgctg

SEQ ID NO: 75210 - DNA, 255 bp, Glycine max
  Peptide Sequence Number=SeqID_166895
atggtgcatcttccaaggaaggaaaacgcatggagtcgccaccaacatttattcgaggaaaacatcggaaaaaacaaaatggaaaaggtcaaaggtctgcgtattttgaaaatgagggttcgggagttgtttatgcacgaagaaggagagaaacgtcaaggcgttgaacctttgaacgatctcttgattttgaaaggagagaaacgtcaaggcattggacctttgaacggtctcttgattttttttacgaaatga

SEQ ID NO: 75211 - DNA, 498 bp, Glycine max
  Peptide Sequence Number=SeqID_166896
ggcctactgagttttaactcggattacatggtgtggtataggcgtaaaacaaagatgtttgttgacccaaacaatgcaaacacaactacattgggtgaagttgtggagactttacagtatatggtgtcaccacaagggaggaacacatggacaattgatgatttcgtgccttacgtggaaaagttagcgattatatccgaagatgttgaaactcggggcataggcagacgaagggagcctgttgaagcggaagaatatttccaacaaatgatggagcgtggtcatggaatgtattacacgccagcaacattttcccaatatctttcacagatgtatcagtatccttttgaaggtcatcacactgatacttctgcgagcgaacatttgtacggtggtgttgcggaaacacagcctcatttttcatggcccactatgactccttcacagcctcatttttcatggcccaatattttcctgacactaaaaatctacagctga

SEQ ID NO: 75212 - DNA, 523 bp, Glycine max
  Peptide Sequence Number=SeqID_166897
atgacaaaagacaacgattggtacctcaaaaccttacactgggcaataaggggcactgtgcgactacacgtcctcaccgccaaagggttacacaccctcatcttcagaggactatacgtcctccccttgagaggactacacgccctcgcctttgtagggctacacgccctcaccttcagaggactacacgtcctcaccgtcggagggctacacgccctcgcctttagaggactacacgtcctcgccattagaggactgcacgtccttgcctttgtagggctacactccctcacctacaaagggctgcacgccctcgctaccctcaggctacacgccctcgcctttagaggactacacatccttgccttcagaggactacgcgtcctcgccatcagagggttgcaggccctcgccttcagaggactacacgtcctcgccatcagaggactacatgtcctcaccttcagaggactacacgtcctcgccttcgagggctacatgccctcgcttcaaagaactgcac

SEQ ID NO: 75213 - DNA, 1110 bp, Glycine max
  Peptide Sequence Number=SeqID_166898
atgatttccaaacagaccattgataagatattctccacgatccgggtagaagagattgtgggtgaatatgtgcagctgaaacgggcagggtctaattataaaggcctcagtcccttccacgaagaaaaatctcccagttttgtcgtttctccgagtaagcagatctggaaggatttctccacaggaaaaggaggaactgcgatttccttcctcatggaaattgaaaacttcacctatcccgaagcgcttcgccatgctgccaaaaaatacggaattgaaattgaagaagatcagcgcgagttttctgaagaagctaaaaatgcccagtctgaaagggatttattatataaaattcatgaagtggccaatgattactttcagaatttcctttgggaggctgaagaaggaaaatccattggattggcttatttcagggagcgtgagctgaaagatgatatcataaaaaaattccagctgggatattctcctgaaaagaaaaatgcctttacggcgtatgctttagagaaaggatattctaaagaaattctggagaaatcaggactctctatttttcctgaaaatgcaccgaatggaattgaccgctttcgtgaaagggtcatctttccgatccatagcttctcgggaagggtactgggttttggtgccaggatccttaagaataatgtaaaaacagcaaaatacctcaattccccggaaacggagatctaccataaatcgaatgtcctttatggattaaaccaaagtaagcaggctatttccaggaaaaacgtctgtcttttggtggaaggatatatggacgtgatttcccttcatctttccggaattgaaaatgtggtggcaagctcaggaacttccctgacgacagaacagatcaaactgatcaaaagacttacggaaaatgtaaccattctctttgatggagataatgccggaattaaagccagtttccgaagtattgatatgttgctgacagaaggaatgatatccgagttcttttatttcctgaaggagatgacccggattcctttgccagaacatccgcaggactatgtggaaattcatcgacaaatgaggcgatggattttatga

SEQ ID NO: 75214 - DNA, 231 bp, Glycine max
  Peptide Sequence Number=SeqID_166899
atggagtcaggtgacatgcgggggtatcgtatggttacccgcacctttcgtcaaccaagggcaaatgagcccgttgacgcgcagagactaacattgtcttctgcaccttttgccatccagggacagcgtgtcaggtggcaggtggagataccttatggtcatccgcacttttcgtcaactgaggcgaacgaattcgacggtatcagcacgatgttggtcgttcgattctga

SEQ ID NO: 75215 - DNA, 72 bp, Glycine max
  Peptide Sequence Number=SeqID_166900
atgagcaaatccgtgaagatttccgccgttcttcactgttcttcggtcttcaaccgccgttatcgcgcctaa

SEQ ID NO: 75216 - DNA, 402 bp, Glycine max
  Peptide Sequence Number=SeqID_166901
atggagtttgcggatcacttactacctgcgggtcagccttgtttagtgcctgggcaggtatctgcggattacattgagtggtttttccgcatatctcaccctttcatgacaccgacccaggcagctgaccagcagagggatgcaccagctgcagaccctgaggactacatacagccgcccagcccccaggttccagtggcatttgacccccctccatatgtggatgattacgagggatatgaggcgattgcacagaggttggagcgtgtgctcaaccttaggatagtcactgtaggcacagagttatatgacattatgcaggactgcctgacgatcgcgagagggggacccagtgctgatgggacggtcggggctcgtcagagacgccgcacggaccattga

SEQ ID NO: 75217 - DNA, 411 bp, Glycine max
  Peptide Sequence Number=SeqID_166902
atgcccttgcggggtaggattgcatcagattccttagaagataaggacatggtcataagcaggatatgcaagaggctggaattgtggaaagaagtagagtctaacacaattgacatgatgatagaaaatgacttctctagagaggatagtgagtggaagacaaatatagaacatataagaaatatggctggggagcttgagcttgttatctttggctttttggtggagaaattttcagaagaactaaagaaggtgatcgcaaaaatagccacaacaaggtcgaggacagtagcgaccttgatgttgacaaaagttgatactgctggatggttgaagaggacgaaacaggagaaaggagagcatccttcagcattatgcaatcaaggaagagtctactccaggctcatataa

SEQ ID NO: 75218 - DNA, 1136 bp, Glycine max
  Peptide Sequence Number=SeqID_166903
atgtcgattgatatctccgagagcaagtttaaaaatttatttgagagtgcggccattggtatcgctatggtgaagcctaatggaggctggtcagaagtaaacgatgagctttgtagaattttggggtattcccgaagtgagcttttgagcctaacctttcaagaggttacttatcctgaagatcttgataaagatttaaatctgcttgatcagctggtatcggaaaaaattgaacgttatcaacttgaaaaaagatacatcaaaaagtcaggtgaaatcgtatgggcagaattgaccgttacaaaacacttaacatctaacggagagattgactactttatttcgatcatcaaagatattcagagcgccaaagaaaccgaagctgctctgactgccttgagaaaaacgcttgaagaaaaagtcaatctgcgtacagaagaactgaaacaggcaaatatgtctcttcttaattcctatcaagaaaaagtagcttcggagcagcaactaaaagacgttgagttggagctaaggactattctggataatgcaaatgatgcttacgtatgcattacggctgatggagatgtcaaagcatggaacaagcaggctgagctaacttttggttggtcagaagatgaagttatagggcgtaaacttgataagctgataattccgccagaactacaggatgcacatctcaaaggtctaaaacgatttgccgaacataaacagtccgacatgatgggtaaacgcattgaattagaagctttgcgtaaagatggcttacttattccggtggagctgcaaataaatgtattggaaatcaaaggacagacacttttcacttcgtttcttcgagatattactgatcgtaaacaactagaaaatctgttgaagaatgaagcgcgtaatgatcctttgacagggctgcctaatcggagaaaacttgaagaagtcttgcctatcgccattcatcgcgcgggagccaatcgagccaacctatcattgctttttgtcgatcttgatggattcaaatcaataaatgataaccatggtcataatgtgggagacatgctgctgcgggaagttgccaacagaatcgacaaatgcactcgacaatcagatacagttgtaag

SEQ ID NO: 75219 - DNA, 267 bp, Glycine max
  Peptide Sequence Number=SeqID_166904
atgagcgtggaggagttccttgcacatgtggcttggccaggagtccagtcttctccttctggagggggtgaggcccctgcaacccaagagcctgtgccagcagaggatgagcttgttcctcttgagccacttatttttgagactgatccagttagtgctcaggaggaggtagcatcaccagctccagttcctgtctctccagcacccattactgatgattaccagccatctgcaccagcattggagcaaaagcagcccatttcatag

SEQ ID NO: 75220 - DNA, 450 bp, Glycine max
  Peptide Sequence Number=SeqID_166905
atggccacaataatgaaggccatgatgagcgtgaagaagataatggaagccaatgtggttgcaattgccgctaccagcgctgtcgctaaagtgaacccgatgctcccatctggcctcaagcaaataaatcatccaatctcaaatatgcacgccttcccatcatatggcttgcctcccaactatacaccacccaatgtggcatacactctcaatgaaaatctcaataactccactccgatacccattgaaagccaacaacctcaatctgatcatgcacatgcctctcgacccatggaggagacacatgaaattccccaccacgatctagctgacttcgagccttggctcggatatgccactgaaaggcaagcagttggtggtataccctttgaaaacactttggagagccctcagtatcacccacaactgcacctcttgcattccacagcg

SEQ ID NO: 75221 - DNA, 150 bp, Glycine max
  Peptide Sequence Number=SeqID_166906
atgccaatgttgaatcaatttcatccatgcattcatgattccattgtaaacattattgatgtcaaagctgatggtaactgtggatatcatgcaattgctgccctattaggtatgggtgaagattcatggttaccatggacaagtggatga

SEQ ID NO: 75222 - DNA, 231 bp, Glycine max
  Peptide Sequence Number=SeqID_166907
atggcagcggaatggagaaggaagagagagaggagacgccacttcaaggagaagatgagtctagaagaaactcaccaccataggaggccatggataagagcttggaggaagaaggagatgaatgaagggagaggaagagaagagcacggaattttgtgctctaaaaaagctttgaaatctgaacccactaatccaagatcaagtccaagattctccactaagtatgcttag

SEQ ID NO: 75223 - DNA, 206 bp, Glycine max
  Peptide Sequence Number=SeqID_166908
atggcaaataaagtctcagagctgaatgtggagggtccggaagaaactggggctgaagctagagctggtaaagatgaagctacagcaaatggagttgcagtagaagtagaaggagcaaaggtagggagagcagaagatggtggagcctcagacctcttgcccttagccttgcggggcccccaaaaagtgactgtggggtcgtcaag

SEQ ID NO: 75224 - DNA, 846 bp, Glycine max
  Peptide Sequence Number=SeqID_166909
atggtagaattctccgtggaagcaattgcatcccttacccagtattatgaccagcccttaaggtgcttcacatttagggacttccagctagtaccaattgtggaagagtttgaagaaatcctaggatgtccgcttgaagggagaaagccatatctcttttcggggttctatccctccatggcaaaagtagcaaaggtagttaaaatctcggtgcaagagttagaccgtgtgaagcaaaataggaacggggtagtagaaataccaaggaaacatttagaggaaaaggcgaaggcattggccgatcaaggggaatgggttccgtttattgacaccttcacactattgatatttggagtcgtcctctttccaaatatggaagggttagtggacctagcagttattgatgctttccttgcttatcaccataacaaggaaagcccgaccatcactattttggccgatctctatgacacgttcgaccgaagatgcaaaaagagcggcgcaagaattgtttgttgtatgccagctctctatgtgtggcttgtctcacaccttttccgccaagaaagtaggcccacctgtccactgcaaggtcaccacttatgcaccgagaagggaaaggaaaactgggagcaactcttggctagtttgcttggctaccccatgaggggagcgccatcggtgggaagcatcacgcctttcatcgcaaggggtttcagtgacaccaatgcgagggtacttcaaggagtccgcaaggcatggaatgcagtgcaaaggaaagataaagagcttaggggaagcagtaatggggtcatcggtggctatcataagtggctgagagtctaa

SEQ ID NO: 75225 - DNA, 249 bp, Glycine max
  Peptide Sequence Number=SeqID_166910
atgttgctaaggaacgtcatccatatctgtgtaagagtggtcatgttggtgcgcatgatccacactcgtctctttgtagcggcatgggtgaaatcttgccccggtatgcatagtagttgtgtgatagcctccctctctgggtttattttcatagttggcaccctccaatataagggggtggcccaggaactgataccacgcccctactggctccttaaccgggagtgcaagtctcggttaagcatttaa

SEQ ID NO: 75226 - DNA, 393 bp, Glycine max
  Peptide Sequence Number=SeqID_166911
atggtagaagtctccacagaggccattgcctccctcgcccagtattatgatcagctgttgaggtgcttcagcttcggggacttccagctatcacctatggtagaagaatttgaagagatcctaggatgccctctagggggaaggaaaccatacctcttcttagggttctatccctcattagctaaaatttccaagatagtccaaatctcggcgcaagaattagaccgccaaaagcaagtcgaaaatggggtggttggaataccgagaaaatgtttggaggcaaaagcaagaatcttggtaggtaaaggagaatgggccttgttcatagacattctcgcactgttgatctttggaggagtcctctttccaaatgtggatgggttggtgacctag

SEQ ID NO: 75227 - DNA, 156 bp, Glycine max
  Peptide Sequence Number=SeqID_166912
atgaaagctttccttggcaaatacttgcagggcacgacaactaaaggtcaccagtccaaggtcacagtggtgagaaactcaggcacacgcgacgcagagctcaggtggtgcgacaacctagggtttgtttgccaactatatgataagatgcagtga

SEQ ID NO: 75228 - DNA, 1617 bp, Glycine max
  Peptide Sequence Number=SeqID_166913
atggagatcgtccataataattattctcctcggaacaggaagcgaaaacgagggttttcaagaaagcttggtgtcaatgaaaaagtggaggtgaggagtgtggatttgggatttctaggatcatggcaccctgcgacagttatccagtgtgagaagctgaagcggcatgtcagatataacaatgttttggatgatggtggggtgaattatcttgaggaggcagtgagtgttttagaagctttggatggtgataaggaatgttacagctactcgcgtggatccattaggccaatgcctcctttggttgagtttgagagaggggaccttaagttcggtctgtgtgttgatgtgaactatgagaaagcttggtgggaaggtgttatattcgatgaccacagtgacggaatggagaagaggagtgtgtttttccccgatttgggtgatgaaatgcaagttggaattcatcagttgcggattactcaggactggcatgaagttactgaggagtgggagcagcgggggaactgggtgtttcttgatttggttgaggagcagaagaggaaatcgtttgttgcagtttcggctaagcagatttggtatgatgtacgcataaaaaatggatttgagaagattcaagagtggacatgtaatatgaagtacttgtggagaaatctggtaatggaggtaattaatgactatttatctcttacgataaatgaagttatctcagtgttgaaccttcaactatttcctccaactatttcatcttctctggttgaagatgaagttgaagatgtacctatgttttgtcctgaggctgttgagcagtctgacatgaaacatttaaatgtctcaggcatgaatgaagaaaatgttgatcaggtttggagcagggatctagtttatagatcagctggaaatcgaaagcggaagcgcttggaaaattcaaaggccaacatacaaaaggtgtctgcctcttcttctcttacaaatcataaacctctaaatgttctgtcttacttgatagacaacagcatcatcttaccaaggtgtaaggtttattataaggtgaaaggcagacaccgtaaagtctgtactttggctgatgggaaaataactcgtgatggaatcaagtgtaactgttgcatgggaatatacagttttgttggctttgaaaatcatgctagtggcaatagtacctgcagaccctctgctagtatctttttggaagatggtagatcactattagattgcctgataaaaatgatgcatgatcataagacaatggaaactagtggaaaatcattcagtgacatgtcttggtttggaggtagattaaccattttccttctcaatcatgctatacttagtgctatcttgacatccctaatggtgactggttttgtccatcatgttgttgtgggatttgtggccaaaggaaaattgacagagatgatgaggttgaacaattacttccttgcattcagtgcgaacataaatatcatgttaggtgcctggaaaatggagctgcagatatatcaacaagatatcttggaaattggttctgtggaaaagactgtgaaaaggagattgggtgagtgcaaacagaagggttag

SEQ ID NO: 75229 - DNA, 1013 bp, Glycine max
  Peptide Sequence Number=SeqID_166914
tgactggtccacgaggcggaggttaccgggacatatttgttgatggatttgttcccccttcaacgagtgttgctccaatatttccctgttatgagaatacatcagagtgggatgattttggtgagggtggaagtgatataaagggaaaactagatgaaggtgctgcaagtttgatacttgatacaaagccatcaaaagtcgtatctgatgaaaggactgtgcaagtcaggtgttcattggtttacatgaattctgaaggacgttcagatggaagatccattaaaaatattctctctcatgtggctcccttgaagctgggtagctatctaaggcaatttcatggtttgaggctgagcagtttcgagacaagcgtgaagaacaataaaattggtgtttatttccaacgtagcccagactcaaacccacattctgagatagtatcagagcctagtttagatccattaatggatcacccaccatatttatccactgaggggcaacctttgtcctatgagttagcttttggagttgagttaggctcaaattcacattctaagatgccagaggttttggtgcatggatcagctgaagctacagagcatctgaaacagcactgcctgaagcatgtctgtccacatgtttatgctccccaaattgaagagacaattgatgttacctctgatttatgtgcttataaggttcaactgtctgagaagctcatgagtaatgtactcttcaaaaagctgggagattatgaaatagcttgggttgatgctgtagtagggaagacagaaaatgatccgctttcgctgctccctgtttctggagcagctcctccgcataaatccgttcttgttggtgatttgaaattggcggatatcaaacagtttctctccagcatgggtgttcagggtggtggttctggtgctcagcaaatagttattgagggtcctctgtgtgaagattactataaaattcgtgattatctctattcacagttttatttgctttag

SEQ ID NO: 75230 - DNA, 156 bp, Glycine max
  Peptide Sequence Number=SeqID_166915
atgaaagcttaccttgacaaatacttgcagggcacgacaactaaaggtcaccagtccaaggtcacggtggtgagaaactcaggcacacgtgatgcggagctcaggtggtgcgacaacctagggtttgtttgcctactatatgataagatgcggtga

SEQ ID NO: 75231 - DNA, 427 bp, Glycine max
  Peptide Sequence Number=SeqID_166916
gtcgactctagaggatccccagcagcaagccctaagagaccaacataaggatgcacagaccaaagttgagtatgtaaaaaaattgtatgaccaagtgaaggtgcaaattgcaaagaatgaaagctatggcaagcaagcccacaagaaaaggaaagaagtggtacttgaacccggtgatgatcttggacatttgaggacaaatgttttccaagaaggagggaatgatgagaatcatgtgaagtgtctctgcctctgggccttcatccttctccacttaggtcttcatccttctccacttgggccttcatccttctccactcgggggctttgtccttctccacttaggccttcgtccttcttcacttgggcctttagcctgtatttggccagtttcatgattctcatcaatctacttgggtttgactaa

SEQ ID NO: 75232 - DNA, 462 bp, Glycine max
  Peptide Sequence Number=SeqID_166917
atggcgcatagaggtcttggtcggactttagaccgagcaataggaaaattcatcgggaggagagaggaacatcctgagctgaagctatctttccatggaaggaagatgactaagaaaactaatagtttccatttgcccgtcggagaggtgactatcaccttggatgacatggcatccttgttacatttgcctatcgtagtggcattccacagcttcaagcaactttatgtcgacgtcgttgtcgatatgttggtggaattactcgagagtgggacttacgcttggggcgctgttgcacttgttcatatatatgataatttaaatgaggcatcaaagagcatgacgaggcagcttgaagagtatatcactctgttacagtgttggatctatgagtatttcctgtctgttggttccgccctagctgccgaggattatgacgagagcagaccgtgtgcacgttga

SEQ ID NO: 75233 - DNA, 324 bp, Glycine max
  Peptide Sequence Number=SeqID_166918
atggagcatatggatgtgaagacaacatttcttcatgatgatctagaggagcaaacttacatggagcagtcagacaggttcattaaaggtggactgggtcggttggttttctccaaggaaaagttgaaatcactcttgagcaaggagtttgacatgaaggacttgggtccttccaagaagattctcgagattgagattttttcagggataggaaatccaaacgattatggctctcacaacaagctttctgtagatcaatgtctgaagacagatgctgagttaaagtacatgtcaaaggttccacatgcaaatgcagttggttga

SEQ ID NO: 75234 - DNA, 156 bp, Glycine max
  Peptide Sequence Number=SeqID_166919
atgccgcctaaacttaccgccaaggagactttcgatataaggaatctccaagccaaggatccactgtcgtcatcttacttgtttgagccggtcaccaagtcaaaactagctctaataccaattgttgtgcgtctaagggggctaaacaccgggaaa

SEQ ID NO: 75235 - DNA, 54 bp, Glycine max
  Peptide Sequence Number=SeqID_166920
atgggtgttatgtttaactgtgatgagcccaacagacctgtaatgattttgcgg

SEQ ID NO: 75236 - DNA, 1167 bp, Glycine max
  Peptide Sequence Number=SeqID_166921
atggcacttctccattccctatttgcccttctcttccttctcctttcccttcaactccatacagtctcatgtgccctcctactaagcctgagacaccaccacaacactctccaccagcagaggccaatgatccatgccaaccaaaccaactgtgcactttttgtgggaacttgggtccaagatgactcttaccctatctatcaatcctctaactgccccatcatagatccacagttcaactgcaagatgtttggccgccctgattctgattacctcagatacagatggagacccctcaactgtgacctccctaggttcaatggggtggagtttctactgcaaatgaagggcaaaactgtgatgtttgtgggtgactcactagggcgcaaccaatggcaatcactgatttgcatgatatatgctgcagttcctcagacacaaacacaattggtcagaggggaaccactctcaaccttcagattcttggactacggtgtgaccatttcattttacagggctccttatttggtagagattgatgtggtccaagggaagaggattttgaggttggaggaggttgatgggaatggtgacgtttggagaagtgttgatgtgctgtctttcaacactggacattggtgggatcatcaaggctctcttcaagggtgggattatatggaattaggaggcaaatactaccaagatatggatcgtttagcagctttggaaaggggtatgaaaacatgggctaactgggtggactccaatgttgatagaagcagaaccaaagtgttcttcctgggaatttctccttcacataccaacccaaatgaatggaattctggagtgacagcaggactgactacaaagaactgctatggtgaaactactccaattactagcactggcacagcataccctggtgtgtaccctgaacaaatgagggttgtggacatggtaattagaggaatgagtaaccctgcttatcttcttgacatcacaatgctgtcagcatttaggaaggatgcacatccctccatttatagtggtgatttgaatcctcaacaaagagctaaccctacctactcagctgattgtagccactggtgtcttcctggattgccagatacttggaatgaactattctatactaccttgttctattaa

SEQ ID NO: 75237 - DNA, 453 bp, Glycine max
  Peptide Sequence Number=SeqID_166922
atgactaatcttgagagatctcaatttctggactatactttcctagattttcagggtgccatcatgtgtcaaaagctcttgacgaataataatccatctccgaatccagtcttgttaacagagtcacaagcaaaatgtgatgtttcttctggaagttgctgtgctaacctcagtgagtctagtccagtatgtgaattataccaagtagaagagattgatctaggagggatgatgaatcatcaaatggagtatacttgtgctggcaaaaataatcaagttattggtgctattgacctagtcaccattgtggagcaaccgagtcctggggatcaacagtgccagaatggaacaaccagcttagagtgctctattgataataatggcctgtataagtgcgtctacacgcgaaggaaagtgagaaagtcatgtgaaggatttagcatgccatcatga

SEQ ID NO: 75238 - DNA, 321 bp, Glycine max
  Peptide Sequence Number=SeqID_166923
atggataaccttaataacactctgacaccttttgtagttaggaaagaggtgaggagcatgactattaaggcaacatataaagaagatatcataaggtttaaggtctctatggattgtggtattgtggaattgaaagaggaaattgccaaaagattgaaactaaaggtgggaacatttgatatcaagtatatggatagggcctcttatggatcagttgatccgtattcgtataaggctcacggatcagttgatccatatgagctgatccgtgggatcatacagatcaacttcatatggatcagaggcttacggatcagttga

SEQ ID NO: 75239 - DNA, 123 bp, Glycine max
  Peptide Sequence Number=SeqID_166924
atgggtggaagtgatataaatggaaaactagatgaaggtgctgcaagtttgatacttgatacaaagccatcaaaagtcgtatctgatgaaaggactaaattgattagaggaaccaagtcatag

SEQ ID NO: 75240 - DNA, 1051 bp, Glycine max
  Peptide Sequence Number=SeqID_166925
atgtctcctttggttgagtttgagagaggggaccgtaagttcggtctgtgtgttgatgtggactatgagaaagcttggtgggaaggtgttatattcgacgaccactgtgacggaatggagaagaggagtgtgttttttcccgatttgggtgatgaaatgcaagttggaattcatcggttgcggattactaaggactggcatgaagttactggggagtgggagcagcaggggaacttggtgtttcttgatttggttgaggagcggaagaggaaatcgtttgttgcagtttcggctaagcagatttggtatgatgtacgcataaaaaatggaattgagaagattcgagagtggacatgtaatatgaagtacttgtggagaaatctagtaatggaggtgattaatgactacttatctcttacggtaaatgaagttatcttagtgttgaaccttccatggagtttattaaatgaagcaccggaacccgaatctgttgaagctatggctagtgttgacttaagcgtgacctttcctgataaggaaattgttgtgcaaaaagaaccagttcctcctgttaaagaggtcttacccaagttgcaaaaagaaattggccccggtggtgctttctggtctgaagaaaatagagaaaatagatcctcaactcatttaagaaaatttcagaatccagatatctttcctccaactatttcatcttctctggttgaagatgaagttgaagatgtacctaagttttgtcctgaggctgttgagcagtattatcgctccggggatctagtttgtagatcagctggaaatcgaaagcggaagagcttggggaattcaaaggccaacatacccaagtgccaaagcaatggattggctccacgggtgaaaggcaggcaccgtaaagtctgtacttttgctgatgggaaaataactcgtgatggaatcaagtgtaactgttgcatgggaatatacagttttgttggcttggaaaatcatgctagtggcagtagtacctgcagaccctctgctggtatctttttggaagatg

SEQ ID NO: 75241 - DNA, 582 bp, Glycine max
  Peptide Sequence Number=SeqID_166926
atgccattagggggtaggattgcatcaactagaggggtcacatcagattccagatccttggagagccttagccctaccatgaacttggcatatataaagaagaactattggaatctagatgatccaatagtgacattcagagggccaaggaagcccaggggtaagagatctgaggctccccctacttcagcagcaccagatgcttctgctcctccttcatctactttaccaaatcctactacagcagcaccttcttcttctactccaactattcctgcttccataccagctcagtttccagttcaactcccagcttcttctactcctacatcagattttgtgtttactctagagatgcttcactctatgatgcagagcctccatagaggagggggtgggacctccgcagcccaagagcctgagcaggcaatagaggagccagtcttagcagaggatgagttcactcctcttgagccctcttcagttgttgcagatacatctatggctcatgaggaggatgtaccagctgctccagtgctggatttaaatgaagaccaggcacaagatgagcaggatgtttaa

SEQ ID NO: 75242 - DNA, 305 bp, Glycine max
  Peptide Sequence Number=SeqID_166927
atgaccggccctctcaatgagtcaatctcttgctttctcataagggtgcacccttgggtactagtaccctcaccttcagagggctacacgccctcgccatcagaggactacacgtccttgcctttagagggctgcacgccctcgtcttcagagaactacacgccctcgccttcagaggactacacgccctcgccatcagaggagtgcacgtcctcgcctttagaggacgacatgtcctcgccttcagagggctacacgccctcaccttcagaggactacacgtcctcgcctttagaggattacac

SEQ ID NO: 75243 - DNA, 447 bp, Glycine max
  Peptide Sequence Number=SeqID_166928
atggcatcaagaaagagagctagaaccgacaacatcccttcatcatccatcccagctcctcagtcaacatccatagaaccaaataataggccaattgtacctctggagtattttcttgagaaagtagccttgcctaaagctcaacttccatttgtgagaaccaatgaggctactccttcgaagcccacgccgggacaggttgaaccaataccagccaagccacgaactccagtggtgaatccacctctttctcctgagcttgaagtagttcccccatctccacctctgattatcatctatgatgcatcatcaaatgaagctgttgcccctcttgattcaccagctaaagaagcatctgacccccctgcttccccagttggaggaattgctgatctttctgattcgtcatctggagaagttgttgctctcactgattccctagtttag

SEQ ID NO: 75244 - DNA, 354 bp, Glycine max
  Peptide Sequence Number=SeqID_166929
atgaagaaaatcaagccgagacgcttccgtaacgcttctaagacgttttcgtgggtgatttctcgaagattttccgccgttcttcatcgctcttcggtcttcaaccggttgtcgtctcttgcaatggacgtgtggggtgctaataccttccccttttcctcaaataaatgttggtggcgactccacgcgtattcctttcttggaagacgcacccgtcgaagggtaggttgcgacactaatgaagacccctatgcacattcggcagcgttcattgaaatatgcaacactgttaagattgttggtgtgccagatgaagctataagactcagcctattctcattctcattggcatga

SEQ ID NO: 75245 - DNA, 494 bp, Glycine max
  Peptide Sequence Number=SeqID_166930
atggattatcccacactaggaaaaatttgttacaacatggacgaacaaggtgatgcacctatgcaacataacaacaaacaaaatagccttggcgacctgcgtagtgtttgggatgccatgaacaacatgatgatgctgcaacacactcaaattaaagcatccttcaaaacaagcatacatttcgttggacatgtctataaaaaaaccttattcaagaggcttcgtagaatggtttcaaggagacttcaattttttgaccaagggttatgtgaggcagaagtcagcatcgacgatgagatagagaccatacgtcagagatttaaggacgttgatgttggcggcaaagttactctgaagagtaaacttcgtgaaattgcataccctgaggaaaactctatgtttcctccttcatcaaaggtgaatactaaaggtgcaccaaagaaaggtctgaaaagaagcgaaagattcacaaagcgtgatccatcatattggga

SEQ ID NO: 75246 - DNA, 453 bp, Glycine max
  Peptide Sequence Number=SeqID_166931
atgtacatggtgaacaacattttcacactatctaggtacaaggaaaacatggtgcagcccaaaccaagtgctggcattaaggggaaacctcaccaacatgctctcactttcatgccttcttgcaaaaataccattgaggcatttcaccgagcacttggtggacgcacttttgggtaccaacaacaagggaatgggggcaatgtggcttgccccatcatttcagaacacaacctaggcctaagaccatcccctacaacccctcaattcaaagaaacaaagcataaacttgccccaaattgtctcacggcattggtatgcgctctctatgggtcggcgttcgcttactcgaacccccttagggtagatttaggcacaacaaactgtggccgtgttaccgtttacctcgatttgtctctgtctttggatttggctcggtatttgaccatcgcctaa

SEQ ID NO: 75247 - DNA, 561 bp, Glycine max
  Peptide Sequence Number=SeqID_166932
atgggtgaagtagaggaggtgcaagagcagatgaagaccgacatggaggccatgaaagagcaaatggccacaatgatggaggccatgatgagtataaaggggataatggaggtcaatgcggttgcaatagccactaccaacactgttgttgaggtggacctgacccccccatatggcctcaaccaaataaatcatccaacctcagatatgcatgccttcccaccatatggcttgcctcctaactatacgccacccaatgtggcgtacactcccaatgagaatgtcaataactccactcctatactcatggagagccaaaaacctcaatctgatcatgcacatgtctctcgacccattggggagacacatgaaatgccctaccataatctagccgacttcgagccttgcctcggatatgccactgaagggcaagcagttggtgatatacccctacaaaacacattggagggccctcagtatcacccacgaccacaccccttgcattccacagtgggtaaaaaccctcatgctatggcagaaatgggaaagttgatcatctag

SEQ ID NO: 75248 - DNA, 222 bp, Glycine max
  Peptide Sequence Number=SeqID_166933
atgtcttggcaggaggaactagagagaaatcaaaaggcatcaggttccaagtctgatggatgtgcaagacaggttgcttcgtatgagtttaccaccttaacttgcatcccaggtgtcatcacatatcgtggagctaaaatccagttctgcacctcagcacttgcctcaattcgggggccaggaaccatgtatcttgcatattatgtctctctatatctttga

SEQ ID NO: 75249 - DNA, 398 bp, Glycine max
  Peptide Sequence Number=SeqID_166934
atggcaaatgaaggtacctctcaaccacaatgtccactcatttctcaaggaagtacacatcatccaactctaaatggacaagaaagttcacatcaaccaactccaaatggacaagaaagttcacatcaaccaactccaaatgaaagtgctaacccgtcaattgttgctcctactcccacaacaaccgatactatggaggttgatagtgcagcaacacaaaaccgtccaaaaaggcgtagaagtgaagtttgggatcattttgaaaagatcattgttgatggaaaagttaaggctagatgtaattattgcaagaaagatcttggtggatcatcaaatgacgggacatcacacttaaaaggacatttattgatttgtcctcaccaggaagattttggaag

SEQ ID NO: 75250 - DNA, 318 bp, Glycine max
  Peptide Sequence Number=SeqID_166935
atgacagatattgtctgcacgaaagatgacgtaaatctccgcgtgtcaacgggcttgttggccgcgattgataaaggtgtgacagaaattgtctgcgcggaagatgacgtaaatctccgcgtgtcaacaaacttgttggccgcgattgacaaaggtgtcagtatgacagaaattgtctgtgcggaagatgacgtaaatctccgcgtgtcaacgggcttgttggtggcgattgataaaggtgtcagtatgacagaaattgtctgcgcggaagatgacgtaaatctccgtgtgtcaactgagcttgttggctgcgattga

SEQ ID NO: 75251 - DNA, 144 bp, Glycine max
  Peptide Sequence Number=SeqID_166936
atggccattgagggctttacaataaaaagaggggtgaaagaaagcgcgctcagcgcgacaccccctcgctcagcgcgtgtagatcgcgcgcttagcgcgcatgttgcaggcttagcgcgcacttctgttggatcatgggcttag

SEQ ID NO: 75252 - DNA, 203 bp, Glycine max
  Peptide Sequence Number=SeqID_166937
ggcttcccggtatcaacagggacaccaggatttatttatttctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 75253 - DNA, 324 bp, Glycine max
  Peptide Sequence Number=SeqID_166938
atgcacacacaaagtttcacaattccacaatttcctaaaataggtctcactcacaaaaacagtccccagtggagtcgccaactgtcgcaacctacccttttgcgggcgagcgaggcgaggctcacgggtgcgttttccaaaggaggaaaatgcgcggagtcgccaccaacgtttatttgtggaaaatgtcagaaaaaccgaaggaaaactgtcatgaagaatattccaagttcgggagttgtatttacatttgaggaaggtcgacaaaagtggggctcttgctcctacataccctccatcgaagaggaaatcagacctacgtag

SEQ ID NO: 75254 - DNA, 210 bp, Glycine max
  Peptide Sequence Number=SeqID_166939
atgtctcctcaacctctagaacctcacaatcactcacgaactcatctcaagctctttggacagcttcctcttcaagcttggatccttgcaggtggctttgttcgtgcttgcgcgcttagcgcaactctgaactgcttagcgtgcattagtgaatttcggcttagcgcgttcttttcttgctcagcggatggactgaagcggtgtgcttag

SEQ ID NO: 75255 - DNA, 582 bp, Glycine max
  Peptide Sequence Number=SeqID_166940
atgtatagagttggtggcattatacacaatgttgcttacgcagatgatgtagtaagggtttgtgttgagacaatttacgatggtgacgccagtgtcccgtttcccactgcagagattcagtatgtcagggacacgagtagcacattcattgcatggcccaaacatctagtgaagcctatagctgatgattcaaatcataatgtgcatttgccacttagacgtcttggtgaggctgaggttgcagctgaagctgatccgttgggcgaattgatgaagacattgttttgcgtgtacaagaatccagtggaagtgtcgtgggaggcgacgcaatttggacttcctaatgttggggcaaaatttttcatcacacatgctgatctagcagaaataatatcaggtgacaagtgtttgaacatctctatcctgcagctgtggaccatttttgtggtagaagcaaagcttatcagtcactgtatggtctgttcgagcctcaatctatacacaatgctaaggacagacgtgaacaatgctaacaatacattcaatcatgggtcaaggaatcacaaaggcagttgtacttag

SEQ ID NO: 75256 - DNA, 528 bp, Glycine max
  Peptide Sequence Number=SeqID_166941
atggcttccaactcccagcaatttagtgccagaaatgatgctattgtcattagaggagtgcatgaagttgtcacgaattcatcttcatcagttgagactaagaagcttgaagacctttgcccttctatgcaacaatctaaagcaattgaacagcctgaagcttatcctgcaaacatctacaatagacctcctcaacctcagcagcaaaatcagccacaacagaacaattatgacctttctagcaacagattaccttctcaatctgtccagaatcccaaaaatgtgagtgccattgcattgaggttgggaaagcagtgtcaaggacctcaatctgtagcatctccctcatccgcaaatgaacctgcccaacttcactctactccagaaaaagatgatgacaaaaatttaaagagtaagttacctaacaattactgtgcagaagcagcatatccctcttctattccctccaagagcaatttccaacaaaaaaatggaagaggcaaagaaggagatcttggaaacatttag

SEQ ID NO: 75257 - DNA, 126 bp, Glycine max
  Peptide Sequence Number=SeqID_166942
atggctgccattgaaatggctccgaaaaagctttccgcgaagagatctaggagggacgtcgcggctgaagggaccagtgccgcccccgagtttgatagtcactgtttcgggagcgccgtgcactag

SEQ ID NO: 75258 - DNA, 414 bp, Glycine max
  Peptide Sequence Number=SeqID_166943
atggtagaagtctccacagaggccattgcctccctcgcccagtattatgatcagccgttgaggtgcttcacctttggggacttccagctatcacccatggtagaagaatttgaagagatcctaggatgccctctaggggaaaggagaccatacctcttctcagggttctatccctcattagttagaatttctaagatagtccaaatctcggcgcaggaattagaccacagaaagcaagtcgaaaatggggtggttggaataccgagaaaatatttggaggcaaaagcaagaaacttggcaggtaaaggcgaatgggccccgttcatagacattctcgcaatgaggagtcctctttccgaatgtggatgggttggtggacctagcagcgatcaacgcttttctcgcctatcatga

SEQ ID NO: 75259 - DNA, 801 bp, Glycine max
  Peptide Sequence Number=SeqID_166944
atggaccgggacgagattcttcagtattcgcaggctgtttgtcaggggctgaaagacgatgatgatggcttgcggcgggaggtgctggctcatgcaggaagtcgctggtcactgggtatcgtcaacacgcttggcgtttatggcagactgcgtcacgccgaaattggaaggcgtatgcacggcgtgactcagcgcatgctgacgcatacattacgacagcttgagcgtgacggactggttatccgccatgatttcagtgaaatcccgccacgagtcgaatacgagctgtccgatacagattatcatgatctcgctggttatgttcatggggcgaaaattattcatttcgctttgaccagagcccccatagacaatatcaatgatgtggtttatgagacagtgaaaaaaacgcgatctgtcagacaattacacatgtcatttctggttcctcgtaccaaaattttgaaaccagctatcatctattttcctgggggaggatttatgacagcggagcacaataaatttatggaaatgcgcatggctttagcggaggctggctttgttgttgcagcggcagaatacaggacaattccggatactttccctgcaccaatgatagatgctaaagcagcggtaaggtaccttcgtcaacatgctcacgattatggaattgatccctcacgaattggtgtatttggtgattctgctggaggatggctggcgcagatgcttggtaccactaatggcgataaatcattcgatcatggcgattttcttagccagtccgcggatgtgcaagct

SEQ ID NO: 75260 - DNA, 291 bp, Glycine max
  Peptide Sequence Number=SeqID_166945
atgggattgaaccaaacaccctcttttaagaaaaggttctatcatgtcaaaaccaagagcctaaaagtagccagtttgcaagagttagggcagcagatggatcaagttcaacgtcaagccttccgcaagacatatggaaaaatctgggacttggctatgatagaagtttccgtggaagccatcacatccatcactcattactatgaccaaccactaaggtgcttcacgtttggggactttcagttggtaccaatcgtagaagagtttgaagggatcttggatgcccactag

SEQ ID NO: 75261 - DNA, 588 bp, Glycine max
  Peptide Sequence Number=SeqID_166946
atggcggaggaggctaaggggaaggggtttagcaccctggggctagtggacctagctgtaattgatgctttccttggctatcaccatagcaaggaaagcccagttgtcgctatcttggtcgatctctatgacacgttcgaccaaagatgcaaaaagaggggtgctagaattgtttgttgtatgccagctctctatgtgtggctcgtctcacaccttttcctccaagaaagtaggcccacctgtccactgcaaggtcaccgcttatgcaccgagaagggaaaggcaaaatgggagcaacacttggctagtgtgacaacttggctaccccatgagaggagcgccatcggaggaaagcatcacgcctttcatcacacggggtttcagggaccccaacacgagggtgcttcaaggagtccgcaaggcataggatgtggtgcaaaggaaggcaaagagcttaggggaagcagtaatgggatcatcggcggctatcataagtggctgagagtccggacacaagggttggattggctcccaaagctaagggctgtgagaaaggaagaggctgaagctctagaagaaagtgaggag

SEQ ID NO: 75262 - DNA, 420 bp, Glycine max
  Peptide Sequence Number=SeqID_166947
atgcctttcctggctgcattaaaacccattattggagctgaagcaatagaattagctttggctatatggtttaatgagagaataaagggaagaagggtggtacatggggattgggttcaacagctgttgatcttgagtcacccatatgtgggttgctttgtgactcaatgtgggtctggctcattaacaaaggctatgcgagcattcgctaagcacgacactcagtggctaagagagaggaagaatccaaaagaagatgagctgtcaggttcgttgagcgcactgctccaggtcatcaagcgcaccgcttcagctcatccgctaagcgagagaagcacgctaagccaaaatccacttatgcgcgctaagcgattcagatttgcgctaagcgcgcaagcacggaccaacccacctatttaa

SEQ ID NO: 75263 - DNA, 994 bp, Glycine max
  Peptide Sequence Number=SeqID_166948
atgaggttgatcgatgatggctccttcaagcaaactcctctagtggatgaatctgttctttctgaatggtcgatgcagatacctcctaagatgaaaagagaagtaagaagaagatggatgcaactttgtccaaggctgctcctacacccccagcatccaccaccatctctggttgctcctaaagtaataagttccatggcctatgtatcaagaagggcagcgcctaagaagcaacaatcattgtccattgtagatcacttaagggagctcagtgagactaatgatgataaagatggcttggtgttcaggaaacataaagctgcaccaccttcggataaggccactacgcctcaagtgaaaaagcaagttgatgctgcaattgctcatgattctcaacttgctaaggttcctcctgttcgggaacagacgtccaccgtccagcagtttgaaagaaacttaagaatgactagggagattgtcatatgccctctctccatgtataaagaccctaaagttgcaccatcttttgttgcattggatcaatctacagggattgaagttcttcctcctccaactttgaaatgtcttcaccctaagatatgcatgcctacatccccaacggccctacacaaaagtgtgtacaagatttcgtctggggcttgtagagaagtgaacatccaactcttcactctcgtgtcccagtttgttcctttagtctatggccatcaagccattccattgactaaggacaacatcttcaatgttggaatgattctgatgcggcatggtctaactgaccaatgggcaagctaccccccaggtatccacattcgtccaaccacaaccatcaaattcatgcccgacagggttgctccaaggttgcctccattggacctctggaaaaataaaggaaaggtgcctcctcacaccaaaccaatgccttatcttggtcccaaagataacatatccctgcgtccaattccctatggggcag

SEQ ID NO: 75264 - DNA, 357 bp, Glycine max
  Peptide Sequence Number=SeqID_166949
atgtcattggagaataagacaggagattcaactgtgctgaagataggaaattcggctaaagttgtgataaaacaagacatgaagggaagaaggcataaatatgggtttaacaacaacaaacgtgagaaggtagagaagaaaagggtggtggatgatgaaactggcgataaacatcaactggatgaaaggggaacgagcaacaatttgaaggttgtatattcaggaactaaagaattcaaaatagctagtaataagagggatttgtttttgggattttctgagcaccaagagcggctacgcaagaagcttgcacttgaggagggaaggatatttgcagctaatgaacaactttcttaa

SEQ ID NO: 75265 - DNA, 324 bp, Glycine max
  Peptide Sequence Number=SeqID_166950
acaacttggctaccccatgagaggagcgccatcggaggaaagcatcacgcctttcatcacacggggtttcagggaccccaacacgagggtgcttcaaggagtccgcaaggcataggatgtggtgcaaaggaaggcaaagagcttaggggaagcagtaatgggatcatcggcggctatcataagtggctgagagtccggacacaagggttggattggctcccaaagctaagggctgtgagaaaggaagaggctgaagctctagaagaaagtgaggaggttcaagccctaaaagcagagcttgaacaagcccgagcagtcaaatag

SEQ ID NO: 75266 - DNA, 54 bp, Glycine max
  Peptide Sequence Number=SeqID_166951
atgcctttatcactatcagaatacacacgtgagccagctcagaggattatttga

SEQ ID NO: 75267 - DNA, 303 bp, Glycine max
  Peptide Sequence Number=SeqID_166952
atgggtggtcttagcaacacccaaatgaccaccaatgggggtcgagtggtactcctgtgtcaaaagaggctaaagtctttaagtactaaaaggagcagtcacgctaagcggaacctgtgggctcagctcgcatctaccgctaagtgcagctacaacgcgcttagtgtgatgagagaatctagaagagcacaagaatcgaggtcgcgcgctaagcacaatatcatctcgctaagcgagatgttcgtctcttgccaggctcagcacacgactggcaccaagcccaaatccatttactcgcgctaa

SEQ ID NO: 75268 - DNA, 297 bp, Glycine max
  Peptide Sequence Number=SeqID_166953
atggcatggctgatggcgacggtcatgcaacttgtcttcctgcagcttggaaagggttgtggcctggggaagagaaattggttggagaagggagacacaaaagaattcaggcgattagtcctttgttcttttggaaaagggagaagagagacacaaaaagaattctggcggttattccttggcgaattctttttggcaaacggagaagagaatgaaaagatgaatagcacaagttttcaaggtttgaaaaaccagaaaacttcagaaagcttttggtacaaagaagaagaagaataa

SEQ ID NO: 75269 - DNA, 1071 bp, Glycine max
  Peptide Sequence Number=SeqID_166954
atgatgaattgttccccaacctcaaccttccgcgccttctccgatgccgaggaggatgaagaagacaatgaagaagaccaagaccaagaccaagacaacgtttctgccgacgaatacgacgatgttttgggtgaggcttccgacgaggccgacgtgttcgctcggcacgatggattcaattggcagagagtcgacaagctatgcaacgaagtcagggagttcggcgccgatctcatcgacgtcgacgagctcacctccgtctacgacttccgcaacaacatgtttcagcagcaggcgatactggcttttctgagaggcttctcgatggtggtttccgcttcgacgagtagtgggaagacgctgattgcagaggctgcggcggtggccacggtgactaggggacgaagaatattctacacgacatcgttcaaggcgctgtccaatcagaaatttggcgagttccgcgagacttttggcgacagtaatgttggccttctcacgggcgattctgcagtgaacaaggatgctcaggatttctctggtggtggtggaggtagtgcaaggcatagaggagagagtggaattaaggaaaaagatgagaaaacatctctcaactatttctgttttttgttaaaacgtcttgaaatttcacaacccgcgctttcgaaaacccttctacactctcgattctctttctcctcccacctgaaatctgccagaaaccgctcggtcgacacccacattgccccacattcatttcgatactatcaaaaaccgctggctagaacccacagaacctcctatcgaagaaaagtcgaagaaaaccctacactgctgttggaactgtgtgggtcgaaaaaaccctacactgctcttggaatagtcgagggtgctcaaagctcaaagctttctacgcttccagttaacaagcttgacgagagttacacaccgagcaaagtttccatccgtgacgatgatggttttcacaacttgaaggagattaagaccgtggaactcgtgaaggcaactgggtgggtttatctatccttgtctggagctgatcctaggtaa

SEQ ID NO: 75270 - DNA, 138 bp, Glycine max
  Peptide Sequence Number=SeqID_166955
atgacacaagacttggcgaggaaagtgaagagatctaagacatggatttgtgcctggaaatcatcggcacctatgtctatgccacgacgacaacattgtttgtcaaaaactttaaccgctaataggaaccacccttaa

SEQ ID NO: 75271 - DNA, 516 bp, Glycine max
  Peptide Sequence Number=SeqID_166956
atggcggcgcaactaatccatgaccgagtggagatggagtgcctagagggagcttgggagaccctcgaaggcaatgcgaggtgccgatttcggggcacgattcgattcacggctacttcattggtgcatccagataaacccgcacacacgcttcagcgcattgtggagtggatactacccacgcctacaccataccgtctagtggagccagtccaagtgatcgaggtgacgtcatccgaggaagaccgtgaggaggattctaaggagctacctcctgagcctgctgtggatgctcttgactttctagagggtgatgaggacccattccctgaggtggattctcccgagggcgtcatgtcggtatctaaggcagactctacggaggatagtggtcctggagagatggcgatcagtggaggctcttcatcatatggctacgggagtttggttaattgtccttccgaacatcagttcaatgattgccttaagaagtttgaaattgcttgttcatcatga

SEQ ID NO: 75272 - DNA, 291 bp, Glycine max
  Peptide Sequence Number=SeqID_166957
atggctaccaaaggttggagctttgttggagcttcaatggtggaggaagaagaagagaatggcaactccctcgcgtttctctgcgcctgtcgaggccagttttcgaaagtaggcaatatatatatcaaaacgctcaggataaaaccccgagtgcggttcaaagtatcactgcctcttaagaaagaactgatgcaatcctcactaggaaaggaccagtcaccagagccattagcaagaggctccaagaggattgggctagagctgttgaagaagtccctagggttcttatga

SEQ ID NO: 75273 - DNA, 214 bp, Glycine max
  Peptide Sequence Number=SeqID_166958
atgacactgccagacataatcaccacaacacagtcatcaattagagatgatggtgttacgtctataatcactgcactttggtatcattgtcctgtgtaccaattcaatggtcatgttgagtataagacaattcaaattattgacgaagaaggtgtttggtgcatgttcaatacatttgcaaatatggaaagtgatgcaagctccattggagctt

SEQ ID NO: 75274 - DNA, 225 bp, Glycine max
  Peptide Sequence Number=SeqID_166959
atgactaattttgcacgttgtttccaaatcatcattgttacgaaaacccatttttggtggttcttcctttgggattgccattcaaagtcattctcgtctggcgacatcccgtcccacttaaacaaagaggaaaagaccgaaacacctagcttcctctccaaaaacactaccctcgagaagatcctattgatccgtgatcgtgcgtgtgatcttttggatcgatag

SEQ ID NO: 75275 - DNA, 301 bp, Glycine max
  Peptide Sequence Number=SeqID_166960
atggcttcttcaaatggaaattttcctgcatctatgcctattctcataggcaagaactatgatgattggtctgctcaaatgaaggtaatctttcgatttcaagatgtgacaaaagtggtgcaagaaggggttcaagaacctgaaaagaacccaactgatgcacaatctgttgatactgtaaagaaggcatgggatattctagagaaatcctatgcaggggatagcaaactcaagaaggtgaagttgcaaaccttgagaaggcagtatgaacttctactaatgagtgatctaaaaagcattg

SEQ ID NO: 75276 - DNA, 624 bp, Glycine max
  Peptide Sequence Number=SeqID_166961
atggagagaagtatgattaatgcaaccaatggtggagcccttggagacatgacccctgcgaaagccaggaatttaattgagaagatgatttccaactcccagcaatttagtgccagaaatgacgctattgtcattagaggagtgcatgaagtagccacgaattcatcttcatcagttgaaactaagaagcttgaaggtaaactagatgccttggttaacctggtagcccagctggccttgaatcagaaatctatacctgtcgtaagagtttgtggtttatgctcctctctcgaccaccatacacacctttgcccttttatgcaacaatctggagcaattgagcagcctgaagcttatgctgcaaacatttacaatagacctcctcaacctcagcagcaaaatcaaccacagcagaacaattatgacctctccagcaacagatacaatcccgaatggaggaatcaccgaaatctcagatggtccagccctcaacaacaacaacagcctgctccttctttccaaaatgttgctggtcgaagcaggccatacgttcctcctccaatgaaacaacaacaaatgcaacagcagccacagccacgaccactgcagcaacaacagccataa

SEQ ID NO: 75277 - DNA, 306 bp, Glycine max
  Peptide Sequence Number=SeqID_166962
atggtttgcgaaggaagtgttccttgcctcggtctatcttacatggtggtaagagacttggactgtgtaaaagaaagttctaatctatctaatggggtgaaatatggtcatagcacagtttatgattctagccaatatgataaagaaattacactatttaggaggatggccgatgacacctttgttgattctgattttgatatgttaagcaaagaatacagtttgtcaagagacacctcaatgacctcaagaggattccaacaagaattgataggaaatagttatagtggcaagtttgaatcttga

SEQ ID NO: 75278 - DNA, 930 bp, Glycine max
  Peptide Sequence Number=SeqID_166963
atgcagcttgagaaggctttcagatacttgacatacataatcttaccctctttctttatggaacttgcccacaagatcatattcttttcagccgttaagatttcagccccacacatcagccctgggctcacctgtgagcttcagaagctgaggtttgaaggggtgcacaagctttttgaaggctgtgggtctgaggcaggcgtgatattcaaagaacatgtgaggatcagaaggcagttgtgggttacaagccataggtataggttcttcataattgggtgtgtggttacaatcactgttagtcagttgggtgctttgctgttggttttggcttccaagtctgataagaccttcttcaattctggtgaccttgtgatttgttcagctgtgcagttaagtggcttcttcttgtgcattttgggagcagcaagaatcacacacagagcacaaggaatagtggcaattgcaacaagatggcacatgctggtgactactgcatctgctgaatcagagcattgcgaagctcaggtgtctgaggggctagctagtgatgatgacagtgactctgatgattcctccaacatacacgtatcagtgatcccaccacaactttcttctttccaaaccagacaaactttagtgacatatttacaacacaatcacggaggaataacggtgtatgggtactcacttgatcgaggattgcttcatactctgtttgccttcgagttttctctagtgctatggattctgagtaagaacaagagagggtacatctcttgtggatcagttcaagtggagggtacatccacttggtttttcaaagagatcaagggagggtacatcccttatggatctttggcttgtaaaggattttacaaggttgaaagaaatcttaagaactgcaggttgcttgggaactggatgtag

SEQ ID NO: 75279 - DNA, 1131 bp, Glycine max
  Peptide Sequence Number=SeqID_166964
atggagcatctgcacatgaaaacccgtacccaacaaatcgaagaattaaagaaagagtggacacagcctcgctgggaaggcatccgccgtccttatagcgcggaagaggtggtgaaattacgcggctcggtcaatccggaatgcacgctggcccagaacggtgcggcgaaaatgtggaagctgctgcacggcggttccaaaaagggctatatcaacagcctcggtgcgctgaccggcggtcaggcactgcagcaggcgaaggcaggcattgaagcaatatttatctctccggctggcagcatgtatccggatcagtcgctctatccggctaactcggtgccgtcggtcgtggatcggatcaacaacaccttccgccgtgcagatcagatccagtgggccgcaggtatcgagccaaacgatccgcgctttattgactacttcctgccgatcgtcgcggacgcagaagccggttttggtggcgtgctgaacgcatttgagctgatgaaatcgatgattgaggccggtgcagcggccgttcacttcgaagatcagctggcctccgtgaagaagtgcgggcacatgggcgggaaagttctcgtcccgacccaggaagcgattcagaagctggtagcggcgcgtctggccgctgacgtgctcggcgtgccgacgctggtcattgcccgtaccgatgcggacgcggctgacctgatcacctcagactgcgacccgtacgacagcgagtttattaccggcgagcgcaccagcgaagggttctatcgtacccatgcgggcattgagcaggcgatcagccgtggcctggcgtacgccccgtacgcggacctggtctggtgtgaaacctccacgccggatctggcgctggcaaaacgctttgccgatgccatccacgcgaaatacccgggcaaactgctggcctataactgctcgccgtccttcaactggcagaagaatctggacgataaaactatcgccagcttccagcagcagctgtccgatatgggctacaagtaccagttcatcaccctggcgggtatccacagcatgtggttcaacatgttcgacctggcccatgcctacgcgcagggcgagggcatgaagcactatgttgagaag

SEQ ID NO: 75280 - DNA, 576 bp, Glycine max
  Peptide Sequence Number=SeqID_166965
atggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacgtgaatacccgacgatttcggcagtttctacacatatattcgcaagatgtggcgtgttacggtgaaaacctggcctatttccctaaagagtttatagagaatatgtttttcgtctcacccaatccctgggtgagtttcaccagtttagatttaaacgtggccaatatggacaacttctttgcacccgttttctccatgggcaaatattatccgcaaggcgacaaggtgcagatgccgctggcgattcaggttcatcatgccgtttgtgttggcttccatgtcggcagaatgcttaatgaattacaacagttctgcgatgagtggcagggcggggcgtaa

SEQ ID NO: 75281 - DNA, 1242 bp, Glycine max
  Peptide Sequence Number=SeqID_166966
atgggtcaacttcaacggcaagccttccgcaaagcctatgccgttgaggtgcttcatctttggggacttcctgctatcaccaatggaattagaccgccaaaggcaagtcgaaaatggggtggtcggaataccgagaaaatatttggagtcctctttccaaatgtggatgggttggtggacctggcagcgatcgacgtttttctcgcctatcataaccacaaggaaagtccggttgtcgctatgctagccgacctatatgacaccttcgaccgaagatgtgaagaaagcaatgcaaggattgttgctgtactccagctctctatgtggggctggtttcacacccttttctccaagaaggtaggcccgtctatccgctacaaggaaggaagaatcaggatcctatcttcatgcgaaggatgtccaaatgttcccttgatgggaacaaggggttgtattaattataatcccgttctcaccataagacagcttggctaccccatgagaggagcgccattagacgaaagcatcacgcctttcatcgcacggggttttagtgaccacaacgcgagggacagagagcttaggggaagcagtaatgggatcatcggcggctatcataagtggctgggagtccgaacacaaggattggattggctcccaaatctaaagactgtgagggacgatgaggttaaagcttcggaagaaagtgatgaggtacaggccctaaaggcagagcttgaaagagcccgagtagtcgaagagaagttcaagtccatagccatcaaaggcagcaatagtaagctcaagctccgaagagtgaaaggaatcatcacgggtcaaaggcatgatctgaaggacgagctaaaggcttgcgttaggtcgaaaagaaatttgtcccaacagctaagcgagactgaagggaatatgtgggccatcatcgatgactgcaaagagaagctaaatctagcggcgactcacgagcaaaggctagaggatgagtacgccaagatatcagcagaaagggaagcaagggaaagggtaattgattcgttgcaccaagaggcaacaatgaggatggaccgatttgctcttactttgaacaggagtcaagaacttccccgattgctagccaaggccaaagcaatggcggacacctactccgcccccgaggagatccacggacttctcagctattgtcagcatatgatagacttaatggaccatatgattagaaaccgctag

SEQ ID NO: 75282 - DNA, 216 bp, Glycine max
  Peptide Sequence Number=SeqID_166967
atgattttcactctcctcttctccaaaaatgccacccaaaccctaaaacctcatttttcaccacccaagaccaccggtggctgccataagccgccgttgcttgttgttggacccccacaccaagaggaacactttaatcgaagcggaatcctcagaatcctcctcgaagattcgatggagaaaatccctcaatcctccatttcaaagttctctgag

SEQ ID NO: 75283 - DNA, 672 bp, Glycine max
  Peptide Sequence Number=SeqID_166968
atgtctcccctctttgagcagaattgcaactgtggtcaaggattcagcaagaggtttggaccgcataaaacagactcggaacggcatagcgggcctaccacagaagtacctagaagacaaggcgaggggtatggccaatcaaggagactgggtcccgtttatggatacctagcagcaatcgacgctttccttgcctaccaccatagcaaggaaagtccggtggtagctgtcttggcagatctatttgacacatttgaccgaaggtgcgagaagagtagcgcacggatcatctgttgcttacccgccctctgtgtttggttggtttcacacttgttccaacaagacacaagacatccatgtccgctcctgagccatcgctcgtgtactgaaaagaggagaatggattgggaccagctcttggccgggataggaggtagaacaatcagttggttcccccgatggaaggaaggaaaagaaggagtccttttctcatgtggaagatacccaaacattccgctggtaggaacgaggggttgtattaattacaatcccgcgctcgctataagacaactagggtaccccatgaggggagcaccgacggaagaagcatgtctctttccttgtgagggatctcggcgcacaaaattccaagactatacaaagaatccataa

SEQ ID NO: 75284 - DNA, 153 bp, Glycine max
  Peptide Sequence Number=SeqID_166969
gttcctaatacgatacaaacccagtttgttgttaacgctgttgaagcagataaacatcctgttgttttactttccagctcaatcataaaatttgctgagcaatgcctcagtccagaaatgagagcatcagtttttagtccccggcttatggag

SEQ ID NO: 75285 - DNA, 69 bp, Glycine max
  Peptide Sequence Number=SeqID_166970
atggaagagaagcttgcttgtggagcttctatggaggctggatctttgagcttcaatgggatcctttaa

SEQ ID NO: 75286 - DNA, 258 bp, Glycine max
  Peptide Sequence Number=SeqID_166971
gcggccaaccacagggggaaggtgcagatccatgagtgtctccaccagctcagcctcagtcagcagagccagggtttcgctccttttgcgtgccctactccagatcagtttagggctgaggttgtatggcccggggattggcctgaggcccaggcaggggaggcacccacagaggctcccagcgatgcagaggaggcccgcatggatgaggagatgacagatttactcgatttcttgggagggagcggaggcacatga

SEQ ID NO: 75287 - DNA, 384 bp, Glycine max
  Peptide Sequence Number=SeqID_166972
atggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccgttaaggctaactga

SEQ ID NO: 75288 - DNA, 390 bp, Glycine max
  Peptide Sequence Number=SeqID_166973
atgatgagaatcatgaaactggccaaatacaggctaaaggcccaagtggagaagaacgaaggcccaagtggagaaggacaaagcccccgagtggagaaggatgaaggcccaagtaatccttgtggcgtctaccttgacttatcttccttcactggaagtggcgtctacccggacttatcttccttcaccggaagtggcgtctaccctgacttatcttccttcaccggaagtggcgtcatccaaatatccgtagcctgtaatccttgtggcgtctacccagacttatcttccttcaccggaagtggcgtctaccatgacttatcttccttcactggaagtggcgtcatccaaacctttgtagcctgtatcaaacaatccgctcctactcag

SEQ ID NO: 75289 - DNA, 255 bp, Glycine max
  Peptide Sequence Number=SeqID_166974
atggggggaggaggttgcatgacagctcgcctaggcgagttgcttacttcctccagaagcaacatgcttgcccagaaaaagaatcaccaaaaaagcaaaggaggggtttatttagtaaaaaagagggatgcaaatagcaacaaggcccacttgggccttccagaatattcctccagaaggcggttgcttctggaggaagcaacctggctcgcctgggcgagctgggtggcaagctcctcccctattttcctataa

SEQ ID NO: 75290 - DNA, 393 bp, Glycine max
  Peptide Sequence Number=SeqID_166975
atgcatgagaacgaatggcacggcgcgtgtttgctctttgcccctatttgggaacctataggacactatctaggggtctctaataactactccccaacaattcataactcacacggctgttttctagagttcaataaaagcacacccaaagttcaccattcgacaattcctaaaataggcctaactcacaaagaaaaatccccagcggagtcgccaactgtcgcaacgtgcccttcgcgggcgaccgagggcgaggctcacgggtgcgctttcccaaaggaggaaagatgcgcaaagtcgccaccaacgtttatttgtggaaaacgtcggaaaaaaccgaaggaaaccggtcaaaacgataattctaagttcgggagttgtatttacgcttga

SEQ ID NO: 75291 - DNA, 246 bp, Glycine max
  Peptide Sequence Number=SeqID_166976
atgcatgtgcatcgttgttgtcctgtaagtcagaggacaggagaagagttggtagataccataccaagtccaaggccaaaggtaagcaaaggcttaggagtaggtacgagcaggtattgggcccgtgatcgacaggtcgtcgtcctacgtctggctcaagatgttaaagaactgctactaagaggctgcctagtaccttttaaatttctgcttgttagttattcacctatgtttcttaagccatag

SEQ ID NO: 75292 - DNA, 534 bp, Glycine max
  Peptide Sequence Number=SeqID_166977
atggctgagctaagccaattacagctcagtctgaattgggctatgccagagccatctgctaagcgtggcatatggcatcaaggaaaaggaagagcaaacctcaagctcagtatgataccaggggattccaatcaatggaagcctggaaccgatatacagataacattttggaccggaggatccttccgtaaaggaatgttaagatttatcatactgaagtcgggaagcatagatgtggcagtggttaaagaattctatgccaacttatacagcccagaagaccagagccctaagcaagtgagggtgagaggacatttaatcaggattgatgctgacaacctgaattccttcttagagactccagaagtcttagaggagggtgagacactgcctacctattccaggttttcgaggatgatgattgatcctcaagagtttgctgctcatctctacatccctggtaggggttttgttctaaatgaagagcaccatccttggaagcttctgaggaaagatctcaccactcttgcatag

SEQ ID NO: 75293 - DNA, 300 bp, Glycine max
  Peptide Sequence Number=SeqID_166978
atggatattaaccccggccttacagctgtcttttgggatgcccgtggatcccactctgtgggagtccgttcccctctacaattccaccaaaaactgaagttagtagtggaggggcatttggtcatttgtatcgggggaggaagacgtcttgcattgcctatccgatacggcaatgatggtggcccgggtgatgttggggtatggctacgagcccgaaatgggttttggcatgaacaacgatggcagaaccagcctggtaagcaccagaggaaatcgcgggaagtttgggttaggctataa

SEQ ID NO: 75294 - DNA, 312 bp, Glycine max
  Peptide Sequence Number=SeqID_166979
atgggttctccacctgcctctactcctcctcatcctcatcctcctcctcctccacctcctcctccttctccttcggacgcatcggcttcgccgtctgctgtgaagcagacacgcaaagcctcacgtctacgatcgttgtccactagaccacctggtgttgaaagaccagtggtgcatgttgatcctgctacagggaaggccgacggtccccacaagaagaaattaagaacatatttggggattgtggcacgtgataaggtggacatcacctacgagaactggacggaggtccctactgctcagaaggactga

SEQ ID NO: 75295 - DNA, 237 bp, Glycine max
  Peptide Sequence Number=SeqID_166980
atgtccccaatggagttgtcaactgtcgcaacctacccttcggcgagagggcgacgcgaggctcatgggtgcgtcttccaaggaaggaaaacgtgcaaagtcgccaccaacatttatttgaggaaaacactagaaaaaccaaaagtgggtctacgaattttaagaataaaaggttcgggagttgtttatgcaccaggaagcggggcttttgctccaacgtatcctcaattgcgatga

SEQ ID NO: 75296 - DNA, 201 bp, Glycine max
  Peptide Sequence Number=SeqID_166981
atggataaagttgatatctttgtccctcatcctctcacaaacgcatctttacttattcaactttcaccggaatgtgggtctgtttgctcaagcgacctgtgctccagagtttggacttccaagaccgttcaattagagattactcgtcttgcacgttggtgggggtgccgtaaaacaacgagtaaagctcaaaacagataa

SEQ ID NO: 75297 - DNA, 869 bp, Glycine max
  Peptide Sequence Number=SeqID_166982
ctatcacctatggtagaagaatttgaagagatcctaggatgccctctagggggaaggaaaccatacctcttctcagggttctatccctcattagctagaatttctaagatagtccaaatctcggcgcaggaattagaccacagaaagcaagtcgaaaatggggtggttggaataccgagaaaatatttggaggcaaaagcaagaatcttggcaggtaaaggcgaatgggccccgttcatagacattctcgcactgttgatcatcggaggagtcctctttccgaatgtggatgggttggtggacctagcagcgatcgacgcttttctcgcctatcataaccacaaggaaagcccggttgtcgctatgctagccgacctatatgacacctttgaccgaagatgtgagaagagcaatacgaggattgttttctatactccagctctttataaaggaggcgcagattgggaccaactcttggcaaaccaagaaggggcgtctatcaactggttccctcgatggaaagaagggagagtcggagttcttatttcgtgcggaagatttccgaatgttcccttgatggggacaaggggttgcatcaattacaatcccgttcttgctataagacaacttggctaccctatgagaggggcaccactagaggaagagctcgcgcctgacaaagaactcagaggcagtaacaatgggcccatcggtggctaccgaaggtggttgaaagcccacgtgcaaggtttggattggctcccgagtttgagaaccgctaaaagggagcaagttgaggcaccggaggaagacgaagaggtgcaggcccttaggacgaaactcgagcaagccaaaacagtcaaagaaag

SEQ ID NO: 75298 - DNA, 357 bp, Glycine max
  Peptide Sequence Number=SeqID_166983
atggttgaagcacgtcaaaaggaggggaaaagacggaggtggttgccgcctagctcgcccaagcgagctgggttgcttccaccagaaggcaccgcctggttgctatttaatgttgcggaactttacggattgtgcaacaatgcttctttccgacttcgagaatgttgtgaaactttcacggattgcctaacgatgggcgtcaagtacctcgaggcggtcaagcgaaggttgcatgccaccaaacaatggtccccggacgaaattaggaggagaaactttgaggaatctcaggaacttgctagagaccctgctatcactgtcagaagacacgtgagcccgcttagaggtaagggatga

SEQ ID NO: 75299 - DNA, 526 bp, Glycine max
  Peptide Sequence Number=SeqID_166984
agcttcaacattcaatttcgagcgtcccgatatattacaggactcaatcagacatccgagtaaaaagttattgtcgtttgaatttgcgcagaggttcaacattcaatttcgagcgtctcgatatattacgggactcaataatcgacatccgagaaaaaatttattgcgttgtttgaattggctcagaggttcaacattcaatttcgagcgtctcgtcaatatattacgggactcaatcagacatccgagtaaaaagttattgtcgtttgaattggctcaaaggcttaaacattcaatttcgagggtctcgatatattacgggactcaatcagacatccgagtaaaaagttattgtcgtttgaattggctcagagcttcaacattcaattttgagcgtctcgatatattacgggactcaatcagacatccgagtaaaaagttattgccgtttgaattggctcagaggttcaacattcaatttcgagcgtctcgatatattacgggactcaatcagacatccgagtaa

SEQ ID NO: 75300 - DNA, 258 bp, Glycine max
  Peptide Sequence Number=SeqID_166985
atgagtaacagggacagtcgggggcattctgatttcatagtcagagaacgaaagttgggggctcgaagacgatcagataccgtcctagtctcaaccataaacgatgccgaccagggatcagcggatgttgcttttaggactccgctggcaccttatgagaaatcaaagtctttgggttccggggggagtatggtcgcaaggctgaaacttaaaggaattgacggaagggcaccaccaggagtggagcctgcggcttaa

SEQ ID NO: 75301 - DNA, 593 bp, Glycine max
  Peptide Sequence Number=SeqID_166986
gctaaaacgaatttgtctcacgacggtctaaacccagctcacgttccctattggtgggtgaacaatccaacacttggtgaattctgcttcacaatgataggaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacgatgtgccgccccagccaaactccccacctgacaatgtcttccgcccggatcgaccggccgaagccgaccttggctcccacttatcctacacctctcaagtcatttcacaaagtcggactagagtcaagctcaacagggtcttctttccccgctgattccgccaagcccgttcccttggctgtggtttcgctggatagtcggattccccttgtccgtaccagttctgagttgactgttcgacgcccggggaaagaggccccgaaggcccgttcccaatccgtcccccgaccggcacgcgacgacccgttctcgccgggaagcagctcgagcagtccaccgacagcgaacgg

SEQ ID NO: 75302 - DNA, 882 bp, Glycine max
  Peptide Sequence Number=SeqID_166987
atggatgtcggtgcggtgtcggtcacctttcaggacacgcacgacaacccggtttatgagccgctgcccggtgaaacccgcctgtggggcgataccgatgtgattggcctgttcgacgcggaaaccgccatggacgatgtagtggccgaactgagccagcatccgctgctgggatcgggtttccgccataagatcgaacagatcgaggataaagactgggagcgcgaatggatggataacttccatccgatgcgcttcggtgaacgcctgtggatctgcccaagctggcgcgacgtgccggatccggatgcggttaacgtgatgcttgatcccggtctggcctttgggcaaaacggtgatcgatttcggctgtggctccggcattctggccatcgccgcgctgaaactcggtgcagcccagggcgatcggcattgatatcgatccgcaggcgatccaggccagccgcgataacgcggagcgcaacggcgtggccggccgcctgtcgctgtatctgccgcaccagcagccggaaaacctgcaggcggatgtggtggtcgccaatatcctcgccggtccgctgcgtgaactggcgccgctgtttagcgtgctgccgaaagctggcggccatcttggtctgtccggcgtgctggccagccaggcggaaagcgtgtgtgaagcctatgcggagcgttttgcgcttgacgccgtggcggaaaaagaggagtggtgccgcatcactggcgtgcgccgctaaccgacgcatgggccagcggctgctggcccgatttcccccgcctgagacctgtctcaaatccccgccagccccgttttcctgccgtttctttacattgaaatcagtagactgctgcaccaggcgatag

SEQ ID NO: 75303 - DNA, 768 bp, Glycine max
  Peptide Sequence Number=SeqID_166988
atgcctacatgtcctcgtattcagagcactacacgtcctccccttcagtggagtacacgttctcaccttccgaggactacacatcctcgccttcagaggactacacgtgctcaccatcaggggactacccatcctcgccttcagagggctagatgccctcatcttcagaggagtacacgtcctcacctcaagagggctacacgccctcaccttcagaggactacacgtcctctccttcagagggctaacgtccttgccttcagagggctacacgtcctcaccttcagtggactacacgtgctcgccttcagaaaactacatggcattaccttcagaggagggctacacaccctcgcctttagaggtgtacacgcccacgcctttagaggactacatgtcctcacctttagagcactacacgtcctgaccttcagaggccaacacgccctcaccttaaaaggcctacacgccctcgccttcagagcgctacacaccctcaccttcataggactacttgtccctgccttcgaaggactacacgtcctcactttcagaggactacacgtcctcacctttagaaggctacacgtcctcgccttcacaggggtagatgccctcaccttcagagtactacatgtcctcgctttccaaggactccacgccctcgctttcgtggggctacacgccctccccttcagaggacaagatgccctcaccttcagaggaataacggtcctgaccttcagagggcaacacgccttcacctaa

SEQ ID NO: 75304 - DNA, 780 bp, Glycine max
  Peptide Sequence Number=SeqID_166989
atggctgcaatcttagctcgaaaatcactccttgctcttcgtgcgcgccaattggctgtaagcggtcaagggctgcacagctcccaatactatggccttcggttaagtgcacactccttctctaccaaaagagaggatgaggaaagggagcaactcgcaaaggacatttcaaaggattggagttctgtctttgaacgtagcattaacactctctttctcactgaaatggttcgaggactaatgctgactctgaaatacttctttgaaacaaaagttacaatcaattatccatttgagaaaggccctttgagccctcgtttccgtggtgaacatgcactccggcgatatccaacaggggaggaacgttgtattgcttgcaaactttgtgaggctttgtgtctagatgttaccaagtgtaacatgtcattggttaatgcagaaacaaatgtgcagctgtttttgtattcgaataacactacacaaagtgtaaggcttagacccttgatatgtcctgcacaagcaatcacaattgaggctgaggagcgagaagatggcagccgcaggacaactcggtatgatattgacatgaccaagtgcatctattgtggattttgtcaagaggcatgccctgttgatgccattgtcgaaggaccaaactttgaatttgctactgagactcatgaggagcttttatatgacaaggagaagctgcttgaaaatggggaccgatgggagactgaaattgcagagaacctgagatctgaaagcctttatcgctga

SEQ ID NO: 75305 - DNA, 1980 bp, Glycine max
  Peptide Sequence Number=SeqID_166990
atggccgctgaaacgattccctaccagaacggcgtcgttgccagctccaacgattccaccgccacgggcaagaaatcgcgggagaacgaccgccgccgccgccgccggaagcagaagaagaacaacaaggcatctgaggccccggttcctaactcttccgaagagagtgacgatgcgaaagagaacaacgattcaaaacagattcataggaaattgattctgaatgttagttcaaacaatattgacgtgaaactagggttttcgtacttgaatagagctcgttgcgtttcagggcctttggttgagagtgagagaatctctagggctttgcttggtgaaagggaattggagggaaaagattggagaatgatctgtgtattcggactacttgttgaacaaattgaaattgagtacgtaccggagaaggcagagttagttgaaggcatggatgaagagtttagaaaaatctttgagaaatttactttcactgatgccactgctttggaggatactgataagaaggatggttcagaagaaaatgcagcaactaataagaaggctaattctgattctgaagaggaagaaaacgataatgagcaaaaagagaaaggcatctcaaacaagaagaaaaagcttcaacggaggatgaaaattgctgaactgaaacaaatttgcttgaggccagatgttgttgaggtgtgggatgctactgcatcagacccaaagttgctggtgttcttgaagtcttatcggaatactgtacctgtacctaggcattggtcctgcatgagggatgtagtgatagggggagctgctgaggcaatcaccaaccctggacttggtaaacgaggtatagagaaaccaccctttcagcttcctgatttcattgctgccactggaattgagaaaatcagacaggcttatattgagaaagaggatagtaagaagctgaaacaaaagcaaagggagcgcatgcaaccaaaaatggggaaaatggatatagattatcaggttcttcatgatgcattctttaaataccaaacaaagcctaaactgacctctcttggagacctgtatcatgaaggaaaagagtttgaggtgaagttgagggagatgaaacctggcatgttatcacatgaattgaaagaagctcttggtatgcctgaaggttctcctcctccttggcttattaatatgcagagatatggtcctccaccatcatatcctcatctgaaaatccctggactgaatgctcctatcccccctggagctagctttggttatcatcctggtggatggggcaagcctcctgttgatgaatatgggcgtccactgtatggagatgtttttggtgttcaacaacaagatcagcctaactatgaggaagagccagttgataagaccaagcattggggagacttggaagaggaagaggaagaggaagaggaggaggaggaggaggaagaagaagaagaaatggaggaggaggaacttgaagctggtattcagtctgttgatagtctgtcaagcactcccactggagtggaaacacctgatgttattgacctccggaagcaacagaggaaggagcctgagaggcctctttatcaagtactcgaagagaaggaagaaaaaattgctcctggaactttgcttggaaccactcacacttatgtggttggcactggcacacaggacaagtcaggtgctaaaagggttgatctgcttagaggtcagaagacagataaagtagatgtcactttacagcctgaagagttggaagccatggaaaatgttttgcccgcgaatggtttcttacctctattggatgagtacaggtacgaagaagcaagggaagaagagaagttgcgtagtcagcgtgaagatttcagtgacatggttgcagagaacgagaagaagaggaaaagaaagatgcaagaaaaggagggcaagtcaaagaagagagacttcaagttttag

SEQ ID NO: 75306 - DNA, 507 bp, Glycine max
  Peptide Sequence Number=SeqID_166991
atgcagcgtttacccgccaaaatgatagccaaaatcgctcgtccagcatgcgatgtcttcataaaccaccgtgggatagacacaaaaaggaacgtttcggggttgttgtacgataatcttacgaggatgggagtgaggtccttcttggacagcatgaacatgaaacctggggataggcttttcgaccacattgatagggctatcctaggttgcaaggttggtgttgcggtcttctctcctcgttattgtgactcctatttctgcctccacgagctagctcttctcatggagtccaacaaaagggttgttccgattttctatgatgtgaaaccgtcgcagcttgtggtcaaggacaacggaacacgttctccaaaggagcttcagaggttcagtttagcacttgaggaagctaaaaacaccgtgggtttgacgtttgattctttgaatggggactggtcggagtggctaaggaatgcttccgatgcggtgatcatgaacttgcgggag

SEQ ID NO: 75307 - DNA, 2526 bp, Glycine max
  Peptide Sequence Number=SeqID_166992
atgaatttaagacagcgacccgtcgccgcgcgcggcggcgccaccaacctgccgcggccgcctccgctgaactccgtcttcaacattatccccgtgcatgacctcttcacggaccatccgtcgctccggtacccggaggtgcgcgccgccgcggcggctcttcgcaccgtcggcgacctcccgaagcaccagttcatgcggtgggaaccggagatggaccttctggactggctccggttactcttcggcttccaactggacaacgcgcggaaccagagggagcacctggttctccacctcgcgaactcgcagatgcgcctcgagccgccgccggtgatcgtcgacgcgctcgacgccggcgtgctgcggcggttccggcgaaagctcctccacaactactccgcgtggtgctcgttcctcggcctgaagtcgaacgtgcttctctcgcgccgccgcgacccaacggatcttcggcgcgagttgctgtacgtgtcgctttatcttctggtttggggagaggccggtaaccttcgtttcactcccgagtgtctttgttatatttatcatttcatggcgaaggagcttaatcatgttatagatgaacacggtgatcctgatactggtcgtccttatatgcctacggtttctggtgaattagggtttttgaagtctgtgattatgcctatttataatactattaaggttgaggttgatagtagcagaaatggaaaggctccgcactctgcgtggagaaattatgatgacattaatgagtatttctggagtaggaggtgtttgaagagactcgggtggcctttgaattttgaatgtaattttttcggtaccacgccgaaggagaagagggtggggaagacggggtttgtggagcagaggtcgttttggaatgtttataagagttttgataggctctgggtgatgctgattttgttctttcaggctgccattattgttgcttgggagggtaccacttatccatgggaggcgttggagaaaagggatgtgcaggtcaagatgttgactgtgtttatcacttggagtgctctgaggtttcttcaatcggtgcttgatgccgggactcagtatagcttggttactagagagaccaggtggcttggagtgaggatggcgctgaagagcatggctgccataatgtggactgttttgttttcggtcttttatggaatgatttggattgagaagggttctaggccaatctggtctgatgcggccaatcagaggatttatacatttcttaaagttgtccttttctttcttatcccggagctgttggcgttggtgctgttcgtggtgccatggttgcggaatgtcattgaggaatcagactggaaaatagtatacttgttgacatggtggtttcatacccggatttttgtgggtcggggtgtgagacaagcgctaatagataatgtaaagtatactgttttctgggtagcagtattagcttcgaagttttcattcagttatttatttcagatcgagcctctagttgctccaacaaaggctcttttgaatcttaagaacattcgttataaatggcacgaatatggtattcaattttctctgccttttatggcgcggcaattgttcaatctgatgccagaggagaagctgctaagtcagcaagctacactgttaaagaagcttcgtgatgccatccacaggttgaaactgcgatatggacttggtcagcccttcaataagattgaatcaagccaagtggatgctaccaggtttgccttaatatggaatgagattatgataactttcagggaggaagatatcatcagcgatcgagaacttgagctcttgaaactgccgccaaattgctggaatattagggttattcgatggccgtgttcccttctctgtaatgagctgctgcttgctgtcagtcaggccaaagagctggaaaatgagtctgactggtcactttggttgaaaatatgcaagaatgagtatcgccggtgtgctgtcattgaagcttatgatagtgttaaatatttgtttcccaaggttcttaaagctgaaaaagaagagtattccattatgactaatatattcggggtcatagacagctacattcagacggggaagttaacagaagcatacaagatgtctcggctaccacagatacatggtaaggtgagtgaatttgttcagcttttgatacaaccagagagagatatgaataaggctgtaaatttgttgcaagctttgtatgaactttttgttcgagagttcccaaaagtgaagaggaccatcatccagctacgtgaagaaggtctggcacgacgaagttcaacagctgatgaaggactcatctttgagaatgctgtgaagtttcctgatgctggagatgcagtctttactgagcagctcagacgattgcacacaattcttacttcaagagactcaatgcacaatgtcccattgatctcgaggcacgacgacgaattgctttctttaccaattctttgtttatga

SEQ ID NO: 75308 - DNA, 879 bp, Glycine max
  Peptide Sequence Number=SeqID_166993
atggtgcttagtgaggaagctgagcctaatgaagcaactatagtaactgttttatcagcgtgtgcctctattggaaccttgagtttggggcagtgggtgcattcgtatattgactcaagacacgaccttgtggttgatgaaaatattgggaatgctttgcttaacatgtatgtgaagtgtggagacatgcaaatggggtttagggtttttgatatgatagtgcacaaggatgttatctcgtggggcacctttatttgtggactagccatgaacggttacgagagaaacacattggagttgttttcacgcatgttggttgaaggggttgaacctgacaatgttacgtttattggggtgttgtctgcatgcagccatgcagggttgctgaatgaaggggttatgtttttcaaagcaatgagggatttttacggcattgtgccgcagatgaggcattatggttgcatggtggacatgtatggacgtgctggtttgtttgaggaggctgaggctctccttagaagaatgcctgttgaagctgaagggcccatttggggggctcttcttcaggcttgcaaaattcataggaatgagaagatgtctgaatggattaggggacacctcaaggggaaaagtgttggtgttggtactcttgctttgctgtctaatatgtatgcgagttctgaacggtgggatgatgctaaaaaggttcggaagagtatgagagggactggattgaagaaagtggcaggatgtagctgggttgagctagagatgtccaacaacagattgggttcaaatttctctctctattacaaaaaccaggtggcaaaatgggttatctgccccgtcctaatgcaagtggcagttatagcaggctaa

SEQ ID NO: 75309 - DNA, 753 bp, Glycine max
  Peptide Sequence Number=SeqID_166994
atggtgtcctttggaaggttgccttttcttcctctcatgctaaccttctggcttatatttaccgcttcatattgcaaatggatgtgtagggcgtcagattttccaagggaatatgatgggacctgccttcagatgagaatgtcatacagtccagcagcacacctgtttctcttttttgtgcaatggacagactgcaatcttgctggagcccttggactgttaagaatcctaatatacaaagtgtatgtggatgggacaactaccatgtctacccttgaaagaaaagcaagtattagggaattctatgcaatcatatatccctctttagtgcaactgcaagaaagtgtggcagatacagaggataaaaaacagaaggctgtatgcatggagaggtatcgcaaaagagatgatgaggagcacagacagccttcagacatagacattgaaagagaagaagaatgtggaatatgcatggagatgaatagtaagattgtgttgcctgactgcaaccatgtcatgtgcctgacatgttaccatgaatggaggacaagatcacagtcatgcccattttgccgtaacagtcttaagagagtaaactcaggtgatctctgggtgttcactgataatagggatgtagtagacatggcaacagcgacaagggagaatcttagaaggcttttcatgtacatagataagttgcctttggtcattccagactttctctttgacacatatgactctcacctaagatga

SEQ ID NO: 75310 - DNA, 2940 bp, Glycine max
  Peptide Sequence Number=SeqID_166995
atgggctctgttcaacttcattggtctcagtggcctcctcagaatgcaacaccacccaaatggttttgcactagtaaaggaccattgggttgtggccccagtggcattatggctggtgatgctatcattacagacagtggtgccatgcatgtggcaggtgtgccaattgttaatccatccaccattgttgtttgggaggttatgcctgggcctggtaatggtttccaagtaattcctagaacaagtaccaataatggtgttccacctcctcttagctcacccaactggactggttttgcacctttagctgcatatttatttagttggcaagatcatctattatctgaagaaaaacaagggaaaaaccagacaaaccaaaaccttggtgattctataccacttaactgttcaccggtttcaaatttttcagcatatgtgagtcctgaaactgcagctcaaactgctgcaaccactacatggggttctggtgtaacagcagtagcttttgatccaacttgtggtggttccgtgatagctgttgtgatagctgagggacagtacatgtccccatatgatccagatgagggcccatcaatcacagggtggagagtgcaactctgggaatcatctttacagcatgttgtccttcatccaatatttgggaatcccacttccagtatgggtggacagcctcctatgcaaactgtttggcagaccaaagtggacctgagcattccaccaacaaatgatttcaagaatcatcaagctccagcagttggaatgaacactgacattcaaaaggtatccgagtttggttttgataagtcaaaaagggtcaattttgatccttttgatcttccaagtgatgttagggcacttgcacgaattgtatactctcctcatggtggtgaaattgccattgcttttcttcggggtggagtgcacatcttttctggtccaaattttgcacctgtagacaactatcagattagtgttggatctgcaattgctgctcctgctttttcttcaacaagctgctgttcagcttctgtttggcatgacccaagcaaagatcagacaattttgaaaataatccgggttcttcctcctgctattccaactagtcaagtaaagaccaactcatcaaactgggagcgtgcaattgctgaaaggttttggtggagccttttggttggagttaattggtgggatgctgtgggctgtacacagagtgctgctgaggatggtattgtttcactcaacagtgttatcgcagtcttggatgcagacttccattctcttccttctgctcagcacagacaacagtattgtcctgtatacttctctgaactttcaccattagctttcgtagttatcttcttcattagtctagacaggataaagtgtaggctgcttgaaggggcaaatgctcaagaggtcagggcaatggttctggatatgcaagctaggttgttgttggatatgcttgggaagggaattgagtctgctttgataaatccttcagctttagtgcccgatccatggcaagtatctagtgagacattaaccagcattgaccctgaagcagtggctgttgaacctgcactagttccatgtgttcaggcttatgttgattcagttcttgatctagcttcacactttatcacccggttgcggcgttatgcaagtttctgccgtacattggcaagtcatgctgtaactgcagggacgggaaataaccgaaatgtggtagctagtcctgcccaatgttctgcaactcctgcaacaagtcagggaggtcaaaatgggacaaccagttctagtggaagcacacagatgcaagcttgggtacaaggggccattgccaagattagtagcactactgacggagtgtccaacccggttcctaacccccccatcagtggtccttcgtcctttatgcccataagcattaatacaggaactttccctggaacacctgcagttcgacttattggggactcacaacaaccccgctatgcgggaggtgtacagagaactgctgacacaaatctacaaaaacctcaacctaatgcttctgtccctggcaaggtggaggaaattgcaaaaccagtgtcaactgtggttaggccagatgatggtcaggctggtcgagttagtcaacttgtgcctgcatcaaaaggaggtgaagaaccatctccagggcgttcaagaattggtactggaaatgctggcctaggatatacatatgaagaggtcaaggttctttttctagtacttatggatctatgtcgccgaactgctggcttgcaacacccgttgccagtttctcaggtggggagtaataacatacaggttcggctgcattatattgatgggaactacactgtactgcctgaggttgtggaagcagcccttggcccccatatgcagaacatgccccgtcctagaggtgctgatgctgctggtcttctactacgtgagctagaactccatcctccagctgaagagtggcatagacggaatatgtttggtggaccttggtctgatccagatgatttggattctgcaaatgatgcaccaaaacttattagtttaaatccacttgattccagctcattggaaaattgtgatgtctactatggagccaatggcttatggccaaggaagcgcaggatgtctgaacgagatgcagcttttgggttgaacacttctgtgggcctgggagcataccttggtataatgggatctcgaagagatgttgttactgcattgtggaaaactggccttgaagggatctggtacaagcttccaccaatcttcccagtcaaaatgaccgggagatttggtggatcagccgctgggcttatggatgtccaatgtgtggtggaacatgggttcgagttgtatagctggcttcaatacaaaattgtcatttga

SEQ ID NO: 75311 - DNA, 504 bp, Glycine max
  Peptide Sequence Number=SeqID_166996
atgtctccttcacctctaggatctcacaatcactcacaaactcatctcaagctcttagaacggcttctgcttcgaactcgcgtctctgcagatcttcacacagcaactctctcagaactctttgaaactttgacctttctctctctagaacttcctaaacatgcaaaagcttcaagcccaggccagactctcggtgaaaacaacacttttgccaatttgcctagtttacctgtgtcgcaacctacccttttgcgggcaagcgaggcgaggctcacgggtgcgtcttccaaaggaggaaaatgcgcggattcgtcaccaacgtttatttgtggaaaacatcggaaaaaccgaaggaaaatggtcatgaagaatattctagattcgggagttgtgtttacgtttgaggaaggtattaacacttctcacgtcgacataagcggggctcttgctcctacgtaccctccatcgaagaggaaatcagacctacgtagttcttttttaagg

SEQ ID NO: 75312 - DNA, 824 bp, Glycine max
  Peptide Sequence Number=SeqID_166997
ggtcggtcggcggtgcaacctacagctggatcccaatgatcagtttccttgcgccttacgggccgacgccaggagcgcgcaggtgccgaggcacgccaagggcgctcgctgccatccacaatcgcgatgatgacgtctccacgagaatatcaacagcccgggcttgggccaccatcgcaatccgcgtcggtcaatgtcccgagtcgatcggcggaccggctctcacctccttttcatctttccctcgcggtacttgttcgctatcggtctctcgccagtatttagccttggacggaatttaccgcccgattggggctgcattcccaaacaacccgactcgccgacagcgcctcgtggggacttgggcccggtccgccactgaggacgcttctccagactacaattcggacgccgaggcgaccgattttcatggtgggcttttccggttcgctcgcgttactaagggaatccttgttagtttctttcctccgcttattgatatgcttaaactcagcggaactgaccggctcgcacgtgattggtctcgagcgtggctcatccaccattttatcacggcgaagtcggccatgaacccagatttcaaccaaccacgaggcgggcgtgccctcggcctaatggcttcgggcgcaacttgcgttcaaagactcgatggttcacgggattctgcaattcacaccaagtatcgcatttcgctacgttcttcatcgatgcaagagccgagatatccgttgccgagagtcattgacgaggaggccgggcgcacggggcgccgtggtcatcccctccctcccgacggtagatga

SEQ ID NO: 75313 - DNA, 132 bp, Glycine max
  Peptide Sequence Number=SeqID_166998
atgaatggcagcggaatggagaaggaagagagagaggagacgccacttcaaggagaagatgagtctagagaagctcaccaccataggacatggataagagctctagtcttggaggaagaaggagatgaatga

SEQ ID NO: 75314 - DNA, 515 bp, Glycine max
  Peptide Sequence Number=SeqID_166999
ctactgacggggtggtgcgtaacggcaaaagcaccgccggacatcagcgcctggcaagtgtagcggttcacgctgcgcggcgcgtcccattcgccattcaggctgcgcaactgttgggaagggcgatcggtgcgggcctcttcgctattacgccagctggcgaaagggggatgtgctgcaaggcgattaagttgggcggtgttgtccttgctgaggtgttgttggctgattcacgattcactcgaccggatatgggttttcacccaacaaaactcaatttcgtgcctagcgatgcggatgaggcgccactcgatgtttccatttgcctgcatgcctttggtattgtggggtgtggttcgtttagtggtgtcaagtctgcgaacgtgagggtgctgacgattggttcctgtgttgcctacctaccaaacggtattcgtgtggctagtcagacccattccatccaggcctctttgttggggacgctggaggatttcaaagtcccacacgtgaaccac

SEQ ID NO: 75315 - DNA, 327 bp, Glycine max
  Peptide Sequence Number=SeqID_167000
atgactaatccacctggctcgcctcctcctccttctcctcctcctcctgcagatccatttaccgtgaagcggacacgtaaagccacacggctacgatccttggccactagaccacttggggcagagagactagtggtccacgtcgatcctgcgactggcaaggccgacggtctccaaaagaagaaattaagaacatatttggggattgtcactcgtgataaggtcgacatgacatacgaaacctggaaggaactccctgctgctcaaaaggatttgatatggaaggatattcaggcggaattgaaatccctgaagcttcggatgtag

SEQ ID NO: 75316 - DNA, 562 bp, Glycine max
  Peptide Sequence Number=SeqID_167001
gaatgtgaagttgttctatgccgaatttgatgaatttagaagggaagttgagaggaggatctggcataaggagctcactaacttctcagagggaagcattgaagtttctattgttaaagaattttatgctaacctccatgaccctaaagacaaatcgcctaagcaggtgagggtgcgagggcacctaatcaaatttaatgctgacgccctcaacaccttcttaaagacaccagtggtcatagaagaaggggagagcttgcccgcctactttaggtttgctaatccaaggccttttcctcaagagcttgcaactcgtctatgtctccctgggaggggatttgagttgaatgcagacgacttgcctttgaagatcttgaggaagaatctgactactcttgcccagaactggagtgttctatccttttcaaacttagccccgacatcccacacttctgacattactctggatagggctaagttgatatacgagttcatcatgaagatggatatgaacttggggtccctcatttttgtcgcaacctacccttcggcgggagggtga

SEQ ID NO: 75317 - DNA, 832 bp, Glycine max
  Peptide Sequence Number=SeqID_167002
atgcccttgccttcagaggactatatgtcctcaccttcagagggctgtaggccctcgccttcaaagggcgacatgccctcgcctttaaaggacttcacgtccttaccattagagggctacatgccctcgcctttagaggactacatgtcctcaccttcagagagctacaagccctcgccttcagtggactacatgccctctccttcagaggacaacacgccctcgccttctgaggactacacgtcctcgcctttagagggcttcacgccctcgcctttagagggctacacgtcctcaccttcagagggctacacgccctcgccttcagaggactacacagggctgcacgccctcgcctttaaaggactacacgtcctctcctttagagggctacacgccctcgcctttagaggactacacgtcctcgacttcagagggctgcatgccctcgcttttagagggctacacgtccacaccttcagagggctacacggcctcgcctttagaggattacgcgtcctccccttcagagggctacacgccctcgccttcgtagggctacacgccttcaccttcagaaggctacaggccctcgccgtcagaggactacacgtcctcgcctttagagggcttcacgccctcgcctttagagggctacacgtcctcaccttcaaagggctacacgtcctcgccttcagaggactacacgtcctcccttttatagggctacactccttcgcctttgtttctttactaaagcatgttcacattttagtgaaagaacaccgagactattttagtctcacacatcacaaaagcaagaactacgtag

SEQ ID NO: 75318 - DNA, 612 bp, Glycine max
  Peptide Sequence Number=SeqID_167003
atggcagaatcatcaaagaaacgtaagggttcatccgcctccgcttcggcttcaagagctcatcgttccggagccaccagcgcatccacaacaccaattccaccctccttatcctcttccacattgttttcttccgaagaacagcagaaacggtattcaaatattttctcatctcgttccattatcgaccctaagttcattgatatggaattcttttctgccgaaacctttgattgcattcaagcatttcagaatttaggtctgatacctttcatgtcattacaattgcctgtttatcctgaattggttaaagccttttattgcaatcttgaaattcaggacaacactttgatttctgaggtttccgggataaaaatggtcattgaccaatcccttttccatgacttaacccaattgtccagtgacggtgtaccatttgaagagcctccactgatcgccatctcttcagggccactatcctccgtagagtctgcctcggatgccgacatgacgtcctcgggagaatccacctcagggagtggtcctcatcaccctctagaaagtcaagagcatccacagcaggctcagagtagctctcgagatcctccttag

SEQ ID NO: 75319 - DNA, 564 bp, Glycine max
  Peptide Sequence Number=SeqID_167004
gccgaggtggggaggatcacgaggtcaggagattgagaccatcctggctaacacggcgcctgtagcgcagctactccggaggctgaggcaggagaatggcgtgaacctgggaggcggagcttgcagtgagccaaaatcactgcaagcgccactgcactccagcctgggcgacagtgtggtggcgtacacctgtggtcctagctgcttgaggatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcttggaagatgccaggaagatacttaacagggaa

SEQ ID NO: 75320 - DNA, 308 bp, Glycine max
  Peptide Sequence Number=SeqID_167005
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccgggccgcggcaaagccgtttttccataggctccgcccccctgacagcatcacgaaatctgacgctcaaatcagtggtggcgaaacccgacaggactataaagataccaggcggtttccccttggcggctccctcgggcgctctctg

SEQ ID NO: 75321 - DNA, 195 bp, Glycine max
  Peptide Sequence Number=SeqID_167006
atggctgaatctcctcaggagcaggtacagatggtggaggtggctgtggggtctgagctggagtggtctcctcctctactgccgctggctgtggaggccccaccccctccagaggaagaaggttggtctcctggccaagccaccagtgtgtcaaactcctccatgctcataatggagggcaagcccaagccttga

SEQ ID NO: 75322 - DNA, 210 bp, Glycine max
  Peptide Sequence Number=SeqID_167007
atgccgaaaggtccatatcaccttcttaactgctcacatgggggcactgcgcccccaaatgcgcaagcaagaagagatgatttttcaggctctcgtgtccgtaaatgcattcatatcatgcaccgcataagcatctcttcatggcatcataatggacatatcgttcctgcatttgtcacttaccatattcatgcattgcattttgcataa

SEQ ID NO: 75323 - DNA, 960 bp, Glycine max
  Peptide Sequence Number=SeqID_167008
atgaacgcgaatcgcctccggcattcgtgttcaaatagctattactggccggccgcaaggcgggtggccatgtgcggtgagaaggatctcagttgccgccgcgggaacgccgttccccagcgctatcttcatggaaccaagtccgctcgccaacacccaggtactcagttggagagttttatgaccgaattaaccgcagcagcgcaacgtgcgctgaatttgatggatttaaccacgctgaatgatgatgacaccgacgagaaagtgatcgcgctctgtcgtcaggccaacagcccggccggccacacggcggccatctgcatctacccgcgttttatcccggtggcgcgcaaggcgctgcgcgagcaaggcacgccggatatccgcatcgccaccgtgaccaacttcccgcatggcaacgatgatatcgacatcgcgctggcggaaacccgcgcggccatcgcctatggcgcggatgaagtggacgtggtgttcccttaccgcgcgctgatcgccggcaacgaacaggtcggcttcgagctggtgaaacagtgcaagcaggcttgccaggcggccaacgtgctgctgaaagtgatcatcgaaaccggtgagctgaagcaggccgatctgatccgcaaggcgtccgagatcgccatcaaggccggggcggactttatcaagacctccaccggcaaggtgccggtcaacgccacgctggaaagcgccgagctgatgatgtcggtgatccgcgatatgggcgtggcgaagacggtgggcttcaagccggccggcggcgtgcgcaccgcggaagacgcgctgcattatctgcagcttgccgatcgtattctgggcgaaggctgggccgatgcgcggcatttccgctttggcgcttccagcctgctggccagcttgctggccgcgctgggccaccagacccagaccgccggcggcggctactga

SEQ ID NO: 75324 - DNA, 433 bp, Glycine max
  Peptide Sequence Number=SeqID_167009
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaatggtggcgaaacccgacaggactataaagataccaggcgtttcccccctggcggctctctcgtgcgctctcctgttcctgcctttcggtttaccggtgtcattcctgctgttatggccgc

SEQ ID NO: 75325 - DNA, 738 bp, Glycine max
  Peptide Sequence Number=SeqID_167010
atgttggtgcgcatgatcaaaactcgtctctttgcagcggcacgggtgaaatcttgccccggtatgcatagtagctgcgtgatagcctccctctctggttgtgctcgcacagttggtcgccctccaaaatcagggggtgggtcaggagcggtgtggatatggagcccactgaaagtgaggacgcatagccctctaaaggcgaggacgtgcagccctctaaagtttaggacatgtcgccttctgaaggtgagggtgtgcagccctctgaaggtaagagcgtgcagccctctgatgtttaggacgtgtcgccctttgaaggcgagggcgtgcaaccctctgaaggtgaggacgtgcaatcctctgaaagggaggacgtgtagtcctctgaaggtaagggcatgtagcccttcgaaggcgaggacgtgtaatcctcttaaggggaggacgtatagtcctctgaaggtgagggcgtgtagcactctgaaggtgaaagcgtgtagccctctgaagttcaggacgtgtcaccctttgaaggcgagggcgtgcagccctctgaaagtgaggacgtgcagtcctctgaagatgaggatgtgtagccctttgaaggcgagggcgtgcagccctctgaaggtgaggacgtgcagtcctttgaaggcgaggacgtgtagtcctctgatggcgagggcgtgtagccctctaagggtgagggtactagtacccaagggtccacccttttga

SEQ ID NO: 75326 - DNA, 394 bp, Glycine max
  Peptide Sequence Number=SeqID_167011
atgcagctaccgcaagagcccttgaacaagaaaccaagagggctcgcaaggaagagcatggccaggaaaaatttcgtggagctttgtggggcagcaacacgtttatgcgagacagagaccatcatgctagccatcgtcagcaagtaccaagaagaactaaatctagccacggcccacgagcataaagtggcggacgagtatgcccaagtgtacgcggaaaaggaggctagaggaagggtgatcgactcgttacatcaagaggcaacaatggggatggaccgattttctcttaccttgaacgggagtcaagagcttccccgattgctagccaaggccaaagcaatggcggacacctactccgcccccgaggagatccacggacttctcggctatt

SEQ ID NO: 75327 - DNA, 627 bp, Glycine max
  Peptide Sequence Number=SeqID_167012
atggcaagaactggtgacaatggtggtgtatatcatcaactggacgaatctcagcgcttatttctggacgcgtggactatacaaatgcaacgtttgttgaaccgtaacaaagaagagccctacagacgaatagtcaaatcttcctcgtttactcttaaacctctatcccctagagaagcgtgtgatgaccaaatcagaatgagagaaaagagagaacaagagaaagaaaatagtgaggctccacaaaggaatatgaaaaagaagagtgatacacccgaggaaaagagtgatacacaaaagagagagagtgataattctaatcaatgtcttttccaaggagattctcatggactgccaccttcaagaagcatagaacatcaagttgatctccttctagaagcttcattgcctaacaagccaacttacaacagcaagccccaagagactcagcataaggatgcacagtcaaagttgagacaaatgttttccaagaaggagggaatgatgagaatcatgaaacaggccaaatacagtctaaaggcccaagtggagaaggacgaaggcccaagtggagaaggacaaagcccccgagtggagaaggatgaaggcccaagtggagaaggatga

SEQ ID NO: 75328 - DNA, 261 bp, Glycine max
  Peptide Sequence Number=SeqID_167013
atgtcgcggaacttcacagattgcttaacgatgggtgtcaagttcctcgaagcggttaagcaaaggttgcatgccatcaaacaatggtctccggacgaaattagggcaatcaattcgtggggctccggactcgatggaggaggatgcatgaatgagaatcaattcatggggctccgaataagatttgatggtggaggatgcacgaacagcactaggcaatcaattcgtgaggctccggacttgatggtggaggatgcatga

SEQ ID NO: 75329 - DNA, 513 bp, Glycine max
  Peptide Sequence Number=SeqID_167014
atgaagcacttcactgacacccctcatcagtgccaacatagtaagccagtatacactccgctagcgcccaatacgcaaaccgcctctccccgcgcgttggccgattcattaatgcagctggcacgacaggtttcccgactggaaagcgggcacccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 75330 - DNA, 150 bp, Glycine max
  Peptide Sequence Number=SeqID_167015
atgggtgccaagtacctcgaagtggtcaaacgagggtcgcatcccaacaacggatggtccccgaacaaaattagggcaccaacaaagcacaaggatttaagctcttgcaaaccacaccctcatcgaacaactcctttacttgaggaataa

SEQ ID NO: 75331 - DNA, 291 bp, Glycine max
  Peptide Sequence Number=SeqID_167016
atgggaggaactaaaaggcttttagtgacaattcccaaggtggtcatatctctcttgatggtttctagagcaagtcagagacctagcatgaccacagattcacctccactccttatgttcccatggacccagtggagttgccaactatcgcaacctacccttcgacgggagggcgacgcgggactcgcgggtgcgtcttccaagaaaggaaaatgcgcggagtttgttggaccttgtggcctcaataatcttaagagggataggcttagaatgcagaagaagcaacaataa

SEQ ID NO: 75332 - DNA, 372 bp, Glycine max
  Peptide Sequence Number=SeqID_167017
atggaaagagaaataatcactatgatagtagacatattgccagtgttctactacgagaagatggtggggtacatgccttctagttttgcggatttggtatttacgggtgagaggattgaggtaggcttgtggagggggaagttcgactatgccgcctccacaagcacaaataattggagatttggggcaagtggggccaagaagaaggagggagatgcacatgcggtaacttcagctccgacatggcctaaaaaccagcaaactcctcacaacacctaccaatacgccccacaccaaccaagcttttcggccaatgttggaaaccctcccaaatcggcacccatccaacaaaagtcacccgctcaaccataa

SEQ ID NO: 75333 - DNA, 438 bp, Glycine max
  Peptide Sequence Number=SeqID_167018
atggatacgccgcttggaacagatctgtctcgcctggtgcgcatctggcgcgcgttgatcgaccagcgtctgaagccgcttgagttgacacaaacccactgggtgacgttgcacaatattcatcaactcccgccagagcagtcgcagattcagctggcgaaagccatcggtattgagcagccgtcgctggtgcgtacgctggatcagctggaagagaaggggctcatcacccgcgccacctgcgctaacgatcgccgcgccaagcgcatcaagctgacccgtcaggctgaaccgatcattgagcaggtcgaaaacgtgatagacgcgacgcgtgacgacatcctctccggcatcagcctcgaagagatcaatcagatggtgacgctgattgcccggctggaaaaaaacattctcgagttgcagaaccgcgagaaataa

SEQ ID NO: 75334 - DNA, 547 bp, Glycine max
  Peptide Sequence Number=SeqID_167019
atgccgagagcggcgccttgcagcgcgaggcgtggcaacgctggtcgcccatcgcaccgaaagccagaaccccgaccagcggctgaggcgctgtacgactacctgcgcgcggcgatcgcgccgcgcctggaaagcctgggctgtgccgctggcgcgtcgacgttgaaggtcgcccagctcgacgctgccctcggcaacgcggcgcgcgacgtcggccggcgtgcccacgtgcaggtcgaaacgcacgatcgggccaatcacggcggaaccgcgccatggccgacggccgagggcgatcgctgcaccgatccgcattcgcatggtgggcgcgcgaggacagtcaccggctcgcctcgctcagcaccatgccgcgcgcggcgcgctcgaagcgcggcgcgcccgcttcttccctccacgcttggcgatctggcggctgatggccgacacctgccacgtgcagttcggacgcgccgctcagctgcccgcctgggccacttcgacaaagtaccgcagggcgatgccgtgcatgttcgcgcctcgttggggg

SEQ ID NO: 75335 - DNA, 1299 bp, Glycine max
  Peptide Sequence Number=SeqID_167020
atgtcggccagcggcagacagctggtggaacaattgcgcgcgcagaatttgctctacagcgtcaccgagcaaggtgcgacgcgtcatgacgtcaaaatcattggttccgtgcattcagcgctgcacccggcgctggacggttgtgacggcattcttaacgcgcttgcccgcgcggaaaccgccatcgtctcgctgacggtaaccgaaaaaggctattgcactcatggcgcaaccggggaactggacagcacccatccgctgatcgtgcacgatctggcccatccccggcagccgaaatccgccattggctttatcgttgaggcgctgcgcttgcggcgtgaagccgggttagcgccttttaccgtgctgtcatgcgacaatctgcgtgataacggccacgtcgcgcgggttgcggtcatcggtctggcacaacggcaggatgcggcgctggcggcatggattgaccaacaggttacatttccctgcaccatggttgaccgcatcgtgccggccgtgacggaagagacgcagcgcgagattaccgggctgctgggcatcgccgatccctgtggtgtcgcctgtgagccgtttcgtcagtgggtgatcgaagataatttcgtggctggacgtcccgactggcagcgcgttggtgcgcaatttgttccggatgtcgccccctacgagttgatgaaactgcgtctgctgaatggcacgcactcgtttctggcgtatctcggctacctcggcggttgtgaaactatcgctgagaccatgcagctgcccgcttaccgtcaggccgcgctgtcgctgatgctgactgaacagcgtgccacattgacgatgccggcaggcagcgatctgaacgcgtatgcgcatcaactgcttgagcgcttcagtaatccgtcgctgcgccaccgcacggcgcaaattgccagcgatggcagtcagaaattgccacagcgcatgctggattcgctgcgctatcatctgcaccacggcagtgactgccggcatctgctgctcggcatcgcgggctggatgcgttatatcctcggcgaagacgaaaagggcgagcgctacccggtggctgatccgctggtcgctaagtttgagcggattaatcagcagttcccttcaggtcccgcccgcgtgcaggcgctgctgggcattaacgagatcttcgcggacgacttacccgccaatccggcctttgttgccgccctgcaacacacctatgaccgcctgtgccagcagggtgccagagccgcggttgcatccctcaatccggaggccaaatga

SEQ ID NO: 75336 - DNA, 139 bp, Glycine max
  Peptide Sequence Number=SeqID_167021
gagttggtttgtggaagttgtgctcgctgcaaggatttggtttgtggaactcgtggtcattgctagggctgtttggggtgctgactttgcaatttgttcggggtgctcactcgttctcgcaaggtgtcattttgagtga

SEQ ID NO: 75337 - DNA, 201 bp, Glycine max
  Peptide Sequence Number=SeqID_167022
atggaaaaacctgacaagaaaactttcaaagataagaaaggaaagaaagaatatatcacttgggaagataatgatatggattcatcaagtgtttcagaaaacgaaatcgtaaatctaagcctcatggccaaagactatgaaagcgaagaagagatgcattcaatgattttcataaaaaatgtatcaaacttgccaaattag

SEQ ID NO: 75338 - DNA, 357 bp, Glycine max
  Peptide Sequence Number=SeqID_167023
atggtgtctggtgcaattatttgtctcatactctctaagaattgggaagttaagggtcagatcttgcgagtcattaggaaagacattgggaggcttgtgaagattggagcatcctatcccatcccatctaaagagaagaaaagcaagagtgataaaagggaaatagtactggtgtttcctaaaagtagtatcaaagctcgactgggagttgtcactcatgatggagatatgttcaagctaaccgcaaaaagttattcatattggaagccaatgatggaagaccatctacgctggaaggatttgcacgagctaatcacccacgataataagtcggaggggaagaaggacaatgaataa

SEQ ID NO: 75339 - DNA, 958 bp, Glycine max
  Peptide Sequence Number=SeqID_167024
ggggataaactttgttgctattgatctaaacaagccactaccagaacaaggtcaatttggggatttaattgctgacttagccattgaagctactacaacagtaggtgttgagattgaccaaggtcccaggtgggcagctggagtattcgagagttctcaagggagtcatgataaaaaaaaagatgtggtttcccctggcaaaatgtccaaaaggttgttaacccacgcatcattcttcttgattctccccttgagtacaaaaaggatattgaagtttaaactggacttggttattttggacaagggtctgactgatttggcaacccattatctcagcaagcatggagttagtgcaatgaggaggctgaggaaaagtgataataatagaattgcaaaggcttgtggtgctgttattgtgaacagaccagatgaattgcaggagtctgatgttggtactggtgctgggttatttgaggttaacaaaattggagatgagtacttcgcatatattgttgattgcaaagaacccaaggcttgtactgttctactaaggggtgctagtaaggatctattcaatgaagttgaaagaaacccacaggatgccatgtctgttgcaaggaacattataaaaaatcctaaacttgttcctggaggtggtgctacagagttgacggtgtcggctggcttgaaacaaaagatttcatctattgagggcatagagaagtgcccttatgaagctgctgccgtagcttttgaagccataccacgaactttggctcaaaattgtggagtaaatgtcatccggactatgactgggacaaagtgttcgtgtatgcttctgaggattgatgatatagtgagtgggatgaagaagaagcaagcccctggagctcctccttcaaaacccaaggttgagactgaggcagatgctaacagtgaacaaatccttgttgactga

SEQ ID NO: 75340 - DNA, 438 bp, Glycine max
  Peptide Sequence Number=SeqID_167025
atggccacacctccgaggtctcctccacagtctgatggtcaatcagaggccacttcgaagcggagtagaacaacgacacaacttagaacattgacattaagaaccatggatcagcccagaccgatagtttatagggtagttgcgcgagaaaaggatcccattatccacaacaattggaaagatgtacctgaaacgcttaaggagatagtgtggaatgacatattagcaaagtttgatatcccagaagccgcaaaggtgaagacgaaggttatgtctacggttgcaacgagatggcaacaatttaagtccacattgactagcaaatttgtctttgctttgaacacccatatgaaagcaatacctaggattggcagtgagggatttatgtgcgaggctaacttcaatgtcgactcagtcaaagatccacatgagctttga

SEQ ID NO: 75341 - DNA, 750 bp, Glycine max
  Peptide Sequence Number=SeqID_167026
atgaacaatcaagatggaaaaccagtcactcagcctgacaagagcaggattgtccctatggcaatcatatttgtggtgctatgtggatcttctttccatatgggtataatcttttgttctgagaaggacaaatttttgtcaatttatagtgagaaatcaattgaatcccacaaggagtcatcaataattcctctgcaaattaaatacattagttatcctaaatgcagcattgactttcaagattacactccatgcacagatccaaggagatggaagaagtacatctcatatcggcatactttgttggaacgccattgccctccaaaattggagaggaaagactgcttagttcctcccccggatggatataagcttccaattagatggccaaagagcagagatgaatgctgtttcagcaatgttccaaatgagtggattaacaagcagaagtccaatcaacattggttgaaaaaggaaggggagaaattcatttttcctggtgggggtactatgttccctaatggtgttgctaaatatgttgatttaatgcaagatctgatccctgaaatgaaagatggaaccattcgaactgccatttatactagatgtggaggttggatgcaaagaaacaaagtcaccatagaggcctccattatacttgtatttgggaaaacgaatacatcaccaaagtccctcaaatgcaccacaaacctaagtttagccaataaacctgccactatcattagctaa

SEQ ID NO: 75342 - DNA, 732 bp, Glycine max
  Peptide Sequence Number=SeqID_167027
atggcttcccgcaaacgccgagctatgcccacacctggggaagcatcaggctgggactcctcccgcttcacctcgaagatcgcttggcataggtaccgggacaacattcagctccagaacattcttccggagaggaatgtagagctcgcacttgggatgtttgatgagttcctccaggagctccagagggttcgaggacaggtggtcagatttgacgctgagacgattaatgatttcctcaacaccccgggcccgactcatatacggcttggtgaggaagatggacctggacctgggaagcctcatttccctacagatcagccagatcgtccagtccagcacttccaggctcgaatttccagcgttgatcacgacgttgtgagtccatcatccatgcaccaaagacccagggtcagcatcagaggctcctcttcctccccatcccccttctccgccttcttcccagggatcgcgtcctccacttgcatccacctcagcacccctggacttgcatggttagatgctgagatccattcatatgggacaacaactcattatggagaacatgcacaggctgtccctgcacctgcagatggatccaccgctcatcactctagaggcttatcgtcagcagccgctactgaggatcctgcagttgatgaagacctcattgctgacttggctggggctgattggggcccatgggcagacttgggcggaggcaacacatga

SEQ ID NO: 75343 - DNA, 102 bp, Glycine max
  Peptide Sequence Number=SeqID_167028
atgaagcacggtgcaagctcaacacgagcacatcatcacaatgaatctggtcttggaggcattgatggagaggtgaccttggtccctctcgcgacggcttga

SEQ ID NO: 75344 - DNA, 456 bp, Glycine max
  Peptide Sequence Number=SeqID_167029
atggatatcgacaatctaatgaactacccaggtgaaaatgaagcatgtttggaggttcatagtttagaagatattgtgggtactatcattgagaacaatgtagaggatgatggcgaagatgatacggtgtctttggagcctgttacgcgaaaggaagcacttatggcattgaacactcttcataactttatgatacaatacaaaaatacaacacctgagccattggatgcaataagaaaagttagagatgagctccaaatagacttgaactttaaaggaaaacagacaactattgaatcatatttcaataaagtggcttatggacatgataatacaaactggagaaggatggagactatgatagaagccaatgctgctaatcataatgcaagtcttcaaataacaacaagcaaaggtggagttatgtggttagaccaagtgtatgcacaccgctag

SEQ ID NO: 75345 - DNA, 1314 bp, Glycine max
  Peptide Sequence Number=SeqID_167030
atgagagaagctggtttctctagcacccttgtgaaaacaagggttgaacaagctgtttcaatggaagcttgttcacaaaaggcttcttctgataggagccatgccaaagaaaatatcaccaagccccatcatgttgttcttggtggtagtaataatgtgtctccatcatctggaccttttggtcaagttgctgctggctccttcacgaagcctaatttagaccatgttaacaataatgatgtaactagtgtgctgagtgagttggtgaggaggaaaaacacagttattgtaggggagggtgtggccaatgctgagggagtagctagggaggtgatggagaggtttgaggtagggaatgttcctgaggacttaaggtatgtgcaatttatgagccttcctctcatgtgcttcaaaaacattagtaaggaggaggttgaacagaagcttatggagattagaaaccttgtgaagagctatgtgggaagaggggttgttctttacttgggtgatctaaaatggttgtttgagttctgggctaatttttgtgagcaaaaaagaaactactactgttctatagagcaaatggtcatggagcttaaaaaattggtatgtggtagtggggagtctagtagactgtggcttatggggattgcaacttttaaggcatacatgaagtgtaaaatgtgtcacccatccctagaagctatttgggagctgcaccccttcacaattcctgttggcagcctcagcctaagtttaaattttcatggtgattttcaagctcaagagaaaagcaaggtgtttttcaaggatgtggcttttgaagatagaacaggagtcagaaaccatctaacttgctgcagggatttcttgataaattttgaaaaagaagctcagagcataactaactgtataagcaataaagtttgcattgctagtagcttgccaatgtggcttcaaaattgtaaggaagagagaagtgacataatggaagatcaggaaaattcaaggcttgagtatctgtgcaagaaatggaattccttatgcaattcaatacacagacgacacccttccattatggaattctgttatagacccccacgagattgtgctcttggatctgacattaaaatcaacatggttacttcaaaaaaatcttgtcccaaacttgctagaatctgtatcagtggaagacatttcattgaagagaaaaatagtacaactaggggtgtgataaagaatcctccaaataatgctcaaagtatgaagcaaggcttccccaaccttgaaaattcaagattgcaacacccttga

SEQ ID NO: 75346 - DNA, 183 bp, Glycine max
  Peptide Sequence Number=SeqID_167031
atggaggagaaggtaaagctgaaaattaatggagggaataagccgtggaagaagaagcttcaccaccaagagagtgtcttggataagaagcttagagaggaagcttcaatggagaaagagaatgagagagagaaaaagtggcgtaggaatgaaggaaatatagggagagaagttgaactttga

SEQ ID NO: 75347 - DNA, 249 bp, Glycine max
  Peptide Sequence Number=SeqID_167032
gctgaatttgatatccctgaagcatctgatatgaggacaaaaaaggaaatacttcaaactgtgggggaacggtggagacagtttaagtctgatttgacgtcgaattgggcacttgcagttgacaagggcaatgtcgatgacactgtatgcataaagtacgacaatagcaaggagaattggacccaattttgtcagagccgcagagacccttcgtgggtggatgtgcgaaagaagacacagaccatctag

SEQ ID NO: 75348 - DNA, 882 bp, Glycine max
  Peptide Sequence Number=SeqID_167033
atgagagctagagctagttctggggatcttgtgaggattgggaacagtaatgaaatgctaaattctgtgagtggagttctccgcaccaactgcattgactgcttggaccgtacaaatgttgcccagtatgcatatggtcttcaagctttaggacgccagctccatgcaatgggtttgactgatgttccaaaagtggatcctgatagtagtattgctgtagctctactggatatgtatcaaagtatgggagatgctcttgctcagcaatacggtggctctgatgctcacaatactgtgtttccagagaggcagggaaagtggaaagcaacaacacaatcaagagagtttttaaaatctataaaacgatactatagcaatgcttacacagatggttacttccaaccacatgaagggaaacctgctctctgggagctggattcagattattatatccatgaatctgggattggggatgatctaattcctgagaagtgttctgaaccaaatatcagtccttctggaagaggtggaatggtattcatgcctataccagcttgtagagatgacttctctcgcataaaaccaggtggggtttctggaaacagtggtgtagcacctgatgcagctgagatacagctcaaaagcccaaattggcttttcggccagagaaagtatgaagagggttcctctgctgcaaaagttgcttctcgtgaatctgacgttgaaggatctcaagctaatggcttttgtgacttgaattggctttcctctggcaatgatatgaatgaagaggatgttttccaaaggtcaccactaactcatttgtatgtttacttagggcattgtgatttgttagctttagacagagcagagatatgctga

SEQ ID NO: 75349 - DNA, 738 bp, Glycine max
  Peptide Sequence Number=SeqID_167034
atgatgtacgagcgagtggtggtggtgatgttgttgtcgttgttgcattttgcgtcgggagcagaactcgtgaaggagttgcatagtgctctgacgacgggcttccacaacgacgtcgtttgcctgtggaagaagagcttggtagccatttgggttttgctttggtggagatgggaacactaccattgggatatcaacactaccattgctttggtggagatggaaacagaggatatcaacgagggtggagaaaggaaggactttggttttgagtgtgtggaaggcagccaggaattggacgagggtttgtgcagcagccagaattatacgcttcccttcagtgatgtactgcgatgggagtcgttttcagtgcaggtggatgtttcagatattccaaggctgaaagaggtgcttagtgcatttccagagagcgagtacttgaaaaggggtgtgaatgatcgggggagggttggtaatgatgttgagacagagcagattgtccttgatgaagaatcaggctcttgcaaggggaagatgagttcagttgtgcaaatacgtggatcaatagcgcttttctggtcacaagaagcatcaacatttagccccaagcctgacataatttgtgtagctagtgaagcgcttgatttaactgggttttactacagtggtaaaaccaacatcattaagagagccaacaagagcaatagaacaagcacagggaggtatgtccatcattga

SEQ ID NO: 75350 - DNA, 678 bp, Glycine max
  Peptide Sequence Number=SeqID_167035
tcagtgatgcaagcactgccttcccatgtgatgcaaacatcttttcatcatagggctgtttgtgataaggtggacaagaagggtctgggatttcgatcttcaaggcttgttagtacaagttacatgatgaaagttgactggctcttcccacaaagagagatgatctatgggaattttcaagaaaaccttggtttgaatattggtgatggtgctaaagtggaattttggaatgataggtgggttcctggagttccacctctaaacagctcgaagggtgatgatcaactgtcatgtattggatcggaggatgatgcagaggtcctgagaggatacgtgttttgctttggaagatcatggtgtcttatttctaaagctatatggtatatgcttttgcctcaaactatgcattcagaattcttggtccaggattcgaatttgtggatgctcagtaatttgaagaatgaggagagtgttcaacctactggtatggtttctcagatatggagagaagcggatcaccctccaaatggtcatttcaaattaaattgtgatggctcagttaattcaagtatgaagaacgtggctgttggaggtgttttttgtgactcaaatggccaagtgatttttgcatatgctgctgatatgggtttctgctctattgtttcaacaaaattatga

SEQ ID NO: 75351 - DNA, 204 bp, Glycine max
  Peptide Sequence Number=SeqID_167036
atggaacaagtgtccaagtggaatttgcttcaagagcttggatttcctcatgcattgctcgacgccattcaggataaagaacaacttgatgatagaactaaggcactgctcgaggagaaaacttgttccttgatgatggaagaatggaagaaaatgctaaacaaccaaaacttcttaaggcatgatagtcaggttcctttttga

SEQ ID NO: 75352 - DNA, 661 bp, Glycine max
  Peptide Sequence Number=SeqID_167037
gcaacgggaaactgccgctgttgccgagaatgttcctcacgtggataacacaactgaagagctattccaacatgctgaagaaactgttgatgatgccgagggttttccagccgagcatcgtgacacattagtgctgactgcctatgctgatcacgttgcaatcattatttggaatggagagcggcttgatcgactgacgactgctaatgtttgctggatgccttacggtgaccaccgtgcagttcaggaggtggtgcaacaatttggatatgttcagacgattcctccacactgtgcgtgtccaagattgttctttgaagacattgatgatagattgatgcatttctctaactacctagcaccgcccggtgatccacccagacatccacctatcatgcaagatgggacatatgtggaaccagagatgcctaagatcctggtggcgccaacatctgtggaggaagcacttgcacaaggaccttctaatgtggagcagcctagacatgcagcagatgcttgtcaaacaattgtagaaaggttggaacgattgctcaacctaaggatagtcactgaaggcacaaaagcacatgatgtgatgcaaggctgtatacgcattgctaggagtgtcactatggatggcaatgtatatgttaggtcgtaa

SEQ ID NO: 75353 - DNA, 273 bp, Glycine max
  Peptide Sequence Number=SeqID_167038
atgtcgatgctggatcaatttcatccatgcacttatgatttcattgaaaatattgttgatgtcaaacttgatggtaactgtggatatcatgcaattgctacgttattagaacttgcaaaatggtctaatgcgtatatcaacctgcttggtggcatagacagatttgaggaattaaagcggttgctacttgttgatggattatccatggttaccatggataaatggatgaatataaccgacatgggatatgtaattgcatcaaggtatttctaa

SEQ ID NO: 75354 - DNA, 507 bp, Glycine max
  Peptide Sequence Number=SeqID_167039
atgctacaatggaggaaggagtttggtgctaatactattatgcagggcaatggtcagaaatcgagtttggaaacatttcagttattctcttccttggtttccgcctttggaatcttcgatgatgttgcacaacaagttcctcatatacctcctcctccctgcgttgaagtccttgcatctgaggttccttcatacatcaaacacaatgtggactctgtaaatttggatggagttactttgttaaagataaaattgcattcagaacttgcacaaccaaaggtaggatcttttcatggtctgcctggaatctttgcattgcttaaggcagaagttcacttttttgctggtgactggagtggaattgataaattgctccctcatgtcagtacagatgcaaaaaaaatcaagagacagtttactcaatcaacagactccaaaatctctatgatcttatcaagaaggtggtggaactcaacgatttctgtctatggtagagaaggatggtga

SEQ ID NO: 75355 - DNA, 618 bp, Glycine max
  Peptide Sequence Number=SeqID_167040
atgattggagatgctctaaggaagcttagtgggaagttgctgattactcgggactggcatgaagttaccgaggattggcagcagctggcgaactgggtgtttcttgatttggtcgaggagttgaagaggaaattgtttgttgcagtttcagctaagcagatttggtatgataaatctggtaatggagctggcatggaatctattaaagttatggctagtgttgacttaagcttgaccttgcctgataagaaaattgttgtgcaaaaagaacctgttcctcctggtaaaaagatctcacctgagttgcaagaagaaatttgcccctatggtacttgtaaagtagtttcagttgaattatgccctgatgttgttgttagggaatatctacttgctcccaagcaagcaaatagggcattatggatggaagaattacaaaaacatcttgtatgtcttggatggaaaattgagtggtcaaataaaaataatgtcaaacgttacggttatgatgttcctgataaaaagggccgaaagctttacctttcactcattgaagtttgtagagttatggaaaaagacctcaacatgaatgtgaacgtactcctcgcagctccaaaatga

SEQ ID NO: 75356 - DNA, 415 bp, Glycine max
  Peptide Sequence Number=SeqID_167041
atgggggagggatgttgtaagcagccttacccttgcatatgcaaagaggctgtttccggattcgaacccatgaccaacaagtcaccaatgcacaaatttaaacgagcgtccgctaagcgcaacactcatgggctaagcgcgaggaagactctggaagaagatgagttgtacagccttttctcattctcattggcaggagaagccaagaggtggctccactcattcaaaggcaacagtctgaaaatctgggaagaagttgttgaaaagttcctaaagaaatacttcccagagtccaagactgcaaaagagaaagctgttgtaccatctatggtgaggctcatgaaacaggccaatgtattcccattgaagaaaacactcaagaaattcattatatgggaaatcaatagcgacaaag

SEQ ID NO: 75357 - DNA, 306 bp, Glycine max
  Peptide Sequence Number=SeqID_167042
atggagattgtcgataataattattctcaggacttgaagaaaaacgagggttttcaagaaagattggtgaggagtatggatttggggtttctaggatcatggcatcctgaaccagttatccagagtgagaagctcaagtggcatgtggtgagtgtgtcagaagcttttcatggtgataatgaatgttactgctattcgcatgggtccattaggccactgcctcctttggttgagtttgagatttgcgttgatgtgaactataacaacatctctaatcaaggattcttatcggatttcttcatttga

SEQ ID NO: 75358 - DNA, 393 bp, Glycine max
  Peptide Sequence Number=SeqID_167043
atggatacgccaaagtgtttgtctccaagggagaaaatgagcggagtcgccaccaacgtttatttaagagaaaacgttagaaaaaccaaaaagaggtttgggaattttgaaaataagggttcgagagttgtttactcatcgggaagttgcagctcgcccaggcgagctggtttcttcaccatgaaactatttggtggcccggcccaggcaagccagatgctagcctgggcgagctggggtccagaaaaatcaagaaaaagacccttttgcccccttctttggtatccttttgtattcttgatcaaaagactgagtgattcttggcttcatgctgcaactggtgtcaaacactgtaattcgactagtaagaatcaaaagatctacgaacgatag

SEQ ID NO: 75359 - DNA, 282 bp, Glycine max
  Peptide Sequence Number=SeqID_167044
atgccaagacctctccaccctatcgtcgtcgtgtaccacacttctctcattcaccctcctcttcctcctcattctcctcacggtggtgggcccggtttcggcatggtagtcgtggtcccagagcaacaaaatgaacatcaacgattacgcctttggggactccaagaaatgcgaggggtactcaaagttcgtgaagctgagggttcctccatagcaggaaatagatccaacactgacgcttgcacctatgcccttaacaccctcaataaaacagaatgttga

SEQ ID NO: 75360 - DNA, 219 bp, Glycine max
  Peptide Sequence Number=SeqID_167045
atggaagttgtgctcctgaatgaggtggagattcctactttaagaatcctagcagagtcaggattggaagaagcaaagtgggcccaggcacgctatgatcaattaaatcttatcgagggggatcttgttctaatgaaagtgtcacaggttcaaaaggatcaccgaggtaaatgggtcccaaactatgaaggaccgtttgttgtgaagaaggctttctaa

SEQ ID NO: 75361 - DNA, 1632 bp, Glycine max
  Peptide Sequence Number=SeqID_167046
atggaggattgggggaattttctccaccgaatccttgaggaggattctaaggattccactccgattaagatgttcctcttggtgtggtggttcggcgaaaagcaacggcggctcatggcggccattggtggtcgtgggtggcagagaagaaggactatactatttccaaatgtagacgggctagtggatctagcaacgattgacgcctttcttgcttatcaccacagcaaggaaaaccatgtcatcactgttttggaggatgcatatgatacattcgacttgaggaagatctgtttgtccgtcatcacatgtgttctgaaaagattaaagcaaattgggaagaactcttggcaggcagctaggctaccctatgagaggtgcaccgtcagaggaaatcctcgcgcctttcatcgcgagcttagaggaagtagcaatggcatcatcggcaactatcacaagtggttgaagtctagaatgcaagggatgacgtggctcccaaagctaaaaagtataagtgggaaagaggttgaaattcttgaggaaaacgaagaagtgggtagcagtaatgagcttaagcttagaagggccgagaggggcgaatcgaggatggaaagcatggcgttagaagagaatatgttgataatcatcgaccaatataaggagaaggtgaacctagctactagtcatgagcagatgctggaagatgaacaggcaaaggtatcggctctgcagattgaaagggaagcgagagagagggtgatagagttgttacatggggaaaatatgaaatggatgagtagatttgctcttactttgaatgagagtcaagagcttccaaggttgttagccagagccaaggcagtggctgacacgtactcggctcctgacgaagttcatggaatagatgaaggccgacatggaggccatgaaagaccaaatgaccaccatgatggaggccatgatgagcatgaggaaatgatggaggtcaatgcagctgcggttgccactacaagtgtcgccactgaggtagatccgactcccccattgggtgtgaatcaagaagcacaagtggcccccatttcacgcaggtccagagcaagcatcatttcccgctgtatggcctgcctcccaactatgcaccacccaatgctctacatgtgcccgaggagaacatcaaccactctgcccttataccccttgagagccaacaacctcaatctgggcatgcacatggccctcaacccatgggggagacctatgaagcaccccgagaccacaatctggccgaatttgagccttacctcggatgttgctgagccgcaatcatttggtggcatgccccagccaaacaccttgggtgaccttcagctgaggcccattgaaggaggtggggactacccttttgcctatatggcagaactatgcctagtacccgatgtcatcattcctcctaagttcaaggtgccagactttgacaaatacaagaggactacttaccccaagaaccacctgaagatgtattgtcagaagatgggggcgaagtatcagtacaacttcgacatggctctggatagaatgcaattgcaaaacatgtggaaaagggagcatgagtccttcaaagaatacgcctag

SEQ ID NO: 75362 - DNA, 234 bp, Glycine max
  Peptide Sequence Number=SeqID_167047
atggcttctccacctgcctcccctcctcctcctgctccttccgacacatcggcttcgccgtctgctgtgaagcggacacgcaaagcctcacgtggacgtcacttacgagacctagaaggaggtccctactgctcagaaggacttgatttgggaggatattcagaatttgaaatcccagaggcttctgacagtaggacgaaaaggaagttacttcagactgtgggtgagagatga

SEQ ID NO: 75363 - DNA, 354 bp, Glycine max
  Peptide Sequence Number=SeqID_167048
atggaagagcgcttatgtgcatattctcgagttgtagcccactttcccacggcagttaaggaggtaaatgataagttcaaatggagaaatggttggttttgttctctctctgagaaggctactgcccaaggcaagccagacccatgccctttacattcccaatggctaaaagagttgagaattgtatggagcttgaactctagtgggcaggaggttaacatctataaaggacaagcccttcgtcctctcctctccccaatttcattcactactctaccatttgggtgttcctactactactgctactaccttgatgatggatacatagacttctctctctctctctctaattga

SEQ ID NO: 75364 - DNA, 603 bp, Glycine max
  Peptide Sequence Number=SeqID_167049
atgtgggacaatgtgggtgtcgagggagcgatttttggtaaatttcaggcaggaggagaaagagaagagcgatttcaggaaggaggacaaagagaagaaggagggcaaggtggtgggtttgagttatggaaccagcaacaactcataggccagggccctcctcctcaaccgcaacctctctttcaccaagatctctactccgcactgggcgttgggcccagcaagaccatctcggacgatcagtcgtggtcgagatccaggactgcgggaaccaagccaagaaagattgccctcatatgcggtgcaggacgtgctgcaagagccgcgacttcgattgccaaacccacatcaagagcacttgggtccccgcttcacgccgccacgaacgactacaataactcttcgctttgcaacaaaccctcaaaccaccttcttctggaggagagagtcgaagtcggtgccggagaggcgagtgttgcagttggcgtcagtgtcctgcccgaacccgcggcccttggtcttcttcagtcaccgcagtttcatcgctgcttctgctcatttttcgaggttgaggggttgtgcgtgtggataagaagaccgtga

SEQ ID NO: 75365 - DNA, 862 bp, Glycine max
  Peptide Sequence Number=SeqID_167050
atggaggagtatgtactcaatcttaaagaaatagggaaattgggatgtatgccatctagagctgttgatagaatcttccaatatttgaagacaagcctaggaaaaggattgttgttcaagagtgagggtacattacccttgaaggtatatgtagatgcaaattatgctgggtcagttgtagataaagatccaactctgaatactgaatggctgctcaatctagtagtagcagaatttcgagctatgacacatggtatgcgtgagaggttatggataaagattattcttgataaccttgaagttcttgaagaagagaaaaaccttggcccgcatgatcggttgatccatgtttatcatttcttgaaagacacaactcaaaatcagcagcaagttcagaactttggacatccttttttattggttatccatgagggtgagacattaactgaagtcaaattgcgaatacagaaaaagttgcaagttccagatgaggagttttcaaagtggaagtttgcatttttgtcatttggtcgtcctgagtaccttcaagattcagatattgtttcagctcggtttcagaggagggatatctacggtgcatgggagcaatatctcggactggaacacactgacaatgcttcaaaaaggtcgaatgctgccaatcaggtgcgttgcggtggtcgacgacggcaaacgaggtatgcagaaggtggtggctatgtcgcggatatggacgatgatgagtggatgtatgaaataatgtttgaacaaacggatatggattatgaaaatgaagaagcatgtggtgcgaatgaaccacatgttgattgttcggatgcgttcaatacttctcagatgaatg

SEQ ID NO: 75366 - DNA, 255 bp, Glycine max
  Peptide Sequence Number=SeqID_167051
atggctcaggcacactctatctctactcctatggttacaaactgcaaactgtccaaacatggggctgatctatttcatgatccaactctctataggtcagtagtgggtgtcctgcagtatgctacccttattagacctgagattagttatgttgttaataagacattccacatcaggaacaactgtctttcttggctcaaacttgatatcctagtggttcaggaagcagaaagtcatggcaaggttgagcactga

SEQ ID NO: 75367 - DNA, 744 bp, Glycine max
  Peptide Sequence Number=SeqID_167052
atgggctgtctgccaggaagtaagggaacaaggcccaaggctcaaacagttgttactagaacaaacagtattcagtacaaaatagagaaggttgttcgctttaggactttggagaaaccaaaggaggatgaatttagtctggagctgacaaagcttgacacttatgacaatgttgtagaagaagttgctcaacatattggtttgagtgatccttctaaaattagactcacatctcataactgctactcccagcaacctaaaccacagtctatcaagtaccgaggaatggaacatttgtcagacatgctgattcactctaatcagacttctgatattctatactatgaagtattggatatccctctgccagaattgcaatgcctaaaaactcttaaaattgctttccatcatgataccaacgatgaagttgtgattcatactattagattaccgagacatagtactgtgtctgatgtaattaatgatcttaaatcaaagtggttcgtggttaattcgattgttccacctcaatttcacacagaggatgatcggatcatggatcgcgttaatcctgaatatgaagcctgggaagtgcaggaccaaatgttgcttgtttggcttcagtcaacactctcgaagtctgtcctttctcgcatgctaggcacgaaccactcctatcaagtatgggagaagattcacgagcatttcagtcttcacaccaagtctagggcacgtcaattgtga

SEQ ID NO: 75368 - DNA, 270 bp, Glycine max
  Peptide Sequence Number=SeqID_167053
atggcctcctgtggtgaagcaaaggaattcattgatgaagatcctaggcctacaagctccaatggagcttacatcaattgggatatcagcgccgacatatcgctgaagtatatgggtgctgacatggtcttgctacatggcctctccgacaaaggtgcaaagcagatgatggaggaggaaaaagagggaggggctactccatttcattccttggagaaatggaatcctaagttgcgcataggatacatactgacatgggtttactgctag

SEQ ID NO: 75369 - DNA, 444 bp, Glycine max
  Peptide Sequence Number=SeqID_167054
atggttggagttccagagaaggagagaactggaccagccgaagccatttctactcaagaacacaaaatcctaagagtaaacggagatataagcaaggtcgacacgtttcgagtgtcgaaaccaaaaactgaaggttggaatggactcaagacgcgccgacgagacgactggcgttggtctggccggattccagcgccaggaagacggcgcgtggcggccacgcgccaagcttactttattacattcaaacaacacatgtatatacaccaaaaaggagagagacagcttgacaagacaagacatactgctgtcttctacaacaagataagcaggaaaacaaagaaagctaaaacagaaaatctatcaagagatacacataattacaacaactcgtatgagttgacatgcgattttgataaccatatagctatcaagataacctga

SEQ ID NO: 75370 - DNA, 339 bp, Glycine max
  Peptide Sequence Number=SeqID_167055
atggttctggtcaatgatcctttggttgctcctgtttccttttccttagaccttacaatcgtcacaagcttgaatttaggtctcatgagtgtgtttttcttgggtattccacatctcataaggttaattcccatcctatgcagaccagatcaaagtctggaattcatttaccaacttaatccaaccttgttacttgctcacaatgaacccaaatctgtgaagcaggctttggctgattcaaaacggtttaatgcaatgaaacaagaacatgaggcattgatgaataacaagacctgggatttggtttctcttccacccaataggaaagcagtgggctga

SEQ ID NO: 75371 - DNA, 147 bp, Glycine max
  Peptide Sequence Number=SeqID_167056
atgactctcatgactcctccaccgatggatcagcaacagcagcagcaggagcacgatgagatgctggttcctcgctctgacttgccagaaggtcctcaacctatggaaggtcctcagatagtggggctggtgcctggcaccaattga

SEQ ID NO: 75372 - DNA, 99 bp, Glycine max
  Peptide Sequence Number=SeqID_167057
atggttcaactaggggctggtcgaagtggaaacatggcctttttagataccaccacctcctggtttttcaaagccaattcatggcaatccttgaagtaa

SEQ ID NO: 75373 - DNA, 816 bp, Glycine max
  Peptide Sequence Number=SeqID_167058
cgaaaaggatcttcctccaccaccactgctgctggccaccgccgccaaggaacctttggaaacccacctacaccaattcctccttctctttcatctcctagatcatccacattgttttcctcggataatcaacgtcaaagatactactctcaattttgtaatagagtcattctaaaccctaagtaccttgaccttgaattctttgatggagaaacatttgattgttaccagtccttattcttttccttgactaaattgcccagtcaaggtgttccttttgatgacacccttgttgatgactggaaatttgattattctagtcatgatgctcgccgcatgatcgactgggcccatttagttaggtactggatgcataaggcattacgggccaatgcacctctgccttatccttaccttgttactctttttcttcatcgttttaatgttcctttggatgatgaaccatttgtcaaggtcaaaaggtctttctctattggtgctagtgcggttacctcctttggttaccgaaagaatgttgatggtcagtgggttcacaaacatgacttgcctcagcctattcctgacgagcgtaccccatctcctccaccacaacggggtgattctacttctcttctgtctgaagtcctcatagaactctacggttttcgagcttttgtgggtgaacgctttaacacgatggatactcgccttgatgtaatggatactcgctttgatgggatggatacgaggatcactcgactcaaagatgatatgagcttcattagacgttacttcgatccctcgactgactcttag

SEQ ID NO: 75374 - DNA, 555 bp, Glycine max
  Peptide Sequence Number=SeqID_167059
atggttaggaccagaggattaggttgtgtcttaggtcacattactgacagaggtgtaggcagaggagatcgtgatgattccgatgatgctccgcagcgtccacagcctaccgcatctgcacgcaggcagagagtagctatcacagctgagcacgatgagccagtggtccctgtgacagaggctgttggagcttcggttgagcctgtcgtatatgcagatgagccgatggcaagaggtgatgtacatgacactggggcagacactcctgcagacacaggcacacaggctgttgaggatgaggctgagggatttttgggtggtccgagcgacccatccgtgctgaccgagtatgcggatcacgttgcaggcagtgtatggacgggagaggagcgtcctgagttgaagctatcctctcacaggaggaaggtccatagtttaggcaggcctatccctgccattaaggggctagttgttggaacaggactaagtcttctgatcgcgtgttcgatagacactggcgatcggggacttttgtcttcgtttgtcgagcggtag

SEQ ID NO: 75375 - DNA, 132 bp, Glycine max
  Peptide Sequence Number=SeqID_167060
atggagaagaagatgaagaacaaggaattaaaatcaatggcagtggaatggaaaaggaagaaagatggttggagacgctacttcaaggagaagatgagtcaagaacaagctcaccaccataggaagccatag

SEQ ID NO: 75376 - DNA, 336 bp, Glycine max
  Peptide Sequence Number=SeqID_167061
atgacaccaggccaggcctcaaatcctctgccagatggtcatgctccgcagccccaagtcatccctcaggtcccagagacagatatccctcacgtgccggagccaggagcaccatcgacatctgcgaggcccactgtggacgagcctagacatgcagtggaagtttgctatgggattgctgagaggttggagcgccatttgagcctaggggtggtcaccccaggctcatcgacacatgaggtgatcgaagaatgcctcaagatggctaggagtgtcacacaggaccagctagtatatgttaggtctcgacgcaggcggtgcatggatcagacatag

SEQ ID NO: 75377 - DNA, 135 bp, Glycine max
  Peptide Sequence Number=SeqID_167062
atgacgaaggaagtgatccacggtcacaactctgtagcgcatcagcttcacttttccttttcttcttcttcttctacatttttctctggttttcaggctactggggaacctcgcccaagcgagctgcttgcttag

SEQ ID NO: 75378 - DNA, 303 bp, Glycine max
  Peptide Sequence Number=SeqID_167063
atggtggataaagatacactggactatagtggatggagaggttcaaagaacctaagggaattagctagtggtgaccatccaacatttgatgcactcatttggcatagggaactcacaagcctcactttgctactcctaacgggttctgagactatgctttttgagttgggagttgggagttgttgtatttccttgtttgtttgtttgtggcgttttgaggagcagagcactcacccctacaaccaacagttttcaagtatcgatgacgtcgagaatgttggtgcccctacaagcctaacatag

SEQ ID NO: 75379 - DNA, 1236 bp, Glycine max
  Peptide Sequence Number=SeqID_167064
atgttaatgtgtttcctatgttttgaattgtttaaagcagaatttagaactgggtatgttccggattctagaacaacaaagcttaggactctgaagcctgaactacattatgttgaacctaagctagtggagaatttgcaggtgcctactcgtgaagattcttaccaggtagaccatgatgatccggaaaatcttgctcttctcaggttcaatgcgctatgggaagcttattatcgtcataattctcttctagttttctccactgggagatcgcctactatatatggagagttaagaaaacagaaacctttgttgactcctgatataacaataatgtctgtgggaactgagattacatatggtgaatccatggtacctgatgatggttggaaacagtatctagatcataagtggaatagggacatagttatggaggaaacagccaagtttcctgaactaactttgcagtcagaaacagaacaacggcctcacaaggttagcttttatttggaaaaagggaaagccccgaatgtcacgcaaactctctcaaaacgtttggaaaaccgtgggttagatgtgaaaataatttatagcaatggtatagctttagatgtattaccccaagctgctggaaaaggacaggccctagcttttctacttgaaaaattgaaggctgatgaacaaggaccaatcaacactcttgtttgtggtgattcagggaatgatgctgaactgttcactgtacctgaagttaatggggtcttggtcagtaatgcacaggaagaattgcttcaatggtatgcagaaaatgcaaggggaaatccccgaataattcatgcaactgaaagatgtgcagctgccattgtgcaagccattggtaacttctctctaggtccaaatgtgtccccaagagatattggagatttaatgtccaacaggaaagttcatagtcctagccatgaagtggtgatgttctacatattttatgagagatggaggcgtggtgaagttgagaatcctgagcagtatatacaaaaattaaaatcagtctttcattctacaggaaattttgtccatccttcaggaattgatcaacctatgcaccaaactatagataccttagcaaaggcttttggtgacaagacgggcaaagactttcgagtgtgggttgattgtatatctttagcagaggtttgtgtggtcagcttgcctctttcatcaacattattaaagtag

SEQ ID NO: 75380 - DNA, 303 bp, Glycine max
  Peptide Sequence Number=SeqID_167065
atggctaaacacaaaagtaaaagcagatccaaaaatccccagatctcgttggtgagagtgtcaattagatctcgtcggtggcattgtcaatccagtttcgttggtagtggcattggtcataatcttgtcgatgttgttgttgttgttgtggagtgtgatggtcgacaaattgtggaactggattttcatggtgggagcgtgcacaaagttgcttccattataagtgaaatgccagatctagagtgtggtgatgcaacattgtttggaacccttcacaatggtgaagagagtggtggattttga

SEQ ID NO: 75381 - DNA, 264 bp, Glycine max
  Peptide Sequence Number=SeqID_167066
atgacagttgcctcaaagatagacaacaccgactcctccaagttgactaggaatgaagaagatgattcagaggaaggaattcctctatcaccttggtcaattgacccttcctgcagctcccttcttcttcgggttgcattgttccttctacaagctgcttcaatctccaagtttagtggagctaagtcctccgttggagttttacctcgcatacaagaagcaagctactacagagcagttaaccaggacaaaggattaaattaa

SEQ ID NO: 75382 - DNA, 339 bp, Glycine max
  Peptide Sequence Number=SeqID_167067
atgcatcctccacccaaagagtttggagttatgcttcatgattgcctagtgtggaccctcaagtgcaatccttcattctccagttttttcggggacccacgaatgtcattgcctagcgttgttcatgtgtcgtccatcttcgagtctggagccccgcgaatgtcattgcctagcgctgttcgccaattctacattctccacttttattcggcgccacatgaatgtcattgcctagcgctgttcatgcgtcctccaccttcgagtctggagccccgcgaatgtcatcaactagcgctgttcgccaattctcaattctccacttttttcggagccccatga

SEQ ID NO: 75383 - DNA, 1440 bp, Glycine max
  Peptide Sequence Number=SeqID_167068
atggagtttaagcaacatgaggaaactgatttgaggatgcttgcagcaacaacgagttacaatgactttggaataccgccctcaagtcaaggcgaagaggagccagtggcggcggcgataccagtggtgattccaatgaccccaacaccacccaccctggctcaaaaaaatgacaatgagaagtatcatgagtgccttaagaaccacaccatcaaaactggcgtccacacacttgatggatgcatcaagttcttgcctctaggcgaggagggaaccctggatgcgctaaaatgcctagtgtgcaactgccaccgaaacttccatcgtaaggagacccccaatgacacctacctggtgccttaccaccgccactcgccgttgccgttggcagcgtactatggggagcaggtgggctacccccatgtgcaagggcaacaatgcaccacactggcactcccttccaggtcaaggggcagtggtggggcccagtcctcgagggaggacatggaagcagtgtcagacccaacgagtggtgccactcctcatggcgggtccagcaagaagcgtttcaggactaggttcacccaagagcaaaaggggaagatgttggcctttgcagaaaagcttggctggaggattctgaagcacgatgagagtgtcgtgcaggagttttgtgcccaaactagcatccaacctcgtgtgcttaaggtgtgggtgcacaacaacaagcacaccttaaataaaaaaaatattggcattgggtctaccatacacaacgtgacttatgcagatgatgtggtaagggtgagtgtagataaagtttttgacggtgacgctcaagtgtcgtttcccacatcaaaaattcagtatgtgaggcaggcccacgacatattcttggcatggccggcaaatcttgggaaatgtgtatcacatgaggattcacgtcttactccatcgaaagtattcgaaccaattgaaaggttgaataatgttgctacagatgatccattgcgtcagttgattagaaccttatatgacatttacgagaagcctattgagttgttgtgggatgggactaaattcgggattccaaatgtggatgcatccttcttcttaacatattcttatgtaaatgaaataatatcaggtgacaaatgtttgaacatagctatactacagttgtggatgatgtttatggatgagtggagttcaagcttgggtcatggttcggtctatggattccttgagcctcagtccatacacaatgcaaaggagagacatgctgaatgtcaacagtacattgaaacatggactcatgttcaaagcggagggtatgagtgtggctattatgtcatgcattggatgtggaacatatggtttggtgatggctgttcgaacccagcaagtgcaccggatcgcgcaagtagtataaaatggtaa

SEQ ID NO: 75384 - DNA, 237 bp, Glycine max
  Peptide Sequence Number=SeqID_167069
atggagatagtcaatgatttttttctttttgataagatcagtatgggctctatcaactcgtccacatccatcacccaacaacaggtggctgagataattggaacccttgaggaagaatggaggaatgagctggaagaagaaaacaaaatggagtctagagagaatgaaataggagttgaaggaggccatcaaaacggagttatcccaaaggggatcgcagtactctcccccaactga

SEQ ID NO: 75385 - DNA, 331 bp, Glycine max
  Peptide Sequence Number=SeqID_167070
atggatgaagatgagtggatgtatgaaataatgtctgaacgagcagatatggattatgaaaatgcagaatcatgtggtgcgaatgaaccacatgttgattgttcggatgcattcaagacttctcagtgccgagaggatgttttgcagtgggctcgatctgtggcttttgaaaacggatttgtggcagtgattttaagatcagacacaaacacaggagtggcgagtataagtgtaggaaaaaagaatttatcagaagagacactgggactaggaaatgtgggtgtcccttcaagcttcgttgcaagccagtggctggaggagaagctggatg

SEQ ID NO: 75386 - DNA, 222 bp, Glycine max
  Peptide Sequence Number=SeqID_167071
atggcggaaccatcgaagaagcgcaagggttcttcaagtagaagccaacgacactccgagcctcaggatactctgattctttccttcatttcctcctccttgttgttctcatcggaagaacaacgtacccgatacataaatctcttctcctctcgttctattattgaccctaagttcatagatatggatttcttttatgatgagagttttgaatgcatttaa

SEQ ID NO: 75387 - DNA, 195 bp, Glycine max
  Peptide Sequence Number=SeqID_167072
atgtcacgcaggcacgtgctcagcgcgtcatcagctcgctcagcgagtcatttgtcaccttctaggcttagcgcgagtttggcgctaagtgaaagttcaattacttgcgctaagcgcgagaatggcgctaagtgcgacgtcgagcttccttgctatggaaggctaaatcctcagttggggattcttgctgagtag

SEQ ID NO: 75388 - DNA, 339 bp, Glycine max
  Peptide Sequence Number=SeqID_167073
atgcaacagggacatgaatacatccctatagttaggttccttgaccccaactatggttcggcggaaagcaacgacggctcgtggtggccaccgatggtcatgggtggtggagaagaaggtgttagggtttggatctcgcttagcaagcttgtctcgctaagcgggagtccacttttcacgcttagcgcgacaattcacgctaagcacaactccctctgcactaattctcgctcagggcgccaattctcactcagcgcaattccttcttgggttggaattgcacttagcgcgctaattctcgctcagcgaaattccctctcgggttggaattacacttag

SEQ ID NO: 75389 - DNA, 1356 bp, Glycine max
  Peptide Sequence Number=SeqID_167074
atgtcacatgactatcatgctccaaatgggttactggatgaagtagttggtgactttagcagcgacgaagatgaaattttggcggacaataataacatcaatgacaatgacgataatgacatacagtttcttttccaaccaaaatcaactgaaaatatctatcttccatatccaaatagcgctgatgttggtgacaaccaagtggctgacaaccccgaatataggcattatttggaccagcaacaacaatctgactcgcacgatgtcgagttgtatgttggtgtgcgaaggatacataagtcttatgttgtccagctgaagggtgccaatggaaacttagagcgcaaaaatatccttgcaatggttgaagaaaacgagcaactaatcattcctacattcatcacattcgtaagacaagagttcggatacaccatcacatatcgtaaagcatggctagcaaaacaatgggccctcgagcatgcatatggtaattgggaagagtcatacaacatacttcacaaatacctacaaactattcctgcactggacgagtccaaccaaccaatcccaaacaagagttcttttgccactactgagagttacaagaagacaacccacacggtactgcatggttggatcaaataccaagggagcaatggaccttggcaatggatgagagaaaacgatggggacacaaccactaatttggcagagtcactaaactcgactgatgcaatgatcgcctctgaacaagtttacacacttattgcagccaagttcatcaccaaagaagaaactaagtccaacactgactacgttcaacagtttggccgacaaagatttcaatttcaagttgaggaaatagtgaatatgagagagagaggtgtcaaatggggaaattcactgtcagactggatcaaagaacatgtgattgtgggaaaccttaaaggatacacatgccatgtgcacatgtcattgctgcatttggaaacggagagctggttaagggagaatttatccagcaatcttgtggttgataactctcattggattgtggcgagtgtcaaagccatgattatagatattcagataagctctaacaatatcctagctttgcaccctggagagcatcttggccttaccaatgaagatagcttagatatttgtaatgctaatgatgccttttctctctactgtgatggtgctatttttaaaagtgtcagtgctgctgcttaccaacgaggctatggtggcggagttgtgggctctgtaccacggtcttggaatggcagtgaagcatgggatccaaaatctggtggtgaaatcggattgtctgtaagctgtaatccttattaa

SEQ ID NO: 75390 - DNA, 261 bp, Glycine max
  Peptide Sequence Number=SeqID_167075
atgaagaggaatttggagcttcaagagagacaacaatggtggagaagaaaagaaagaaaaagcaacgtggaagaagaaaagggagctgctggaattttctggagaaagagagagaagaaattccaggatgtcataggaactggtgctgatgttggagctggagtggtagcaagggcagaggtagagtttggagtagaggtatcaaggactcaaaggtcagagaatttggaacaactcctcgggcgatgcataaggcagtga

SEQ ID NO: 75391 - DNA, 429 bp, Glycine max
  Peptide Sequence Number=SeqID_167076
atgtcattatttagagacaccacagttcctcctccaacaccctctggcacctccgctcagagcacaaatgtcatagtgccgatgctgcagtgcctccaccactgcttatgcctggtgatgcagagtatccacgatttggctcagcattggcttattctcaggatgaaggactttatggcccaagtggactggccaagagtccagccttctcctgtggggggaggtgaggctcctacagcccaggagccacagccagagccggagccgacacctgaggacacaccagaggagactccagaggtcacccctactgccacacctttggaggctactaaggagagagatggtgctgcagatacagattatgccacagatatggcagcaacgcagggtacttgggatgatccaacaccggcacaggagaactga

SEQ ID NO: 75392 - DNA, 324 bp, Glycine max
  Peptide Sequence Number=SeqID_167077
atgggaggaagtgagaaggaaaagggttcagcccctgaggcacttctctctctttcgaatttgcttggaaaaattgtttccgtgaagaaaatgctgtcgtcccttgggacggacgtgtggggtgctaataccttccccgtgcgtaaatacaactcccgaacctttcaattaaaagttcgtagatcgcgtcttttccggtttttccgacgttttcctcaaataaacgttggtggcgactccgcgcgtattcctttcgtggaacacgcatcccgcgagtcacgcgtcgccctcccgccgaagggtaggttgcgacaacaatgttaa

SEQ ID NO: 75393 - DNA, 555 bp, Glycine max
  Peptide Sequence Number=SeqID_167078
atgcagtccaagtttcagtcgcaaatgcaatcacagggactcgcactgcctcctgagcctgaggtgggtccttcaactgctcgtgtcagcacaaaggagagttgtgttgatccctcagggaacaatccagacacaggtgacacaaacaaatgcaggttgtacaccgaagaaattcctccacgcctggttgccttaggaagagtttatgagggatccacaaccgttcacaatattcctttgttgcatgttcaagtcaaggttggtgtggaggaggttagagatgtagatgctcccattcctatacccactaaagaggttaagttagtggggcagacacctaacaccttccttgcttggccgacacatctagtcaagcgtttatcagaacagggagctgagggaccagcaaaacctgcagataggccaaatcatgaggttatgtgggatgctaccgtgttcggggtatttaatgaacacttccccttgtacataaagcgtgaaggtctgtctgaaatagcacacggtggtcaatgtctcagcatctctgttatatag

SEQ ID NO: 75394 - DNA, 453 bp, Glycine max
  Peptide Sequence Number=SeqID_167079
atgactccattgatgaagaagatcgaaggcctacaagctccacatggagctacatcaaaacccactactttctcaactcagatcacttgttacaaatgtgaccccttcttcgccatagctcaggctgaaaagacgtttctcccccatcttctcctcctcaccttgccactaaaagggtgtttggttcgtgtcattgctggtttgtgtcattgccgcaaaagaaacgacacagtgatggaaacttctgcttgggtcgctagccactcctcctatgtccttgttgactctgtaggaattgagaaagtggtgagcaccattgtgttggacgctttaaatttttgcttctggcctggtccatgtgatatatccgtaaatctaaaaaattattattcactgcatgggggggctagtagtgcatgtggtcccaatggattaggcttggcaaaatactag

SEQ ID NO: 75395 - DNA, 162 bp, Glycine max
  Peptide Sequence Number=SeqID_167080
atggtgggagaaaatgtaaatcatgaagattttgatgatatcaagaagaatttgcttgagaaagagggagatgtaaatcatgcaagctttgatggtgtcgagaagaaatcacatgtttgtcatcatcaaaaagggggagaatgtgaatgtatgtatacatga

SEQ ID NO: 75396 - DNA, 354 bp, Glycine max
  Peptide Sequence Number=SeqID_167081
atgtttttaatgcatttgtttccattatattcgactacttctggtggccgaattgttgttcctcctgccaacaggaagtcagaggctaaccctttgaagcagaagattgagaaagctgaagttggccaaagatttcaagaagtttctgttttggccaatgtctttccgacatatagaaaccctagcctagtgcttatcaccatcgctaggggagaaagggagaggcgggaaaatgagcggagcggagggcaagaaggggcgagcttcgtgatcaattgcgtgaagctggtggaggataagaaggggaagaagaagaaggttttctctggagaaggtccttcaggagaggattaa

SEQ ID NO: 75397 - DNA, 201 bp, Glycine max
  Peptide Sequence Number=SeqID_167082
atggggtgtatcagtaatcaaaatagtcatcaggagagtgcctctgttggtcatcgacttgttgatcatctacctggtgctgttgttggtgttggtgttcctactggtcctgatgctactgaggtaggaactgaaggactactgactgaaaaatgcatatctcctctattggttgacatagctcctccctcaggcggttaa

SEQ ID NO: 75398 - DNA, 384 bp, Glycine max
  Peptide Sequence Number=SeqID_167083
atgaggttcttccatggtgattttccaccatggagatgcagcggaaggcaaaggagaagaggagaggggagacaccatccactagggaataagccatggaagaaggagcttcaccaccaagaatgtgccttggataagaagcttgaagatgatgctttaatggaggaaaagaaagagagaagggaggagcacgaaattgaaggaataaaagagggagagaagtggacttttgaagtgtgtctcataagactttcattcatcaaagttacaacaagtgttacaaatgcttctatttatagactaggtagcttccttgggaagctttcttgtgaaaacttccttgaaaagttagtgcttagctacacacatccctctaataactaa

SEQ ID NO: 75399 - DNA, 219 bp, Glycine max
  Peptide Sequence Number=SeqID_167084
atggcttgcccttccaacaggcttctacactatgggagaaaaaacataaataacttgattcaatttgaccctaagccaccaattttttcaccgacgcagggaccaacacacatatacctatcatatcagatgctcccaacccaaagtggttacgagcagacaaatccaaaaaagagggtaattgtgacaccctctacccttacaattataactaactaa

SEQ ID NO: 75400 - DNA, 288 bp, Glycine max
  Peptide Sequence Number=SeqID_167085
atggataagtgtcaaagacgatatccacaaacacgatctccacaatgtggttgcagtcacggaagcgcaggcgactttgacacaaggagaaagaagaagaacgatagggttcaagcgcaaggagaaagaagaagaacgatagggttcaagcgcggtttttacaaaaccgatgttaacaatggcatactaacatcggttttggaaaaaccgatgttaactaagtctacttatttacaaaaatgtcaccgcgctttcgttaacatcggttttagctataaccgatgttaa

SEQ ID NO: 75401 - DNA, 582 bp, Glycine max
  Peptide Sequence Number=SeqID_167086
atgaaaaagggagcagagaaagaaagggagaaggaggatgaagggttctatttttgttccaaacctgattgtgtcaagtttttctgttccaaatctgattgtgtcaaattctgttcatccaaccattgggataaaaatgaaatgccgttatggacgacgacacacagtggtcacaatggtggggcaactgtatcgaggtgtgttgctggaactgagaagacatttgatgtgatcctgactaggagcggatcgcttgatacaggcaacaaagatttggatgacacaacttccggccttcatccttctccacttgggccttcatccttctccactcgggggctttgtccttctccacttgggcctttagcctgtatttggccagtttcaggattctcatcaacattactcacactggcagtggcacgagaattagaggataaggacttagaagcactttatgagttaaagggtccaatgacaagatctagagccaagtttctacaagaagagatgatcaagaggatcaaggatgaactactcatcaaaggcaaggaaggagaaaatcacaaggggttgaattga

SEQ ID NO: 75402 - DNA, 168 bp, Glycine max
  Peptide Sequence Number=SeqID_167087
atggcgtccaaccgaagcagcagctgggctcgcggtgaaggagaaggctcgcggaagaggtgtcgatgttggttctgggctttgatgttatgtgccgatgttggtttgggcttcgacaggaaagtgtgcttggtaggtactgggcttgaatacaacgataaaatgtga

SEQ ID NO: 75403 - DNA, 555 bp, Glycine max
  Peptide Sequence Number=SeqID_167088
atgatagaagtttttgttgaagccatcgcctcccttgctcagtactatgaccagtcgctaaggtgttttccatttggggactttcagttggtaccaaccgtagaagagtttgaagggatattgggatgcccgttaggaggaaggaagccgtatctattttctgggaagcacttggaagagaaagcaaaagctttggcagatcaaggagaatggacttcattcattgatgttttagcattattggtgtttgggatcgtcctttttccaaatgtggatgggctagtggatctagcggcgatcgatgcttttcttgcttatcaccacaacaaggaaagtccggtcgttgctgttttggctgatgcttatgacacattcgacccgagatgtgagaagagcagtcattgcatgtgtgtcgagaaagggaaagcaaattgggaattcttgacagggttcctaaacatccccttgatgggaacaagtgaaggcaatgcaaaaatgctgcaaagagtccgaaaagcgtggaatgcggtgcaaagaaaggataaggagctttaa

SEQ ID NO: 75404 - DNA, 261 bp, Glycine max
  Peptide Sequence Number=SeqID_167089
atgggatcttcgttagcaatgggatgttcttctcgatttgatgtttccgtttgtggtagctgtgaaggtggcgtaaagggggatgaaggatggttttgttggtcaaaggagtataaatgtcaaaggggtcttgtgctgagattgttggatgaagatactagattattgaggtctatgttgttgtacggtaactgtaactgttgtggaggcggtaattgtagttgtggacatgagggttgtggagacgatggttgtgattga

SEQ ID NO: 75405 - DNA, 597 bp, Glycine max
  Peptide Sequence Number=SeqID_167090
atggagtggatgaaggatgttgcctcataccttaactgcagcttactgtctgtaccatttacctacttgggtatccacatcggggcaaacccaaaagagagtgatcccgaagaaggtggtactcaagctggtgaaactagaatgatgtttcctgtgggaaggagatacgaacatacgaagattgcgtgggaaaaaggtggtttgggaattagagatttgaccaagtttaaccaagctcttcttggtaaatggaagtggaatctgtttcatcatcacggagagctatgggctagagtactagagtcaaaatatggaggatggaggaacctggatgagtacagaagggttctggttccatggttaggttttgggaagaagggagaagggaggttgcttgatgggatccctataatgttcacatggaacatgggagtagtgcctgcagtggaggaaatccaacatctcaacataaacgagcagcaacaagacgggtgggtgtggctaagcgaatcaactgaggtatatactgtaagcagtgcctatcaactgcttgacagggaatcaagagatgagaacatagatggggtatttcaagac

SEQ ID NO: 75406 - DNA, 1515 bp, Glycine max
  Peptide Sequence Number=SeqID_167091
acggtcacagacttggcgttctttgctgaagatgttcatctcttggctagtgttggcacagatgaccgtgtctacttgtgggagatctctgaaggcccagatgatgaagataagcttcaaattactaccaatattgttattgctcttcaaatagtgagggaggagaaagttgaacatcctcaaatttgctggcactgccacaaacaagagattttgatagttggtatgggaaaacatgttttacggattgataccccaaaagttggaaatggtgaagcctttgtggtagatgatcctctgagatgtcctgtggataagctcattgatggggttaagctggtaggcacacataacggggaggtgactgatttgtcgatgtgccaatggatgaccaatcaatttgtatctacatcacaggatgacacggaaaatctgatatctaaattgcatccgaggaaagggacatggaagatagcagtgcgtataactgatatctgggatgttaagaagcacaatgggagacaagcgattaacatggtcttgatggaccaaacgggtgcaaagattggtgcgacgctatggcaggaattcttccttgaatttcaaccgaagttgcatttgggttgtttctatttgatccagaacatcaaagttgtggataatcagtctgaatacaaagaggattatgctctacagcttgatgatgctattgaaaaaaaccattttgttggggagccgttggtgcttatgttaacattagctaagatcaaagatgccaaagacaagtatccgctgagtgtccaaaatataaagaatggttccaagttgtatgtgaacgccgatattgccaagatcaagaaattccgtaatgcgtacgataaatgcaaacaaaaaacaacagatgaagggagtggttctcagtcccagtataccaacaattcacaaagaatgctgcaggataagttcttgcataatgctcagatggtgagcttaggtgacataagcaaactgagagaggacggttactgtttgaccgttgctatggtggatgaagtcatgattgatacaccatggagttatgatagttgtccctactgcactacaacatttgatccattaaaaataagggcagcctgtcgttcgtgccagaaccaagttagtcatacggttcccaggtataaattagttgtcaaaatggatcacaatggggagaaagctaactttcatttctgggatgcgtcgtgtatcaaaatgttcggtaagacaactgacgaatgtcgacaggaatggattgcggttggtgacgagatcaaagtgttccctgagtgtgtgaatgatttggtgggtaagacattggctgtcagattcaagttccatgtacacatgtgccaatcatctgtcttggatgttagccaagaggaacatcatatccacacattgacctccacacttggtttacaggatgaagcaagtatagggaagtcaccagcggcgtgtgctgaaacttcattatag

SEQ ID NO: 75407 - DNA, 234 bp, Glycine max
  Peptide Sequence Number=SeqID_167092
atgaagaggaagaagaaggccggtgaaggacatttttgccatttcaccctacgtgctgggtgccccagcaaaaatgctggatgcaccaagtgcttggcacccatcattaggcaatttgtgaaattccgggacatgctgaaaaagaaaagaaaaattgatgcgcaatccgtaaggttccgtgacacaccggaaatcaaatggaagcatcgttgcacaattagtgaggtttcgtaa

SEQ ID NO: 75408 - DNA, 243 bp, Glycine max
  Peptide Sequence Number=SeqID_167093
atggattctgtagaagcaaagctccatggtgaatcaaagatgatgacaaaggtgatgacaaaaagctcaaagatcaatcaaagaaaaactcaagagaatccaagatcaatcaagaacaattcaagagttcaagataagaatcaagaagaattcaagactcaagaagaaagtctagagacaagaatcaagattcaaggatcaagatcaagattcaagaatgaagagaagactcaatcaagataa

SEQ ID NO: 75409 - DNA, 333 bp, Glycine max
  Peptide Sequence Number=SeqID_167094
atgactccattgatgaagaagatccaagggctacaagctctacatggagctacatcatatcctcatttggaaatactcatcatgattgtcgagggcctccacaactcgaagaaacacatgcctttgcatgcaaaaccttcttcaaaattgagtatttatagtcggagaaattggggcaaaaaggaaggagggagatacccatgccaacacttcggcgcccgcataggtcaagcccccgcagacctctcatggtacgcatcagtatgcgcaacatcatccgagcttttcagctcgcgctgggaactcctccaattcagcacccgtgcagcctaa

SEQ ID NO: 75410 - DNA, 213 bp, Glycine max
  Peptide Sequence Number=SeqID_167095
atggttcccgcatgtcatcgggcccgacacctctggatgacaaaaggcgcagaagacgacgttagtctctacatgctatcatgctttgagtcttatagagagcaaaaagtttataaggataaccggttggataacttagcaacatatgcttttcggatgaaaaacaatgtgtctaccggggaaggggagtatgctgatgaaatcttctcataa

SEQ ID NO: 75411 - DNA, 426 bp, Glycine max
  Peptide Sequence Number=SeqID_167096
atggtgcttaccaacatggatggcgaggagctacctttccccatgaactctgatgtggtgtgttcttcttggtttcccccaaggattctcgtctgctgtaaaaaaaaagtacaagttagcttgcctgggcgagcacccctgcacctacaaataaaaaacgagggagggggagttttcctccacccaaaactctcccccccccccccacttcaaaaacaccaagctcacgggaactacgaagacagcagcccccaagcttccattgttgagtttttgcttcccttttcacgctttgtttcactccctacaagggttgtaagggatggccttaggcctatgttgcattttggagtaatggggcatgccacattgcccccattctcttgctattcatgccaaaacatgcgcccaccaagtgctcggtga

SEQ ID NO: 75412 - DNA, 2013 bp, Glycine max
  Peptide Sequence Number=SeqID_167097
atgatgtcctcaccagctaatttgaacacggggggagaagagaagaaattagaaatagagaaagtggtagagagtcaggtagaggtagcagataccgagtcaaagagaattcagccatggaaagagcaaataacagtgagaggattggtggtgagcacggtgcttggaatcatatacagcataatagccatgaagctcaatctctcagctggaatcgttcctaactttaatgtctctgctgcccttcttgctttcttgtttgtccgaagctggaacaaagtgctccacaaggctggttttatctccaaacccttcacccgccaagaaaacaccatcatacagacttgtgttgtctcatgctatagcattgctgttcatggaggatttgcttcttatcttttgggattaaacaggaagacgtatgagttgtctggagttgggactgagggtaacaatccaaatactgttagagatcctggatttgcttggatgactaccttcctttttgtggtttgctttgttggtctcttcatcttgattccactcagaaagatcatgatagttgacctgaagttgacgtttcctagtggcttggcaacagctgttctcatcaatggtttccacacgcagggggacaaaatggccaagaagcaagttggtgggttcttgaagtatttttccatcagtttcatgtggggttttttcaagtggttcttctcagggacacaggattgcggattcgctcagtttcctacctttggattgcaagcttggaagcaaacattctattttgattttaacatgacttatgtgggagcagggatgatttgcccccaccttgtaaatttgtctttgctccttggagccattctctcctttggagtgatatggccgctcattgatcgtcgcaagggagattggttccctaccaatttagatgagagcaacatgaaagctttgtacggctacaaggtctttctaacagttgctctcatcctcggtgatggcttatacaactttgtcaagattttagtttcctcaatccttagcgtacatgaaaaaattaagaaccgtaaaaatgcttcaagtgcggatcaacagagagataacgctgaagagcttaaacaaaaagaagttttcctgagggacaacatttcgatgtggatcggaaccggcggatacatagttttgtcggtgatttccataattgtaatccctttaatgtttcctcagctgaagtggttctacgtggtggtcgcttacatcttagccccgtccctggcattctgtaacgcttacggaacgggtctcaccgacatgaacatggcatacaattacggcaaagtggcactctttgttgttgcagctatgagcgggagagacaacggcgtagtggcaggtctcgtagggtgtggtctggttaaatctgttgtctctgtggcttgcactctgatgcacgatttcaaaactgcatattacacctgcacttctcctaaagcaatgttcatatgccaattaatcggcactgcgttgggctgcgtaatagctcccctcagcttctttctgttctacaaggcattcgatgtggggaacccgcatggggaattcaaggccccctatgcgctaatttacagaaacatggcggttttaggcgtcgaaggtttctccgcactgccccagcattgcttgcagctctgttacgggttctttgctttcgcggtggtggtgaacatggtgagagacctctcccccaacgtgtttgggaaatggatgccgttgcccatggtgatggcgattccctttctggttggtgcctactttgccattgatatgtgccttgggagtttggtggtttacgtgtggcacaagcttaacactaagaaggcagaggccatgattccagcaactgcctctggactcatttgtggagaaggcctgtgggctcttcccgcttccattcttgctcttgccaaagttaacccgcctatctgcatgaattttcttgcttcctag

SEQ ID NO: 75413 - DNA, 951 bp, Glycine max
  Peptide Sequence Number=SeqID_167098
atgggatcaaatcaagcacatttgtctaagaaaaggttctatcaagtcaaaatcaaaagcctagaggtttccagtttgcaagggggtaatggatggaccagccccaacgtcaagctttctctagtgctgaccgtggaagagtttgaagaaatcctgggatgtcctctaggaagaagaaagccatatctcttttctgggttctatccctccatggcaagaatagccaaggtagtcaaaatctcggcacaagagttggaccgagtgaagcaaaatagaaatgggatagttggaataccaaggaagcttttggaggaaaaggcgaaggcattgtcggatcaagtggcgattgatgctttccttgcttatcgccatagcaaggaaagttcggtcgcttctattttggccgatgtctatgacacggacgagaagctattgatgcatttcttccaagatagtttggccggagcagcggtcatctgggacttggcagcgcaagtggcaccccccatgttagaaaaagagatgatcacaatgatagtaggcatgctgcctgtgttctactacgaaaagttggtgggctacatgccctttagcttcgcagatctagtgtttgcgggcgagaggatcgaagtaggcctgaaaagaggaaagttcaactatgtctcccctgccagtacaagcaacataagattcagagcaagtggagcaaagaagaaggaaggggatgcccatgtcgtgacttcagctcctgcttggctgaaagaagagaaggttgaagcagctggtgtctcgttaagcgaggaatatgcgcttagcgatgccacaagctcacccagtgagtcatttgtttcttcttgtgctcagtgtgcccagctcgctaagccaaatttcaccaactcgcgcttagcgagccttcagaatttgaaacgtcaaggagcctttaaacactga

SEQ ID NO: 75414 - DNA, 273 bp, Glycine max
  Peptide Sequence Number=SeqID_167099
atgactaagggcaatccaggtgatttacaacccttttatcatgacatagatagaacctttcatagattagttaggcatagtgtgcatcctgatcattcagtgcattttgagcattttgagcattcagagtattttgttgctagtgattctgaatattctgattttgatcattcggctgttaattttcatattgagaacatggctcaacccccacctcgtgagaggactcttagggagatggctgcacctgatttcacttatgaaagcttgtga

SEQ ID NO: 75415 - DNA, 66 bp, Glycine max
  Peptide Sequence Number=SeqID_167100
atgggttcgaatccggaaacagtctctttgcatatgcaagggtacagtctctttgcatatgcaagg

SEQ ID NO: 75416 - DNA, 477 bp, Glycine max
  Peptide Sequence Number=SeqID_167101
atgggtgccaagtacctcgaagtggtcaaacgagggtcgcatcccaacaacggatggtccccggacgaaattagggtggaagaagacactaaagttgtcatttttaactccaaaaagataacagagaaaaaagatgaactaggaaagcttgaagtaattgattatggagaaccactagatgaagcatcggcagacctggatgatgttattggttcttttaactactatgtcgagcttgcagtaggattggacgcaaagaaaaattcttctgtatcccttcctatggaaacctccaagagtcatgttcacaaggagcctattggagttgttgcattaattactccatgtttttgtgcggatctctcagggaaaaagatggctaaggaggacaacttcatacggtggacttcgccaatactggacatcatctcagtgtatcaagcaaatattatggattaccttttcacctgttcttag

SEQ ID NO: 75417 - DNA, 756 bp, Glycine max
  Peptide Sequence Number=SeqID_167102
atgactaatcagcaaagtgggttatgtaccgcaagagaacattgtttggctttggcaatagcaatagctttagccttgttgggagcggatgaagtagatttgggtgttggtttagaggatggtggtgaaagttcagttgatggttgggatggttgggtctggaaaggctgggttttaggctttttggctgaggttaggggtttaggttcagaagatgaagggcatattcaccttctcacataccatgatcttgtagatgcagaagcagtctctatcactgacattgtctctggatcctactcgaggcatgactatgttgaaaagcacaatgtggatcatcctacacatgtaggttatctcctcctagtctttgctcatggtcagaccatccagagcacatctagatgtagcaacaatggtggccggagagattaccacctgagtcccagcaatagttcccttgatgttggatgcatcttgcctagtatttccttagaagaaagcataagggccataatgtcaggtgttgaacttttccagaaaataagtccagctcaccttgccaaacaatccctttacatcaaatccttcctccttcaggttttggaagtttatccacttcctagggataaatcaatccttagggaaagcttatgttgcatcatcaacattgttgatggttgggatgctagtggactcattcttcctagaggtgccattgttcatagagagtttaaggaaaaagagagtttttga

SEQ ID NO: 75418 - DNA, 603 bp, Glycine max
  Peptide Sequence Number=SeqID_167103
atggctcttatgttcgactatcgtggttgtgcgacgtgtatcagacgaagatcgaagcatagtgggagttatgcttggggcgctgctgcccttgtgcacatgtatgataatttaaatgacacgtcgaagagcacggtgaggcagcttgcaggatatatcactctgttacagtgttggatctacgagcattttccatctgttggtttctctattcctaccgaggattatgatgagaggagactgcgagcatgtcaatggacctctagcaaggcactaaccgtttccacgtatcgtaggtgtctggatagactgacccctgacgtgatagggcccattgatggtcattcacgaccggagaggattgtacaacagtttggctacatccaggctattccgtcacatcatgctgcgtcttcgttctctattgaagaaattgatgatagatggatgcagttcagtgagtacatagcacctatagggcaattatgtgcagtgcttaaccattgtttgacagattacatggattggttatgcatgatttcgcacccattcatgagtctggcacaaccaggggatcctcctagagttctaccgattcagtaa

SEQ ID NO: 75419 - DNA, 306 bp, Glycine max
  Peptide Sequence Number=SeqID_167104
atggcaatcaagaagaccaaaggaacaacggccgaagaagacgaaagcaccacaacaacaaccacggaccaccacgaaaacaggaacaagaaccactgccggagaaaagaggaacaacaaccactgacgccggagaagagacgaagaagaagcaccggagaaaagaggaagaagaagcagttccaaaaatgccgagtgccccaagcaacaactatacctgaatccataaatagcgagcccaatttgccttcgtctaagtcacacttgtgcatcctcatccaaatcgccctcaccctcgatttctaa

SEQ ID NO: 75420 - DNA, 363 bp, Glycine max
  Peptide Sequence Number=SeqID_167105
atggaggaagaagttgatccatcgataaagagggagaagcacaaggaaaatggagtgacgaatgtgggctgcgaagacgattttcttgatagcccaattacaaaattttatcaagaaggaagtccaagcagcttagacatggagctaaggcagaagggatgtactgagccagtcaagttgattaaagttatatggagtccacccttgtccctcctaccaccaaagccactgaacctcaatttgcatgcaaggattgtgggtcgttcacagttaagctacaaggggtgcagttgtcttccaacaatcagacataactttaggaagtttaagtgtgtaattccagttttcagattccaaccttga

SEQ ID NO: 75421 - DNA, 192 bp, Glycine max
  Peptide Sequence Number=SeqID_167106
atggtgtcgtcttgttggcttggaagggttcgatcatctctacatcatccaatgacttcatatccacatatcttcataccaatccccaaccaggcattggatagaagactccaagaagattgggccagagatgcaagagaaggccctagggttctcatgagccttagggtagatttcaggcccatgggctaa

SEQ ID NO: 75422 - DNA, 372 bp, Glycine max
  Peptide Sequence Number=SeqID_167107
atggtgctgatgctgcagagcctttaccacttatgcctggtgatgcagagtattcataacttggctcagcatcggcccatcatcagcatggaggatttcatggctcaggtggcctggccaggagtccagccttctactttgggggaaggtgaggcttctacatcccaggagctgcagccagaggccaaggcccagtcggaggtcacactagaggccactctagggacttcgcctgttacgacaccacttgtggaggtctttgaggaggatgatggcgctacaaacacatattatgcagcttatttagcagtgatgcagagcacctgggatccctggcctgctacagctcaggagacatctcagccagcctag

SEQ ID NO: 75423 - DNA, 609 bp, Glycine max
  Peptide Sequence Number=SeqID_167108
atgcattttaaatcaaaccttaagaggaaatgggcccttgcagtcgatcaggatggtgtggatgacattgtctgtgagaaatacggcataagcaaggaaaaatgggcccaattttgccagactcgtagagacccttcttgggaggatgtgaggaaaaaagcacaggccatccagaaacagaacattgccccccacattttgtctcgtgggggttatgaatatttggagcaaaagctcctggttgagaagaccaagaagaagctggaggtagctgcacagtcaggaagcgttgatggcatcatcgaccctccatcccccgttagacgccacatgaagtggaagatggtccgtaccaagaaaacaggggagatgatgactgaggccgcaaaggaaatcgctgagaagatcgattcctttgaggagcaggcgtcacagggatcctttgtcccccatggacgtcaggatgttctcaccgctactattggacatctagagcaccctggacgtgtccgtgctgctggagctggtgtcaccatcaagcaatacttcggatcggctccacggatgtcccgaaactcttcctcgctacctcttgaagaattgcaatag

SEQ ID NO: 75424 - DNA, 387 bp, Glycine max
  Peptide Sequence Number=SeqID_167109
atgaaagtgctctcaagaagctctcaacaggttggatacgtggttcatgggagagaacaagaagatgaacttcaaaatgatctatggcgtgaagaacgtgagaattccaaaggattcaactttaccaacttgcttgaggtacaaggtttgtcaacattggtgcagatgaagggaaccttctaccctgagttggtaaaggtcttctacacatgtgccaaagctgttatggaagtagcaggaatagatatgtgcggagtccgaaagttagaggaatctgctgatggctacaacaaaatgaccacatacagagactttaccaaagcctctaatgagataactgaaaggcatctcaagaagcttggcatgacttatgttgatcatgaatag

SEQ ID NO: 75425 - DNA, 345 bp, Glycine max
  Peptide Sequence Number=SeqID_167110
atggttgttggaagaggattgaagcctttgaaaagggtctcgcgtctaaggctagatcgtgtgctaaccatggttgagaaagagaagccacaaggtatgttttacaacaaccccatggtgagcgccaaatgtacttaccaaaatccggagctatcccatgttagggtggacgtggctaaggagagtatgagtgagtatgaaaagagtgagagggaacctggtacttatagagttgaggaattgcgggcccttgtttataggggttgttacggtgatgtaacaacccttgcagataattaccggcttgtacataatagtcagtggataactatggcttatagataa

SEQ ID NO: 75426 - DNA, 231 bp, Glycine max
  Peptide Sequence Number=SeqID_167111
atggaagcagaatggagaaggaagagagagaggagatgccacttcaaggagaagatgagtctagaagaagttcaccatcataggaggccatggataagagcttggaggaagaaggagatgaatgaagggagagggagagaagagcacgaaattttgtgctctaaaagagctatgaaatctgaacccactaatccaagatcaattccatggttctccactaagtgtgcttag

SEQ ID NO: 75427 - DNA, 728 bp, Glycine max
  Peptide Sequence Number=SeqID_167112
atgttagccatcatcaacaagtaccaagaagaattaaatctagccacgacccacgagcacaaggtagcggacgaatacgcccgagtgtacgcgaaaaaggaggctagaggaagggtgattgactcgttgcatcaagaagcaacgatgaaagacgccataactaagcgcgccccaaggcatccctatcgcatcagatccaaatctaggatgatgggtgacctagaggaagtacaggaaaagatgaaggccgacatgtcggctttgaaagaacaaatggcttccatgatggatgccatgcagggaatgaagcaactaatggagagtaacgcggccaccgtcgctgctgttagttcggctatcgaagcagacccgactttcccaactgccacgcaccaccctattctgaacatggtgggacaagagagaagcacaccggggcacatcagcaacccccatccgaggtacaaccgaggagcttacccctatgatttaccacctaattacacaccaccagtcatacgtgacgacgcgggtcacgttcctcccctcatccttgaaggggagcctcctcgacatccggacgaggtccacgaggatcatggagagcatgctcagggagacgtcgactcctactccccgtttcccgccgagggaccggcatccaatgcactacctcagcccaacatcacgggagaacctcaaaaccacccaacgcagccaatgtttct

SEQ ID NO: 75428 - DNA, 714 bp, Glycine max
  Peptide Sequence Number=SeqID_167113
atgaggcacatccaggtcttgacaaaagccaagacagatgtgttcctggtcgcggctccacaagctcatcaaacccaacatccacccttggtgaatctcacttctccaaatgctcacaaaacccaaggtatgcccttggtgagtcttgtttcttcaaaggcttgccaacctaaaggtccacccttggtgagtcttgcttctccaaaggcttgcaaaatccaaggtccgcccttagtgagtttcacatcgccaaaggctcgcaaaaccaaaggtctgcccttggcgagtctcttttctccaaaggctcgtcaaacccaagatccacccttgctaaaggctctcataatccaaggtctacccttggtcagtcttgtttcaccaaaggcttgcaaaacccaaggtctgcctttggtgagtctcatttctctaaaggcttgtaaaacccaaggctcttcaaatccaaggtccaccattggtgagtcttgtttctacaaaggctcacaaacccaaggtccgcctttggtgagtctcgtttctccaaaggctcacaaaactcaaggttcgcccttggtgagtctcatttctccaaaggctcatcaaacccaaggtccacccttggtaagccttgacacagggtctaaggtacacggggtccaccccaaggtctgcccttggtacaaaaacccaaggttttcccttggtacaaaaacctaa

SEQ ID NO: 75429 - DNA, 354 bp, Glycine max
  Peptide Sequence Number=SeqID_167114
atggaagaaggactctccaccaacaaaccacctctattcagaggcataaagcacgtcacaagtaaagaggaacaaactcagtctcctcacacatgttttcaaaccattcttaatgaactaagatccttaggtaaaacttgtgataattatgatgacattgacaaaattataagaactctatctaagaagtggagaccacaggatgaaggactcgaaagaaaaaagtccttgactttcaatagccagaagaacaagaaggcatcatcatccagagagcaagtcttgagaagttcatccaaagcacttaaagtcgatgattcatctgatgatgaattagaagaagggtgcaagtag

SEQ ID NO: 75430 - DNA, 729 bp, Glycine max
  Peptide Sequence Number=SeqID_167115
atgggctacgtgggagtacgtgagctcagttggaggtgggcaacaggggatggtgggtttatgcgtgcattgtggatggtgaaacttcctgcttttattgttgaccacagagtggtacctggagatatgtcgcgagggtcaggagaccttggggacgtcaggcgagctcctggcagtcaacagataaaaggaacaaagaccacaaagcaaggaggcttgtggcttgaaaacgaggtcaggaagctaaggaagcctctggtaatcgattaccaagggaggaatgaggcactgatcgtgatggcggcgcagctaatccgtgatcgagtagagatggagtgcctagagggagcttgggagaccctcgaaggcaacacgagttgccgatttcggggcaccattcgactcacggctacttctttggtgcatccagatgaacctgcacggacgcttcagcgcactgtggagtggatactacccacgcctacaccatatcgtctagtggagcccgttcaagtgatcgaggtaacgtcatccgaggaagaccctgaggaggatctggaggagctacctcctgagcctgctgtggatgcccttgactttctagagggtgatgaggatccacttcttgaggtggattctcccgaggaagtcatgtcggcatctgaagcagactctacggaggatagtggcccgagggagatggcggtcagcggaggctcttcatcctag

SEQ ID NO: 75431 - DNA, 591 bp, Glycine max
  Peptide Sequence Number=SeqID_167116
atgtggtatggaacactcatcatcaatttcgtcaagccacatggagctatggtattggatgatctagccacaaagatgacatggattgtgaatggcagcaggatcaaacactacttgggtgcagaaacaaggagttttcgtcccaggagactcgcctgggcgaatatatcaggtaaaaataacctgcgaaattcacccaacctcgctaaggactggcctaggccaatcaatgaaatttacttaaactcacttgggctagtgaagagttgcttggtttggatacaactagctgaacaattgcctaaaaatgaccataaagttattttggaattttacgcgaatgcttggcctactaaggagggagttcttgaccagcattctaaagtgtggggccaatggatcccctatccaatgatgttggaggaaggacaacaatgcaaatatacttcaaggagagaaagggctataggttttgatcaagaagctataggccatctgctttgcttccgaggttgtgacttcgttcttagaatgatgcaaaaacggttgtggatcatgagaacacatatgaccataatcactcaaatctag

SEQ ID NO: 75432 - DNA, 300 bp, Glycine max
  Peptide Sequence Number=SeqID_167117
atggataaggcaacaccatctattccccgacccgctccaaccatagagcatattaagcaagataactccggaaaggtagagataaccttcaataggagaaattctttttcatcaaggatagaagcctctaggtttgaatatgagtcagccagaaggtctttttcagttagaacctgttcaatcccagtaggactaaccagatatgagtcacataaccagttccctactatgactaggtggattgctttaagaaaccttgtgctagaagatgtcagaacacaatgctctgataggatgtga

SEQ ID NO: 75433 - DNA, 138 bp, Glycine max
  Peptide Sequence Number=SeqID_167118
atggaagcagcagacctttccataagagtgagagggcagctagttgtagggctacgtgcaggagtgcaggttaacgtggtagggatgcaggaattgccattggtgcaggcgagatgcaggaagaactcgccagtttga

SEQ ID NO: 75434 - DNA, 249 bp, Glycine max
  Peptide Sequence Number=SeqID_167119
atggaaaaagacactaaagttgtgatttttatctacaaaagcttcgatttttatctcaaacaggtgatgacaaaaagctcaaaggttcatgataacaaagatgatgatttcaagaatcaagaatcaagattcaaggttcaagcttccaagaatcaagatcaagattcaagattcaagattaaagaatcaagaagagacttaatcaagataagtatgaaaaagttttttcaaaaactgagtagcacatga

SEQ ID NO: 75435 - DNA, 294 bp, Glycine max
  Peptide Sequence Number=SeqID_167120
atggccatcttatactctatcactgagatcattccaaccctagaaatcactaccataaacattgacaatgaaccctccatccatgttgaacactttttcgacatacaagaacttgaaaaagtgggtctgaagctcaataagacactacttttctatggtgcaaggcatttcttcaatgagccacaaataatatacccagaacttatcagaaccttttggaggaatgttgagtttgtaaacaaaaaagaagatagcatccaaagttctgggaatcaaggtagtattgtcaagtga

SEQ ID NO: 75436 - DNA, 603 bp, Glycine max
  Peptide Sequence Number=SeqID_167121
ggtacatcctttgtggtacaagtagagggtacatctacttgggttgttgtgactgagaacaagagagggtacatctcttgtagatcagttcaagtggagggtacatccacttggttgttcaaagagaacaagggagggtacatcctttgtggatctttgcttgtaaaggattttacaaggttgaaaagaaatctcaaggaccacaggacgcttggggactggatgcagactcttcaagcacgaagtagttgcactgcatcaaaagagggagctttcaagcaaggattggcaagctctataaagcaagattttgctactgtgtctgagcgtagtttctcctttattgttgagcttccaaactccatgttcactttcattcatcaagtccaacccattatagaaaaagtgaattctgatgatgaggaacctgttgttgctgctaaagatttggccatggaattctatgatggccctcctccatccttggaatataagttttctaaaacaccaatggacagttcctctgatgatgaatctagagatgatttctttcacaagattgaaaacgaagaagaagctgccaaacaaaagagggagaagtaa

SEQ ID NO: 75437 - DNA, 279 bp, Glycine max
  Peptide Sequence Number=SeqID_167122
atggccaagttagaacctccagaaggatgcagcttccttgatggtcttgaggttcatgttgcatttggaagtgttgatgcagctcttgatttgagccacacacaaaacatagggagaatgacaaaggctcacttcccacactcagagtttattgtggtttccttgaaggaaggcatgttcaataacaccaatgttcttttccggacaaaatttgtggatgtgtttgcttcatcgatctgttacaagtcttacacttatgttcatcttcagggcaagtag

SEQ ID NO: 75438 - DNA, 843 bp, Glycine max
  Peptide Sequence Number=SeqID_167123
atgggtgatgtagaagaggtacaagaacagatgaaggccgatatggtggccttgaaagatcaagtggctttcatgatggaagccatgttaagcatgaaaagactgatagaaagtaacatggccacggctactgccgccagcgccaccgccgaggcagatcctactcatccgtctgccacgaatcaagcacatcaacccgcctcggacatgatgggacaaggcagagaggtgttggggagcaccggcggcccgcacatgggatataatagaaatgcttatccctacagcttaccccccaattatacgtcgcccaccatgcacaagaacattgatcatgctattctcgttacccttgagggtcagcaaccccagcctatggtagaaggagagatgatcataatgatagtagacacgctgtcggtgttctactatgaaaatttggtaggctacatgccctctagcttcgtagatctagtatttgtagctcccgcttggtcgaaaccccagcaaacccctcacgatacttaccagtatgctcaacatcatccgagcttttcggcccgcgctagaaacccctccaactcggctcccgcccagcaaaggacagttgttcagccacaaagggctccagctcacagcttagatccaactcaacctcaccccaccgacggttccaatcctagcctaagtgccaatccggggaggaaccctctagtgaagaagcttccagagtttgccccaattccaatgtcgtacggggacttgttgccatctttgatcgccaaccaaatggcagtggtgacccttgaaaggatttaccagtctcctttccctcagtggtaa

SEQ ID NO: 75439 - DNA, 594 bp, Glycine max
  Peptide Sequence Number=SeqID_167124
atggggggagaaggttgcaacacagctcgcccagggtatgacacttatcaacaaggaccaaagcattacaatagcatagtcattcctccttttaacaacaagctttggaagttgaagccagcactgctcagtctgattggctcacaccctttcattggaatggatcatcaggattcatacacgcatttgtctaccttcttggagttgtgtagtaccatgggagcttttggcaaaaatgctaaagttgtctacctcaaagctttcccattctccttggcaggtggtagaaaacatcattgcaaggttctttcctctatccagattcatcaggatccattgctactttttcccaaggatctgatgaacctctctgtgaaacatgggagagattcaagtctttgttgcagagttggagatactatgatgtctaagagcccagaggaagcaattgtaatcattgaatcattgcagccaatgattatcagagtcgccatgatagggcttcgattcaaagaaaaggccaacttcctcaacaatttcaacaaggtggatcacaaaaaacacaccaagctcatcaagttcaaaaagttctaa

SEQ ID NO: 75440 - DNA, 324 bp, Glycine max
  Peptide Sequence Number=SeqID_167125
atgaccagaaggcttcttgctggttcattggcttttgaaagccgcatccttcattatctcattgtgcgtatcttgcttccaagatcttcaaaccttgcccagagatccttcttaattggtgccgctgtgattgcatcttttggttaccgtaaagagcatgatggctcttgggtgaaaaaaggtgcacaacccattgatgaagaaggacacttaccagttggagaagattccactcttcttcaaaagattttggacaggtttgatggtcttcaaacctttgttggtgaaaggtttgatgctctggagttacaagtagacatgtga

SEQ ID NO: 75441 - DNA, 342 bp, Glycine max
  Peptide Sequence Number=SeqID_167126
atgaatttcaaggacgagaaatgtgacatcctagaatttctacccagaattttctccaaaattcctcttcatttcaatcccaaattgcaaggaaaagccattttcggagtcttggagcctccctctacttcgtggggatttaaatttcagatttctgtattaggaacctctagtaaaattctcaaggcgatccaatggttaatgaatcagaacgaagagaatgttactggggcatgggttgatgggggacccagtgctgagaggaacgaggataagggctacgtaggagtgcgtgagctcaatttaaaggtgggcaactggggatggtgtgcttatgcctga

SEQ ID NO: 75442 - DNA, 291 bp, Glycine max
  Peptide Sequence Number=SeqID_167127
atgcgtgctagagctagagtaatgagtgaagtagaggaagttcaggaacagatgaaggttgacatagaggccatgaaagaccaaatggctgccatgatggaggccatattgagcatgaagaagataatggaggtcaatgtggctgcagttgtcgctaccaacgtcgttgctgaggtggacccgactcccccatctggcctcaaccaaataaatcatccaacctcagacatggtaggtccgagaggcaaagagttaggaagtacaaacgacccccattttgtgcgagtttag

SEQ ID NO: 75443 - DNA, 222 bp, Glycine max
  Peptide Sequence Number=SeqID_167128
atgtctcctccacctctaggacctcacaatcactcacaaactcatctcaagctcttaggacggcttcctcttcaagctcggttctctgcaggtcttcacacaacaaaatctctcaaactctctggaacttggacctttctctctctagaactatctagacatgcaaaagcttcaagaaaaggccaaaactcctttccaaaatccgattttaggcttgaatag

SEQ ID NO: 75444 - DNA, 156 bp, Glycine max
  Peptide Sequence Number=SeqID_167129
atgcattcgtgttttcttctgcatcttcacgcatcgtctgctactaacagcaatccaaacgaactcgctaagcgtgcctatcgtgctaagcaagttcatcttttgaggatgaacactcatcctcttgctgaaatacctgtggctaagcgaggctga

SEQ ID NO: 75445 - DNA, 246 bp, Glycine max
  Peptide Sequence Number=SeqID_167130
atgcagaacttgcagcatattgggactgcactccatttgccgattataacaccaaaggacttccttcagagggtggcatggcctggagactggccagaggcagagcctactattattgttgctactgctgagactgctaaggctgagcctactgctgctaccactactgagatggaccatatacctgctaatactgtagagcccaaacttaatgaggactatattgttgatgtctcaggggattag

SEQ ID NO: 75446 - DNA, 207 bp, Glycine max
  Peptide Sequence Number=SeqID_167131
acttatcaaggtaatccttgtggcgtctacccagacttatcttccttcactggaagtggcgtctacccagacttatcttccttcaccggaagtggcgtctaccctgacttatcttccttcaccggaagtggcgtcatccaaaagctctacagcctatatcaagcaatccgccccgtaagattcacatcaaatccaacccaaaattaa

SEQ ID NO: 75447 - DNA, 669 bp, Glycine max
  Peptide Sequence Number=SeqID_167132
atgggtcccaaaaagctcccagccaagcgggccaggaaaaacaccgctggaaagggttccattggggccccccaggcagaagtggacttcgataggcacagggacgaagagtttgctgagttccaaaaggagatagcctggaggcattgggctccgctcgtatcacccatggctaatggattccctttaacagagatgccatcagccagaggctatcgaccagttggtgtacgtgccgaggcaggactttgcccggattgtagtggggagacaggggttacgcctttgagacacccagtggacccagagaagtccaacagggccctgggatttcctgctctgattacaggcctcaatcaattctatggagtgcaggcaggcacagggccaggcaccacagtagccacaagaggaatagcagcaggcagctgtagacgtatcaccaccacctttacggcaaccgccatctctagagtccatctctgctcacatgtagaggatcccaacccttatgtgtggcctactcctgagcagttcggagccacaatggcatggcctggagatatgcccgattttcagacagaggcagggcccaccaggacctccagggatggagacggagctcaggaagatgatgacatggtcgatgtgatggacttcttcctttga

SEQ ID NO: 75448 - DNA, 513 bp, Glycine max
  Peptide Sequence Number=SeqID_167133
atgaagaaggaaaaggtgggaccaaagcaagaagacacatggaaaatgaggaaggagagagataatacacgtcttaaggagctttctgtgagcatctccaagttgctcgagatgttagaagctgataggaaagagaaaaaagctggattcaaaactctagaggctacgatggactcattgctgaaaccaaacaacaactctggcgctaatatgcatatgaatgtagcgggaaacaacttcattggaggttcgccatctactccaccgtttcagactaatcaccaactacactactacgttgtgtatctcaggccaagctatttgaggagaaatacttacccaagcacaagccaattcaaaatccctaccaaaaccgtaactaaaccagctgaaatgcagatccgaagggagaaagggctatgctatacatgtgatgagaagttcacttcttctcataagtgtcctaaccggcaatacctactattgcaaatggacgaggatgaaaaatgctga

SEQ ID NO: 75449 - DNA, 69 bp, Glycine max
  Peptide Sequence Number=SeqID_167134
atggattacaataatgaagcaagcaatggtatcaagttcaggatgcttggatactttacaattgggtaa

SEQ ID NO: 75450 - DNA, 528 bp, Glycine max
  Peptide Sequence Number=SeqID_167135
atgaaatgtgctgccattggcaatggcctattcacccaaaccaccccagaagttcatagaattgttccagagaatgaccacaacttgccaatagttaaaattgtgtatgaggaccttcaggctcagtaccaatcatccctcactgctgcagtgatagctttcaatagcaaaaggaagcatgcttcctatgtggttcttggttacttggttgaggagcttcgggacatggtgatgtacaagaccttctgcaaggacttggaggatgccaacatcttcattgggtccttgatttttgtggaggagcttgccctcaagataaaggctgcaatggagaaagaaagggaaaggcttgatgcagttttggtgtttccatcaatggatgaagtgatgagactcaacaagttgggttccttcagtatgtcacagcttcgacagtcaaacaacccctttttccacctcatcatccatttctatgtgaagcagcagtattctatgtggtctttcatatcttcgttgtatgcccactaa

SEQ ID NO: 75451 - DNA, 162 bp, Glycine max
  Peptide Sequence Number=SeqID_167136
atggcaagtggccaggaatacaaaagatggaaaatgagtgttaatgtcttgagagataactgtgaatccttgattcaagatttcttcaagatcaagccttgcctcacaatgaaaggtttcaattcattcaaggcacatgtaatcgattaccaatacatgtaa

SEQ ID NO: 75452 - DNA, 228 bp, Glycine max
  Peptide Sequence Number=SeqID_167137
atgtcacagaacttcacaaatttcctaacggatgggtgccaaggttttgctccttttgcatgccctactctagagcagtttggggctgaggtcgcatggcccagagactggctcgaggcccaggtaggggaggagcctgcagaatcccccggtgagacagaggaggcccgtatggatgaagatattactgacttgctcggtttcttgggaggaagcggagccacgtga

SEQ ID NO: 75453 - DNA, 219 bp, Glycine max
  Peptide Sequence Number=SeqID_167138
atggcaggacacatcctcatgttaggtgtcacaacgtgcccttcgcgggcgatcgaggcgaggctcacgggtgcgctttccaaaggaggaaagatgcgcggagtcgccaccaacgtttatttgtggaaaacgtcgggaaaaccgaaggaaaccggtcgacaaaagcggggcttttgctcctacgtaccctccatcgaagaggaaatcagacctacgtag

SEQ ID NO: 75454 - DNA, 225 bp, Glycine max
  Peptide Sequence Number=SeqID_167139
atgtgggacttcaccttacacttgtactctaacaatttccatggttaccccaccactttcactcttgaagaaataaaaaagagaaaagatgttcaagatagaatcaagaacatttcaagattcaagaagaaagttgatttcaagaatcaagattcaaggatcaagtttccaagaatcaagatcaagattcaagactcaagattcaagaatcaagagaagacttaa

SEQ ID NO: 75455 - DNA, 195 bp, Glycine max
  Peptide Sequence Number=SeqID_167140
atgggtgatattgattaccgaaggaagcgagaaggaagtgatgaaatgagaaagggaaacggaggagaaggagagaagcgagcaagggagcaccaacggggcaagaaaagggcgacgtttctagtggctagcctgaacattgcggtgaatggaactgtcaaatggagagagagaaatttaaaaattaaaacttaa

SEQ ID NO: 75456 - DNA, 1419 bp, Glycine max
  Peptide Sequence Number=SeqID_167141
atgttagaaaaccaacaatctcaattaccaacatgcaaactggagggagagaacagatatcacctctacttcactaggttccccgacgatacaacagagaaggagctttggacccagttcaaaaaatggggggatgtgagggagatcttcatctccgaacagagaaataaaggaggcaggaggtatggttttgtgagattcaaaggagtgtccgacgagcgtagactggaaagacagctagataatatcatcgttgggggtcttaagctgtatgtgaacatcacaaaatatgggagaggaaaggcgaggcatgaacaagctatagtcaaacccaagaggcaggtggagggcgaaaacgaaggaatgacagtagctcaacaaatggcaccccataacatggtacctacaatgtcatatgcggaggcggtggctacacgcatagagaacacaggacaacgaaggaacacaacgatctccctagccaggtatgggggatcacactcatcggtccaactcaagatcctggcgggggagaaaaaatggtacaccgacgcatgggtgggaaggttgaagaaacaagagattttcgaaagagtcgacgacgaaatcccatggatcttaggttcgaacgtggtgcctaagtacctaggagactacatggtcctccttcttaggctcttagatatcaaagcagaggagatgagcaatgaagaaaacaaccatggctcgtccctgttttactcgttagagaaatggaatccggcgatgaaaccgggaaacaggctggtctggattcaatgttggggcatcccaatagttgcatgggacattgggcacatttgcaaaatcgtggcagcaatgggagatttggtggaagtcgatgacgatgtagaagaattgcggaggctggacagggcaagggttctcatcaggaccccatggagaccaacaatccaacattcgatagatgttcacatcgacggggagatccacacagttcacattgtggaagaaaactcaagcgcagaaggtaagtgcactcaccagtgccgaagcaccccggggtcgtcggaagaaattgtttccgacgacagcgacaccggcacaccattgttgaggttgatcaacttttcgccaagaacaattgctagcgaacccaacaacgggatcattatcaacgagaacttgtcattacccagcggttatcgagacaatgtggacccaatgggtaaagaccgcggcaacttggcacactgccccatccatgtgacgtgtgaggcagaaatcgaaatggggaaagaagctgagcttgaatcaaggccattgtcagagacatctgcatgtagcggcgaaaaggaaacctacaatgtacaaacaaaagccaagcatggggacaaagggaaaaaagctatgaggtag

SEQ ID NO: 75457 - DNA, 987 bp, Glycine max
  Peptide Sequence Number=SeqID_167142
atggatctcatacaagaaatattgttggacatgaggcaaatcaaggaattacttcttgaattcaagaaaggaaagacgccttcagatggtggggaatactcgatcaacaatgacaagaagccggaaggggagaatagtgacaataacgggcttgagttcgaaaaagaggacaaacaacccatgcagacagtactgtctttgcaattgggtgtgtgggtaacaaagtcacagcaagaatatgattcagcaaaagcccttgagggttcttccaatgagagaattggcacccactgtggggagcagcttggtgtcaaagacaaagacttgaaaaccattgatgttgaggtagtgaaggagatcagggtggaagaggctgtgaatttgcagcaaaaaatgcaagaacaagaagggttttctcaattatcatcaaagaatctcaatcttggactgattgcacctacaccagcaccaaacccgccggatgcaagctcacatatgacccttaatgggttgtcatcagcagagctacatcttctcaatgagagaaatccaaagctagacgctactcatttggaaaaggccaaagaactttataccagagttctgattcagcattgttctaatttatatgttaccaatggtaatgaggtagtcttagtggaaaacgaccattttgatgtgcaaaggagatcgttacacaggttcaagaagctgccagtggtagtgtttatgtctagatgcctgatgtttgatgcaggggttgcaatgcaaaagttttcagcatcgacactaaaaaaggcaaaaaggactgcagacgaggtgagagcaactgttgctgagctgcaaaatgtcgttcgtgtatttagtgaattgtttgctgcttccaacctacatactcatgtgtttgatgagaagaaaattgacactcatgttggatacagcaatcacttactttcggctactaaagttcatcttgaaacagcttag

SEQ ID NO: 75458 - DNA, 1341 bp, Glycine max
  Peptide Sequence Number=SeqID_167143
atggtgctttgcaaattgacaaatattacaataaaaagtctcacctacacttttgtaaacaatgaagggagaagaaggagatgggtctttcccacacttgtagaatcccatgggtttgaggatgtgaagtcattgaacaaaatccatgggatgaagatagttggtttattaccttattggctccacgtagcagaaggtgttgtgcgtaacgatgttgatatgcaatcattatttcttttgacaggaccaaatggtggtgggaaatcaagtttactgcggtcaatttgtgctgctgcactacttggaatttgtggactcatggttcctgccgaatcagcccatattccttattttgactccatcatgctacatatgaattcatatgatagtccagccgataaaaagagttcctttcaggtggaaatgtcagaacttcgatccatcattggtggaaccaccaaaaagagccttgtacttattgatgaaatttgtcgaggaacagaaacagccaagggcacttgtattgctggtagtatcattgaaactcttgatagaattgggtgtttgggtatcgtatccactcacttacatggaatatttactttacccctaaacataaacaacactgtgcacaaagcaatgggcacaacatccattgatggacaaacaattcctacctggaagctaacggatggagtttgtagagaaagtcttgcttttgaaactgccaggagagaaggagttcctgagcttattatcagaagagctgaatatatttatcagtcagtttatgctaaggaaaaggaactgctttctgcagaaaaatcctcaaatgaaaaaaagtattctacttatatcaatgtcagtaatttgaatggaacacatcttccttcaaagaggttcttatcaggagctaatcaaacggaagttttacgcgaggaagttgagagtgctgtcactgtgatatgccaggaccacataatggaacaaaaaagcaaaaacattgcattagagcttactgggataaaatgtctccaaatcaggacaagggagcagccacctccgtcagttgtaggttcttcaagtgtctatgtgatgttcagaccagataaaaaactctatgttggagagactgatgatcttgagggtcgtgtccgagcacatcgattgaaggaaggaatgcatgatgcatcgtttctttattttcttgtccctggaaaaagcttggcatgccaattagaatctttgctcatcaaccagctttctagtcgaggcttccaactgaccaatacagctgatggtaaacataggaattttggcacttccaacctgtatgcataa

SEQ ID NO: 75459 - DNA, 207 bp, Glycine max
  Peptide Sequence Number=SeqID_167144
atggatcttgagtgcaagaacccactcaaattgtcatacactgaagaagggagaccagtcagggtcacgctattttacgagaatactccaatcatatgggatcaacataggcttaaaggagcactcaaaccgggtgtatttatccccaaggcctacactccgaagagtccgccagggcctctccctcctgattcaggtccaacctag

SEQ ID NO: 75460 - DNA, 306 bp, Glycine max
  Peptide Sequence Number=SeqID_167145
atgtcagctagcatgcatcaatcagactttgcaccttatgtttcaaggtcatacaatggtcaatggaatgcctcagaactcccccatgataagcacatgtcatattcgagttgtatcctcgaggaaatggagattgaggaatctttgttgggcttatggctaccattgcattatcgagcagatatgagagggtggtgtttggtcttggatgttcagcaggtggattttgtggctgatttaggggtggcctttgtggatgattgggcattcttggttggtagtgtggggagtaatgggaaggactga

SEQ ID NO: 75461 - DNA, 624 bp, Glycine max
  Peptide Sequence Number=SeqID_167146
atgtggagctctattatgttgaaattcgggcaacttgcttcaatgttgtggctgatcagttctacaatgttattgaagctagtaaggactatagccactagtcagctatatgtggaggctgattttcctgaggtttgtacactaaaaagattgtttgaaaatgaagggaagagtgtcccaactctttctatttccagagaaatgtctaatctaggtaagactgatgtgcggaagactatatctcaaattaaagatgagaagttagggactttagagaagcctgattggatatctgtctttgtagctgtttcacacattaaggttgataacttctgttacctcgggtgccctctcaagataagggatagacaatgtaacaaaaaagttactaataacgcagatgggacatggcattgtgaaagatgtaaggtctataagggtaccatgacaaataatctgaatgttgcaatcaagcatataatcaatgatgatggaaatgtggacacttttgtcagacaaattacaagcttatctcatggcagacaccctaatatcagcagttgcaaacaatcacagtttacttggtgccaacttaaagtggaattaaacaaggaatatacttaa

SEQ ID NO: 75462 - DNA, 2571 bp, Glycine max
  Peptide Sequence Number=SeqID_167147
atgagagcaggagtttgcagcatacagctacaggctctgacaccagaggctgcaaccctagttaaacaagctgttactcttgccacaagaagaggtcatgctcaagtgacccctcttcacattgccactgtcatgcttgctacttccacaggccttctccgcaaagttttccttcaatgccactctcaccctctccaatacaaggcactagaactttgcttcaatgtttccctcaaccgtttgccagcacccacaccaagccctcttctgagtcctccatattccaccactccctcactttccaatgccttggttgcagccttcaagcgtgctcaggctcaccaacgccgcggttcgattgagaaccagcagcaacccattctggccttgaagattgagatggagcagctcatagtctctatccttgatgaccctagcattagtagggtcatgagagaagctggtttctctagtgcccttgttaaaacaagggttgaacaagctgtttcaatggaagtttgttcacagcaccaagcttccaaggaaaacaccaccaccaagcttcaagttcttggtggtagcagcagcatgtccccatctagatcttttggtcaatttggggcatcattcaagtctatagaccatgttggtgatcatgtagatgatgtaactagtgttttgagtgaacttgtgagcaagaggagaaacacagtcattgttggggagagtcttgctagtgctgagggagtagctaggggagtgatggaaaggttagagacagggagtgttcaaggagagttgaggtttgtgcaatttgtgagtcttcctcttgtctcctttaggaacattagcaaggaggaggttgaaaggaagcttgtggagcttagaaacctagtaaaaagtcatgtggggagagggttaattctatacttgggtgatctgaaatggttgtttgagttctggtctagttattgtgagcaaagaacaaactattactgttctgtggagcatatggtgatggagcttaaaaaattgattagtggaaatagggagaatagtaggttgtggcttatggggatagcaacttttagaacatacattaagggcaaagcatgtcacccctcccttgaaactatttgggatcttcacccctttacagttccagttggtagcttgagccttgctttaaattttgatagtgattttcatgttcaggagagaagcaaggtaacattcaaggacgaatcttttgaagaacgagccaaagtgcgcaagtatctaacttgctgcagagattgctcattgaattttgaaaaagaagctaaaagcattgctagtagttttactataagcaagagagattgcaccactagcttgccaacatggctcaaaaattgcaaggcagagagaagtcgcatgatggaggatcaggaaaatgctaagctttgggatatttgcaagaaatggaactcattttgcagttcagcacatggatttccgtccaatcttgagaaaccatttttgttcatttcatcctctccttcatcccctacttcagtctcttcacatgaaagaaagcctagtttaaatctgagccacctaaactggccagtcatttctgaacgaaaagaagtacctaaagaatgtgagttatacactgagactactgttagaaatgattcctatgaaggaaacttgataatgttcatgccagagaggaaccatcctaagccagaccttttatcaaatccaaattctagccccaattccgcttcttcaagtgaggcagtggaaggtttggacagcactcaaatgttcaaggaccataatgatgaaaatctgaagattctatgtgatgcattggagaaaaaggctccacaacagaaaaaaacagtgaaggagattgcaagcactgtgcttctttgcaggtcaggaatgagaaaagtagggaatcacttagtgaagagagatgataggcaagaaacttggtttttctttctaggtgtggattctcaagcaaaagaaatggtctcaaaagagctagctaaagtaatttttggctcttatagtaactttgtctccattggtttaagctgtttctctttaactcatgaggagtccaaaaataaaagggcaagagatgagtttggtggcagttatcttcagagatttggggaagcactgaatgagaatcctcatagggtgttctttatggaagatttggagcaagttgatcacttttctaaaaagggtgttaagcaaggaattgaaagtggagctataacccttcctggtggtgaatctgtgcctctcaaggatgcaattgtcattttcagtagtgaatgcttcagttcagtactgtcaagagcttgttctcctgcaagaactacttctccattttcagatgaagacatgaaagagaatattaacaactcagaggagaaaatttcatgcctctctttggatctgaacatggccattgaagttgatgtgcaaaaaaatgtgcatttagatggagaaactgatgagatcctagagttagttgataagaaaattaattttaaaatatga

SEQ ID NO: 75463 - DNA, 426 bp, Glycine max
  Peptide Sequence Number=SeqID_167148
atgtcaccccatcctccattgattcttcagtccctctctattcagggcctcatctcatcaagtggtggtggtggtggtagtactgctagtggcgatgcagggagtagtggtgcttcaagagcaattgttaaagacaggtttaagacattcaatactatgtttgaggaacttcatcagaaacaatctcagtggacagtaccagacacagagttgcgtgagtctcttattcttgcagttgctgaagtcttgctgcctgcctacagatcatttgtgaaacgttttgggccactagtggagaatgtaaagagtactcagaggtacgtcaaatacactgctgaagatctagagcgaatcttagggattggtgccccatcaaacatggtgaggtcaaaggtcataaagttcaaagtaaaggagaggggatag

SEQ ID NO: 75464 - DNA, 687 bp, Glycine max
  Peptide Sequence Number=SeqID_167149
atggcttcagactctcagaaaactgatggtcctgccttctctatctctggaacaccaacaatcacttcagaaaaattgaatggaaaaaattatttagcatggtcagcctctattgaactttggtttcttgaccaaggttatcatgaacatctagagcaatcctcagaaaagatttcagaagacaaacgcgagcagtggaagaaatttgattatcaactttgtgctctcttgtggcagtctgttgagccaactatattgacaaatttcagagccttcaaaacttgttattctttttggaaaaagacacaaagtgtttttgctaatgacattcaacaattgtatgatgctgctcagaaattgaccactcttaaacaaactgatcatgacatggttgtctatgctttgaaagcccaatctgtagtggaggagttaaaattatcattggaagccgataaacttgaagacataaagacggaacttgataatctatatatggtgttggaggaaattcagttgatagtattgaaacttctaccagggtatctaatcgagggggacgaggtggtcgtggaaaccgaggaggacgagctggaagaggaggttgccttcaatgttcttactgtaagagagtgggtcacacacaagacacttgttattctattcacggattccccggaaaatcggtga

SEQ ID NO: 75465 - DNA, 1494 bp, Glycine max
  Peptide Sequence Number=SeqID_167150
atgcacgtcaacaccccaaagtttgaaagagcacaggttagaaagacactttcagcagccaaaagacgagaatgtgttgagcaaattgttatggagacaaacagtggaagacaacaaggagcgggaatgaagcaaggatcgtacgcggaggttgtgatgaggaacgttccaagaccacaccagaggagaacatcagccactgacgatcacaacactcacagatcacgttcatcggtgtatctagacatttcactaacagggcaaaaatggcttaatgaggcatgggtggggaggctgaaaaatccagctttgtttgatagggtcaaagacgatctcctctgggatatcggaaccaacatatcgccgaaatacatcggggacgatatggttctgcttctcggcctcaccaatgacaaagcaaagcgaatgattgacgtggaaagtgaaggaggggattcgttgttctattcactagagaagtggaacctgcggatgcgtacgggaactccaaaaactggacaaggcccgagtcctaatcaaaacaccgtggacgccgatagaagaacacactgtcgacgtacacatccaagggaagaaatctactcagaggatagtgatgctggaacgcctcggagcgtaacgaacttgagaatggagaaggagcatgaggtgcagtccatgacagcgtcgggagtcaccatagcggcgacaatggagaaggagcatgaggtgcagttcatggcggtgccgagagccaccatagcggcgacaatggagaaggagcatgaggtgcagttcaaggcggtgccgggagccaccatagcggcgttaatattcagccaaacatcaccatcggaagtaacgtcgtcgggaacatcgcacctcagcgttgcaactccaacggctatcgccggggctggaaacactacttttggcacggtcacacatgaccaccactgtgccatggctaatgaaggggaagcgcagaaaaaagtgaacatgagacctgccgacagtacaacaaagttgcctgaaataggaagctatgacgtggacaagagctttatgcctttgggaaggcagattttaaataatccccagtcacgcccaaatagcgcatgcagagagtacgttaggaaaagatggtgcacaaagcaagatgacccaagttgtctagcttgtccactccctcacacagctacggaattaataactcccccacaacagcaacaaccacgcatcaatgacaatcaaacaaaaaagcaagaacaagccactaaatgtctcgaaaacaaaacagcacaagcagtagcggtggaagctgatttagtcaacaatcagactcaagaggcagaagttttatggaaaatggcacaagagttgggtgtcactagcgggccaatacaaaagagctttgtggagaaaataatggagatggaggaaagagacaacaaagaggcagagaggttgggaaataggagtgtgaccccatga

SEQ ID NO: 75466 - DNA, 435 bp, Glycine max
  Peptide Sequence Number=SeqID_167151
atggaaccagcaatagatacccgttctaaagtattggaagaaagcctgcaaaagcttggagttgaaaaactaagcaaagatgatgttcaaaagctacaatgggaggttttggaagccaaaattggaaactggattcatttcatgcgtattgctgtcaaattgttgtttgctgcggaacggaaagtttgtgatcagatatttgaaggatttgactcacttggtgatcagtgtttcgctgaagtaactacaaacagtattttcatgctacttagttttggagaagcaattgctaaaagcaagagatcacctgaaaagttatttgtacttttggacatgtacgaaatattgcaagagatacattcagagttatataaaatccaaacaccaaggcaacaacagacattagttctaaatttcatgttacaggggaagtga

SEQ ID NO: 75467 - DNA, 612 bp, Glycine max
  Peptide Sequence Number=SeqID_167152
atgggaatggcggtggcgagtgacgatttgctgagcaagaaagctgcggcgatgagagcgtctctggagagaagccaagccatcacagacgacgtcgtctcgattctcggctccttcgatcaccgcctctccgccctcgaagccgccatgcgccccacccagatcagaacacattctattcggaaagcccatgagaatattgataggactttgaagtctgcagaggccatattggctcactttgatcaatattatcaggcagaagcaaaaatagttaaaggaccacatgaagatgtgaagaactatcttgaagcaattgatcagctgagaagaaacattagattttttggtaataagaagggttttaagaatgatgatgatgttgtcatccgtgccaacaatttgataagcgaagctatttctaagctagaagatgaatttaagcggctattatcatcttacagccgctactctgtttgcgttgtcgacagacaaggctcaacaaccttcactatctctggcgacgtcttcttcagcctccgtcttgccgtcgctgacctttcacgcatctattgtgttgtcttcctcttccataggggcggtgcatgctaa

SEQ ID NO: 75468 - DNA, 243 bp, Glycine max
  Peptide Sequence Number=SeqID_167153
atgcccatatggttggaaatagctccgtgcaatggtgaggatgaagttgttgttgctggcgtcgacggaggagtccccgaagacgaccaccgcagaaatcttgatttctcatatggaaaacatcaagaaatccagccactggggtcaagaaatccattaaaaaaattgaaggaagaaactaaaacaataaatggaaaagaggagaagattgaggaagagaaagacagagaaagagaagattga

SEQ ID NO: 75469 - DNA, 444 bp, Glycine max
  Peptide Sequence Number=SeqID_167154
atggcggaaggtggtgatggtggtggtaaatatcatcaactggacggatctcggcacctattactggacgcgatgactacacaaatgcaacatttgttgaactgtaacaatgaagagctctacagactaatagaaggactagagcaccaaatgaatccaaatgctgggagaccttatggtgggaacagaagggccaatgatggaccaaaccgaatggatggacataataaaattgagggagtaaaactcaatgtaccccttttcaaaggaataagtaacccagacgcctaccttgactgggaaatgaagattcaacatagagatgatgagagaagagagacgggagatagatacatgactgagatgagaagggttatgcgaaagaggtatgttccaactagctacaacagaaccatgcgacagaaactccagaggctgtcctag

SEQ ID NO: 75470 - DNA, 355 bp, Glycine max
  Peptide Sequence Number=SeqID_167155
atgactaggggcaatccaggtgatttacaaccctttgatcctgaaatagttagaacctttcatagattagttaggcatagtgtgcatcctgatcattctgtgctttttgagcattgtgagcattttgagtattccgttgctggtgattttgaatattctgattttgagcattcaactactaattttcatactgagaacatggctcaacctccacctcgtgagaggactcttagggagatggctgcacctgatttcacttatgaaagcttatgcattcaatatcctgatgagggtgttccatatgttctcaagattggactaatacatttgctgcccaagtttcatgctcttgcag

SEQ ID NO: 75471 - DNA, 216 bp, Glycine max
  Peptide Sequence Number=SeqID_167156
atgaggacccttaatggtgattttccaccatggagatgcagcggaagacaaaggagaagaggtatgaggaggcgccatccactagggaataagccatggaagaaggagcttcaccacaaagatgagccttggataagaagcttggagaggatgcttcaatggaggaaaagaaaaagggagagaaagagagagaggggggggggagcacaaaattga

SEQ ID NO: 75472 - DNA, 393 bp, Glycine max
  Peptide Sequence Number=SeqID_167157
atgttggtggcgactccgcgcatctttcctcctttggaaagcgcacccgtgagcctcgccttcgctcgcccgcaaaagggcacggagtggttcactacatataggtcaaacaattttggaagtgcctatttgagtgatgacaaagcttgtgttattgttggattgagacagaagcaaattgctacaaatgatggtggagtgataacattgtgtgatgctcaagagatccctaagttgaggaagaatttaatctcttcttggtactttgtaggccaatggtttttaatagagattaggatactcttagaatctatgtgtgtgttgactgtgatgatagcacaaaaaactattggcaatatttacagactgttggggaggatagttgtaggctga

SEQ ID NO: 75473 - DNA, 672 bp, Glycine max
  Peptide Sequence Number=SeqID_167158
atggcatcctttcttcaagaacttctaattggatttccattcacctcagcagcatacgtgggtgagaaatcaaagaggtacctgccagatcctgccacccaatacaacacatctaccacaagctcagagcaaggtagagtaaattcagttcttaccgggatgaacaggcttgggagaaagactaacaacttggcaactgggctcaaagaacatgtaaaacttggaccaaaaataactgatacagtaaaaggaaaattaagcttaggagcaagaattcttcaagttggaggagtcgaaaaagtcttcatgcaactattcagtgtaaaagatggtggtgagaagttactaaaagcatgccaatgctatatatcaaccacatctggtcctctagcaggactcctattcatatccaccgataaagttgcattttgcagtgacagatcaatcaaggcctattcttcaaagggtcatttgatcagaattcattacaaggttgtgatcccacttgaaaaaataaggagcattaaccaaagtcaacatgtgaagaagccttcccaaaagtacatagaaatagttacagtggataactttgacttctggtttatgggtttcttaaattatcagaaagctttcaaatacctgaagcaggctatctctcaagctcaagcgtag

SEQ ID NO: 75474 - DNA, 612 bp, Glycine max
  Peptide Sequence Number=SeqID_167159
atgaggggtcaagacatttattgtagtcaagaggagactacttcttccccttcctctagtggaagtgaagatgaagtaaggggtgaagagtctagtgaggaagtctacccacatgaagaaggtgacctcctagtggttataaggctccttggaggtgatatcaaaagaacactccttcttaaacaatctttctaccttctcctatcaagggaaacatcccttagcactgccatacctattgagcttgaggttattcctcaagtaaaggagttgttagatgagggtttggtttgtattataaggcaccgaatccctatgataagtggtatgatgaatgtgttgagtggtgcaaccctcttttgtaaaatcacccatgcatccaacatcttcataattcatatacatagggactcattaggcagtgatcaagggattcccgcacaccctaagagaataaaggtcatttctgagtggcccaccccaccaagtgttgatggaagaagctccgagtttcaagaacctttcgatttgaggttagatccttttcaaggaggagggaatgatgcaatcctacaccctaaggcattggataaaaaaatcccagaatattga

SEQ ID NO: 75475 - DNA, 432 bp, Glycine max
  Peptide Sequence Number=SeqID_167160
atggcttctaggaaaagaaaggcaccagcctcagcatcccaagcccgctatgatcgctctagattcacatctcaagaggcctgggattgctactctgatattgttattggcaggaagatcttgcctgagagaaatgtcatgatatatcatacaaaatttgatgagttcaaggctaagctcgagagaaggaattggcaaaaggagctgaccaatttcatggatggaagcattgatgttgcaatcgttaaggagttctatgctaacttctatgatccagaggataactcacctaagcaggagagggtcagaggccacttgatcaagtttgatgcagatgctttgaatacttttttgaagactcctatggtcatagatgaggtggaagagctaccttcatactccaaattttgtcgtctgaggccagatccatag

SEQ ID NO: 75476 - DNA, 195 bp, Glycine max
  Peptide Sequence Number=SeqID_167161
atggttgcttggaacgaagaaggtgtgtttgcacaagccaaagggcatgacctgaaattcaaagtggctacgttgtatgcggaaggcggttttgctggcatcctcctccctcatcaaaatttgatgatagccctgccacaagtgaatagcgtagttggtttggtaggaaggttgtttggtcatggaataaagtag

SEQ ID NO: 75477 - DNA, 147 bp, Glycine max
  Peptide Sequence Number=SeqID_167162
atgctttctttgtgcattttccactttgaagcatcaaccatacaccatccaaaactcgctaagcgtgcctactacgctaagcgagttcatcttttgaggatgaacactcatcctcttgctgaaccacctatggctaagcgaggctga

SEQ ID NO: 75478 - DNA, 363 bp, Glycine max
  Peptide Sequence Number=SeqID_167163
atgagttgtacaggttcgcaaagcgcaccacgtcatctctctaagagcgccacttcagttcatctgctaagcgagaaaggcgcgctgagccaaaaatcactaatgtgcgctaagcggtccatacatgcgctaagcgcacgagcacgaacaaggtcactctcactaagtaagatcatagggagaccagtcagggtcacggtgttttgcgagaatgctccaaccatatgggatcagcataggcttaaaggggcactcaaacccggtgaccccaaggcctacactctgaagagtccgttagggcctctccctcctgattcaggtccaacccctaaaatcattttagcacacagacactgctcgtga

SEQ ID NO: 75479 - DNA, 363 bp, Glycine max
  Peptide Sequence Number=SeqID_167164
atgagaagtgccaagaaggctgactgcttcctcttcactccttcccctatttatagcaaaataggggaggagcttgccacccagctcgcccaagcgagcaaggttgcttcctccaaaagcaaccgccttctggaggaagaaaccggaaggcccaagatgccaagtatcccagagcggccgatcaaaggttgcacatcatcaagtaataatccccgaacgaaattagggtatgacacctttgaacgaatgaagccaccttttagcctctccaaacaaagagaacgagaacaagctcaatctaactgtgtccttaggcagaccagccaatctaacagtgttgcaaattttaatataagttgctag

SEQ ID NO: 75480 - DNA, 384 bp, Glycine max
  Peptide Sequence Number=SeqID_167165
atggcttcctatgggagcatcaatgtggcaatagtgaaggagttctatgccaacttgtatgatacggaagacaagtcacccaagcaaatatgggttaggggccacctgattaaatttgatgtagatgcccttaacacctttctgaagacccctatgatcatagaagagggggagaacctgcctgcttattccaagtccagtcgtttaaggatgatgggggaactacttcaagctcaggagaataaggtggattcaccactagagattatggatcagctggcactggttcaacccatgcagctttgtagcatagggactaaggtttgcacatccgatcctatggttgctgacggaggagctagagtggatgatgaagggatgtaa

SEQ ID NO: 75481 - DNA, 213 bp, Glycine max
  Peptide Sequence Number=SeqID_167166
atgtatatgtttgaggcctttaggattggaatgaaaattagggaaatatctacttcgaggggtgtgaatataagtgtgagaatgatggttgtacacatgatggaaaaatattatcataggaagctcaagctcaaccttgtgaaagggttgagagtgatccttatggctatagttgatattaccaatcaacaagatctagtatatctgaattag

SEQ ID NO: 75482 - DNA, 753 bp, Glycine max
  Peptide Sequence Number=SeqID_167167
atgacttctagaaagagaaagagcatttgtacaaggccaacatctcaatatgacacaaggagattctcttcattagatgcttggaccagatacgctgataatgttatgggaagaaacattttacctgagaggaaagtagagctatatcacactgagctagatgactttaaggccgagctggagaggcgtaatttccataaacgcctcatcaatttagccaatgggagcatagacctggctttggtgaaagagttatatgcaaatttatacagttatgaggatcgtccaccaaagcagttcagagtcagagattatttggtaaaaattaatgctgacagtctcaacatattcctggagacacctgtgggccaacctgggaagattctcaggaaggatctgactacactggctcaggtgtggagtgtcctctcatactccaacttggcccccacatcacatacctctgatttgacacttaacagagctaggctgatctttggcctagtctctcacttggatatgaacataggagcactgatctctaaccagatgacctctatagcccagacgaactgttggaaccccgaggatctaatagtctctatccgaggggctaggagggcgagggcatggccagctgagcttccttctatttctgcagctcctactccagcatccacttcagcagttatcccagctcagacaaattctcaatgctttgaagccatgctccaaagcattcatccgggatag

SEQ ID NO: 75483 - DNA, 1431 bp, Glycine max
  Peptide Sequence Number=SeqID_167168
atgggcactgcagccgacaacgatggtgtggacgacactgtctgtgaaaaatacgacattagcaacgagaaatgggcccagttttgtcagacccacagagatccctcgtgggaggatgtgcagaaaaaagcacaggtcatccagaagcaaaacatcgccccccatgtgttgtctcatgggggttatgaatatttagaacagaagttgatggctgagaagacaaagaaaaaactagaggaagcttctcagtccggaagcactgagggcgtcattaaccctccatctcccattagacgacacgtgaagtggaagatggcccgcaccaagaaaactgggcagatgacgtctgaggccgcaaaggaaatcgctgagaagattgattcttttgaggagcaggcgtcacagggtttgtttgtcccctatggacgtcaggatgtcctgactgtgcgtgctgctggagccagtgtcaccatcaagcaatacttttggatcggctccacaaatctcccgcagttcctcctccatccctcccaaagaactcgagcagttgactcaacaaatcaaggaccaggtggaggaatcgatcatagaaaaagtgactcgacagctgatggcatccttcagccagatgcagggagttgtggtgatccctcaccaaccgatccagagacgggtgactcagacaaatgcgggttgtacatcgaagaaaattcttcccacctggttgctctaggaagagtttatgagggatccacatcggttcacaacatccctttgttgcatggccaagtgaaggttggtgttgaggaagttaaagatgcagaggctcccattcctgtacctactgacgaggttattttagtggggcaggcacttaacaccttccttgattggccaacacatctcgtgaagcctttatcagaacaggttatgtgggatgctaccgtgttcggggtgtttaatcaagacttcccattgtacatcaagcacgaagatctctccgaaattgcacacagtgcggggaattctgatgtgtatggattcctcgagccacagtctattcagagatctgggcaatcgcagtttgaatcagaaagttacatcaagagttggatgcagagttcaaaacgcgatgtctaccttggagcctacctgaatggcggacacaggaaaatggtctttattctgcctaaggaaaaccttgttgtctggttttgttccttgcataacaggtcagacaactaccttaagggaataattaacagtgctttgaaaggacttgatgatactccacaatctaaatccaaggctggtgctaggtggatcgttgttaagtattttaacgatgttaaaccattggaagcaaagagattgaaggtgcttcgcatccagtgggcacaattttatctcaaagttacaaatcaaagttag

SEQ ID NO: 75484 - DNA, 156 bp, Glycine max
  Peptide Sequence Number=SeqID_167169
atgggcccgaaatctaccctaaggctcatgagaatcctagggccttctcttgcatctctggcccaatctgcttggagtcttctatccaatgcccttgcaggtatgcagcttgatacatcaggaaagtttgatgacgttgatcgaggccgtacctga

SEQ ID NO: 75485 - DNA, 1638 bp, Glycine max
  Peptide Sequence Number=SeqID_167170
atggggacagatcaaactggcaaaaggttttatcaagtcaagattaagggcctagatatcaccagcattaaggagttggggcggttgatgggacctctccaaatgcaagccttccgcaaggcgtacagaaagatcttagatttgaccatagcagagatatccacagaagccattacatcactcacccaatactataaccagcccttgagatgcttcacatttggagacttccaattagtaccgactgttgaagaatttgaggagattctaggatgtcctcttgggggaaggaaaccatatcttttctccgggtttcttccctccttgagcaaaattgcaattgtggtcagggatttggcgagaggattggaccgcgtaaagcaaactcgaaacggcatagtgggcctaccacagaagtacttagaaggcaaggcgagggatatggagaatcaagaggagtgggttccgtttatggatgtattagcattgctaatctttggggttttcctctttccaaatgtggatggtttggtggacctagccgcaattgatgctttccttgcatatcaccatagcaaagagagcccggtggtttgctcggatcatttgttgtttacccgctctttgtgtatggttggtttcacacttattccaacaagacataaggcatccatgtccgctccgaagccatcgctcgtgtgtcgaaaaaagaagagaggcagaatagtcaactggtttccacgatggaaagaaggaaaggagggagttctcttctcatgtgggggctacccaaacatcccgttgataggaatgaggggttgcattaactacaatcccacacttgctataagacagttagggtaccccatgaggggagcaccgacggaagaaagcctgtctcctttccttgtgagagattttggcgcgcaaaatttcaagattatcaacgaagagaacttcgaagctccggaagaggatgaagaagtccgagctctgaaaaccgaactaggaaaagcgagacttgccaaagaaaaattcaagttggtcgctacagacgttcggaaagagtgtgccgggttacgagaagaaaatgcagctaccgcaaaagcccttgaacaagaaaccaagagggctcgcaaggaagagcatggccgtgacaaattccgtggagcattgtggggcaacaacagtgagctcaagcttcgaagggaagagagagaccgatcacgagcacatagcatggttttaaaagaaaagttaggcgtttgctcaaggtccaaaagaaacttgtctcagcgtttatgcgagacagagaccaacatgttagctatcatcaccaagtaccgagaagaactaagtctagccacggcccacgagcatagggtggtagacaagtatgcccaagtgtacgcagaaaaggaggctagaggaagggtgatcgactcattacaccaagaggcaaccatgtggataggccgatttgctcttaccttgaacgggagtcaagaacttccccgattgctagccaaggccaaagcaatggcggacacctactccgcccccgaggagatccatggacttctcgactattgtcagcatatgatagatttaatggcccatataattaggaaccgctag

SEQ ID NO: 75486 - DNA, 522 bp, Glycine max
  Peptide Sequence Number=SeqID_167171
atggaggagaaaaggaagaaaagacagcaggaagcaatgaatatggaggattcaacaatgatcatcgaccctccatctctcattgcaaaacatgtgaagactcattacaagaacagacgacacatggcagctttgttctatatggttgtgacgacatactcaatactgccattgggcgaccagagcatccaggtcaacacaaaaggaagcaatgctaaaagtgttgccaatccatcaggggaagatcttgttgctaatgtgatgtcaactatggggttatacgtgcaaggtgatcattgtgcacatctggtggccttgggaaaaatatatgaggaagggtctatcatacacaatgtgccttatgctgatgatttggtaagggtgagtcttgaaaaagtttatgacaaagactctcaagtcccgttttcgacgtcagagattcagtatgtcaggcagacctttgacacattcattacatggctgacacatcttgtgaaacctgtatcacatgaggatgcatag

SEQ ID NO: 75487 - DNA, 264 bp, Glycine max
  Peptide Sequence Number=SeqID_167172
atggttaaggaggagtgtaaggaggtaagtgtctcctcgaaaaggacacttgttagcactatcatacctcttgagcttgaggttattcctcaagtaaatgagttgttggatgagggtttggttcataagagcttaaattcttgtgttttgttggtgcccaaagataggtgtgatcagaggtttcctacagaacctgagagaataaagatcattcctaaatggccccactccaccaagtataagggaaatttgggactttcatga

SEQ ID NO: 75488 - DNA, 546 bp, Glycine max
  Peptide Sequence Number=SeqID_167173
atggctatactaggagaatgttgtgcactatgtcctaattcagggaagctttcagcttggggtggaaagctcaaaacctctccttggctaggagagttaccttggccaagtcaacaaataatgcttatttatactatgatgtctatggatattcctaaaggacaagatgatgatgcccaagggattgatatgatctacaagatccaagtcattcttcctgcttctctaaaggaaggttctaatgttaaagtgtggcttggagagggaattggtgatttctctatggcgagtacttatagaatgttaacaacttcatctttgcctattgacgatggtgattggtctaggatttggaaacttatgtgcaaagactttgtagccttcaacaagtcaaagaatgtccctcttacgtgcaataaggtccttactcaggggcttaaaattgctaaggatagaggtttcactcatatagtcttgcaaagtgattctcaatatgctatatctgctatcaaaggtgacaaattcggggttgctgaaagggggtag

SEQ ID NO: 75489 - DNA, 336 bp, Glycine max
  Peptide Sequence Number=SeqID_167174
atgagtgtggttataatcttgaatatgcccaggagaatgctagagcagattcgcattacaaagaatagattccccaatagtattccacttctagaaaaagcttgttgggaatccatcgggttaggagacttccaaggtcccatatcatggagttacagtggaagacaaaggagaagaggagagaggaggcgtcatccactagggaataagccatggaaggagaagcttcaccaccaagagagtgccttggataagaagcttagagaggaaggttcaatggaggaagagaatgagagagagagagagagagagagagaaagtggcatggaaaattga

SEQ ID NO: 75490 - DNA, 204 bp, Glycine max
  Peptide Sequence Number=SeqID_167175
atgctacttcaaggagaagatgagtcaagaacaagctcagcatcatttgaagacatggataagagcttgaaggtagaagaagatgagcggagggagagggagagagaggacatgaaatttatgcctcaaatgaggtgccctaaaataaaagggctgaaaaattctacattactagggtaccctccctacactatggagccttaa

SEQ ID NO: 75491 - DNA, 162 bp, Glycine max
  Peptide Sequence Number=SeqID_167176
atgatggcacatcaccttacctctaagcagactcatggttttcaggcgttagagagaggagaagggattgaaacctccattccgcgctctacatgtgatgagtatttctccctacaagaacgttattttgtaaatcccaacggtaaatatgtgtggcagtga

SEQ ID NO: 75492 - DNA, 408 bp, Glycine max
  Peptide Sequence Number=SeqID_167177
atgaagaacgtcgaagaacggtcgaaaccttcgcgaaattcctcacagaaacgttacggaaacgtttcggaagcgtctcggcttggattttcttcacggaaacaacttttccaagcaaattcaaaagagagagaagtgcctaaggggctgaaccctttttcacttcacttctcccctatttatagaaaattgggggagaagcttgccacccagctcgcccaggcgagcagggttgcttcctccagaagcaacaaccttctggaggaatcttctggagggcccaagtgggcctgggtgtacctacgaggacattctgacgttcaagttagaggtgcaaagactccttggccagccaccgaatatggaggcttgacgagttcgagtagtacaaatgccctcaagctctga

SEQ ID NO: 75493 - DNA, 229 bp, Glycine max
  Peptide Sequence Number=SeqID_167178
ggcaaacgagcccattgacgcgcagagactaacatcgtcttctgcaccttttgtcatccagggatggcgagtcaggtggcaggccgagataacttatggtcatccgcgcctttcgtcaatcgaggggaacgaattcgacggtatcaggatgatgttggtcggacgatcgagtgcaatggcgaagggaagtgtcgtggttggtccaactttgtcgttttcaagacactga

SEQ ID NO: 75494 - DNA, 192 bp, Glycine max
  Peptide Sequence Number=SeqID_167179
atgtgtctattggggaaggagaggcaaggatggacatcctcaccctgggtcaaggtttatggtgagttgggattttggctcaaggcttgtagaacggctggacatgatatatgtcagggtgttggtttggccagcggtttagggataaaggagatgtcccacattatttccatgatacacatgcaacaatga

SEQ ID NO: 75495 - DNA, 245 bp, Glycine max
  Peptide Sequence Number=SeqID_167180
gggcaggatcgtcttaggcaacggtcagaggtgcttagggacggacgcaaggagaggctagggtcacgacccataggtcgtcaaactttgcctagcccgggacgaacggaaagcgccgctgcaaagcagcctagggttgtaagggatggccttaggtctatgttgcattctggagtaatggggcatgccacattgcccccattctcttgctattcatgccaaaacgtgcgcccaccaagtgctcg

SEQ ID NO: 75496 - DNA, 274 bp, Glycine max
  Peptide Sequence Number=SeqID_167181
atggaagcttgcttgtggggcttctatggaggctggatctttgagcttcaatggggtcctttaatggtgattttccaccatggagatgcagcggaagacaaaggaaaagagcttggagatgatgcttcaatggaggaaaagaaagagagaagtggggagcacgaaattgaaggaataaaagagggagagaagtggaactttgaagtgtgtctcataaggctttcattcatcaaagttgcagcaagtgttacacatgcttctatttatagactag

SEQ ID NO: 75497 - DNA, 369 bp, Glycine max
  Peptide Sequence Number=SeqID_167182
atggtagagccatcaaagaagagaaagggatcatcctccaccgctaccgctgctgcccatcgccgtcacggcccatccggagcacccacaacacctattcctccttctttgtcatctccaagatcatcaacactgttttcatccgatgatcaacgtctacgtcaaggtgcaccttttgagggcaccattgttgatgactggaaatttgattattcgagtcatgatgctcgtcgcatggtctgcaatgatcaagctgaaatgaccggtagattgctggtcgggtcattaacttttgataatcgcatcatgcattatatcattgttaggatttttgcttcctcggtcttcaaatttagcacaagcctctga

SEQ ID NO: 75498 - DNA, 475 bp, Glycine max
  Peptide Sequence Number=SeqID_167183
ggcgcaggagacgacgttagtctctgcgtgctatcaggcttttcgtcttacagatagcaaaaaggtttatacggataaccactcgggtatctccgcccgtcagcgtgactcaaaagtcagtatgacagatcttgtaagcgcggaagatgacgcttttcgtcttacagatagcaaaaaggtttatacggataaccactcgggtatctccgcccgtcagcgtgactcaaaagtcagtatgacagatcttgtgagcgcggaagatgacgcttttcgtcttacagatagcaaaaaggtttatacggataaccactcgggtatctccgcccgtcagcgtgactcaaaagtcagtatgacagatcttgtgagcgcggaagatgaccaaaaaagaatttatacggataaccactcgggtatctccgcccgtcagcgtgactcaaaagtcagtatgacagatcttgtgagcgcggaagatgac

SEQ ID NO: 75499 - DNA, 522 bp, Glycine max
  Peptide Sequence Number=SeqID_167184
aagaagaatgaaagctatatcagcaagccacagaaagaggaagtggtacttgaacccggtgatgatcttggacatttgagggcaaatgttttccaagaaggagggaatgatgagaatcctgaaactgaccaaatacaggctaaaggcccaagaggagaaggacgaagggcccaagtggagaaggataaagcccccgagtggagaaggatgaagacttatcaaggtaatccttgtggcgtctacccggacttatcttccttcaccaaaagtagcatctaccctgacttatctaccttcaccgaaagtggcgtctatccagacttatcttccttcattggaagtgacatcatccaaatctccgtagcctgtatgaaacgatccgctcctagtcaggttcacatcaatttccaattcgtgcatatactccactgcaaagaccaattccacaccatcaaacttgatgctaaagaggtagttaatgataagtctttctattataagccatatcaacacttaacataa

SEQ ID NO: 75500 - DNA, 171 bp, Glycine max
  Peptide Sequence Number=SeqID_167185
atgactactgtatcgtccactgactccagcccggaaccacccagattcatgggatcaacaagaagctacaaatttgtggcagcattccacaatgacagggtacttccgccaagtgctatgccttatcttgatacctcaattcaatatatgatagttgtgacaaagaattag

SEQ ID NO: 75501 - DNA, 259 bp, Glycine max
  Peptide Sequence Number=SeqID_167186
gggttgtgaaaaaatacctagatccatgataagcagcggaattgatgagtctgaggaactgttggttttgtgttcttcctcaaccaaatcattgttttccttttgggaacttaggtttctcgtcagatgggaagaagagaatacaatttctgagtccaatagtgatgcaatcctacccccaagggcattggatagaagactccaagaagattgggccagagatgcaagagaaagccctagggttctcatgagccttagg

SEQ ID NO: 75502 - DNA, 225 bp, Glycine max
  Peptide Sequence Number=SeqID_167187
gtgctggaagcaaccatcaaagccaccacagagaagaagatggagctagaacggctgatcacaaggctctcagaaagtggcattgatgatgaagaagcagctgaagaagaggaagaggcagctgaggaagacaaagaagcagctgaggacgaagaagaagctgctaaggaagaggaagatgcagcagatacagaatcagatgaagattctgaagccaccccatga

SEQ ID NO: 75503 - DNA, 321 bp, Glycine max
  Peptide Sequence Number=SeqID_167188
atgacttcaaaagaattgaacgaggagccatatgaagtgaaaatctcatgtacggctacccatgagacaaaagattttctttctaaagaaattcgattcggaactacgatatgtccaaggatttccaatcctagcaggaaaagggggggaacggatactcaatttcaagtgagtaaacagaattccatactagatatcatagatacatatagaattctgtggaaagccgtattcgatgaaagtcgtatgtacggcttggagggagatctttcatatctttcgagatccaccctacaatatggggccaaaaagccaaaataa

SEQ ID NO: 75504 - DNA, 929 bp, Glycine max
  Peptide Sequence Number=SeqID_167189
atggtgaaagttggaacctcttacgtgccgatcaacgtctcattttcgccaaaagttggccccagggcttcccggtatcaacagggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggcgaattggagctccaccgcggtggcggccgctctagaactagtggatcccccgggctgcaggaattcgatcacccccgataccgttgatcgtgttcttatacgtggatttcctgtgaccgctgcaaccgtttcatatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 75505 - DNA, 456 bp, Glycine max
  Peptide Sequence Number=SeqID_167190
atgacacattattcagttcctggggcatccgttagtcctggaggagggccaacactgcgaattcagtcagaggaggagctaggcctcgtgcatgaccaccctaacacagatttggatgacattgctactcagcaacatcctcctcagcgatcacaattccaacctcccccgccgaagtgccagctagtctatgccatcttgacccagttttatgcggtgccagttacttccaccaagcttatctggcctccccttaacaaggccttcatagaaaaatattgcatgccaaggcaggcacaacagcagggtcaagcacagcagcagcaggcatccgcagatgcgccgccaccacctctaggtgttcagacaggggcagaacccgcagggactaccggagatggagatggagcacaagatgatgatgacatggccgatgtgatggacttcattctttga

SEQ ID NO: 75506 - DNA, 270 bp, Glycine max
  Peptide Sequence Number=SeqID_167191
atggagagctatgaaggcccttcaccaaagcaagccagggtcaaaggccatctagtgaagatcgacgctgacagcctcaacacattcttagagacacctatggtgtgggcagagggtgagactttgcccacatactctagatactgcaggctgcccacagactacagagagattgaggctgccttatgcataccagggcgagggttcatcttgaacactgagggccatcctaggaggattctcgggaaagatttgactactttagcctag

SEQ ID NO: 75507 - DNA, 300 bp, Glycine max
  Peptide Sequence Number=SeqID_167192
atggcgccagtggagatgcgccttcaacagggaagagccacgtggcaagtcgccactgtgactgccgacaaaggactgcatatcgcaggtcctattggcgcatccagaggcgccacctcgggtggcgatttgggtgagagggaggcgccagtgatgttggcgttttcagcttcagtgggatttaaaagaaggtggttgaaagggaggctccagttcacggttgcttgtaaaatttgtgtgttgaaggtgaaaaagaaggtggttgctgttgagagagaggtagctggtggttgctgttga

SEQ ID NO: 75508 - DNA, 231 bp, Glycine max
  Peptide Sequence Number=SeqID_167193
atgcatctaggtgatcaaggaagccttctttacaacaaagagaagaacaatatgaaggattgcaaaaatacaagtggtgaggatgtctccttcacctctaggatctcacaatcactcccaaactcatctcaagctctcaaactggctcctgcttcaagctctggtctctgtagatcttcacacaacaaaatctctcaaaactctctggaacttagacctttctctatgtag

SEQ ID NO: 75509 - DNA, 302 bp, Glycine max
  Peptide Sequence Number=SeqID_167194
cgatgcggatgaggcgccactcgatgtttccatttgcctgcatgcctttggtattgtggggtgtggttcgtttagtggtgtcaagtcttgcgaacgtgaggacccattccatccaggcctctttgttggggacgctggaggatttcaaagtcccacacgtgaaccacctagcgctggcaatgctcgtggcaggtgcttggtcattaacggatgctacctggttgatcctgccagtagtcatatgcttgtctcaaagattaagatcaagcttatcgatgccgtcgacctcgagggggggcccg

SEQ ID NO: 75510 - DNA, 297 bp, Glycine max
  Peptide Sequence Number=SeqID_167195
atgtcgacgaggaaagatcaacgatctaggtttaaaaaagaagcatcaccggatgacgccgatcgaacatttcctattagacatcatccaaatattattcagggattgaatagaaaatacaatagccgacatcggtcgataggatgcatttttgatcggtgttgccgtaaaaatttacaatgtacgtcggcaaggttttatcgttcgagctcaaccgaagttgtggttcggccgacaccggcatgttttcatttgctcggcaaggaaaacgttagcccacctcggaagaaaacttga

SEQ ID NO: 75511 - DNA, 198 bp, Glycine max
  Peptide Sequence Number=SeqID_167196
atgccgatgctttatcccttttctgaagttaacttcaagataatagaacaaaaaaaagaattgactgctgagccgtatgagtcaggaaattctcaaagtacggttctaaggaaaaggaatttgactcacctattccgacccgagggagaacaggccattcgacagggagactcggaagttgcggagtctttggtttaa

SEQ ID NO: 75512 - DNA, 1002 bp, Glycine max
  Peptide Sequence Number=SeqID_167197
atggttaacatggagtttatctctaatgcaatgatactttcattctcaatactattgttgctaccaagtacatcatattcactatatcaaaagcctgaaaatcatatcaagacagctatttttgtaactgggagttttgaaatgggaccaggatcaattgcaacaaaaacatttgagaatataaagtttccaaaaggtcatgttggaattaagagttttgatgcgaaactagttgaccaagaagggaactctataccttcgtatgaaacttaccttcatcattggtttgcaataaagtaccaccaaaatattaccatgtcacctaatcctaagcttcgtcgtcctgaggatgcttttttccaaagaaacgaaggcacatgtaatggtggcattcttccacattattggggatttggagtagaatcacgaggaacaacctcaaaaattcccgatccttttgctatagaacaaggtaacccaacaaaattaaaaatggatatgaggagaaatggttgctcaacatcatggtcattgatacacgtggtgcacaagataagaaagcctgcactcaatgacaacttacaatgcaagcaaatagagggttttcaaggttcaaggagaatggtttccttaagatacaaaattagttgggttgattggaacatataccaaataccagttaaggtttacatacttgattccaccgacaaagtgaggtcaaatggttccaaaatacttcatgattgtctggcagagtataccattccagctggtggtggtggtgattctcctcatgtccaaaaagcaaacatcccaatggaaaatggaggttatctaatttatggcactgctcatatgcattcaggatggaaggactttatgtacatcaacaccaaaatatggaacgggaaagaggctggaaatgagaaaggttatctcattggaatgtctgttgttatccacaaccgggttcaatcaagattcatgatggtgaaattttga

SEQ ID NO: 75513 - DNA, 231 bp, Glycine max
  Peptide Sequence Number=SeqID_167198
atggatgatagatggatgcagttcggtgactacattgcacctgttagtttatttattagaggggtgtgggtagttaagactttagcttctcaaagaagcctctcaaggaagcttcacaaagaagcctcacgagaaagcttctcaaggaagctgcctgaagtcatcctggttcataggacaaatgttcatgatctgaccgttgcaatctgcgatatgtcttttggtatgtga

SEQ ID NO: 75514 - DNA, 222 bp, Glycine max
  Peptide Sequence Number=SeqID_167199
ttctttggagtgctcgtcacccccagcaaggtcatcaggcctcgtattaaccaagctttcatcaagaaatattgcacttgcaggcaagcaaagggtgagacaccacaacagcctggggatggccagcaacaggcaaccaatgcaccgccgccacctccagagcccctcagctcatccacaaaagggttagagtattgcctacgaaacatggccgaccaatag

SEQ ID NO: 75515 - DNA, 179 bp, Glycine max
  Peptide Sequence Number=SeqID_167200
atggcttcgagaaagctttccgcaaagagatctaggaaggacgctgcggctgaagggaccagtgccgcccccgagtttgacagtcatcgtttcaggagtgctgagcaccagcagcatttcgaggccatcaaaggatggtcgttccaccgagagagacgcgtccagctcagggacgatga

SEQ ID NO: 75516 - DNA, 155 bp, Glycine max
  Peptide Sequence Number=SeqID_167201
atcagttcagggctgaggtttcctggcccggagattggcctgaggcccaagtaggggaggcgcccgcagagggtcccggcggtgcagaagaggcccgcatggatgaggagatgacagatttactcggtttcttggaagggagtggagccacgtga

SEQ ID NO: 75517 - DNA, 378 bp, Glycine max
  Peptide Sequence Number=SeqID_167202
gaggatgtgggccacctattcttcaactgtaatctgacaaaaggtttgtggtgggaatccatgagatggatccgggtaataggcccccttccaagtcacccaaagtgccactttactcaattctgtgaaggctttgggaaccctgtatatcaggacataaggggtggatggtggagtgccttgactagttctatctggcaccatagaaacaacctgattttccaaggaagaccttttgatccatataaagttatggatcatgctatatacctagtttggtcctggttcaaggctaaagataaagatttcaatattagcttaaatcattggtcttcaaatatttcgaattcctttggatattctgctaggctttcttaa

SEQ ID NO: 75518 - DNA, 594 bp, Glycine max
  Peptide Sequence Number=SeqID_167203
taacttggcaggtgtgtggtcctatctgaactgggagatcgatcccccctcttacttcccagcgacttccgtcgaaagcccggaccaccatggagcttggtttcaggctggagccattgtcaaggagcactttggccatgatgtgatccatgcatttgacaaatacatgcagagccctattatgtcctcgtccctcaatgggaatctcctcctcagtgaaggtaaggtagttattggcggtgatattgttgacaatcccctcgaagccttctacggagatgtcttgggccacttgggcctcttgctcgattatcttgaattcactctgttggattatacggaggaactcgttggcctcctccaaggatacctcctttctgccgaggccttcccctttttcaatgaacctccctactggaacatcctcatctggggtggggtttgcttcgttggccttttccgtgaccatctttgcttttcctttggcattcgcgggtcataccgtgtcggtggccttctccttcctctcgctcggcttctgaggagcgtacctccacgggaccgccttgctgtttttataggggaaaaggacag

SEQ ID NO: 75519 - DNA, 1497 bp, Glycine max
  Peptide Sequence Number=SeqID_167204
atggcaagaaaaactttagcttggtccttgcttctagggatggcttgttccatagttattggttcatatgaggagagctttcctactaggacattttctagtaacaactatcatgaagcaatacaaagattgcagtcatttaaggcctctctaacaagacatgattccattgcttcagcctcatcttccttatcaaccttctcaagcccttcttctgctccttctccttctctctcacttcagggcgtgaacaatccacgcgtgtaccgtgtgacgtcttatggtgcagatccaacgggtaattcggatagcactgaagcactccttgcagccatagaagatgcagccaagggtcctagtgaaggatatttgatggaaggcatcagagaccttggaggtgctcagattaatcttgagggtggaaattacttgatcagccggtcactcaagttgccggtggccggggtggggaaccttatgatacatggagggactataagagcctcagataattttccagaagacggctatatcattgatttgtcaccctcttctaatggaagaaacagtttaccatcctacaattttgagttcataactctcaaggaactcttgctggactcaaacttcaggggtggaggcatttcagtcataaactcacttaggactaacatagacaattgttacatcacacatttcaccaccaatggaattttagtccaaagtggtcatgaaacatacatcaggaactctttcctcggccagcatataactgctggcggcgacaaaaatgagaggaacttctcaggcactggaataaccctccagggtaatgacaatgctgtcactgatgttgtaattttctctgctgctataggaataatggttactggtcaagctaatgccttttctggtgtacattgttacaataaggccactggctttggaggcactggaatttatttgaaactaccaggtttgacccaaaccaggattgtgaattcttacatggattacactagtattgtggcggaagacccggttcaactccatatctccagcagtttcttccttggtgatgccaatattgtcctaaagtccaagaatggaattgtgaatggtgttgatattgttgataacatgttctcaggttcaaatcagggtgttgaaattgttcagcttgaccaatcaaatagtcctttccaacaaattgatcaagttattgttgatagaaacattgcaagggggatgaagttaaaggccacagttgccaaaatgtctatgcaagggaatggaacctcttggagtgttgattttaacaatgttttgctttttcctaacctcataaagaatgttcagtactctttaagctcctcaggcagcaccttccccaatcatgctctgaggaacgtgtccgagaatcgtgttgtgattgaaacaaatgaagcagtggctgccaatgtttttgttacggtggatcaaagtgcgttaagttga

SEQ ID NO: 75520 - DNA, 1271 bp, Glycine max
  Peptide Sequence Number=SeqID_167205
gagatttagaaaaaagagatgatttgtttccacagattctaagagacgaggcagtggcaaggctttatgagcttgggaaggtgagtgatgctagcggttatttggagaggacattcttgagtcctgcatccatgagggcaatcaatcttattcgtaaatggatggaggatgctggtttgagaacttgggtggaccaaatgggaaatgtacatggtcgcgttgatggtgctaatgcaaatgctgaagctttattgattggatctcacatggacactgttgttgatgctgggatgtttgatggatcactaggaattgtctctgcaatatctgccttgaaggctatgcatgtcaatggaaagctacaaaagctaaagcgccccgttgaggtgattgcatttagtgatgaagagggtgttagatttcaaactactttcttgggcagtggtgctatagctggtattttgcctggcacaacattggagatatctgataagagggaggtgatgattaaagattttcttaaggagaactcaatagacattacagaagaaagtcttttaaagctcaagtatgacccaaagtctgtttggggctatgttgaggttcacattgagcagggtcctgtgctagaacaagttggtttcccacttggtgtggttaaaggcatagctgggcagacacgattgaaggttacagtcagagggtcacaaggtcatgctggaactgttccaatgtcgatgcgccaggatcctatggctgctgcagcagaacaaattgtagtcttggaaagcctctgtaaacaccctgaagaatacctttcttatgatggtcattgcagtgattcaacagtgaaatcactgtcaacctcacttgtttgtactgttggagagatatcaacatggccaagtgccagtaatgttacatataccgtggatatacgagcaattgatgaccttggacgcgaggctgttatctatgatttatctaaacaaatttaccaaatatgtgacaagcgttcggtttcctgtattattgaacacaagcatgatgcaggtgctgtgatttgtgattctgatctgagttcacagctcaagtctgcagcttattctgcactcaagaagatggagggtgacattcaagatgaagtgccaacgttaatgagtggagcagggcatgatgcaatggcaatatctcacttaacaaagaatctgacaatgaatgaggatttgaacaggtgggaatgctgtttgtgcgttgtcgcggaggaataa

SEQ ID NO: 75521 - DNA, 1017 bp, Glycine max
  Peptide Sequence Number=SeqID_167206
atggcagatggatcatcaacaccagcaacaccttctgccaaagtttcagccatcttcatataccctattaaatcatgccgtgcaatttctgtttctcgtgctcctctcactcctactggatttcgatgggatagacaatggatggtggtgaattcccaagggaggatgtacactcaaagagttgaaccaaggcttgctttggttgaggttgaattgccatctgaggcatttcttgaaaactgggaacctacacaagactcctacatggtggtgaatgcacctgggatgcaacctctcaaaatatgtttgagccaacaagggaaggaggtagcaaatgctgtctcagtatgggaatggactggatctgccttggatgagggagctgaagcatcacagtggttctcagattatttaggaaaaccatgtcaactggtccgcttcaattcagaatcttcactgacagagcaaaacttaactactgaatttgtagtccctaattcccatgagagttatacttctgaagttcgaccagtggatcctgattacgtcaagggacaacatcagaccacatttactgatggttatccattcttactcgcgtctcaggaatcattggatgaactaaacgagcatctaaaggagcccgtttctattaaccgatttagacccaatatcctcgttgaaggttgtgaaccatattctgaggacttatggactgacatcaagataagcaagtttttattttctggtgtcaaactgtgctaccgttgtaagatacctacaatcaatcaagagactgcaattgctgcacctgaaccaaatgaaactctcatgaaaactaggtctggagaactcataagaccaaatgataaaaataaaaaaaggatctactttggtcagaatatgacctggaactggatgggattttctgctgaagggagtggtaaaatcatcaaagtgggagattctgtttatgtgcttcagaaggtctcttcaactgctgaagcagctgcttga

SEQ ID NO: 75522 - DNA, 120 bp, Glycine max
  Peptide Sequence Number=SeqID_167207
atggaggaagatgaagaaagggtgagcgaaaaagcgggtttcgcgaggatcgagagagaacacagaccttttgatcgcgcaatcgcgttggttttgatctggtggtggtcttcattgtga

SEQ ID NO: 75523 - DNA, 206 bp, Glycine max
  Peptide Sequence Number=SeqID_167208
atggggcatgcagccaaaccgccattgccaatggcgagtttggtctcagtgaaggactcgccactgccagtggcgatatggtgcatgcctagccctgcgagagcaggcatggcagtgcagaaggaagcagacgcgcagggtgcaggccaaatcgtcactcccattggcggtttgccttgcactgggatcgtcagcatggctggcag

SEQ ID NO: 75524 - DNA, 450 bp, Glycine max
  Peptide Sequence Number=SeqID_167209
atcaactgggctcacttggttaggtaccgaatgcataaggcattacgggccaatgcacctcttccatatcctcaattggtcaccctttttctccgtcattttcaaattcctcttgatgatgaaccttttgttcaagtcaagcgatcctttgctataggtcctggtgcagtcacttcatttggttaccgtaaggatcgtaatggtcaatggctgaagaaggacgcgctacctccgcaagacgagcgtactccctctcctcctcctcagcgagatgattcctcagcctttatgactgaagttctttcagagttacggggcctccgcacctatgttggtgaacgattcgattccttggatggtcactttgaaggcacggatacccgcatcacccagcttgaagagggtgtgacttatcttcgtcggtgcttcaatcttccaccgccttcttag

SEQ ID NO: 75525 - DNA, 285 bp, Glycine max
  Peptide Sequence Number=SeqID_167210
atgtcgctaagcggtagtgtttattttgtgaagatggcctccaggaagcgtaagagcataggggcaaggccaactgctcagtatgatactagacggttccatccccttgatgcttggaatcgttatacaaataacattttgggaaagagcattttgccagagagaaaggttgagatataccacacaaagttcgatgacttcaaggcagagttggaggggcgtaatcttcacaaatgcctcactaacttagctgatgggattattgatgttgctttggtgaaataa

SEQ ID NO: 75526 - DNA, 366 bp, Glycine max
  Peptide Sequence Number=SeqID_167211
atgagtgcttcgtggtttgcctggttgtttgaggctctgaagttgagcttgagggcttgctctagagtgatattgtcaaggccttcgaggatagtccctaccccgcttccttttacgttggacacaccgtcaacgaaaaggatccaccagtctagggtggtttgtcgtttccgacgaattctaccaaaaaattcagtcatgaattgcgtcttcatggggtcgcatggggctgagctgacaacttcgtcaattactgagagatacaagagcaagggtgctcttggccttgatcgactcaaagatggtagtgtggttatggtcttcttgaaagctagaaaggcttgttcacaagtctcgttccattaa

SEQ ID NO: 75527 - DNA, 472 bp, Glycine max
  Peptide Sequence Number=SeqID_167212
gcgcgaacaggcactattagagccgttctggcttctcttcgggcgcaaagcgcagtcaaatctgctaaataacgcgcggatgttgcttttttgtaaacggattaacaatcagccgaaatcctgctatgctggccgacgcagaaccgggcacctcaccctactgtttgacagcatcaacaggtgcaccggaaagctatacaatgagagcgaggagaacgtcgtgctagaagaataccgtaagcacgttgccgagcgtgctgcccagggaatcgtacctaagccgttagatgcttcccagatggccgcgctggttgaactgctgaaaaacccgccagcgggtgaagaagaattcctgactgacctgctggtcaaccgtgtcccgccgggtgttgatgaagcggcgtatgtaaaagccggattcctggcagctatcgcaaagggcgaagcccactctccttctggtcactcgtga

SEQ ID NO: 75528 - DNA, 249 bp, Glycine max
  Peptide Sequence Number=SeqID_167213
atggaaagaaacggcatgcgtacctttttcacgatgatgaacgcagtggtgcgagcgagggttcgggtttttattgggagtgggagagaagagggtgtacgctttggtttggtttctctctactgtgcgcttctatgcccgatccaactccgcaccgtaacatatatcaaaaacatgtacttaatttgttttcactttttcacatcttctaagaagcacaaaactgaaacagcaatgcgaacagggtga

SEQ ID NO: 75529 - DNA, 171 bp, Glycine max
  Peptide Sequence Number=SeqID_167214
atggatgaaaattgggttccagctgttgcccccatttatcagtcagtgaaatatcgagctgagtttaggggtgaagttaccgagacattgcagtatatggtgtcaccccaagggcgaaacacatggacagttgatgatctcgtgccatatgtggaaaagttagcgatttga

SEQ ID NO: 75530 - DNA, 450 bp, Glycine max
  Peptide Sequence Number=SeqID_167215
atgttggtgcgcatgatccacactcgtctctttgcagcggcacgggtgaaatcttgccccagtatgcatagtagctgcgtgatagcctccctctctggttgtgcttgcacagttggtcgccctccaatattaggggggcagaggaccttaaattctcttaaggtgtggatgtggagcacactgaaaatgaggacgcgtagccctctaaaggtgagggcgtgcagtcctctgagggtgaggacgtgtagtcctctgagggtgaggacgtgcagtcctctgaaggtgaggacgtgcagtcctctgaaggcgaggacgtgtagtcctctggaggtgagggcgtgcagccctctgatggtgaggacgtgtagtcctctcaaggcgaggacttgtagtcctctgaaggtgagggtgtgcagtcctctgttggcgaggacgtgtagtcctctcaag

SEQ ID NO: 75531 - DNA, 351 bp, Glycine max
  Peptide Sequence Number=SeqID_167216
atgccgatctcaccctgcggaagtatcagttggtctgtgctgtcccgacatagggatcgcgcccgcaagacacccagtggacctggagaagtccagcagggtcttggggtttccagctctgattacgaacctctgtcatcaagccccctactaaccgagctttcatcaagaagtactgcgcccccaggcaggcacagggcgagacaccacagcagcctggggatggccggcagcgggcaacagatgcaccgccgccacctcccaaagcctttcagctcatctacaaaagctggagcgttgcctaggacccgtggccgaccagcaggcgaccaagtccaaagccaaaggtaa

SEQ ID NO: 75532 - DNA, 774 bp, Glycine max
  Peptide Sequence Number=SeqID_167217
atgcctactcgaatgcccatttttgactccttcgacacgattagccaaaagataagcaattttaatgaacaattactgagtggtattctggacacattgccactgcaaattgcagtgatcgatgaatcgagcagtattgtgtatgtgaaccaggcatggcggtcatttggcctgctgtacggcctggacattgaaacagattggtttggcatcagttatctggatatttgccgtgccaacgaagataccaatcagccactattgctggacggcattgcacatgtactcaatggctcacaaaatcatttcactactgactatttgtgtcatacccccacccagcaacccacttggctcaccttgcatctgcagcccatgcaaactgcattggctgatggcaagttatttttactgtcactcaccaatatcacccaccacaagcaaactgaggaccgcatctcggcattgacattgaccgaccccctgactgggctcgccaatcgccggagactggagcaattcatgcatgatgaatggtcacgggccatccggcatcaatccagcctgagcgtgatgatggtggatgcagaccactttaaacagttgaatgacagcatgggccatgccgctggagatgactgcttacgccagttagccaacatcctgagaaaatacagtaaccgcccaggcgatctggccgcacgttacggtggtgaagagtttgtgttagtgctagggcaaaccactcaacaggaggcggccaaaatttgctga

SEQ ID NO: 75533 - DNA, 240 bp, Glycine max
  Peptide Sequence Number=SeqID_167218
atgacgaagaagaagatgataacaatgatagtagacacattaacagtgttctactatgaaaagatggtgggctacacactttcaagctttttcgatatggttttcaccggcaaaaggatcgaagtgggtctgaaaagaggaaaatttgatcatcctactttgatgaatgggaagcctagggcaaatagagaggatgagaatgaggaaggaacccatgctgtggctgccattcctacatga

SEQ ID NO: 75534 - DNA, 237 bp, Glycine max
  Peptide Sequence Number=SeqID_167219
atggggacaaatcaaaatggcaaaaggttttatcaagtcaaggttaagggtctagatgtcaccagcctcaaggaattgggacgattgatgggacctctccaaaggcaagccttccgcaaagtgtacagaaagattctagatttgaccgcaacggaggtatttacggaagttgttgtatctctcgcccaatactatgaccagccgttgagatgcttcatgtttggggacttccaaatg

SEQ ID NO: 75535 - DNA, 490 bp, Glycine max
  Peptide Sequence Number=SeqID_167220
gaagaactgttggaatcccgaggatctaacagtttctatccgaggggctaggagagcgagggcaaggccaactgagcttccttccacttgtgcagctcctactccagcatccacttcagcagtggtggcacctccaggatctattccttcagtggagcagttcagggagatggatgagtcatctgaagccaccatcccaaagccatttgttataggggaggaggcaggtgagacacaggtgagacaggtagttactgccactcctaagagatctcttgaggccacttcagagcctcctgcactagtggtggacctaccctcacctcagcgtatagtaaacccctccactcctattctagagataccggaggacccgaccacaccagtcttggctatggacacttctcctccagctactccagtacttcatctgacaaatgaggaggatgttccgacacaggatacccaggaccagtcacaggaattataa

SEQ ID NO: 75536 - DNA, 525 bp, Glycine max
  Peptide Sequence Number=SeqID_167221
atgggaacaaatcaaactagaaaaaggttttatcaagtcaagattaagggtctagatatcaccaacattaaggagttggggcaattgatgggacctctccaagtgcaagtcttctgcaacgcatacggaaagattttagatttgaccatagcagagatatccacagaagtcgttgtatcactcacccaatactatgatcagcctttgagatgcttcacgtttggagacttccaattagtaccgactgtcgaagaatttgaggagattctaggatgtcctcttgggggaaggaaatcatatcttttctctggggtttcttccctccttgagcaagattgcagttgtggtcagggattcggcgataggattggatcgtgcaaagcaaactcgaaacggcgtagtgggcctaccacgaaagtacttagaaggcaaggcaagggatatggcgaatcaagcggagtgggtcctatttatggacatattagcattgctaatctttggggttgtcctctttccaaacattga

SEQ ID NO: 75537 - DNA, 1037 bp, Glycine max
  Peptide Sequence Number=SeqID_167222
ataacgcgctggctggaacagtttggtttggaattcggcggagtgatgtcgctgttgatggtattggggttgattgtcctgatctcggtcgcgatccacctggtgctgcaccgggtggtgctggccgcccttcagcgccgtggccagcaatcgcagcgcgtctggcaacaggccatcacccaatacaaactgttccagcgcgtggcgctgctgctgcaaggggtgatcatcagcatccaggcgacgctgtggctgcagagcggcagccagacccaggcggtgatcgtcacagccgcacaggtgtggatcctcgccttcaccctgctgtcgctgatccgatcctcggcctggtggccggcatccagctctccgccaacgatatgctgaagatcggcgactggctggaaatgccgaaatacggcgccgacggcgcggtcaccgacatcggcctgaccacggtcaaagtgcgtaactgggacaacaccgtcaccaccattcccacctacgcgctgatctccgactcgttcaaaaactggcggtcgatgtcggaatccggcgggcgccgcatcaagcgcagcctgaatatcgacaccggcagcgtgcacttcctgtcggaagaggaacagcgccgcctgcagcgcaacccgctgctgcacagctacctgaatgataaaacccaggagctgagccggcacaatcaggagattgccatcgatctggcctcgccgctcaacggccgccgcctgaccaacctcggcacgctgcgcgcctatctggaagcctacctgcgcgctcacccgcgcattcaccagaacatgacgctgatggtgcgccagctggcgccgacgccggaaggcctgccgctggaaatctacgccttcaccaacaccacggtctgggcggagtatgaaagcattcaggcggatattttcgatcatattctggcggtgatcgacgagttcggcctgcgcgtgcatcagacgccaaccggcaatgacctgcgcggcatgctgctacaaaacgccaacgcttcctga

SEQ ID NO: 75538 - DNA, 281 bp, Glycine max
  Peptide Sequence Number=SeqID_167223
ccgacaaggaaagtgctgatgacactgtattggaaaagtacgacattagcaaggagaaatgggcccaattttgtctatcctgcagagatctttcgtgggaggatgtgcgaaaaaaggcacaggccatcccgaaacaaaacactacccctcacttgttgtctcgcgggagttatgaatatctagaaaacaagttgatggaggggaagagaaacaaaaaagtggaggaaactgctcaatctagaagcactaacaccgtgattggtattccatctcccatctga

SEQ ID NO: 75539 - DNA, 624 bp, Glycine max
  Peptide Sequence Number=SeqID_167224
atgtcgtcaccttcaaaggactacacgtcctcgccttcagaaggttacatgccctcgccttcagaggactacatatcctcgccttcagagggctgcacgccctcaccttcagaggactacacaggacaacaaatcctctccttgaaaggacttcacgtcctcgccttcagatggctacatgtcctcgactttagaggactgcacgtccttgcctttagagaactgcacgtcctcgccttcagagggctgcatgcccttgccttcagaggactacacgtcctcgcttttagagggctccacatatgcgccttcggtggacttaaggtaagtatgcacgtggctcaactaatttctgatgccatccactatttccagggattgtgtccacacgacacccagtggacccggaggatcccaacagggccctggggtcccagcaaggtcatcaggccccctactaaccgagctttcatcaagaagtactacgccctcaggcaggcgcagggcaagacaccacagcagcctgtggatggccggcagcgagcaacagacgcaccaccgccacctccaaagcccctcagctcatctacaaaagctagagcattgcctacgacccgtggttga

SEQ ID NO: 75540 - DNA, 387 bp, Glycine max
  Peptide Sequence Number=SeqID_167225
ggagggcaaaatggtcatttggtgacttcttcagacacctggttcgctcaggctagcctctggcttgcctgggccaccagaaagcttagggttgaactcgccctgggaaagtctaccaatgtcccttccctcggtggtacaaccctagtgcaacttgcgcctaccatggaggtccagagcttgatcgatgcggggtggctgacattccaagaggataacccaaatgtgaggacaaatcctcttgctagtcatgggggaccggcagttaatgcggtggaggagtataaacctcggggcccgaagtggatggaggatgtgttgacctcgaagaggttcatattggaggcgatgtgtgatgcagggataatttgccttgatgggcactag

SEQ ID NO: 75541 - DNA, 594 bp, Glycine max
  Peptide Sequence Number=SeqID_167226
atgccggagcagccgtggcaggagagagggtcggtgctcttctgccgtcgccacatcggcattcctgtcgaacgtgcgcccggggaatgggtacacagtgttgcaacgccgcacgagctgttgagcctgctggcgcgcatctacaaagtggagctggaagagcgcgacggcgcgggcggattgccgtcaccggaatctctggcgtcggtgaatgacgatatgatgattctggtggtggatgaccatccgattaaccgtcgcctgctggctgaccagctgggatcgctgggctaccagtgcaaaaccgccaatgacggcgtggatgcgctgaatgtgctgagtaaaaatcatattgatatcgtgcttagcgacgtcaacatgccaaacatggacggctaccgtctgacgcagcgcatccgccagctgggcctgacgctgccggtggtgggcgtaacggcgaacgcgctggcggaagagaaacagcgttgtctggagtcaggcatggacagctgtctgtcgaagccggtgacgctggacgtgctgaaacagacgttgtcgatttacgcggatcgcgtgagaaaaaccagaatataa

SEQ ID NO: 75542 - DNA, 276 bp, Glycine max
  Peptide Sequence Number=SeqID_167227
atgtcaggatttacacgtgattctcctcaaatttcagccagcccgcatcaattagaccttgcaccttacgcttcagggccctacaatgctcaatggaacgccccgacgcttctccatgacaagcacacgttgcgttcgagtcgtattctcggagaaatacggaggttgatgaaccttggttgggggatggcctttgtggataactgggcagtgggtaatgagaaggttggttattggctaagtaatgacattgttgggttggtgggaaacttggct

SEQ ID NO: 75543 - DNA, 330 bp, Glycine max
  Peptide Sequence Number=SeqID_167228
atgtcatccactatttgctgggatcgcgcccacaagacacctagtggacctggagaagtccaacagggccctggggtttccagctctggttacgggcctctatcagtcctaccgggtgctcgtcccccccaacaagggatcgtgcccgcaagacacccagtggacccggagaagtccaccagggtcctggggtttccagctctgattatgagcctttgtcagttttacgaagtgcccatctccccaacaaggtcatcaggcaccctattaaccgagctttcatcaagaagtactgtgccccccaggcaggcacagggcgagacaccatag

SEQ ID NO: 75544 - DNA, 528 bp, Glycine max
  Peptide Sequence Number=SeqID_167229
atgaaaagagaaaaacatgcctcctatagtagtcataactcttgcaaaagcctaagtgaagaactttgtgactattatgaaggaaggcataggtcacatcttaggcctctctcccatagaagagaaaaggaaagaaagcctcaagaggctaacattaaactctcatacttccatgggaaggacaatgtagaggataatttagattgggaaataagggtagagcaacaacttaaaaagaagtctacttcaaaatcttatggctctcactcttatccaaagaaagaacaaggtcaaggcatcttaggggcacttgctagcattgccacacctcttgggcttgagtttattcctcaagtaaagaagttgttggatgagggtttggttcgcaagagcttaaatccttgtgctttgttggtgcccaaaataggtattattacgcaccaagtccctaaaataggtggtatgatgaatgttttgagtggtgcaaccctcttttgtaaaatcactcgtacacctaacatcttcatg

SEQ ID NO: 75545 - DNA, 198 bp, Glycine max
  Peptide Sequence Number=SeqID_167230
atgatggatgcacctgactcaacactcagatgcaatgtgggaactgtgctgagtttgtcgggaccactcgagggtgcaagtaacagcccctctctcataggtgatcaacctggaagcccaaaggtgttccctaccaaggttgggaagcgttttttaccgaggcagcttcatgtagcttcctcaagaagctttatttaa

SEQ ID NO: 75546 - DNA, 264 bp, Glycine max
  Peptide Sequence Number=SeqID_167231
atggcaagttcaacaagctttcaacaagagtcttcacaaataactatcatgaagcagaaaactaacaaaactacccatcatatctcccaaaaccccatacccacacacacccttcatgaccccgaaaatgctctcctttcgcgatttggagcagaaatgatggccaaaggttggagctttgttggggtttcaatggagaatggaggagaaagaaaaagcaacgtgaggaagagggagagagagcttctgaaaatgtggggctga

SEQ ID NO: 75547 - DNA, 276 bp, Glycine max
  Peptide Sequence Number=SeqID_167232
atgaccactagtggccaccatgagcagccattgattaccactgaaccaccacttggagaagaacattttaatcagatcggaatcctcaaaatccacctcaaggattcggttgagaataagctatcgatcctttctttcatagcctctctgagacttgtgttgtttgaagacttggggagtgtgaatctcatacatgaactatatatgtatgtatgtgcggaattgaccataatgaatatccctggtggggcaaatatagtggttaaagagctttaa

SEQ ID NO: 75548 - DNA, 132 bp, Glycine max
  Peptide Sequence Number=SeqID_167233
atgagcaagaggctccaagaggattgggctagagctgctgaagaaggccgtagggttctcatgaacctcaggggctccataatgaaggtagggtaccctagaaatataggatttttagcccttgcattttag

SEQ ID NO: 75549 - DNA, 201 bp, Glycine max
  Peptide Sequence Number=SeqID_167234
atggcgcgcatcgtgttcgcttcgtgcccctattttacgaacctacatgggagggagctaaaagggcttttagtgataattcccaaggtggtcatatctcttttgatggtttctagaggcatcatccccttcgaagaacatattgcggcagttgggactactaacaacaatacgtttatcaaagaaaaaaactctagatga

SEQ ID NO: 75550 - DNA, 546 bp, Glycine max
  Peptide Sequence Number=SeqID_167235
atgtcgtttaaggcaacaaacgacacgtgggatgttctatatgaagttgcagggcaagttgtgaggttgaagatgaaagatttagtctttttgaagtttgatttccagaatagtggagtgctgggtggttttcctccacctgttgcggcgaagaatgcattttttccaaaccagggtgtttctcaggccaaggaagaggatgttctaagagcaagttcagtcaaaaggtatggtaggaagaagcacagaacaatccctaagcctaggtcaattgagcctgatttaattaaccaaagtggtcatcagcatgcaatagcatatgttgaaggagacaagtattatggagcaaaaaccattatatcactttgggaacccaagattcagcaacctaatgagttcaacttgtctcagctttggatattaggaggctcatttgatcaagatcttaacagcattgtagctggcaggcaggcagccgatgtgggacttgggtattttcccaatacacccctttcacgcccagcacttattgggcttggtgcgtga

SEQ ID NO: 75551 - DNA, 240 bp, Glycine max
  Peptide Sequence Number=SeqID_167236
atgtcaccctatcatgcacatgcaactgccccccatggtgatcagcctgagtcacaagggagttccaaaccgagtgacatgcccccaagtacaagtattttccctcatgaaaaactacaaatgcattgtatcccattagtcgaaaacattatctttcttgaaaacaccagcatgcacagggacaaacatacattcccatcattgggttgcctggccccaattatggtatcaaaggtataa

SEQ ID NO: 75552 - DNA, 627 bp, Glycine max
  Peptide Sequence Number=SeqID_167237
ggactactcacactctccatttggagttttgtagttgtcgcaacctaccattcggcgggagggcgacgcgagggctcacgggtgcgtcttccatgggaggcaaatgcgcgaagtcgtcaccaacgtttattcgaggaaaacgtcggaaaaatcggaaagggtgtttcccttgctcctacgtattcctcaattgcgatgaggaaatcagacttacgtagttcttcgagaactaaacattggagagaaacgttaaggtgttggaccattaacgatctctttgtttttgaaaggagagaaacgttaaggcattggaccattaacgatctcttggggtggccgacaaaagcggggcttttgctcctacgtatcctcaattgcgatgaggaaatcagacctacaccgaagaacgacgaagaacgaatgaagaacgaacgaagaacgatgaagaacggtgaagaacggggaaaagagggaggtggttgccgcccaggcgagctgggttgcttccaccagaaggcaccaccttctgttggaacaccctggaaggcccaacggtcaagcaaaggttgcatgccaccaaacaatggcccccggacgaaattagcgtatgacagtagtgtcctctaa

SEQ ID NO: 75553 - DNA, 567 bp, Glycine max
  Peptide Sequence Number=SeqID_167238
atggttaagccgaagcaacagaagaagctaccccagcagaagcaacaacacccacaagttcatttaaggaatgctaggagtagaagtagagtaaattccttctcttatcaatggtgctttcatcagccgcgctctctgtatctactgccactatccctcttggtcactgcacccaccgctgaccacaattctcgtaactcagccactgaacatctggaagatgcggttctccgcctcacacaggatctatccactaatcaggagttagccgttatgctcgacgtcatcctgttcggttatcggctctcactaccactccatcatctcccaaatcaccgtcgcttcccttccacgtcaaccaaccagattcgcaaccagctttgcaaccttccaccgcgacgtcaccaatcatggcatctgcaccagtcgagcagcgagtcacgagaagacactcgaaatagagcgtgctctaacaaagcagccaccggtcttttaatggtgattttccaccatggagatgcagcggaagacaaaggaaaagaggtgagaggaggcgccatccattaa

SEQ ID NO: 75554 - DNA, 582 bp, Glycine max
  Peptide Sequence Number=SeqID_167239
atgattgatgcctggaaattggatattctagtcatgatgtgggctttccttccccggtcttcaaatttagcacaagcctctgaggaggatttgattctgatgtgggctttccttaccggtcgtcagattgactgggcccacttggttcggtaccgaatgcataaggcattatgggccaatgcacctctcccttatccacaattgataactttgtttctgcgtcattttcaaattccgcttgatgatgaaccatttgttcaagtcaagcgttcctttgcaattggtgctggtgcagtgacttcctttggttaccgtaaggatcggaatggtcaatggctgaagaaagatgcactccctcctcaagatgagcgtactccttcacctcctcctcagcgagatgattcagcactcatgaatgaagttcttaccgaattacgaggtcttcgttcttatgttggtgaacgttttgactcattggataaacgttttgccagcatggatattcgcctcacacagcatgaagaggatgtgggttacattcgtcagagttttgatcttccaccaccacctccaccttcttag

SEQ ID NO: 75555 - DNA, 876 bp, Glycine max
  Peptide Sequence Number=SeqID_167240
atggaaggatttttagtttctggaaaatatgttgctttgcaaatttgtgatgacaaagatgttgaaaccatgctcgaaagttttcaacaacaaaatcaaatgtcagttttggaattgtacatagaaaaggatgtgactggtggttctatgttttattctgcaaattctcttacatcatgcggaaataatttatctaataatgaggcacaaccgccaacaaatgtgagcaacttacatggtgatgaagatgatgatgatgattatcttgtgtctaattcatacgttgaagagtctttagatgaagatgatagtgttgatggtatatctgatacagacgatgaagtcaccgacataattcaaccagtaagaattgttcacccaacagaaggtgtacaaggaattgaaaatccattttggagtgatgctttgtattataacaatatcgactggagtcatcttgatgaggaagacatttgtgatttggagatgtcatcgagttttaatgttggacaagaattatatgttggcatggattttgatactaaagatgcggtaaaaaaatgcactgaaacaatatgttatgaaggaaggattaacagtgaatttgcctacaaggtgtcgtacaaaaaagcttggttggcaaagcaaaaagccattgcacttgaatatggcgattgggaagagtcatatgcgaaactttcgttgtggctaacacacatgcaaaatcattctcgtggatcatattttcaaatactacatgacgattttattgttgggaacacggggaccctcttagtggccacattacaagatgaaaatggtggtgtccttcctctagcattcgccgtggtcgaaggtgagacgttaacagcgtga

SEQ ID NO: 75556 - DNA, 234 bp, Glycine max
  Peptide Sequence Number=SeqID_167241
atggaaactgatggtacatgggctggacatatggaattgcaggcagcttctcctgtaacgcgtaaacatgtccctcggtggtacataagaaattttggggatcgtggaattcgtatgatccatttgtcttatcatgatggggagcattataacagtgtgcggttaaaggatgatccttttgatggacctgcaaggccaattgtaattaaggttcttattatttctgtttgctga

SEQ ID NO: 75557 - DNA, 363 bp, Glycine max
  Peptide Sequence Number=SeqID_167242
atggtacacttgagaatcctatcacttaaaaatgatgagattaaagaatatgtagattgcagatatatttctccctgtgaagctacttggagaatttttggttttccaatacatgctagaaagcctattgtcaagagattacattttcatttgttaggccaacacagtgttatttatgaagatgatgatgatatagatgatatcctatcaaagccaagcatttcagattcaaaattcttagcttggatgaataacaacaaatgcttttcagaaggtgtcattactaaacctaaagaactttggaatcagacatggaattggttagctgaagacattgcatatcattatttgtatgctgaataa

SEQ ID NO: 75558 - DNA, 270 bp, Glycine max
  Peptide Sequence Number=SeqID_167243
atggtcagtggcatagttagttcaagacagcacacctttatgagctcaatggtttcaactccaagaccaacaccttcaacaactttcctaaaatcatcttcagcccagaaagtgaacacctcaaaggtttcccctgaaatcttgaaaaatgttaaaacaacaataattaggaaagccttgattcaagatttcttcaagatcaagccttgcctcacaatgaaaggtttcaagtcattcaaggcacatgtaatcgattaccaatacatgtaa

SEQ ID NO: 75559 - DNA, 987 bp, Glycine max
  Peptide Sequence Number=SeqID_167244
atggagtattacgatgagagtatcttaatggctttagtggtggtcgtaggcaaaccagtcaaggttgatatcaaaaccattaatgtgtctcatggaaagtttgcacacatctgcgtggaaattgaccaaaaccaaccagtagtgggtagagtttggtttagaaacacatggttcaatgtggagtatgaggggatgcaccttatctgcaatagagcgacccaagcgaaggaggggggatctggtgtaaaccctagcaaccacaacattatgagggctcgacccgactcatctaaaggtagtaatggcaactttggtcaactagttatactaactcatgaggctaacatgaacatcacaaaggctatagacaaccacaagggcacagaaaggcagcttgagggaggacgtcatgatggtggtggactcaacttttggtctagcgtaagaagggcttcgaacatttatgtcttttgtcatggaacgttatgggctttgccaacaagcggagtcatggccatgaaaagaagcaagattcatggtctccgtcgaccttctagagagtggtatattgataaccaaattcttcatgaagaggcaattaaatatttcaaaaccctcttctgctcaagagaaagcataagcagtaaggaattgaggtgtgatgtggggacactcttactagaggctaggagggcccttaccaatcctatcaccaaacaagagcaagttgggtatagtgtttggaggtttgtgccagatgcttttgttatgggtcattttgatgctaggataatcgagactttcctcactcttcagctttttggttttcttgaagttattgtctccctaatcatgcacgatatttcttccactagcatctccatttgttggaacgacaataagcttgagggatctaccctatgctttggagccaagaacaacaaggaggtccatgagggtaactgggagcctattcaactatcttga

SEQ ID NO: 75560 - DNA, 297 bp, Glycine max
  Peptide Sequence Number=SeqID_167245
ggtacatctacatgggttgttgtaactgagaacaagagagggtacatctcttgtggatcagttcaagtggagggtacatccacttggttgttcaaagagaacaagggagggtacatcccttgtggatctttgcttgaatacttgacatatactggttcactcaacctgagctacattcagctctctgatgcaatcctccctaggaagggaccagtcaccagagctatgagcaaaaggctccaaaaggattgggctagagctgctgaagaaggccctagggttctcatgaacctcagg

SEQ ID NO: 75561 - DNA, 309 bp, Glycine max
  Peptide Sequence Number=SeqID_167246
atgtcttccagaaaaagaaagagcattggtgcaaggcccacaactcaatatgacacaagaaggttccattcctttgaggcctggaccagatatacggaaaatgtgctaggaagacatatactagctaagaggaaggtagaaatataccatacggagttggatgagttcatggctgaattagagaggcgtaacttccataagcgcctcatcaatttagctgacagtagcattgacctagccttggtgaaggagttctatgccaacctcgacagccccgaggggccttcaccaaaacaattcagaatctga

SEQ ID NO: 75562 - DNA, 291 bp, Glycine max
  Peptide Sequence Number=SeqID_167247
atgggtgaattttcaaggtctagaagaagggggctttcaaaagaagttagaattagaggcattgttgaaggaaagaaggcgataatctctccagccaccgtagctagtgtgtctggatgtgcagaagaagggaacattggagttgatgtgtttaagatggcatcgtctgttagggacttgcaattaaaaggagaaactttcatgaagatggggattgctaataatttcccagaatatgctcaaaagcgtataaagagaaacatcaagaaggagcccaagcaggaatcatag

SEQ ID NO: 75563 - DNA, 1210 bp, Glycine max
  Peptide Sequence Number=SeqID_167248
acccaatgaaaggaaggcataccctcatgggcttcaatttagccccaatgaaaggaaggcataccctgatgtgaacaagaatgtagttcttccatgggatcgcactacctcagaatatggccctgagctccgaatgaagctatgtgcttacagagaagagatcagattaaggaaagcttcattcagaaggattgaaaagcttaacattcacatgcctttcatgcatggatctcaattctcttgcctagctactctagaaacccagttccaaatagcaatggacaagcctatgttgtatcaaaaggctaactgctacaagggcaaaaagattcttattaaagatgatgaagatgctcctctaaccagatacgtgaaagctcatttgttcaaacatgagcttgagactcttaagttctacagacttaaagctcattactctattctagaaccaaatgagaagcctcctacagatgtagttcatcatgagatagggcatagacaagcgagttcttgttatcagaccttgaacaatacattgttcttgccctactccagattcactttcactcatcatgtgcaacctatcattgaagaagtggattctgatattgaagttgcagtttatcccaatgatgtggctattgaagaatatgatcctccaccctcaagggagtatgtcagattaggagtggctaacctactaaagacaaatgaagcacttgcacgtgatcttgaagattgtgattatgttgaaaaagaagttgtgaagtggcatctgattggatattatttttacaagaaggtcactggacgagagcctctaagaactcctactcctccaattagcccaatatttcctgctccttttgatctcttatcagattctgattcttctagtgatgagttttgcaggaagcttgatgaaaaacctaccaaaaaaagggggagaaagttgttgcatcagaatgtcttccatcttccatggagaaagggagttttgacatcaagtttctctaactctatgtccaaagttgtcactagggccagcaaaacaagtatggaggcatctgggaatagtgatgaagcctctgcatttggattatcagtgattgattctgctaaagggaagaagaagaaaggaaaaggtggcaagaagagcaaagtggatcctaaggacatatgcaattattgcaaagaattgggtcattaa

SEQ ID NO: 75564 - DNA, 291 bp, Glycine max
  Peptide Sequence Number=SeqID_167249
atggtggagaatacatgttcagcgacgacattaaaggaggctgaagatcgagttgcatctaggctggaaacacgtctcatccatttagcgggtccaatccctcgcggtgaacattctcttaatcttcaatacaattgtggcattaggttagctcacattgattttcccagattcaatggtgcaaaggttcatcagtggatttatcaagctgaaaattacttttccattgatcatacatcgaacgattacaaggtcaagattgctatcattaatggcatactgcattcatga

SEQ ID NO: 75565 - DNA, 264 bp, Glycine max
  Peptide Sequence Number=SeqID_167250
atggacctcaaatcagaccaccagtgggagaaatgctgctttggtggtccctcttccaaacctctccaaccccattcatctaagaggaaaatgaggggtggaggttgcacagcagctcgcccaggcgagctacttgcttcctccagaagtaaccttgctcgcccaggtgagcttagcttgtctaggcgagctggtgacttcagtcctaagctttctggtggcccaggtgagccagaggctagcctaggcgagctaggggcctaa

SEQ ID NO: 75566 - DNA, 144 bp, Glycine max
  Peptide Sequence Number=SeqID_167251
atgctagctactggtaatcgattactaccttctggcattgcttctacaccaggcaccacagcagcccgaggaggatcaatagccagcggcagatgcgccaccaccgccatgagaggaggccccatctctgaggtccctctctga

SEQ ID NO: 75567 - DNA, 414 bp, Glycine max
  Peptide Sequence Number=SeqID_167252
atggagggagaaggagagagggagcacaaaattggtgcctcaaaagaggagatggctctgaaaaaactttccacaaagaggtccaggaaggacgcccctggagaatactccagtgctgcccagccagcagacacagattttgaaaggcaccgattccggagcgccaagcatcaacaacattttgagaccatcgagggatggtcattcctcagagagaggcaagtccagcgaagggatgatgagttccctaacttccaggaggaggtggctcgcaggcgctgggcaccacttgtgatgcaatccgaccccgcaagggcattggatagaagactccaagtagattgggccaaagatccaagggaaggccctagggttctcatgagccttagggtagattttgagcccatgggctaa

SEQ ID NO: 75568 - DNA, 252 bp, Glycine max
  Peptide Sequence Number=SeqID_167253
atgaagccacatatactgagggctcataagaagattgatgttgaagcatttccagatgcaaccagatgtgttacgtatgatgaagttatgttacttcaggaagccatatcagttgtgatggaagcttgcttgtggagcttctatggaggctggatctttgagcttcaatggggtcctttaatggtgattttccaccatggagatgcagcggaagacaaaggaaaagaggtgagaggaggcgccatccattaa

SEQ ID NO: 75569 - DNA, 518 bp, Glycine max
  Peptide Sequence Number=SeqID_167254
atgactataggcaatccatctgacttacaaccctttgatcctgagatagataggacatttaatagattagttaggcatcattttataccttttgatcattctgagcattccataactggtgaatctgtgcattctattattggtaattttgaacatcctgatcttgagcattataattttgagcattctgattttgcacattctgagaacatggcacaacctccacctcatgagacgactctaagggaaatggctgcacctgatttcatctacgaaagcttgtgcatccaataccccgatgaggatgtcccatatgttcttaaaactggactgattcatttgcttccaaagtttcatggccttgcaggtgaagaccctcacaaacatttgaaagaatttcacattgtctgctccaccatgaaacccccagatgtccaagaggatcacatatttctgaaggcttttcctcattcattagagggagtggcaaaggactggctgtattaccttgctccaag

SEQ ID NO: 75570 - DNA, 220 bp, Glycine max
  Peptide Sequence Number=SeqID_167255
atggcggaaaatcttcacggaatcacccatggaaatgttttggacgcgttacggaagtgcctcggtgtggattttcttcacggaaacgattttttttcactaatttcaagtgatcctcagatactaggagggaaaatgagggacgagcttgccacccagctcgcccaggcgtgcgaggttgttccttcagaaggcacatcctggaggcccaatgggcctg

SEQ ID NO: 75571 - DNA, 1065 bp, Glycine max
  Peptide Sequence Number=SeqID_167256
atgagtggtgcccgcacccaggccgtgctggttgagaaaaagcagaatttcagcgcagagtgcccgtgctgggcccaaattatccagcccgtggttcctataaccagttacgcacggaagagcagctcggctacgcggtgtttgccttctcccatgaacgtgggccgccagtgggggctgggttccctgctgcagagcagcgataagcagccagcatatctctggcagcgttaccaggctttcttcccgcaggtggaagcaaaactgcgcgccatgaagccggaagagttcgcccagatccagcaggccgttattgcgcaggtgatgcagccgccgcaaacgttgggtgaagaagcctcacagctgagcaaagattttgatcgcggtaatctgaaatttgattcgcgtgataaagtagtggccgagataaaacagctgacgccgcaaaaggttgccgatttcttccatcaggcggtgattaagccgcagggtattaccatcctgtctcaggtttccggtagccagaacgggaaaacggagtacggtgaacgattgattgaagcctcagcgggaacgggaaaaaccttcaccattgccgccctctatctgcgcctgctgttagggcttggcggcaacgccgcttttccacgccctttgagcgtggaagagttgctggtggtcaccttcaccgaggccgctaccgcggagctgcggggccgtattcgtaccaatatccacgagctgcgcatcgcctgtctgcgtcagagcacggataaccccctctacgccagccttctggaagagattgccgataagcagcaggccgcccagtggctgctgctcgctgaacggcagatggatgaagcgtccgtctttaccattcacggtttttgccagcgcatgctgagcctgaatgcgttcgagtccggtctgctcttcgaacagcagctcattgaagatgaatccgtgcttcgctatcaggcctgcgcggatttctggcgtcgccactgctaccccttacagcgtgatatcgccgaagcggtacatgagctggggatcctctag

SEQ ID NO: 75572 - DNA, 632 bp, Glycine max
  Peptide Sequence Number=SeqID_167257
atggggacaaataaaaacggcaaaaggttttatcaagtcaaggttaagggtctagatgtcaccagcctcaaggaattgggacgattgatgggacctctccaaaggcaagccttccgcaaagtgtacggaaagattctgtatttgaccgcagcagaggtatttacggaagctgtcgtatccctcgcccaatactatgatcagccgttgaggtgcttcacgtttggggatttccaaatggtaccaactgttgaagagttcgaggaaatattaggatgccctcttgggggaagaaaactgtatcttttctccgggtttcttccttccttgagtaagattgcagctgtggtcagagattcgtcaaaagagttggaccgcatgaagcaaactcaaaatggcgtagtgggcctgccgcggaaatacttggaaggcaaggcaagggatatggcgagccaagagaagtggggcccgtttacggatatactagctctgttgatctttggggttgtcctctttccgaatgtggacggtttggtggacttggcctcaattgatgctttccttgcatatcaccatagcaagaagagtccagtcgtggctatcttggtggacttatttgatacctttgaccgaag

SEQ ID NO: 75573 - DNA, 225 bp, Glycine max
  Peptide Sequence Number=SeqID_167258
atggattcatccggagactcagaaaatgaagtcgtgaatctaagtctcatggccaaaaactatgaaagtgaagaagaggattctttgaagaaaggttggtacattgatagtggatgctttaaacacatgacgggagatgcatcaaagtttactcatatttctcccaagaataatggacatgtgacttatggtgacaacaacaaaggtaaaattcttggaatctga

SEQ ID NO: 75574 - DNA, 393 bp, Glycine max
  Peptide Sequence Number=SeqID_167259
atgaagccacaactcagacttcatcataggcatcatgtaggaaacttagaagacgctggaaaaagttcaacaacaagattacttctaggaattgatttagaacatatagaggaagcaaaagaacatcacctagatgaagatgctctgataccacatcatgtaagctccattggagcctgtaggcctaggatcttcttcatcaatggattcctttgcttcttggaagatgaatggaagcggaagagagagaggagatgccacttcaaggagaagatgagtctagaagaagctcaccaccataggaggccatggataagagcttggaggaagaatgagatggctgaagggagagaaagagaagagcatgaaattttatgctctaaaaagctttga

SEQ ID NO: 75575 - DNA, 231 bp, Glycine max
  Peptide Sequence Number=SeqID_167260
aacagtgctttaaaaggtcttgatgatgctccacagcctaaatcaaaggctcctgctaggtggattgtcgtcaagtgtaatagacaaaagggaagtactgagtgcggctactatgtcatgcactggatgtccaccatcattttaggaacttttaggaataactgggaagcgaaaaatgatgtcaacctccctcatgcatacacttattttgttgtacttctttgtttataa

SEQ ID NO: 75576 - DNA, 436 bp, Glycine max
  Peptide Sequence Number=SeqID_167261
gcttaaaaacgagaccaggaagctaagagggcttctggtaatcgattaccaagggaggaataagccactggtaatcgattaccagatcgtgatggcggcacaactaatccatgatcgagtggagatggagtggctagagggagcttgggagaccctcgaaggcaatgcgaggtgccgatttcgaggcacgattcgattcacagcaacttcaaagtccaagtgtatcgaggtgacgtcatccgaggaagaccctgaggagaatcctgaggagctatctcctgagcctgctgtggatgctcttgactttctagaggatgatgaggacccactccctgaggtggattctcccgaggacgtcatgtcggcatctgaggcagactctacggaggatagtggccctggagagatggcgatcagtggaggctcttcatcatag

SEQ ID NO: 75577 - DNA, 138 bp, Glycine max
  Peptide Sequence Number=SeqID_167262
atgtttcgtgtccctagtaaaatcagctcgcaacaagcacgcgcactgacagcaatgtgtgatgtcatgctggttatgcccagagctcttacagaagatccttcaaatatattttcccattcctttaatgaaagatga

SEQ ID NO: 75578 - DNA, 1118 bp, Glycine max
  Peptide Sequence Number=SeqID_167263
ccccgggccgccagccagcgcgccagccggtcatagcgcccggcgtgctcgctcagcccatgcagcagatagatgctgggcgtgcccgggccgacgatcggcgaaggcacattcggggcggcgggccaggcatgattggccaggagcgtgccgtcgggcgctggggtcatggaaatcggcgacaatttgtggctgtcctcgaaatgaaaagaccgtggggtctttacggtaatgacgatttcatcgctgtttcgtttcatgttcaagaaagccggcctgattcttgtggtggccctgctggccagcgcctgctcgccccgttacaactggcgcgaggtcgacgtggccgatggccgcgtgcgggcggctttcccgaaccgcgtgcagaccgagacccgccagttgcggctggatacccatacgctggatttcacgctggccagcgccaccgtgggcgaggcggtgttcgccatcggctcggcgccgctgccgcgggagatcgcggccgatcccgtggcgcggcaggcgctgggcatggcgctgatgcgctcgctgtatgtcaacatgcaggcgccgccgcccaccgagtggccgccctatgggcaggacatcgacgtgcagggcaaggccatgggcaagcccggctggctgcgcgcgcgggtgtgggtgaccgacaccatgctgatcgaggccgtggcggcgggcaccgaagccagcctgcccgaggagcgggcgcgcgaattcctgaggtcggtcgtggtcaagccgtgaccgtgttcagcagtccgcgccggatggccgtggccaccgcggcgcgccggccgcgcacctgcagcttgcggcaggcgttgcgcagatggaaattgacggtgctttcgctgatgtcgaggatgcgggcggtttcccagctggtcttgccgatggcgctccagtgcagcgaggcggattctcgaggcgaaagccggacgggggcgggcgcccgcgggatggcggaagcgggtttggcggacatgacggatagggcgctgatagcctggaaaaagacaacccatgctccgacccccgatggccaccggacaagcggcgatgccgccacgtatctcactttgaatctctga

SEQ ID NO: 75579 - DNA, 642 bp, Glycine max
  Peptide Sequence Number=SeqID_167264
atgggttccccgctacaagctcgtgacgaaagacaacgattgtacctatcgccttcagagggctacactatcaccttcagagggctacacgccctcaccttcagaggactacacgccctcaccttcaaaggactacacgtcctcgccttcagaggactacacgtcctcgcctttagacggcgacacgccctcacaatcagagacctacaggtcctcgccttcagaggactacacatcctcaccttcgaagggctacatgccctagcctttagaggcccacacgtcctcgccatcagagggctgcacgccttcacctctagaggacttcacgtccttgtcatcagagggctgcacaccctcaccttcaaaggactacacgtcctcaccatcagagagctgcatgccctcaccttcagagggctgcatgccctcacctatagaggactacacatcctcgccaccagagggcttcacgccctcagcttcagaggactagacatcatcgcatttagaggaccacacatcctcgccatcagagggcagcacgccctcacctttagaggacaacatgtcctcaccatcagagggctgcacgccctcaccttcagaagactacacgtcctcaccttcagagagctgcac

SEQ ID NO: 75580 - DNA, 192 bp, Glycine max
  Peptide Sequence Number=SeqID_167265
atgaagaataaaaagaaaggtagtaaatcgagaaaggaacacataaacttacctgtttgggctacagaatggcgtctcatccctaaaactcgagaaaatggaaagattgataggggttttggtgcagtggatgagctcgtaatacaagaggcattggccattgacagcagtgataagcctggcctaggctag

SEQ ID NO: 75581 - DNA, 186 bp, Glycine max
  Peptide Sequence Number=SeqID_167266
atgggagatttggctaaagttgtgataaaacaagacatgaagggagcagagcataaatatgggtttaacaacaataaacgtgagaagccagagaagatgtgtatttttcaaggtcttcatgtcattccttcatcattcaacgtcttcatgtcattccttccccgagagtttgaagtactattctga

SEQ ID NO: 75582 - DNA, 279 bp, Glycine max
  Peptide Sequence Number=SeqID_167267
gtaatgctcgaggaaggtaacaatgtcgattacatcattagcacaagggcgaaggtgatgcaatcctatcccgcaagggcattgggtagaagactccaagtagattgggctagatatccaagggaaggccctagggttctcatgagccttagggaggagagcttagctattagagagcttctcaaggaagttttctcaaagaagcttctcaaggaagttttctcaaagaagcttctcaaggaagttttctcaagaaagcttctcaaggaagctacctag

SEQ ID NO: 75583 - DNA, 624 bp, Glycine max
  Peptide Sequence Number=SeqID_167268
atgtcttgcgtaagtgatcataactccgaccttcctctgccgaagtgtcagctggtgtatgccatcctgacacggatgagtgtccatgtggctcagttgattgctgacgccatctatttatttgcaggtatgccacccaccaggcaccctctagacccagataagtctaacagggccctggggtttctggcattgatcacgggcctctgccagtcattcggggttcccgtcactcctagtaaggtgatccgaccgccgatcacctgggccttcattgagaagtattgcacgcctaggcaggcacagggtgatgcaccgcaggctgcagacgcaccaccaccacctcatcaggctgatcccactgggtcattaggcatggagcgttatctacaacacttggttcgccagcaggcggccaaccaccgggggcagggccagggtttcgttccttttgcgtgccccactctatatcagtttagggctgaggtcgcatggcccggagattggtccgaggcccaggcaggggtggcgcctgcagaagctctcggcgatgcagaggaggcccgcatggatgaggagatgacggacttgctcggtttcttgggaggaagcggagctacgtga

SEQ ID NO: 75584 - DNA, 164 bp, Glycine max
  Peptide Sequence Number=SeqID_167269
caaagagtagaatcgtctcaggccacggtcagaagtcaagacaaatcaatggcagaaatcaaccaaggtacatagggacgaatgcaagtggggatggggtcacgaccgaccaatcgttgccccttcccggcgctaaacgagcagagaacgtcgctgcaaggtag

SEQ ID NO: 75585 - DNA, 143 bp, Glycine max
  Peptide Sequence Number=SeqID_167270
atgattacgacggctatgaggcgattgcacagaggttggagcgtgcgctcaaccttaagatggattgccagacgatcgccagaggaggagccagtgctgatggaagtgtcagggctcgacagagacgacgcacagagcattga

SEQ ID NO: 75586 - DNA, 191 bp, Glycine max
  Peptide Sequence Number=SeqID_167271
atggaactcagcctcaggtgggaggcgttaaatggcaacttctccaacatgctcttgggcatcatgttcaggcttgagccgttgtcgatgagtactttggccataacatgttccatgcatttgaccgacacatgtaaagccctattatgccctctctcctcggcgaggatttcctcttcaatgaaagtgag

SEQ ID NO: 75587 - DNA, 276 bp, Glycine max
  Peptide Sequence Number=SeqID_167272
atgacaaacctgtggctaagcgagtgctgtctcgctaagcccagatggcatccaagaagaggaaaagcactgcttccagacctcaagctcagtatgataccaagcgattccattctttggacgcttggaatagacacaacgataacattctcggtcggaatatccttccggagagaaatatgcagatttatcatactgagtttcacgagtttaaagtggaattggagaggcataatctacacaaacgcctcaccaatctccaagatggaagcatag

SEQ ID NO: 75588 - DNA, 195 bp, Glycine max
  Peptide Sequence Number=SeqID_167273
atgtttgatgttctaacctggcgccgtgatccggcgtggggacagtgtctggtgggtagtttgactggggcggtctcctcccaaagtgtaacggaggagcacgaaggtgcgaaagcaggtcatagtgatccggtggttctgtatggaagggccatcgctcaacggataaaaggtactccggggataacaggctga

SEQ ID NO: 75589 - DNA, 264 bp, Glycine max
  Peptide Sequence Number=SeqID_167274
atgaatctggggatctcccagtcacgtatctccactccctcccaagaagtcaagcaaatcggccatctcctcgtcctcgtgggcctcttctccaccgccgggagcttctgggggtgcctctcctgcttgggcctcgggccaatctccgggccatgcgacctctgccctgaactgcctggccagcctgatgaggtggtggtggcgtgcctgcggcctgtggagcatccccctgagcctgtctctgggtacagtacttctcaataa

SEQ ID NO: 75590 - DNA, 177 bp, Glycine max
  Peptide Sequence Number=SeqID_167275
atggtggttcgcacttctgtaatactcagcttcaaaagtcctttcactaagctcatgcctcacactaagcacatctctgttcatgcgctaagccgcgagtctcaagcgcttagtgcccaacctttgcatctgaggctgatttggtccgctaagctggccaaggttgagctaagctaa

SEQ ID NO: 75591 - DNA, 219 bp, Glycine max
  Peptide Sequence Number=SeqID_167276
atggttcagctacgcgcatatcgatgcgctaagcccaacatctttactttatgttgcaccttaagcagtagtggcgctaagcctaaatcacatcttaggctaagcgcatattgcagaaagattcttggtgttgcaaaaagcgctaagcgcaactgccacactaagccccaaatgcttactggaggttacaacttcaagttgggcttagtgcgaggctag

SEQ ID NO: 75592 - DNA, 1152 bp, Glycine max
  Peptide Sequence Number=SeqID_167277
atgctgaccatcgcgattgcagtggtgatattcatcatctggcactttagcgccaactcaaaaaccacccgctcggcctcctctgtcttatccgtcacggtacaaaccatacaaagcagcccactcaacagtagcctggaactgttcggcaaagtcattgcgctggaacaggtcccagtctatgccgacatgatgcaaggccgcattaccaaagtattggtggacgaaggcgaccacgtgaaagccgggcagcaactggccgtggtggacacttcactggccaaagtacagcgcgtgcaatctctggccggcaaacaacgggccatcgtcggctttagcgaggcggaagctgcgctggaagatgcaaagaaacaacttgagcaggcccgtgcagaaaaagcacgcggcgaaaaagtggctgaggacgggttgatttcaaaagaaaccctggagcagcgcgtgcttgcagaacaagcggcagaaagcaaagtcaataccgcacgcaatcagttacgtattgctttatcggacctactggcagccaatgcgcaagtggacgaagctgatctcaaaataaaacaggcagaattgattgcgccggccgccgggcggattatccagaaaaacgccgtggtcggccaagtgctgggccaggccagccaaccgcagtttttactggccaaagacgacacactggaagtcgatattcaaaccacacccgaagaagcgacttccctgaaaaatggcatgccagtcgtgattaaagttgacggcatgtccggcacttaccgtggcactatccgcaaaaaaggcgtgatggtccgcgacgaaaaccagatggtgcacatcaaggtcgcttttagcaaagcgccagaactgatgcccgggcaatccgccaccgtgtcggccaagctgccacatcaagacggtatccgcctgcccgacagtgccatcaccgccgaaggcaatcaatactttgtctatacggtggagcagcaacacgccaaacgcattgcagtatccataggccagcgtgtggatggccaggtagagattcttgacggcgtcacgccgggtatgcgcatcatagacaagttcgctggctttgttcgtgatggcgaacccgtcaacgtcatacaggcagcgaactaa

SEQ ID NO: 75593 - DNA, 903 bp, Glycine max
  Peptide Sequence Number=SeqID_167278
atggtagaagccatcgcatccctcactcaatactacgaccagtcactcagatgcttcactttcggagattttcagttggcaccgaccatagaagaattcgaagggatcttagaatgcctgaactgcttggagaaggcaaaagctttggcggatcaaggggcgtggacctcattcattgatatattagcactgttggtgtttgggactgtactatttccaaatgtagacgggctagtgaacttagcagcgatcgatgcctttcttgcttatcatcacagtaaggagagcctggtcatcgctgttttggccaatgaatatgatacgttcaacctgagatgcgagaagagcattgcaaggattgtctattgtacgccggctctttatgtgtggttggtctcccacattttttgtcatgaaggtaggcctgtctgtcctctacaaggattcccaaacatccccttgataggaacaaggggttgtattaattataatcccatgctggccataagacaactaggctaccctatgagaggtgcaccattggaggagatcatcgcgcctttcgtcgcacgaggtttcaatgaagccaatgtgaggatacttcagagaatccataaagcatggaatacagtggaaaggaaagataaggagcttaggggaagtagcaatggcgtcatcagcggctatcacaagtggttgaggtttaggaggcaagggataacttggctcccaaagcttaaaggcccaagtgggaaagaagctgaagtccttgaggaaagtgaagaagtgcaagctttgaaagcggagctcgaaagaatgataatggtcaaggagaagctaaagacgacagtcactagggtcaagaaagagtgtgatgagctgagagatgtcaacatgactatg

SEQ ID NO: 75594 - DNA, 906 bp, Glycine max
  Peptide Sequence Number=SeqID_167279
atggctggttgtggaaagggttgtacatattgggttctggacgttttctatcagatcccaacgcttggagggattgatggggacccagtgttgagaggaacgaggataagggctacgtgggagtacgtgaactcagttgaaggtgtgcaactggggatggtggatttatgtgtgatttgtggatgtggagagtcgacttgcaccattgcccgatcgccaccttgtaccacatatgacggagtggtacctgaagatatgtcgcgggggtcaggagaccttggggacgtcaggcgagctcctggcagtcaaccgataaaagaacaaagaccacaaagcaaggaggcttgtgtggtggctggccagctctggatcttgagtgatatttggaatatggcctctggtaatcgattacaaaggagtaacaggtcactggtaatcgattaccagttatgtgtaatcgattacacagtgtatattgctggttttcatgttctgaagttgtgtaacttgagttggcctctgggtggacctgggatgatcacaactgttatccaggttgtaaagctgatggataatcttcagtctcgaggagcattaaggactcggagggaatgccattacatcaatgctgaatatttgttgagcgagcttggtcatttgaagaaaaaaagtgccaattggaataacactcagggagatgaagaaattggttcatcctcaacaaaggtgtggacacaagatatcaaaaacaagcttgatgatgttattaaaggctttgcactacctctggcagtaacagtgacaaagatgatcataaatgaatctcaaattgatctaaggagaaggaagaaacttgttcttgatggtgatttggaaagacaaatcaaagatctccatgagaagtag

SEQ ID NO: 75595 - DNA, 939 bp, Glycine max
  Peptide Sequence Number=SeqID_167280
atgttggaaaactatagtcatgccaatgacgtacttgttaccatcaaggttactagccttgcgagtcttactgaaagttgtgccgggtgtttcacgacgataggtgatgtgtattctatgacaagaactattggagttcccatgacaaccattgaagccaggcttgaatctgtgccagagatgggatatgatgccctctccaatgtaccccgtggagaaatttgtttgagaggaaataccttgttcttcggttaccacaagcgtgaagatcttaccaaagaagttatggttgatggctggtttcatacaggtgacattggagaatggcaatcaaatagggccatgaaaattattgatcggaagaagaatctctttaaattgtctcaaggagaatatattgctgtggagaatattgaaaacaagtatttgcaatgccctcttatagcatcgatttgggtgtatggaaacaactttgagtcattcttggtggctgttgtggtccctgaaagaaaagccattgaggattgggcaaaagagcacaatttgactgatgattttaaatctttatgtaataatcttaaagcaagaaaacacattttggatgagctcaacaacactggtcagaaacaccaaaacaggaaaccatcaagcatgtacagaggagttcaacgcaggaaatgggggaaatatgtagcagaaattaaagaccctaaggagattcgtaaacttactgaccatggcgggtcacagcagctacacttctgggagatgccacacaggtcacaggcacgggctctctcacgtactcacagcatgagctccactgcacacaatgggcacagcagggagaagggggttagtgtatgggccacgcgcgtgaggaacaaagacgggcttatcagaggaccgtcgttgccttacattaaggtaacattctaa

SEQ ID NO: 75596 - DNA, 231 bp, Glycine max
  Peptide Sequence Number=SeqID_167281
atggcagcggaatggagaaggaagaaagagaggagacgccacttcaaggagaaaatgagtctagaagaagctcaccaccataagaggccatggataagagcttggaggaagaaggagatgaatgaagggagaggaagagaagagcacaaaattttgtgctctaaaagagctctgaaatctgaacacactaatccaagatcaagtacaagattctccactaagtgtgcttag

SEQ ID NO: 75597 - DNA, 255 bp, Glycine max
  Peptide Sequence Number=SeqID_167282
atgaccccttcacagcgatatcatggcccaattccaacacctaatgccccattaggaacacaatggaatgtaccgggaccaatacctaatatgggtgacttattaggtgttgatttgcatcacaaattttctggtgaagctgacgaagaagaagcagggaggcatcggggcagaagaaatcctgatcgccaagcacgaagatgggatcgaccatgttgcacatcctcacggcatcgcggacaccaaaatgaatga

SEQ ID NO: 75598 - DNA, 165 bp, Glycine max
  Peptide Sequence Number=SeqID_167283
atggggatacaaaagaattctcaagcgggagacacaaaagaattcaggcggttagtccttcgttcttttgaaaaagggagaagagagacacaaaaagaattcaggcggttagtccttggcgaattctttttggcaaagggagaagagaatgaaaaagatgaatag

SEQ ID NO: 75599 - DNA, 616 bp, Glycine max
  Peptide Sequence Number=SeqID_167284
gtgggcaactggggatggtgtgcttatgcctatgcttgtgaaaatgggatatttgttttgcgccatcgcccaatcgccacctagtaccaaatatgacggagtggtacctgaggatatgtcgcgggggtcaggagaccttggggacgtcaggcgagctcctggcagtcaaccaataaaggaacaaaagtccacgaagcagggaggcttgtgtggcggctggccagctatctatcttgggttgttatctgaaaaattccctctgatcgcgatggcagcgcagttgatccatgatcgcgttgtaatggagtgcctagagggtcaacccgcacgcacacttcagcaacctgtggagtggatactacctacacctactccatatcgactagttgagcctgttcaattgatagaggtgtcatcatctgaagaggatcttaaagaggacccagaggagctacctcctgaacctgctgtggatgcctctgacttaccagaggatgatgaggacccgctccttgatgttgattctccagaggatattatgtcagcatctgaggcagactctacagaggagagtggccctggagggacatcgaatagtgatgactcttcatcatag

SEQ ID NO: 75600 - DNA, 297 bp, Glycine max
  Peptide Sequence Number=SeqID_167285
atgaaatttaagcactgccgcaacctacccttcggcgggagggcaatgcacggctcacgagtgcgtcttccaagaaaggaaaatacgcggagtcgccaccaacgtttatccgaggaaaacgtcggaaaaatcggaaaggtgtggtctacgaaatttaatcgtgaaaggttcaggagttgtttttacgcacggggaagtccatgtttaactgataaaagcaaaaaggaccgcttaaggcgttggaccttaaaacggtttttagtgatttttacggacaaagctcgatttgtgagttga

SEQ ID NO: 75601 - DNA, 117 bp, Glycine max
  Peptide Sequence Number=SeqID_167286
atggcgatgtcaatgcgaatcccatggtggtgttatggtgtctccatacactcggatgctcaagttaatattggcaggaggggaatcattatcattgtgtggggcacacatctctaa

SEQ ID NO: 75602 - DNA, 300 bp, Glycine max
  Peptide Sequence Number=SeqID_167287
atggattcttttggagttaatgttgatgagaatgacaatgagagtattgatgtggatgtgcataaaaatattattcatgaagatgaacctattgaatctaaaatgtcaaaaaagagggctagaaattattcatcacatgtgtggaatttttttgagaaacctgttatacatagtgatggaaatgtgaggagtaaatgcaaatattgtttgaaagatcatgtgggcggtgacaataagaatgggacttcaaccttacaacgtcatatggggaaatatgatgtatatttgaagacattctaa

SEQ ID NO: 75603 - DNA, 1065 bp, Glycine max
  Peptide Sequence Number=SeqID_167288
gctaaggatccaacaacatctttagcccattattttgatgtgatatcaggaactagtactggtggcctcatgactgctatgttagcagccccaaactcatctaatgccaatagtcctctctttactccctcggatgtcgtgcaattctacaagaaatatggccctaaaatatttgaacctactagagcttggtatgagttttacgaatgtcccaaaatcaatggagaggtcttacatgatataactcgtaagatattgaaagaaacacgactgaataaaacattgacgaacgtggtaataccaactttcgacgagaggaaaatcaagccagttatattctccaactataagctcaagacagaaacttacttaaatgccaaactctcagatatatgcatcgggacttcggctgcaccgacttatctaccgccgcaccaatttcagaatgatggcgttcaatttgatttggttgatggtgctatgtctgctaataatccagcgctggttgctgtgagtgaagtgatacaacacaatgagcataaagaaatcctgttgctgtcattaggaacaggaacaataaaagctgaggagaagttatctggcttctttgatgacttgcttgatgacttgtatgatgacttgtgtggacttaagtggctagctagcagccgtaacgtgttttatgaggctctatatagtacaaacatgatccattactatcttgcgacggtgtttccaggtgttttgcctgcggataactatcttcgaattgaggagtataacctggatccatccatgaaagaaatggataatgctgacaaggaaaacatggataagcttgaaaaggtaggaaaaagccttttgctccaaaaagctttgaggatgaatgtgaatacttttgtcccagttgaactagaccaaacaaatgctgaagctcttgacaggttgtctgagaaattatatgcagagaggcagttgcgtctgaaaaggaaatctatggaaaaaggaggaagccgaattattgaatctgtcaaagtcccttctggccgaatgcatgcaacttaa

SEQ ID NO: 75604 - DNA, 372 bp, Glycine max
  Peptide Sequence Number=SeqID_167289
atggcggaggacacgaacaacaacttcaatggaggatgtcaacttcagaaaggaacaacagcttcaaatgaagggaaccaaatttcaaatggagaaggaaatgagggcgcgaaggaagaagggaatatcggggaagaagaagcacgaatggagattgctgggtgcacggggaagaaacaagcgcggaagcaaggggaagaagaaagcaacagaaaaataaaattagaaaagagaaacagcagagctaactgtgcgcgacgacagaggtctggcatggtcttcgcgcggcaacaatgtgaagcaacggaggcatttggttcgcttgcgggaaatgtgaaggagaagaagaaggtgcatgagaatgagaactga

SEQ ID NO: 75605 - DNA, 210 bp, Glycine max
  Peptide Sequence Number=SeqID_167290
atgcaacctaaagtactaaacctcgatccctcaaatccccaactaaggtatttaaccagccatacaaggaaccctaatgcaaatgagacagaaagctctaaaatcacgacgtcgcgcttagcgccaccctcgcgcttagcgcaagtaagtggatttgagcttagcgccagtcatgcgctgagcctggctaaagacaaccatcacgcttag

SEQ ID NO: 75606 - DNA, 366 bp, Glycine max
  Peptide Sequence Number=SeqID_167291
atggcagcccaagatgaagaatcagaagatgaagaagacttctcactctttgtgaagaagtttcacaaatttgtcaagaagagaagaatcgagaggcgtcaaaatttcaaccatggaaaaagatttcaagaagactctccaactcttagatgctacaagttcaaccaacttggtcacatcaaagcaaattgcccctcaaatgagcaatggcctgagaagaatgagaagaaaagtcatgaagaaagaagatccaagaaggcgtatattgcatgggatgacaatgactcatccgatggttcggaaaaggatatcaaccttctatccaaggactatgagagcgatgagaacatctctcaagaagattaa

SEQ ID NO: 75607 - DNA, 345 bp, Glycine max
  Peptide Sequence Number=SeqID_167292
atgggggagtctctggttgtccaccagaaatccatgttagagaggaagataacctctagtgttaaggttgttgctggagaaaccgccgatgatgacattaacatcattcctgttgagtttgatgaggaagaaactgaggaggatgtttatgagtcatttaggagtgaaacatatttaggagatggtggtgatctggttgttgttggtggtgtattagagaacattgtagggcctttttcccttaaatctaagaaagtaaagggtataagtcctagaaaacctagggagaaaaagaaataccctccaatcattctcccaggttacttaggtcactggaaaggttaa

SEQ ID NO: 75608 - DNA, 315 bp, Glycine max
  Peptide Sequence Number=SeqID_167293
atgcatgctttgttagggtcattcaacattggaaactggtttgattctaaagtccttgatagtacgggactaagttgttgtgctatcacaaggaatcaggagagcgacggtggaggagtgaatataggagcacgtgagagtgatcgagggttcggagaggaaagggagaatgagaaattttgggaatggggaattgtggtggagcgtggaggaggacgcgaatgcttggcggagccagcaaagttggggtcgatggagtctagggctttgaagagggtgcaagaggaatttggacctgaaaaagggttggaatga

SEQ ID NO: 75609 - DNA, 702 bp, Glycine max
  Peptide Sequence Number=SeqID_167294
atggggacaaatcaaatcggaaaaagattctatcaagtcaagattaagggcctagatgtcactagccttagagagttgggatggttgatgggacccctccaaaggcaagccttccgcaaagtgtacagaaagattttagatttgaccacaacggaggtatttacggaagtcgttgtatccctcgcccaatactatgaccagccgttgagatgcttcacgtttggggacttccaaatagtaccaactgttgaagaatttgaggagatattaggatgccctcttgggggaagaaaatcgtatcttttctccgggtttcttctctccttgagcaagattgcagttgtggttggagattcaacgagagagttggatcgtatgaagcaaactcgaaacggcgtagtgggcctaccacaaaaatacttggaaggcaaggcaagggatatggtgagtcaagaagagtgggtcccgtttgcggatatactagctttgctgatctttcgggttgtcctctttccaaacgtggacggtttggtggacctagccacaattgatgctttccttgcatatcaccatagcaaggagagcccggtggtgcgagaagaacagcgcacggattgtctgctgcctacccgctctttgtgtgtggttggtttcgcacctattccaaaaagacataaggcactcgtgtcggggatcctctag

SEQ ID NO: 75610 - DNA, 201 bp, Glycine max
  Peptide Sequence Number=SeqID_167295
atggtttttcacttaaggcttgtaatgagcttcaaaacaaagaaaggggaacataggctcaaaggggctatcaaaggaattaattcaaggaagcatcaacaagaattaagccaaggctattgtgcaatcaatcaatggggaaaaacacaccaaaagattatgatgatggatggctcaaattctgacaaagaggaaaaataa

SEQ ID NO: 75611 - DNA, 837 bp, Glycine max
  Peptide Sequence Number=SeqID_167296
atggctgctcgattttcccgcctgttaagcttgtgcctggcactgctgttttgcctgtcggcgcaggccagcctgttctcgcccactaccaataaccgctttgtgccggtcgatcaggcctttggctttgatttcagccagcagggtcatcagctgacgctgagctggaaagtgaaggacggctattacctctatcgccagcaattccacatcagcgcgcaacacgcgcagctggcgccggtcacgctgccgccgggccagccgcacgaagatgagttttacggcaagagcgaaatctatccgcaggacgtacagctgccgatcaccctgcgccaggccgatgccggtgcaacgctcagcgtgacttatcagggctgcgccgcggccggtttctgctatccgccggagacccgctcggtgccgctgacggcgattgctgccgatagcgccacgccggcaatcgcggcatcaccggccgctgaccgcacgccgctgccgttttcgccgctgtgggcgctgctgattggcatcggcgtggcctttacgccgtgcgtgctgccgatgtatccgctgatctccggcatcattcttggcggccagcgccgctactcgctgggccggctgttcgccctcgcgctggtctacgtgcaggggatggcgctgacttacaccctgctcggtatggtggtggcagcggcggggctgcgtttccaggctgcgctacagcatccttacgtgttgatcggcctctccgtgctgtttgtgctgctggcgctgtcgatgtttggcctgttcacgctgcagctgcctgccagcctccagacgcgtcctgacgct

SEQ ID NO: 75612 - DNA, 591 bp, Glycine max
  Peptide Sequence Number=SeqID_167297
atgggtggtggtgcatggccgttcttagttggtggagcgatttgtctggttaattccgttaacgaacgagacctcagcctgctaaatagctatgtggagatcattgcaattgttggtcttcaacgaggaattcctagtaagcgcgagtcatcagctcgcgttgactacgtccctgccctttgtacacaccgcccgtcgctcctaccgattgaatggtccggtgaagtgttcggattgcggcgacgtgagcggttcgctgcccgcgacgttgtgagaagtccactgaacctatcatttagaggaaggagaagtcgtaacaaggtttccgtaggtgaacctgcggaaggatcattgtcgatgcctcacaatcagattgacccgcgaacttgtttattcatctaccgtcgggagggaggggatgaccacggcgccccgtgcgcccggcctcctcgtcctcgcgacaaacacaaaccccggcgcttcaatcccgtgaaccatcgagtctttgaacgcaagttgcgcccgaagccattaggccgagggcacgcctgcctgggtgtcacacatcgtttccccaacgcaaacatgtaa

SEQ ID NO: 75613 - DNA, 363 bp, Glycine max
  Peptide Sequence Number=SeqID_167298
atgtgtagaagaaacaacgttgcaagaagaaagaaggaacaacaaggggatcaagaaccatcatcctctatattatctttttcttttccacatcccaactttgaagaacacatcatggcagaagaccggccatgcaggatcaccttggaggactactctagtacctctacacctcagtatttcataagcatagccctgctcaaaatagagatttgcaacacaatgaaaatagtcggagttcctgaagatgccatccacctcaacctattctccttctctttggctggtgaagcaaaaagatggttgcactcgttcaaaggaaatagcttgcggacatgggaggaggtggtggagaaattttga

SEQ ID NO: 75614 - DNA, 414 bp, Glycine max
  Peptide Sequence Number=SeqID_167299
gtcgactctagaggatcccacattgagaagtattgcacgcagagacaggcccagggggatgctccgcaggccgcagacgcgccgccacctcatcaggctggcctagctggatcatttgatacggagcagtatttacggcatttggttcgccagcaggcggccaaccaccgggcgcatgtacagacccatgattgtctttaccagttgagcctcagcctgcagagccagggttttacttcttttccgtgccctactccggatcagttcagggcagaggtcgcatggcccggagattggcctgaggcccgggcaggagaggcaccagcagaggctcccgacgaggcagatgaggcccgcgaggacgaggagatgaccgatttaattgatttcttaggagggagcagagccacatga

SEQ ID NO: 75615 - DNA, 120 bp, Glycine max
  Peptide Sequence Number=SeqID_167300
atggtgagggatcccaaggcacgggaagtggttgatcaaggttgtgagggatcccaaggtgtattcaaagtctgtaaaggatttacagagatagtggaaaatctcaagtgggttgcttga

SEQ ID NO: 75616 - DNA, 438 bp, Glycine max
  Peptide Sequence Number=SeqID_167301
atggagcgtggtcatggaatgtattacacgccaacaacattttccgaatatccttcacagatgtatcagtatccttttgaaggtcatcacactgatacttctgcgagcgaacattcgttcggtggtgttgcggaaacacaagctcatttttcatggcccactatgactccttcgcagcaacacgatgcccccatggcaacacctaacgccccatttgctccgcaatggaatgtgttgatttgcgttaggaattttctgctgaggctgagcaagcagaaacggggagacaacgcggcagaagaaatcctgatcgtcaagcgcgaagatgggatcgaccatgtggcacatcctcacgacatcgcggacaccataatgactgattttatgtctctgtgtaaatttcttgttgtttgtaagacatttgattttggcaattaa

SEQ ID NO: 75617 - DNA, 363 bp, Glycine max
  Peptide Sequence Number=SeqID_167302
atagatgtatatgcaggcacactatctatggagtttggtgatataattgttcattttaatattcttgatgctatgaaacacccatctgaagatctttctgtatttcgtgttgaaataattgaccatattgttgatgaatacatgactgatcttcattctaatctgcatgtctatcactcttcatgcattgaattgccttacccctcttgcatgcgagagcgtgcggtgactaccacccctatcattcaggcacctgattggacagccccattcgagctaatgtgcgatgcatccaattacacattgggggttgtccttgctcaaaagatctccttacttcagcttacttcttttccaccatga

SEQ ID NO: 75618 - DNA, 282 bp, Glycine max
  Peptide Sequence Number=SeqID_167303
atgaggagaagaggtgagaggaggcgtcatccactagggaataagccatggaagaaggagcttcacaaccacgagattgtcttggataagaagcttagagaggaagcttcaatggaggaaaagaaagagagagggggggagcacaaaattgaaggaggaaaagagggagagaagttgaactttgaagtgtgtctcacaagactctcattcatcaaagttacaacaagtgttacacatgcttctatttatagcctaggtagcttccttgagaagcttccttaa

SEQ ID NO: 75619 - DNA, 279 bp, Glycine max
  Peptide Sequence Number=SeqID_167304
atgtgcttgtgcccttgtgcttttgtgctttcttctgcctacacttcaagtcatccttgcatcattcttgctttcatctcacatccttcacttccatccaagctaagcgcgccctgtgcgctaagcctgagtgtcattctgatggcatcaaagaagagaaagccacctgccacacctttccaggtccgatatgaccgatccaggttcacttctcttgaggcctgggaaaggtacactgatattatggtacctagaaagataatccctgagcgaaatgtg

SEQ ID NO: 75620 - DNA, 464 bp, Glycine max
  Peptide Sequence Number=SeqID_167305
ttaggccaccacttcaagaactctgtagcaccgcctacatacctcgctctgctaatcctgttaccagtggctgctgccagtggcgataagtcgtgtcttaccggggtcggaacaggagagcgcacgagggagcttccaggggaaacgcctggtatctttatagtcctgtcgggtttcgccacctctgacttgagcgtcgatttttgtgatgctcgtcaggggggcgagcctatggaaaacgccagcaacgcggccttttacggtctggcctttgctggccttttgctcacatgttctttctgcgtatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaat

SEQ ID NO: 75621 - DNA, 384 bp, Glycine max
  Peptide Sequence Number=SeqID_167306
atgggctccagtgccgcctcagagtttgatagtcaccgttttcgggagaggcgtgtccagctaagggaagacgagtatcctgacttccagggagagatctctcacaggcattggacacgactagtgacccctatggctaaatttgacccggagatagtcatagaattttatgccaatgcctggcctactgaggagggggttcgggacatgcgctcatgggtgaggggtcactgggtcccctttgatgcagatgtcatcagccagttcttgggcgaccaactgattttgaaggaagaccagcaatgtgaattcagccaaaggaggagccaggcagacggtttcgatgaggaagccatcgccaaactattgtgcataccggggtag

SEQ ID NO: 75622 - DNA, 437 bp, Glycine max
  Peptide Sequence Number=SeqID_167307
atggtggcgcaggccaccggcctgggcgtgggtgatttcgtgcatacgctgggcgatgcgcacctgtattcgaaccacttagagcaggcgcgcgagcagctgtcgcgtgaaccgcgcgcgctgccgaagctgtggttgaacccggaggtgaccgacctgttcggcttccagttcgacgacatccgcatcgacggctacgatccgcacccggcgatcaaggcgccggtggcggccggaccggccgatgcgctgtcgttggcccggcaggtcaatgagcagatcgtgcacaagcacatgcgcgaggaagtgcaggcgttcgccggggcgttcaacggcagcacgatgatgccccaggatgtgccggaaggctgccgggcgcagatgcgtgaggccggtaaccggcatgtacacggcgatgaccgagcacctgaaggcgg

SEQ ID NO: 75623 - DNA, 782 bp, Glycine max
  Peptide Sequence Number=SeqID_167308
atgcacgaaatcacccacgcccaggccggtggcctgcgccaccatgtgggtcagcagcgcgtagctggcgatgttgaagggcacgccgaggaagaggtcggcgctgcgctggtacagctggcagagagcttcttccggaatcgtgcacctcgaacggacagggcgctgcaggggtcgtcgagccaggccacgtctggccgcggatgtgccgttccatgctggagcgtcagccgcccccgcgagtccgaggtcgtcgttgctcgccacgtcggtgatctggtcgatccccgccgtcgggaggtgggccaggagcagcgcctcgcgccgtcgggccgaggcgccgttcctgtcggtgcccagctcgtcccagatgctcaggccccgcgctcctgcagccagcgcacattggtagccgtccccgcgcaggactgcccagcagctcgaggatgtcgagcgggtgtgcacccgcttggtggtgatcagcgggaagccctgcgacaggtcgaagcggatctgctgccgaagaggtgcgggtgccggtcgccggtgcggtcgcccttggcgtgcccggatctccatgacctcgcgcagcaggtcctcgtagggggtggggatcgttcatcaggaaccctttcgcctcggggagggccggggtgctgccgcgcaccaccagggagtacggggtctccacgacccggggcgggccgtcgtatccctggatgcgctcggccaggaggtccagcgcggtgctggcaagaaccttcttgtccggggagatggtt

SEQ ID NO: 75624 - DNA, 796 bp, Glycine max
  Peptide Sequence Number=SeqID_167309
agaactacacgtcctcaccttcagaggactcaatgtccttgccttcagaggactacacatcctcaccttcagaggactacactttctccccttcagagggctacacgccctcaccttcagaggactacacctcttcgccttcaaagggctacacgccctcgccttcagaggactacacgtcctcgccttcatagggctacatgccctcgcctttagggggctacacgtcctgaccttcagaggactacacaccctcgccttcaaaggactacacctcttcgccttaagaggactacacgtcctcgcttttagagggctccacatctgctccttcagagaactcaagcaaccttcttaccagcgaccaccactccgatctccccctgccgaagtgtcagctggtttatgccatcatgacataaggatcgcgcccacaagacatccagtggacctgaagaagtccaacagggccctgggacactcagtgtgcccagaaaagtccaacaaggtcctagggtttctcggtttgattacgagcctccgtcagttctacggagtgcccgtcgcccccaatagggtcattaggcccctattaacagggctttcatcgagaagtactgcacccccaggcaggcacagggcgaggcatcacagtagtgggcaacagacgcaccgccaccacctccagagttcacctcaactcatccacaaaaaggctggagcattgcctacgacacatggccgaccaacaggcggccatcatcattttcactcctcttttaaacccaccaattga

SEQ ID NO: 75625 - DNA, 1229 bp, Glycine max
  Peptide Sequence Number=SeqID_167310
atgggaacgatgaaagcacgcgccgagcttaactcagcggccttcagcgagatgttgggggccgccgacggcaaggcgcggcaaaacaaggcgaatccgctgtcgcgcatcaccgcgcagacgatgcaaaacgtgacggcgctgttcgcctccgcggcgagagcggcgcccactcaccccgcggcagccgcgggcgacgctggcggaaagcgcagagctgctgcaaacgcgaacgaactatctgcggacggcgctgcaattgcacaatccgggcaaggcgttcagcatgccggcgctgctcaagctgtgatgaggaaagcggagcgcccaacgggcggcgctccgctcggcgctgacgtgcatcgtgctgttgtcgcccggttcgtgcagggcgatgatgcgataagaggtcgcgccgcgttgatcggcgattttactgacctggctgctggcgtcatccggcgaaaccacgttctggttcagggtgatgaagccgacgctctggcgttgatcggcctggtgcgacgtgatctccgtggcggccattacgttggcggagaacagggcggccagcgccgttgcgagaatgatgcgtttcatagtgcctctcttactttttgccgttacggcctgacagcgagtgtcgctgcggcaaaaagtcatttatctgcattgaataacctggaatctttttcgtcgcgctgtctgcggcggatatggttctcccacgagcaaatcgtgctatttcccataacgcctcgcattaacgcgaataaaacccacgcagtccttgagtttcccgccctgcgtcagtatgattacgcgagcaattcgatgcgtcattacgaaatcgtttttatggtccatcctgaccaaagcgaacaggttccgggcatgatcgagcgttacagtgctaccatcactaacgcgcaaggtcagattcaccgtctggaagactggggccgccgtcagctggcttatccgatcaacaaactgcacaaggctcactacgttctgctgaacgttgaagcgccgcaggaagcgatcgatgagctggaaactaacttccgcttcaacgacgccgttatccgcagcatggttatgcgcgttaagcacgcggtaactgaagcatctccgatggttaaagcgaaagacgaacgtcgtggcgatcgccgcgaagacttcgctaacgaaaccgcagatgatgcagatgctggggattctgaaga

SEQ ID NO: 75626 - DNA, 219 bp, Glycine max
  Peptide Sequence Number=SeqID_167311
atggagaattgcactaagcaatcactacgcatagctccaaactcgaagggtgagaatggagaattccactatgcaatcactacgcatggctccaaactcgaaggtggaggacacatgaacgaaaacgcaattcatggggctccgaaaagattgagaatggagaattacactaaacaatcactacgcatagctccaaactcgaaggtggaggacacatga

SEQ ID NO: 75627 - DNA, 384 bp, Glycine max
  Peptide Sequence Number=SeqID_167312
atggggcagaaacaagttctgaagggctttatggggccgaaagggacgagtcaagggtggaaaagactagaggatgagcatgcgaaggtatcagctctgcaagtggaaagggaagcaagagagagggtgatagaatcattgcacggggaagttgtgaaatggatggatagattctcttgcactgtgaatgggagtcaagagcttccaaggctgttagccagagccaacgcaatggcaaatatatactcagctctcgagggagttcatgggcttttcgattattgcaagcacatggtcgagttgatgtcacacataattaggaaccgtttaggcgtttgcatttatgctttggctttgggcatgataaacaacattgtttcttaa

SEQ ID NO: 75628 - DNA, 711 bp, Glycine max
  Peptide Sequence Number=SeqID_167313
atggttatgggagatttcatcagcagactctccttccccggcagacgcattgtttttcactcaaaaagcatatgctgctctaaatcagttggaatatttgtctctttgctaaagcatgtttgcattttagtggagaaaacaccgagactttttcaagtctcacaagttatccagaactacgtaggagcaagagcctcgcttttgtcgaccacaccgccttttgtcgccataactcaacagctggtagcccgcggagacaccttacggttatccgcacctcgtcattcagtgaccccaagtgtgattgatgaacagaggccaatgtggtcatctggccttttccggagatgtcagacattgtgtccgatggcacgcagagaccgtttggtcaagttctgcacccaagttgatacgcggagataccttacggttatctgcacccctttgtatgcagacacagtgtgtccgatggcacgcagagacaagtttggtcattctgcacccatgatacgcggagataccttacggttatctgcacccctttgctatgcagacgacagttgtgtccgatggcacgcagagaccaagtttggtcattctgcacccatgatacgcggagataccttacggttatctgcacccctttgctatgcagacacagttgtgtccgatggcacgcagagaccaagtttggtcattctgcacccatga

SEQ ID NO: 75629 - DNA, 264 bp, Glycine max
  Peptide Sequence Number=SeqID_167314
atgaatacacctgtaagtcaaactgaaaccaagggaaactacgctaagccaatggacaaaacattgtcacttccaactgtcatatttcagaaatccatgcatcgcgtacaagaggagtacatggatgtgcacgtgtcggatgcagagagggccacgctgcgctgccaccatcacttggtagcaccgtaccgtgcccccagaccacaaaatctcgtcgccagtttctgctgccccttttacattgtatcggatgttttgctttga

SEQ ID NO: 75630 - DNA, 684 bp, Glycine max
  Peptide Sequence Number=SeqID_167315
atggattcggtgccttcgaattcgcatggaaacctcgatgagcagatttctcagctcatgcagtgcaaacccttgtccgagcaagaggtaagggtcttgtgtgataaggcaaaagagattttgatggaagagagcaatgtacagcctgtgaaaagtcctgttacaatttgtggtgatattcatgggcaattccatgatcttgcagagctttttcgcattggagggaaggttgaatctgaaatattttgtcttcatggtgggttgtcgccatctattgaaaccctggataacatacgtaattttgatcgcgtacaagaagttcctcatgagggacccatgtgtgatcttctatggtctgatccagatgatcgttgtggttggggcatctctcctagaggtgctggatatacctttggccaggacatatctgagcaatttaaccataccaataacttgaagctgattgctagagctcaccagctggttatggaaggatataactggggacatgatcaaaaggtggttactatatttagtgcacctaactattgttatcgttgtgggaatatggcatcaattcttgaggttgatgactgcaaaggacacacattcattcagtttgagccagctccaaggaggggagagccagatgtaaccaggagaacgcctgattacttcctatga

SEQ ID NO: 75631 - DNA, 606 bp, Glycine max
  Peptide Sequence Number=SeqID_167316
atggaagctgtgtatgctttttctgttggcacacttcacatcccgacagcacatgaaacaccaaactcatttaggaaatctatattcttgagcaaccaagtggcttcaccagtttcattggttctcaggggcgcttcaaaatccaagcttttcactgccttgtcaccccctccattgacagaatccagcaacaaccaacctgaggaggctgagccagaatttgaaagtcatgcagagaaatttgactggtactctcactggtaccctttgatgccaatttgtgaccttgacaagaggaagcctcatgggaagagggtgttgggaattgatgtggttgtgtggtgggataggaatgagggtgtttggcaggttcatgatgatgcttgtcctcatagattagcacccttgtctgatggaaggattgatcaatggggcaggttgcagtgtgtgtaccatggttggtgtttcaatggcaaaggagaatgcaagctcattccccaggcaccccctgatggccctccggtgagatcatattatgttgatgcgtggaacttaggtcattggttgtacatctcactaatgcttcaaactacccttggccactag

SEQ ID NO: 75632 - DNA, 1083 bp, Glycine max
  Peptide Sequence Number=SeqID_167317
atggtgaaaggccaaattcttccatataaacacgcctatggcgcctccaaaggaggcctctcttcacaagttgcttgtggcggtaatgctggccttgagtctgccgtaaattggatagtagagcatgagaatgatcctgacatagatcagatgcccttggtacctaccaacaccaaaattgaggctcctaaaccttcgcttaccccagaagaattgaaggccaaacagcaggaactaagggagagagctcgtaagaagaaagaagaggaagagaagagaatggagagggaaagagaaaaggagagaattcgcattggcaaggagttgctggaagcaaagaggattgaagctgacaatgagaggaaacggtctggctcagctagtaaatttattgtcgcacatcttgtgttttgttttgaatgcactcagctacaagaaaaaaatgcttcctcttgcaggttgttggccttgagaaaagcagagaaagaggaagagaaaagtgctagggagaaaatcaagcaaaagttggaagaagacaaggcggaaagaaggcggagacttggattgcctccagaggaaccctcagcagccaaaccttcacctgcacctgttgtggaggagaaaaagagttttgtgcctgttaggcctgccacaaaagccgagcaaatgagagagtgcctccgttctctcaagcagaaccacaagcaatgcttctcaactatcgtttgtctgcttaaatattgtgacaccttagcctatttacgtgttcacttattcttggagcaggaggatgacgccagagtgaagagagcattccaaactcttctaacttatgtagggaatgttgccagaaatcccgatgaggaaaagttcaggaagatacgtcttagtaaccaatcttttcaggacagagttggttccttgagagggggaattgaatttctagaaaattgtgggtttgagaagatcgatggcggcgagtttttatttttgcctagggacaaaattgagatggccgtcctgaattcagctggatctgaactagactctgcaataaagaatcccttctttggagttctttag

SEQ ID NO: 75633 - DNA, 360 bp, Glycine max
  Peptide Sequence Number=SeqID_167318
atgagggcgagccctggtgcagcggtaaagttgtgtcttggtgacttgttggtcatgggttcgaatccgaaaacaacgtcttatgcaaggactattagtggtcctacttatggagtaatgatgatcaacataatggtcattgcaagcatagtgaaatggtctgtgaaactaatctatgatccatcaaggaaatacgctgggtacccgaaaaggaacatagcgagtttaaaaccagactcggagctgagagtagttgcttgccttcataaaacacaccatgcatctgctgtgaaagattgccttgacctttgttgtccaacaacagaagaccccaactgtggatgcaatgcatctaattga

SEQ ID NO: 75634 - DNA, 339 bp, Glycine max
  Peptide Sequence Number=SeqID_167319
atgggctttattgggcttgtaacgtggttacggcaagggataaattatgtagaagcaaagcttcatggtgaaccaaaggtgattcaaagatgttttgatgataacaatgatgatgacaaaggtgatgacaaaaagctcaaagatcaatcaaagaacaactcaagtgaatcaagaacaattcaagagttcaagataagaatcaagaagaattcaagaactcaagaagaaagtctagagacaagaatcaagattcaaggtttaagatctcaagaatcaagatcaagattcaagactcaagattcaagaataaatagaagactcaatcaagataagtattaa

SEQ ID NO: 75635 - DNA, 633 bp, Glycine max
  Peptide Sequence Number=SeqID_167320
atgggaagcccgttaaggaaagataaagaacttaggggcatccgtaatggcatcatcggtggttatcatgaatggctaagagttcatacacgagggttagattggctctccaagttgaaaattatcaacgaggagaacttcgaagctctggaagaggataaagaagtccaagctctaaaatcagagctaggaaaggcaagactcgccaaagaaaaattcaagtcagtcgctatagacatccggaaaaagtgtgccgaattacgagaggaaaatgtggctaccgcaagagccctcaaacgagaaaccaagagggctcgcaaggaagagcatggccgagataaattccgaggagctttgtggggcagcaacaatgagctcaagttccagagagaggaaagagatcagtcacgagtacatggcatggtcttaaaggaggagttagctgcttgctcgagatccaagaggagtttggcccaacacttagaagccatggagcaaagcatgctagctataacagggcaatacaaagaagagttaaaccagtctttgatccatgaaaaaaaactagtagaggacttcgcacaagctgatggaagcttgcttgtggggcttctatggaggctggatctttga

SEQ ID NO: 75636 - DNA, 222 bp, Glycine max
  Peptide Sequence Number=SeqID_167321
atggatcaactgatttctgctaccatctattgtttgcagggatcgcgccttcaagacggccgttctacggagtgcttgtcacctccggcaagggcatcaggccccctactaatcgagctttcatcaagaagtactgcgtccccaggcaggcatagggcgaaacaccacagcagcctggggatggccggcagcgggcaacagatgcaccgccatcacctctag

SEQ ID NO: 75637 - DNA, 533 bp, Glycine max
  Peptide Sequence Number=SeqID_167322
atgactagaggcaatccatttgacttacaaccctttgatcctgagatagataggacatttcatagattagttaggcatcattttataccttttgatctacctgagcattccattactggtgaatctgtgcattctgttattggtgattttgaacatcctgattttgagcattataattttaagcattctgattctaagcattctgattttgaatattctgagaacatggcacaacctccaccccgtgagaggactctaagggaaatggctgcacctgatttcacctacgaaagcttgtgcatccaataccctgatgaggatgtcccatatgttcttaaaactggactgattcatttgcttccaaagtttcatggccttgcaggtgaagacccgcacaaacatttgaaggaatttcgtattgtctgctccaccatgaaacccccagatgtccaagaggaccacatatttctgaaggctttccctcattttttagaaggagtggcaaaggactggctgtattaccttgctccaag

SEQ ID NO: 75638 - DNA, 77 bp, Glycine max
  Peptide Sequence Number=SeqID_167323
gagtgggcgaaaactcacggattgcgaaaaacacctcctttcgatttccgtcacattacggaattttcacggatcac

SEQ ID NO: 75639 - DNA, 165 bp, Glycine max
  Peptide Sequence Number=SeqID_167324
atggagtttggaaaaactaaagggagaactgccaggaaaccacattacaagcgaaacctcaaagagagttgggcttcgtcctcaaaaggaacaacaccagaaaatctagccttccatggattcaaacagaaaacgcaattgaaacatgagcagaaacgtaaatga

SEQ ID NO: 75640 - DNA, 507 bp, Glycine max
  Peptide Sequence Number=SeqID_167325
atggcggcggaaaaaatcagtcgcgactacttgacgactgagttggctgttgttttgtcttgtcaatccctgagtgttctatgtgtgatgagaatcatgaaactggccaaatacaggctaaaggcccaagtggagaaggacgaaggcccaagtggagaaggacaaagcccccgagtggagaaggacaaagcccccgagtggagaaggatgaaggcccagacttatcaaggtaatccttgtggcgtctacccagacttatcttccttcattggaagtggcgtctacccagacttatcttccttaaccggaagtggcgtctacccagacttatcttccttcaccggaagtggcgtctaccctgacttatcttccttcatcggaagtggcgtctaccctgacttatcttccttcaccggaagtggcgtcatccaaaaaactctacagcctgtatcaagtgatccgccccgtatggttcacatcatctggtatcagagctttggctcttga

SEQ ID NO: 75641 - DNA, 372 bp, Glycine max
  Peptide Sequence Number=SeqID_167326
atggaggatatacgtggtcacttggaaagttcagattgctctatgcattctgaagctgaagcactagaacatatgatgaaaagagatagaggccatcaaagtgtgtcattggagaataagataggagattcaactgtggtcaagatgagtgagaaaaataataatgccgattccggtgactacatgattcttgatgaccatgaaggagaagagcattgttgtggcaaaggaacaaatgcgaggagtgtttcttttttgccaagaagccaagagaagataggagattcggctaaagttgtgataaaacaagacatgaagggaggagagcataaatatgggtttaacaacaacgtgagaagccagagaaggtaa

SEQ ID NO: 75642 - DNA, 661 bp, Glycine max
  Peptide Sequence Number=SeqID_167327
atggcttctaggaaaaggaaagtcatagcttccaggccccagcctcactacgatacttatagattcacctctaaggacgccctgaaccgctatgctgacaacattcgtggctggaacatccttctggaaaggaatgggagcatagatgtggctcttgtgaagaaattttatgctaatctttatgtcctgggggataagcctccaaagcaagttagggtcagagggcatttaattaagtttgatgtggattccctcaacacttttctggagactctggttgttctagagccaggggagactcttcctacttactccaagttctgcagactaagaccagaccctcaggagctggccacccgactttgtatcccttgtaggggatttgttctgaatgctgagggcctaccatggaagtttttgaggaaggacctcactactctagtgcagacttggagcgttctgtcttatttcaaccttgcccctacatcacacacttctgatttgaacttggatagggcaaggttggtatatggattagtgatgaagatggacatgaatgttggagccctcatctctggacagatcactcttatggctcagtctaactcctcgaggctcggatttttagccctcatcactgctttatgcatggccacaagga

SEQ ID NO: 75643 - DNA, 366 bp, Glycine max
  Peptide Sequence Number=SeqID_167328
atgagttcgatgcggactccctcaacacttctgaagactccagtggtcttggagcaaggcgagagcttaccttctcactctaggttctgcaggttgaggccagaccctcaagagctggcagcccggctgtgtatccctagaaggggatttgttcttaacaccgagggcttgccgtggaagctcttgaggaaggatcttacaactctagcgcagatgttaattaggaaagtttgtgaagtgctgatttttagcttctcgccaagccaatctgccggcttagcgagccatccgctgagcgctccactcttgcggctgagtgcaccactcctgcggctgagcgtgaggaagaatctagaagaaggatga

SEQ ID NO: 75644 - DNA, 358 bp, Glycine max
  Peptide Sequence Number=SeqID_167329
tcgacacccacattgccccacattgatttcaatactgtcggaaaccgctcgctggaacccacagaaccccctatcgaagaaaagtcgaagaaaagcctacactgttgttggaactgtgggtcaaagaaaaccctacactgctcttggaatagtcgtgggtgctcaaaggtcaaagctttctacgctgccagttaacaagttgattgtgctttacgtcgttttcaagcttgacgagagttacacgctgagcaaagtttccatccatgccggtgatggttttcacaacttgaaggagattaagaccgttggaactcgtgaagccaactgggtgggtttatctatccttgtctggagttga

SEQ ID NO: 75645 - DNA, 186 bp, Glycine max
  Peptide Sequence Number=SeqID_167330
atggatatcatcgttttggacacggagcctactatggtcatggaaagttcaagcatgggaaatatggcaagcgttggaagcatggcagggcattaccccaaagggagcccttccagaaattctcaaaggcctgagccaaacccaggcctaagagggggtttggaaatagttttcaaccagcaatag

SEQ ID NO: 75646 - DNA, 362 bp, Glycine max
  Peptide Sequence Number=SeqID_167331
atgggcagaaatgtgtcagcattgataggtaaatctgttcctcacattcctgagaaatgtaaggacacagatgtggtgattcatttggcaaatagaagtgttgcttaccccgtaggtttcatagaggatgtgctggttcgggttggcccacttgggccctccagaagattcctccagaaggctgttgcttctggaggaagcaaccctgctcgcctgggcgagctggttgtttccgtgaagaaaatccaagccgagacgcttccgaaacgtttccgtaacgtttctgtgaggaatttcgcgaaggtttcgaccgttcttcgacgttcttcattcgttcttcatcgttcttcgatcttcaacgg

SEQ ID NO: 75647 - DNA, 225 bp, Glycine max
  Peptide Sequence Number=SeqID_167332
atggaggttgatgaaccttggctggggttatggctaccattgaattatcaagtagatatgggagcaagctttgtggttgatttagggatggcctttgtggatgactgggtggtgggtaatgaggaggggattttctatttaggaacgacagtcgcagcatgggtttctccttcattctcaccctcttcatttgccccagttttctcattcgtccaagcaagatga

SEQ ID NO: 75648 - DNA, 173 bp, Glycine max
  Peptide Sequence Number=SeqID_167333
atgggagcaaatgatatcatcattgataaacagagttctggctgtggaagagattggagggaactgagcttgaagaggaagctattttgcaaagcattggataagattttgagtgattatgagaagcctccctgctatggagagctaaatcctcagttggttcttcctatggg

SEQ ID NO: 75649 - DNA, 141 bp, Glycine max
  Peptide Sequence Number=SeqID_167334
atggtagtaggaaatgcaactatagaaaaacccagggaacaatgggatgaagaggaaaggagaaagatcttccaagagagcaaagaacttcaagatatcatcctcttgataatatcattggtgacatctcaaaaggggtaa

SEQ ID NO: 75650 - DNA, 406 bp, Glycine max
  Peptide Sequence Number=SeqID_167335
atggtgaaagtggaactctacgtgccgatcaacgtctcatttcgccaaaagttggcccagggcttcccggtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatgagcgaaactaattgcaaaagaggggaaatcggccacattaaaattaccttctggggag

SEQ ID NO: 75651 - DNA, 201 bp, Glycine max
  Peptide Sequence Number=SeqID_167336
atgaagaaggagattacatcatggcaattggcaaatgctaagcttgcaggggtcggtggcagactcaagaataatggaatgtgtagtggctttgtcccatacctccattgcagttcagttgtgcctgagcttgcttccctatttttattaattttgttcatgtttatgagtgagttgaaacttcctgccgaggaccaaaag

SEQ ID NO: 75652 - DNA, 276 bp, Glycine max
  Peptide Sequence Number=SeqID_167337
atggggctccgaaaaaaggcgaggatggaggattgcactagagggtcctcactagtcaatcatgaagcatggctccaaactctttggtggaggatgcatgaacgaaaacgcaattcgtggggctccgaaaaaaaggtgaggatggaggattgcactagagggtcctcactagtcaatcatgaagcatggctccaaactctttggtggaggatggatgaacggaaaacccaattcatggggctccgaaaaaatggcgaggatggaggattgcactag

SEQ ID NO: 75653 - DNA, 1621 bp, Glycine max
  Peptide Sequence Number=SeqID_167338
atgaacgagaccctggacggcgactaccagaccttcaaatccaaagacggcgcttacgtgcgcgagcacttcttcggccgttacccggaaaccgcggcgctggtcaaagacatgaccgacgacgaaatctgggcgctgaaccgtggtggtcacgatccgaagaaaatcttcgctgcactgaaaaaagcgcaggacaccaaaggcaaaccgaccgttatcctggcccacaccatcaaaggttacggcatgggtgaaaccgcggaaggtaaaaacatcgctcaccaggtgaagaaaatgaacatggaaggggttcaccacttccgcgatcgtttcaacgtgccggttgccgatgccgacatcgaaaaactgccgtacatcaccttcgagaaagattccgaagagtacaaatacctgcacgaacgtcgccaggcgctgaaaggctacgtgccgacgcgtctgccggagttcacccagaagctggaaatgccggcgctggaagatttcagctcgctgctggaagagcagaacaaagagatctccaccactatcgctttcgtgcgtgccctgaacgtgatgctgaagaacaagtcgatcaaagatcgcctggtgccaatcatcgccgacgaagcgcgtaccttcggtatggaaggtctgttccgtcagatcggtatctacagcccgaacggccagcagtacactccgcaggaccgtgagcaggtggcttactacaaagaagacgagaaaggccaaatcctgcaggaaggcatcaacgaactgggcgcagcctcttcctggctggccgcagcgacttcctacagcaccaacgatctgccgatgattccgttctacatctactactcgatgttcggtttccaacgtatcggcgacctgtgctgggcagcgggcgaccaacaggcgcgcggcttcctgatcggcgggacctcgggccgtactaccctgaacggcgaaggtctgcagcacgaagatggccacagccacattcagtctctgaccatccctaactgcatctcttacgatccggcttacgcgtacgaagtggcggtgatcatgcacgacggtctggtgcgcatgtatggcgacaacccggaaaacgtgtactactacttgaccacgctgaacgaaaactaccacatgcctgcgatgccgcagggtgcggaagaaggtatccgcaagggtatctacaagctggaaacgctggaaggcagcaaaggcaaggtacagctgctgggctccggcgccatcctgcgccacgtgcgcgaagctgcgcagatcctggcgaaggactacggcgtgggttccgacacctacagcgtgacctcgttcaccgaactggcgcgcgacggccaggattgcgagcgctggaacatgctgcacccaaccgaaacgccacgcgtgccttacatcgctcaggtgatgagcgacgcgccggcggtagcttctaccgactacatgaaactgttcgccgaacaggttcgtacttatgtgccggccagcgactatcgcgtactgggcaccgacggcttcggtcgttcggacagccgcgaaaacctgcgtcaccacttcgaagtcgatgcatcctacgtggtggttgctgctctgg

SEQ ID NO: 75654 - DNA, 159 bp, Glycine max
  Peptide Sequence Number=SeqID_167339
atggttagaaccaaaggtttagggcgtgcattaggtgatgttccccggtggcgtaggcctaccgcatttgcccgtaggcaaagggtacatgttgcagttgctgaggatgttcctcatgtgactgagaatgttcctcatatgactgaggatgcaccttag

SEQ ID NO: 75655 - DNA, 1665 bp, Glycine max
  Peptide Sequence Number=SeqID_167340
atggagttaagaatagaatcaactcatcgtgtcaaatttatatcatgcaggcaaaattttgtgaacaggtgggtatggggtggtttagatcgtggttatatatcgaatgtagatattaactggggtgatatattgcaaattactgcgaaactgacagggaaaaaagagtttcaaggggttggccttctaaacttcaacaatactgaactagaccattgggaacagcttattcctaatgtcacacatgttgttctggagctggagtatgctgcaaaaaatatgacatgggaatcccaatacccggaatggattgatgaggaagaggaaaccgaagtccccgtttgtccttctcttccaagtcttagatctactggaataaggctcaatctcatagctgtgaagcttcctcatgcaaatggggggaattggtctagagatgttgctaggttgcacttgcagctagcagtagctaggcttacaacttctttcaaaggaaattatcccttgtatgtgctttttgttaccaacttctttccaatacctaatttgtttacctgcaaagaacttgtgggacatgtgaagggaatgtttttgggagaaaaactccaccttccactaggatcttgtgaacttgcatttcctttgaggggcaaagaactgagttacgtgggaaatgttcgtagagaagcatatgcaacaattctccattcagctcacgtttatgtttgtggagctattgctgccgaacaaagcatccacatgtctggttcaactcgagacctagttatacttgttgatgagacaataagacaattcaaaggatcagaaaaagacgcttacaatgaatggaactacaacaagttccgtttgtggcagcttacagattatgacaagataatattcattgatgcagatttgctcatcctaagaaatatagatttcctatttggaatgccagaaatcactgcaactagaaataatggcactctattcaactcaggagtcatggttgttgagctatcaaattgcacattcaagctcctaatggatcatattaatgagtttgagtcctacaatggaggggaccagggatacttaaatgaaatattcacatggtggcataggataccaagacacatgaactttctaaagcatttttgggttggtgatgaggaagagaagaaacaaatgaagactttgttatttggtgctgaccctccaattctctatgtgcttcactatcttggaatgaagccatggctgtgcttccgggactatgattgtaactggaactgtgatgtctttcacgagtttccaagtgatgttgctcatgaaaggtggtggaaggtgcatgatgtaatgcctgagcttttgcaacagttttgcatgttgaagtcaaagcaaaaggcacaattggaatgggatcgtaggcaagctgaagttgctaattacacaagtgggcattggcaaattaaagttaaagatacgaggttgaagaaatgcatagacaatttgtgctcatgggaaaacatgttgaagcattggggagagaccaattggactgatgatgagtctcacactccaacacctcctgctattgccacatcatctctttctgatttgcgacttgtgaatttagctttctatcatccttgcaaatgttaa

SEQ ID NO: 75656 - DNA, 1116 bp, Glycine max
  Peptide Sequence Number=SeqID_167341
atggcaggtgctatagtaaagtacggaatcataggagtaggaatgatgggtagagagcatcttgtgaatttgtaccatcttcgcacccaaggcgtggcagttgttgctattgctgaccctcatcttccctctcaacaactcgctcttgacttagcacactcctttacttggcctctcaaggttttctcaggtcaccaggagctgttggacagtggactatgtgatgttttggtggtatccactcctaacatgacccatcataggattcttatggacattatcaatcattccaaaccccatcatgtactggtagagaagcccttgtgcaccacaatctcacactgcaaagaggttgtcaatgctgctagaaagagacctgatatattggtacaagttggactggaatatagatacatgccacctgttgcaaagctgatagaaatagttaagggaggaaaccttggacatgtcaaaatggtagcaattcgggagcatcggtttccttttctggttaaggtgaacaattggaaccggttcaatattaactcagggggcactctggtagagaagtgttgccacttctttgatctgatgagactgtttgttggtgcaaatcctgttcgtgtgatggcttctggagctattgatgttaatcacaaggatgaagtatatgatggaaaggtgccagatatcattgacaatgcatatgttatagttgaatttgacaatggttctcgaggaatgcttgacctttgtatgtttgctgaagggagtaaaaatgagcaagaaatatctgttgtcggtgatattggaaagggagaagcctttgttcctgagagtgttgtgcagtttggtacccgagaggcggggcgagatggtgtccagactttgaaagctgaggatcacaggataaaatatgatgggttacaccatgggtctagctatctggaacaccttaacttcttgtctgcaatcagagcaaaaggagaaaaggctcctagtgtagatctccaagatggattaatatctgttgctatgggagttgcagcacagctctctatagaatatggtcgatttgtttctattcaggaagttatgaatgagtgcaaaatttga

SEQ ID NO: 75657 - DNA, 2178 bp, Glycine max
  Peptide Sequence Number=SeqID_167342
atgagtgttgtgaatgtttggccttcttcggaattacaactaatcttggtacctatcttaccaccagattacatgaaggaaacgtttcttctgaaagaaacatcagcatatgcggccgctatagcggcggagtggcccccatccccgacgggcacctctttagcgaagcagtttcgtgtcgcggctggagtggccgctatcgtggcggcacgggtggaggaattgaaaatcttgatctgtgtgtttccaatttgggccaccgggatcatttttgctgccgcctatgcccagatgtcaacattgtttgtggagcaaggaacaatgatgaacacatgcattggttccttcaaactgcccctctcaacttttgatgtcatgagtgtggttttgtgggtccctctctatgacaggataattgttccaatcataaggaagttcacaggcaaggaaaggggcctctcaatgctgcaaagaatgggaattcgccttttcatttcagttctgtgcatgttatcagctgctgttgtggagattatgcatctgcagctcgcaaaagagcttgaccttgttgataagcatgttgccgtgccccttagtgtactttggcaaatccctcagtatttctttttaggggcagcagtagtattcacatttgtggggcagcttgagttcttgtatgaccaatctccagatactatgaagactttaggtggaaagcctggttggattcctgataacttgaacaaaggcaatgagtgttgtgaacgtttggccttctttggaattgcaacaaatcttgttacctatcttaccaccaaggtgcatgaaggaaacgtttctgccccaagaaacgttagcatctggcttggcacttcttatctcacacctctcattggagctgctctaggagatggttactggggtcgatactggacaattgctgttttctctgtggggatgtgtaccttgacactttctgcatctttaccagcattgaagcctgctgaatgcttgggttctgtatgcccttcagctactcctgcacaatatgctgtgttctactttggtctatacgtgattgcacttgggatcggtggtataaagtcatgtgtgccatcttttggggcaggtcaatttgatgatactgatccaaagggaagggttaagaaggggtcgtttttcaattggtattacttttctatcaatctaggtgccattgtatcgagcagcatagttgtgtggattcaagacaatgcaggatggggtcttggatttggcattcctactttgttcatggtattatctgtgataagcttctttataggcacacctctctacaggtttcaaaaaccagggggaagtcctgttacaagaatgtgccaggttttgtgcacgtctgtccggaagtggaattttgttatccctgaggatagtagtcttttgtatgagatgtcagacaagagatctgcaattaaagggagtcacaaactgctacatagtgatgatctaaggtgtcttgatagagcagctacagtgtccgattatgagagtaaaagtggtgactattctaatccatggagactttgccccgtaacacaggtggaagaattgaagatcttcatctgcatgtttccaatgtgggctactggggctgttttttctgctgtttatacccaaatgtcaacattgtttgtggagcaaggaacagtgatgaacacaaacattggttcctttgaaatacccccagcttccctcgcaacttttgatgtcctaagtgtggttttgtgggctcctgataattgttcccaaaggggaatttcagtgttgcaaagagtaaccattggcaacttcatttcagtcctgtccatgttagcagctgttgttgtggagattatgcgtctgcggcttgcaagagaccttgatcttgttgatgaacctgttgctgtaccactcacactgtcacctttgtattttgcgttgggaaattacttgagctctttcattcttactatggtgacttacttcaccacacatggtggaaagcttggctggattcctgataatttgaacaagggtcatctcgattattttttcttgcttttagctggacttagcttcttaagtatgttggtatacattgttgctgccaaaaggtacaagcagacgaagacttcttaa

SEQ ID NO: 75658 - DNA, 132 bp, Glycine max
  Peptide Sequence Number=SeqID_167343
atggcttcacaagttgtacgtacaactagtggtggaggccacgatggagcaagagcaacatggatattgaagacagttgacttatatccaacttcaagtattgtagaccaaagtgcactttttgtggattga

SEQ ID NO: 75659 - DNA, 903 bp, Glycine max
  Peptide Sequence Number=SeqID_167344
atggctgcaccgtttttctcaacgccctttcagccttatgtttatcagagtccgcaagatgcaattataccttttcagattttagggggtgaagctcaagtggttcagataatgttgaagccacaagaaaaaatcatcgcaaagcctggttctatgtgctttatgtctggatccgttgaaatggaaaatgcctaccttccagaaaatgaagtaggcatatggcagtggttatttggcaaaactataactagcattgtacttcgcaattctggaccaagtgatggatttgttggaattgctgcaccttattttgcaagaattcttccgattgatttggcaatgttcaatggagagattttgtgtcagccagatgcttttctttgctctgtcaatgatgtgaaggttagcaacatagttgatcaaaggggacggaatgctgttgctagtgctgagggattcttgaggcaaaagctatctggccaagggcttgcattcatattagctgggggatctgttgtacagaaaaatcttgagatcggtgaagttctagctgttgatgtttcttccattgttgctgtgacaagtgcagtcaatatccaaataaaatataatggtcctgcaagaaggacaatgtttggggaaacacaatatccctcccccataccttcgcatagcgaagagtctctgggcaatgggggtgacaatgctgtcacagccgttctaacaggaccaggcattgtgttcatacaaagtttaccttttcatcgattctctcaacgaattgctagggcggtgacatcacccaacatgagggaaaatcccaagtttttcatacagattgcagttttcttttttctggcgtatgttgtcattgtatcttcgttaatattaacagatgtatga

SEQ ID NO: 75660 - DNA, 441 bp, Glycine max
  Peptide Sequence Number=SeqID_167345
atggctcctctcttcatctcaatgcaaatgcttcttcaagtctttagctgcatattattccatgcaacaacaacaaccgtgacatgcacaacctaccaccacagcacccccaaaatagtgtcttccaaaaactcctctaactgggtggagcccatcggacaccaagtaatcaccgttgacgctaatggcagaggtcattttcgagagaaggtggtagtgcccgtgacgaagccgtacattatgtttcatggcgcgggaagagatgtgacagtgatagaatggcatgatagggctagtgacccttgtcccaaccgccaacaactgcatacttacagaactgcttctgttactgtttctctgccaggaatatccgcatcaaggtcaaatcaattcagctctatatcatgcttcattatttctcttcttagtcacattatatga

SEQ ID NO: 75661 - DNA, 6747 bp, Glycine max
  Peptide Sequence Number=SeqID_167346
atggattatgatgacaatgattttcaaagccagaatctccatttacctggtgaagggagcacaaaatttcctccagcattaaggccatatgctctgcccaagtttgattttgatgaaagccttcaagggcatttaaggtttgatgatagtttggttgaaactgaagtttaccttggtattggaagtaacgaagataaccagtggattgatgcatactcccgcgggagtagtggcatagagtttggcacaactgcagctgaatcttgctctatatcaaggcataataatgtttggtctgaggccacttcctcggaatctgttgaaatgctattaaaatctgttggacaggaggaatttatccctagagaaactgttatacaggagtctgatgcctgtgatgaactggtatgcttagctaagcaaatggagcccgatccaaaacctgatggtagaaatgaatttaaaaataatattactgatttacagcctacaggttttattgatgagaacttggctggattgaaggatgaagaaagggagcagtctctggctggagtttcccagggtgtactatccattgatggaagtttaagcaatctgcaaccacatgatatgcttggcaatattgacttgccaatggctagggggattctctttactgatgacaaaagtaatgatacaaatcaaggaaaagttgagactgtggctgatggttctcttgaagaaaaaactcaagaggactcggctgcttctggggggaagactaatattactgtaacttctgtacacaatttcacttcttgtgatgtcttaaacattcaaaatgtgcaaaatcatgtagttggcatgggtagtgaggagcaaagttctttacagatacaaactaatgagcaagatttggattcttctgtgattaacaaagattctaatgttgacactcgaactttggatgtaaatgcagttgggggtgaagcgcatcattctgataaacctctttgttcatttcctaaggaagaagcattggaaagtggcaatgcagttgagggccttgagacttgtggaagtagtttagagggctccttgagcatggtatctgatggtatttctgacttgcagaacacagagagatgcaatgaagatgcatgtttcagagatttgtctcagggcaatgcaaaagaagacacaattgtggataatcaatctgcagtagatacaagtggctcaccaatggttgcaattaaagatgattccagttctgaggggcatatagttggggtcagcaaatctgagtgtattacatctcctaattttcagcagaatgtgggtaccattgagaagacatatgctgaaagcagtgcttctatggaaaagcagttattgaacattggtaaccagatggatacagaggttttattaagtaattcggaggcatctatgtttgctgtgggggataaaaacacttctactgttaataaaagaaataatgataacaaagcaggcagtttttctagtttaggtgcagtggcttctacaaaatcttgtattttgggtgaggcaactcaagtatgtgaaaacagtgaacctgacaagcagggtgaccgtgaaaacttttgtcaggatgtttctgccattgaccaagagaatgaaatagccacttttgattccagcctattgcattgtgatgtggaccaatcccatcttgttgatacaggagttagttcatcatctgttagtgcaggtaacatggaaactaagttgacaacttctacagtatcagttgatgtcgagcctgtcaacaattcagcttcacaatatatattagaaaatattagttcgacatcctgtgagatagtggatgtttgtgttctctctcctagcagaattgtgtccacacatgaagttacagatcactgtgaagttcaaggagtgacgcctgttgggtctgcttctattgatgaaaaggaaaaggctgaagctaaaatagccaatgaagctaccatagtcaatgaagcaagctgtgaagctaaactagccaatgaagccagctctgaagctaaaatagtcaatgaagcaaactgtgaagctaaaatagagaatgaagcaggccctgaagctaaagtagtgaatgaagcaagctcggaagctaaaatagccaatgaagcaagcacagctcttcttgttgggtcttctgaacaggaaactgctccttgtcctgaaactgaaatacatttttctgatacatcaggacaactgttgtgcaagacagtaagcagttgtgttcttactgcttctgaaaagatgggtaaaccccaagaaactctgagtgatagggttgatcaggaatgctcaaaagaggttggtgtggctgcagttctgtgtgcatcaacagagaaacagggtgataaagttgcagtttcttttaccaaggatgacaaggaggcaatacaagagaaccatgacaagccgtcggcaaaagtatcagtgtccttgcacggcaaaggtgatgatttatctgcaaatgaaggctccaattctttacctgattcttgcaccaagttgcatgaaactggaagcagtcctgccaatcagtctgataatacttgtggtgtcaatgttacatttggaagccaacctgaaactgaaaaggatgtgaatcaagttaaggcttctgctaatcggaaccctccagtttctgagtgcataaataaggatgcattgaacacatctactgatcgtgatcctaaggggaatgatgcatctaaagatgagaaaagctcagctcctgtggtcaatcttgtgccaaatttgtccaaaaaagatgtttcagaaaagaccaccaaaagatcaaatttgggaaagaggcaacgagctgcagccaaaaaagctccaatggttgtagaggaacctccactgccttctgcactaggtactcccaaaactaaagttccaggaaatatctcccttgggagtcgacaaatatctgatggtgttatagcacatagtgtttctcaaggtacacctgaacgcaaaactaggcgagcctctaataagacagctggaaaggaaacttctcgaaaaggaaataaaggaaaaacaccaggaagacagtctgaaagaggggatagatcaactagtgtgtctgtgagcccatcacctggtttccaggtccaatcgaatgagatgcagcagtttgggcactttgattgcatcagtacaaagccatttgctattttaagtgcttcaacatctagccttccagatttgaactcttctgcttctccacctgttctgtttcaacagccttttatggatatgcagcaagtacaattgcgtgcacagatctttgtctatggggctttgattcaaggcaccgtacctgatgaggcgtatatgatatcagcttttgggggcccagatggtggaaggagcatttggcagaatgcctggtcttcctgcatggaaaagcagcatggtaaaaagtctcatcctatgaacctggaaacgcctctgcaatcacgatctggtcctagaaccactgatgtggcagttaagcaaaatgcacttcaaggaaaaggaatctcttcacctcttagcctagccagcagcaaggctactccgactattgctaacccattaatgcccctttcatctcccctttggagtctaccaactccttcctgtgattcccttcaatctagtgcgtttgcaagaggttctgttgtggattattcacaggcacttacttcttcgcatccttatcaaaccccacccctcagaaactttcttggacataacacatcttggttatcccaagccaccctttgtggagcatggactcctacttctgcccctgataacaacagttcccatctttctgcatcacctctcacagatacaattcggttaagttctgtcaaaggatatcctgtacctccttcctcaggcataaagaatgctcctcctggtctgccagcttctagtgcaggcctacaaaatgtctttatagcaactgcccctccgcttgatacaagcaatgtgacagtattgaatgctcagcattcttcagattcaaagcccaaaaaaagaaaaaaagttatggtgtctgaggatcttgggcagaaggctatgcatttgcattctccattagtactgactcctgttgtaagcagccacatatctactgctgttgccacttcaacccctgttgggagtgtgcccataactactgttgaaaaatcagttttgtctgtacctccgctatctcttgctgatcacctcaaaagtgagtggaatgttgagaagaggattctgtcagataagtctcttacaaaaattaaggaggcaagggtaaatgcagaggaagcttcagctctttctgctgctgctgtgaatcatagcctggagatttggaaacagttggataagcaaaaaaattcgggattggtgtcagatattgaggctaaattagcttctgtggcagtagcagttgcagctgctgctgctgttgcaaaggcagcagctgctgctgccaatgttgcatcaaatgctgcattgcatgcaaaattaatggctgatgaagcattagtctcatctgattatgagagttcttgccaaatttctcattcagagggtatgactaacttgggaaaagtaacccctgcctccatcttgaagggtactattggaaccaatagttctagttctattattggagctgcaaaggaggttgcaaggaggagagtggaagctgcttcagctgcccgaaaacgagctgaaaatatggatgctattgtgagggctgctgagctggcagcagaagctgtatctcaggctggaaagattgtaactatgggtgatcctttgacattaaatgaattagtagaagctggtccagagggttgctggaatgcagctcaagagtcttctcagcaagttgacttgttgaaagacgtgaccagtgatcgggtgaatgttgacaatgttggagacagaccggaaacttctcatatatgtaatacagataattcatctgatgaaatgaggaagaagactgctgcaagtgagaagtcaccttttcatacagtgcatagtgagatatctcaggaccataagaaatgcattggtggcttttctcctattatcaatcaaaagagttcaaaaggaccaaagggccgcaaggtttctgatttagtcaataccattgatgtgcttcctaattctgagactgaaatacaggctacttccactgctggtaataaacctgaaaatctggaggataataacatcaaggagggctctattgtagaggttttcaaagatggagaaggatttacagcagcatggtacacagccagcatattaaatttgaaggatggtaaagcttatgtatgctatgttgtgcttcttgatgatgaaggtgcaggacctttgaaggaatggatttcccttgaaggtggagaagtcaaatctccgagaatacgtactcctcattatcttcctggtttgcataatgaaggaacaaggaagagacagagggcagctatggtagattatacttggtctgttggggatagggttgatgcatgcagtgaagaaagttggcaggaaggagttattacagatcagaacaagaaagataaaacattaactgttcacttccctgtcagtggaaaaacaaaacttgtcagagcttggcatctacgtccatcccgtttttggaaggatgggaaatggattgagtatcccaaggttggaaccggtgacagttctacccatgagggtgatacacctcatgaaaaacgacctaagttaggtagtcctgcagtagaggtaaaagggaaagacaggattccaaaaggtactaatgccgtggagtcggcaaatcctggcaagttgaggttacttgacttgactgaaaatgatagagtgttcaatattggtaagtacagcaagaatgaaaataaatctgatgcccacagaatggtgaggactggtcttcaaaaagaaggatcaagagtgatttttggtgttcctaaacctgggaagaaaagaaaatttatggaagtaagcaagcattatgttgcagatgggacaagcaagatcaatgatggaactgattcagtcaagctttcaaatttcttgatacctcaaggtactggatcacgtgggtggaaaaatagttcaaaaaatgataccaaggaaaaactaggagctgactccaggcccacctttaagtctggaaagtcgcagagtgttttgggtagagtggtcccaccaaaagaaaacccattatcaaactctcgtactaatgatttgacaagtcatgcagaaaggatcaaggattcatcaagtcattttaagaatgtatctcagagtgaaaatcaggtggaaagagcattgtattctggaagcactggagctggggccggaccaatcttgcattcatcacttgtgtcttcgactgattctcaccctgctaaaaagacatcaacatcaagggcaagtaaaggaaaacttgcgcctgctggtggtggaaggctgggtaagattgatgaagaaaaagctttcagtggaaatccactgaaatcaacatctgaaaacactgagcctcgtagatccattcgcaggattcagccaacgtcaagactattagaaggattgcagagctctttaattatctcaaagattccttctgcttcacatgaaaagggtcacaaaaaccagaatcggaaaacttctagggggtga

SEQ ID NO: 75662 - DNA, 291 bp, Glycine max
  Peptide Sequence Number=SeqID_167347
atggcttccgcgtgcagcagaatcgcgcaacgaacgtcaatttcttctataaaatcagccatcaaatccaacattcgcgcttcttcattctccaaaccagcttcctcctcttctcctcttcgccaatccttattgaccaggatttcgccggagctgagatgcgcgcagtcgatgttgccgctgcacagcgcggtggcggcggcgagaatgacgtcgtgtctgagcgtgacttccagaagctgccgagcgctttctcagggtactctctgctgcacctctcccggcctctaa

SEQ ID NO: 75663 - DNA, 417 bp, Glycine max
  Peptide Sequence Number=SeqID_167348
atggtttcaaggtacgctttaaatgagattgctactgagtttgagtgtgtacgttatgttggcaacaatttctcttcttgttattgtgcgatgagagtcacgcatgggttatgtgaggccgaagtcaccatcaaggaagagatcgtgaccatatgtaaaagatttgaagaacttgatgtccacactaaaggtgcactgaagaaaccgatgaacagaagtcaaagatccacaaagtgtgatccatcttattgggagtatgttgatgcttttcattttgttcagagcaacaactcttcagtgaaacgtagtgcatcatcttttcctgacctgctgaagccactgaaaccaacaaggatcatcctgatgttggatcaatttgatccatttatacagggtttcattgacgacattctagat

SEQ ID NO: 75664 - DNA, 300 bp, Glycine max
  Peptide Sequence Number=SeqID_167349
atgaaacttctctctctccccgtgtttgcgcttctgcttctttttctttcggatctcctcttcttcttcctggttgttgttcattctttgggcgtcttcttcttcattccttgcgcgtcttctttgtgcctctttttcttcttcgttgaggaggtccccgaggtagcttgcggcggtgatccgaggaagcttccgcgaagagcaacggtcggtgaggaggttagcgcgtccgccgtcgagtcgatggcggaaaccattgtcagaaatctcaacatactttacggatcacctgatccgtaa

SEQ ID NO: 75665 - DNA, 417 bp, Glycine max
  Peptide Sequence Number=SeqID_167350
gacattgaggcaacagcaattccacaagaacctctatcttctaaggcatcttctagttttccaactcaagggcaatctcatacaattttagctgaagcaaatatcatggttgaggagccaagaagagttactttggaagactactcaagctcaagaaatagtcttaagacttgggatgaagtagttgagaaattcttgaagaagtacttcccagagtctaagatagctgaagggaaagctgccatttcatccttccatcaatttccagacgaatctttgaggggaaagatcaaattgaagaccccagaagaagctatggaattaatagagaacatggctgctagtgaccatgttgtgtcatatgtggtggagcacatgagtccgactgctgtattccccaagaagaaaaccacatga

SEQ ID NO: 75666 - DNA, 237 bp, Glycine max
  Peptide Sequence Number=SeqID_167351
gaacccgcacgcacacttcagcagcctgtggagtggatactacctacacctacttcatatcgactagtggagccagttcaagtgatagaggtgtcatcctctgaagaggacccagaggagttacctcttgaaccagctgtggatgctcttgacttcccagaggatgatgaggacccactccctgatgttgattctccagaggatatcatgtcagcatttgaggcagactctacatag

SEQ ID NO: 75667 - DNA, 1926 bp, Glycine max
  Peptide Sequence Number=SeqID_167352
atgtctcatgagataagatctccattgtctggggttgttagcatggctgaaattctttctaacacaaaactcgattgggagcaaagacaactcctggatgtcatgctatcttctggagatttggttcttcaaattataaatgacatacttgatctttccaaggtcgagtcaggagtgatgaaattggaagctacaaaattccggccaagagaggtagtcaagcatgtactccagaccgctgtggtttcattgcagaaaatattaaccttagaaggacatgtagcagatgatgtacctattgaggtcattggtgatgttttaaggatgcggcaaattctcacaaatttaattagcaatgccatcaagtttacccatgaaggcagagttggaataaacctttacgttgtgccaaagcctaattttgcaaaagcagaagacatccaaatgatgactccaaaccaatcaactatgtcagtgaatggtgtaaaagaagaacaacatctctcaaaacctcaaagtggcaatgatggaaatcttcttgatggttgtcaaaaacatgacgaccatcccagtcaaaaccatgcattcaatgacgaatgtggatctccggccaaaagtgaatgctcaatgaatggagacactgaggagcaaccttattcagctgaaacaacggtgtggatacgttgtgatgtatatgacacaggcataggaataccagaagatgctataccaaccttatttaaaaggtacatgcaagtcagtgcagaccacactcgaaagtatggtggcacagggctaggactagcaatatgcaaacaactggttgagttgatggggggtcaactaacagtttctagcaaagaacactatggttctactttcactttcattcttccatacaaggtttcaatcgcttgtgatcattctgatgatccggatgagctttctgatttggagaataatgatgtcgcatctgatgatacaatagagagtttcttccaattccaaccacgcactttgggctctcttttctcttctaatggatctagcaggacacagaagttattaacacacaaaattggctacaccagctcacataaacttggtggattttctgagagtttatattcattcccctccaatgatatcatgtcaaaagggacatgttcagttgatgatgcatcttctgtggttgatgctccggagacgtctgaatcggctagttcatctggtcacagcctagaaacaaagaacaaaagtttggttagaagagataaacagcatcaagataaggctcgtgcttggtcctttaatggttatgcagattcctctgaagttactgtgtcaaacggagaaatggctggagcaacaaagtcaagtgaaccccaacaaacatgtcagggtcaagggaaggcaaacacaactactcaatgtgttacaagcagcagcacatcagaagtaaccaaatccacaataaagcctaagatccttcttgttgaagataacaagattaatgtcatggtgacacagtccatgatgaagcaattaggccatagcatagatgttgtgaacaatggagtggaagcagtacgtgcagttcagcgccacacttatgacctgattctgatggatgtctgcatgccagttatggatggtcttcaagcaacaaaactgattcggacttttgaggaaacaggcaattgtgatgctgcaagaagtgctggaattgaggaaagtctaccagatcaagattatgaatgttatgtaccatttacaaagcgggtccccattgttgcggtattattagactattacaaaaatatttccatccttaatagtttcttcagaagccttgattttcctgcttgttcaattttgctaataagttcctatggactaattcaaattctgctcgttaccaaatag

SEQ ID NO: 75668 - DNA, 108 bp, Glycine max
  Peptide Sequence Number=SeqID_167353
atggtcattctgcgtcttgtatcaaccaagaggaacaaattcgacagtatcaagatgatgtgtcgggaggttcactggccgaatggtgtttcgctcgaacgaaattag

SEQ ID NO: 75669 - DNA, 783 bp, Glycine max
  Peptide Sequence Number=SeqID_167354
aggatcccacgatcgttcgtcccccagggacgtcaggatgttctggccgctgctattgaacgtccagagcaccctggatgtgtctatgctgctggagccggtgtcaccatcaagcaatactttggatcggctccacagacgtcccacagcgcttcctccctgcctcctgacgaattacagcagctgacccagcagatcagggaccagctagaggagtccatcacagagaaagtgacgaggcaggtcatggcatccttcagccaccttcagtcgcagatgcaatctcagggagttgcagtgcctcctgagcctgtggttggtcctggtccctccagtcctcgagtgagcacaaaggggagttgtgttgatccctcaggaaacgatcctgagatcggtgactctgataggtgcggcttatacatagaagcagatcctgcacgcctggttgccatcgggagagtttatgagggatccactgttgttcataacactcctttgttgcctggccaagtaaaggtgagtgtggaggaggttagagatgcagatgctccagttcctgtacccactgatgaggtttccttagtggggcaggcacttcacaccttccttgcttggccgacacatctggtcaagtctttatcacagcaggttagatgggatgccaccgtgttcggggtcattaatccagatttccccctgtacataaagcacgaagacctctctgaaatcgcacacggtggtcaatgtctcagcatatcagtgttaccgttgtggattttgtaa

SEQ ID NO: 75670 - DNA, 231 bp, Glycine max
  Peptide Sequence Number=SeqID_167355
atgtcacgaaaccttatggattacgcaaccgtcccctctttggcctctgaaattttacggatctttacggattgtgcattaacgcttcctttcgactcccgacatgtcgcggaatttcacggattgcctaacgatgggtatcaagtacctcgaagtggtcaagtgaaggtcacatcccaccaaactgatggtccccggacgaaattagggtatgacaccatgttttactaa

SEQ ID NO: 75671 - DNA, 384 bp, Glycine max
  Peptide Sequence Number=SeqID_167356
atgttggggaatggctacaagcccggaatgggtttaggcaaggacaacggcggcagaaccagcctggtaagcaccagaggaaaccgtgggaagtttggattaggctataaacccacacaagcggacataaggaaaagtgtcacaggaaggaagagcagaagccaaggttcgcaattgggacgacaagtcaaagagggcccatcctgccacatcagtaggagctttataagtgcgggtctaggacacgaaggccaagtcgttgcgatatgcaagaatgactctccgagtgggtcggatttggtacgaccatgccctcctgatttccgactaggaaattggcgagtggaggagcacccgggcatttacgcgacaagcataatgtaa

SEQ ID NO: 75672 - DNA, 210 bp, Glycine max
  Peptide Sequence Number=SeqID_167357
atgtcaagatttacacgcgattctcctcaaatttcagccagcccgtatcaattagacttcacactttatgcttcggggtcatacaatgctcaatggaatgcccaggggctcctccatgataagcacacgttgcgttcgagtcgtatccttagaaaaatggaggttaaggaaccttggttggggtggtcttcgtcattggaagtgcggtag

SEQ ID NO: 75673 - DNA, 987 bp, Glycine max
  Peptide Sequence Number=SeqID_167358
atgggatggtcgttccacagagagagatgcgtccagctcagggacgatgagtacatgaattttcaggaagaaatagctcaccgacattggacgtcgctagtcactcccatggctaagtttgacccagatatagtcctggggttttatgctaatgcttggcccacagaagagggagtgcgggacatgcggtcatgggtgagggaggaaggccaggagtgtgagtttagtctgaggaggaactgggccgatgggttcgacgaagagaccattgcccagctattatgcataccgggtcaggatttcgctcggactgctgcagggaggtgggtgcggatcatgcgcaccagcatgaccaccttgacccagatgtggatgacgttgctgcttagcaatgtcttgcctagtgatcataactccgaccttcctctgccgaagtgtcagcaggtgtatgccatcctgacacagatgagcgtccatgtggctcagttgattgctaacgccatctatttatttgcaggtatgccacccaccaggcatcctctagacccggataagtctaacagggccctggggttttcagcattgatcgcgggcctctatcagtcatacggggttcccgtcacacctagtaaggtgatccgaccgctgatcacctgggccttcattgagaagtattgcacgcctaggcaggcgcagggtgatgcaccacaggccgcagacgcactgccaatcacctgggtcattaggcatggagcgatacatgagtgtctctaccagctcagcctcagtcagcagggccagggtttcgttccttttgcgtgccctactccagatcagtttagggctgaggtcgcatggcccggagattggcctgaggcccaggcaggggaggtgcctgcagaggctcccggtgatgcagaggaggcccacatggatgaggagatgacgaatttgctcagtttcttaggagggagcggagccacatga

SEQ ID NO: 75674 - DNA, 315 bp, Glycine max
  Peptide Sequence Number=SeqID_167359
atgtcctcacctttacagggctacacgccctcaccatcagaggactacatgtcctcgccttacagagggctacatgtcctcaccttcatagggttacactccctcacctttagagggctacacgccctcgcacttagaggactactcgtccttgccttaagagggctatatgacctcacctttagagggctacacgcccttaccttcagagaactgcaagtcctcgcctacagagggctacatgtcctcaccttcataaggctgtatgtcctcgcctgcagagggctgcacgtcctcaccattagaggactacat

SEQ ID NO: 75675 - DNA, 267 bp, Glycine max
  Peptide Sequence Number=SeqID_167360
atgatcgaaagggacttcgatagtcttcagataggaagggtgcgagcgaccatatgttgtctctgcgtgtcatcggacttgtcgtctctggatgatgaaggtgtggataaccatgaggtatctccacatgctatcggaccctcaagtcacgatagtagaattgagacttgtttgcagtctcggtcggaagatgctgacatctctgggaatggtgcagatgatcacattggtctttgcgtgtcaacagactcgctagcttctagctga

SEQ ID NO: 75676 - DNA, 526 bp, Glycine max
  Peptide Sequence Number=SeqID_167361
ccatttagctaataagcccgtggatattgaggttccacaagcggtatttcctgatactgtatttgaagcagttgttcgaattccttatgatatgcaagtgaaacaagttcttgctaatggtgggaacaggggaaggggtcagatttatcttgacgggagcaagagtaataataatgtgtataatgctacagcagcgggtatggtaaaaaaaatcatacgaaaagaaaaagggggatacgaaataactatagtggatgcattggatgggcgtgaagtgattgatattatacctccaggaccagaacttcttgtttcagaaggtgaatctatcaaacttgatcagccattaacaagtaatccaaatgtgggtggatttggtcagggggatgcggaaatagtacttcaagatccgttacgtgtccaaggtctcttgttcttcttcgcatctattattttagcacaaatctttttagttcttaagaagaaacaatttgagaaggttcaattgtccgaaatgaatttctag

SEQ ID NO: 75677 - DNA, 449 bp, Glycine max
  Peptide Sequence Number=SeqID_167362
gatccgaaaggagaacgccgaactgcgagacataaatatagccaccaccaaggccttagaacaagagaccaagagggcccgaagggaagaacatggtcggaacaaattccaaggggctctgatttgcctaaggtctaagaggagcttgtctcagcggttatgcgagaccgagaccaacatgttagccatcatcagcaagttccaaaaagaattaaatctagccacgacccacgagcacaaagtggcggacgaatatgcccgagtgtacgtggaaaaggaggctagaggaaagatgattgactcgttacatcaagaggcaacgatgtggatggaccgatttgctcttactttgaatgggagtcaagaacttccccgattgctggccaaggccagagcattggcggacgcctactccgcacccgaggagatccacagactcctcagctatt

SEQ ID NO: 75678 - DNA, 204 bp, Glycine max
  Peptide Sequence Number=SeqID_167363
atgatgaatgcacctgactcaactctcagatgcaatgtggaaaccattcagagttcgtcgaagccacccggttgcgcacgtaactgcccccccataggtgatcagcctggggcccaaaggagttccttaccaggtgacaagtcccctcagtacaaagtacactctgccataattattctatttctcgtgtcatatgagctatga

SEQ ID NO: 75679 - DNA, 459 bp, Glycine max
  Peptide Sequence Number=SeqID_167364
atggccatatacagagatatcatgttgaaaagtcatcgactagtggattatgaatttccatatccagtcttgacctcaagattcattgattacttcaatatcaatgtttctaatgagattgtagactttaccaaagcctctaatgagataactgaaaggcatatcaagaagctttgcatggaatatgttgatcatgagtgggtcatggtaggagaacaatcgacaacaacacacgttgatctggtggaagaagaagctcaacaagagctaactcctcaatggaacccttttgagtcccttatgattcaaaggatggatgtccaatctcaagactcttcaaatgcactcaatgtcgtattcaagtttggcatcatcaaagccaaaatgggagagattgttagagataagggagtagcaacatggaaaaacctaaggctaaagcttgaagctcaaggctaa

SEQ ID NO: 75680 - DNA, 885 bp, Glycine max
  Peptide Sequence Number=SeqID_167365
atgggcccgaaatctaccctaaggctcataagaatcctagggccttctcttgcatctctggcccaatctacttggagttttctatccaatgcccttgcggggatgtgcgcaaaaaggcacaggccatccaaaaacagaactactgccccccacgtatctagcaatactttggattggctccatggacgtcccgcagctcttcctccctgcctcctgaagaattacagcagccgacccacaaatcagggaccagctagaggagtccatcacagaaaacgtgacgtgacagctcatgacatcattcagccagatgtagtcccagattcaatcccagggacttgcactgcctcccgagcctctggaaacgatcctgagacgagtgacttagataggtgcggcttgtacatcgaagcagatcctaactgcctggttgccctggggagagtttatgagggatccactattgttcataacactactttgttgcctggccaagtaaaggtgggtgtggaggaggttacagatgcagatgctccagttcttgtatccactgatgaggtttccttagtggggcaggcaattcacaccttccttgcttggccgacacttctggtcaagtctttatcacagcaggtagttgtgtctccggcaaaaccacctccaaagcccgatccggaggttgatgatccgctttatctgatgacattgaccatcccagagcttttcttgaggccttatcaggttacatgggatgccaccatgttcggggcctttaatccagatttcccgctctacataaagcaacgaagacctctccgaaatcgcacacggtggtcaatgtctcagcatttcagtgttacagttgtggattatgcatctcactga

SEQ ID NO: 75681 - DNA, 1572 bp, Glycine max
  Peptide Sequence Number=SeqID_167366
gcgttgctcggcccgcaggcgttcaccaatctgcccgagcaacttctcgttgacctcggccagctcgcgggtacgttcttccacgcgcttttccagctcggcatgcgccgagcgcagccgctgctggtcgcgctgacgggccaggccggtaccgatgttctgtgcgacgaaggtcagcaggcgctggtcatgcacgctgaaaatgctgttctcgctgtagctctgcaccacgatcgcgccgaccacttcgtcgtcgcgcagcagtggtacgcccagccagcagtgcgaacgcgcaccggattcacgcacttcgccactggccagcagcgcatcgatctgcgcgcgcgaggccagcagcgggcgccggttgcgcaccacgtattcggtcaggccccggctgaagggccgtggcgcgcggctggcattgtgctcgtccaccgaatacacgaaatccaggccgttgccggccgggttgaccagggcgatgtagaaattgcgtgcgtcgagcaggcgcccaaccacgccatgcacctgtccgtagaactgggccaggctgtcggccgacatcgccatctcggcaatgttgtagagcgcggtctgcagctgttcggcgcgacgccgctcggttacttcgtcctgcaggctgtggttggcccgctgcagttcctgggtacgccgctctacctgctgctccagccgcacctgcgcctggcgccggtccatcgcggtctgcacatgctgcgcaacgaaacccagcaatgcgcgctcggcctcgccatagcgggccgcctgttcatagctctgaaccacgatggcaccgcatacacggccatcgcgcagcatcggcacgcccagccagtccaggctttccggcccacgctgcgggtcgtgctcctgttccatcacctgcgccagcagtttgcgcgagggaccactgagcggtttgccatggcgcagcagcgccacggtcaggctgcgcggcatctcgctggcgtcatggctctgcgtgggatcggcgacgaagtcatcgacctgatcggcgaagtacaggaaccggatctggtcgcgcacatcgtcgtattcgacgatgtagcagttctcggcatacatcagcgtgcccagcacaccatgcacgtggcgcagcatctcgggcatttcaaggtcggcaccggccaggtctgcaatctggaacagggcctgctgcaaccgctcggcctcttccagtgccttgatctggccggcctggcggccgcgctcagcgccagctccatcgcctgccgggcaacgccccaccatgccggcgaaggcactgcgccttcgaccgacaacagcaggcgcgcaccatcatgttcccagccgtgctggccatcgcccgcgccgggtgccgccgcatcacctccggcagccgctgtcggccagcccccctggccacgaccgagctgcgggtcgtcccagccgacgcggaccacggccgtttccggcaaaagcgcatgcaacgcgcgcaccagcgccgtgctcagcacggcctcgtgtggtggctcttccgccggttcagcatgcgtggacaaatga

SEQ ID NO: 75682 - DNA, 926 bp, Glycine max
  Peptide Sequence Number=SeqID_167367
aaacatcttgccagaaaggaaggtggagctctaccacactgagtttgatgattttaagactgagttggagaggcgtaatctccataaacgcctcaccaatttggttgatgggagcatagatgtggctttggtgaaagagttctatgaaaacctatatagctctgagggccctttaccaaagcaagcccgggtcagaggccatctagtgaagatcaacgctgatagcctcaacacattcgtagagacacctgtggtgttggcagagggtgagactttgcccacatactccagatactgcaggctgcctttagatcctagggagattgaggctgccctatgcataccaggccgagggttcatcttgaacgctgagggccatcctgggaggatcctgaggaaggacttgacgactttagcccaggtgtggagtgttctctcatactccaacctggcccccacatcgcacacctctgacctgacagtggacagatctaactcttctagacttgggtttcctgctctgatcaccgccctatgtcgagccagaggggttgtctctaacagcctcacttttgaacgtctgagcccggtcattaacttggcctacatcaggaagaactgttggaatcctgatgatctgatagttgctatccgaggggctaggagggcgagggcgaggccagctgatcttccttccacatctgcagctcctactctagcatccacttcagcaactcctttagtcccatctcagatggattctcaacgctttgaagccatgcttcagagcattcatcagggacagatcattttacttcagagtttacaggtggtggtgcctccagggtccattccttccattgagaagtttctaaaaagggtagcctggattggggcccaaccttctcttcatagggaagatgaag

SEQ ID NO: 75683 - DNA, 282 bp, Glycine max
  Peptide Sequence Number=SeqID_167368
atgactgttgcagatagtattaagacaactttccctaaaatcgaaagtgctaaaaggtttataggattagtgggagagtattctcaaatagctgataagtctgttgttgggacattaatgagtacattgaccaccatgaagtttgatggttcacgtactatgtatgaacatgtcaatgagatgacaaacattataagattccttaccatccaaaccataagcccaaatgagaagttcggttttcatgggaaatggagtgaaagctccagtggaaacaattga

SEQ ID NO: 75684 - DNA, 132 bp, Glycine max
  Peptide Sequence Number=SeqID_167369
atgtcgggccggatccaaaggcggagaccaatcaaggaacggacgcaagtagaagctaggatcaagatcgatagatcgtcgtcccatgcccagctctggacaagcggaaagcaccgctgggaagcagcctag

SEQ ID NO: 75685 - DNA, 219 bp, Glycine max
  Peptide Sequence Number=SeqID_167370
atggattcctttgcttcttggaagatgaatagtagtggaatagagaaggaagagagagagaggagatgccacttcaagaagaagatgagtctagaagaagctcaccaccaaaggaggcgatggataagagcttggaggaagaaggagatgaatgaaaggaaagggagagtagagcatgaaattttgtgctctaagagagctctaaaatctgaaatttaa

SEQ ID NO: 75686 - DNA, 733 bp, Glycine max
  Peptide Sequence Number=SeqID_167371
atggcttccagaaaaagaaagagtattggtacaaggcccacagctcagtatgatacacagaggttccactcctttaaggcctggacccgatacatagataatgttctaggaagacatatactgcctgagaggaaggtagaaatataccatactgagctggacgagtttaaggttgagttggagaggcgtaacttctataaaagcctcaccaatttagttgacaatagcatagatctagctttggtaaaggagttttatgccaacctttacatctctgaaggaccttcaccaaagcaagtcaaggtcagaggccacgtggtgaagattgatgcagacagcctcaacatctttctagaaacacctgtggtactagctgagggtgaaaccttacccgcatattccaaatactgcaggttgcccacttatatcagagaaattgaggctgccttatgtatagcagatcgggggtttgttttgaatgttgaaggccaccttgggaagattctcaggaaacatttaacaactcttgctcaggtgtggagtgttctctcgtactccaacctggctcctacttcccacacctcagacctgacagtagatcgagccaggctgatctttggcctagtctctcagatggacatgaatgtgggagctctcatctctggtcaaattacatctatggcccagtctaactcttctagacttgggttccctgctcttatcaccgctttat

SEQ ID NO: 75687 - DNA, 195 bp, Glycine max
  Peptide Sequence Number=SeqID_167372
gttcactgcaaaggatgtcaagggatggctgaggatttaggagcgattgctgaggattttgagcgggtcatcaacctcaggatggtcattgagggcattgacttacatgacatcatgactcgttgtctgaagagagttagaggtaacgtcgcagatggaagtcttaggctgcgccagagacgccgcatagattag

SEQ ID NO: 75688 - DNA, 453 bp, Glycine max
  Peptide Sequence Number=SeqID_167373
caatctggaaagagtggcattgattctgtggctacctctcagaaactaaagggagaccttagggccattttcaatgttctttcaaaggacatgcaacaactcatgctttcaaaccctgaaagggcgtcccttctgcaaccaagtccagagtcaccaaaacttccagggcgtccgctcatacaagttgcggttgggtcttctacatcaccccggggtatttcgacatccggtgacttctctcctctgatgagagacagaaaaattgagttggtcgtggaagccgtaacgaccaattgtttcgaagttgttggaagcggtgatttagagcttgtagggaaggttgtcctccgacatgatgagaagttttctgttgaagaacacgaggccagtgttggcggcgccaatgctgttgcgatggtcgacaatgccgcaagggcctcatgcatagaataa

SEQ ID NO: 75689 - DNA, 765 bp, Glycine max
  Peptide Sequence Number=SeqID_167374
atggcctccaagaagcgtaagagcattggggcaaggccaactgctcactttgaggacccttcaccaaagcaagccagatttagaggccacccagtgaagatagacgccgacagcctcaacccatttctagagactcctgtagttctagaggagggggagacattacccacctactctaggtactgcaggttgcccgtagaccacggagagattgaggctactctttgcataccagggatggggttcattttgaatgctgagggccatctagggaggattctcaggaaggatctgactaccttggcccaggtgtggagtgttctcccctactccaacctggcccctacatctcatacatcaaaccttactatggacagagccagcttgatctttggcctggtctctcatatggatatgaacatcggcgctctcatctcaggacagatgacttctattgcccagtctaactcttcccgaggggttgtctctgacaacctcacatttgagcgcttgagcccgatcattaacttggcctacatcaggaagaactattggaatcctgatgatctaacagttgcttttcggggggctaggaaggcgagggcgaggccagctgatattccatctacttctgcagctccagcacctactccagcatctacttctacagctccttcagttccagctcatgttgactcgcattgctttgaagccatgcttcaaactatccatcagggacagattctattgctgcagagtctatag

SEQ ID NO: 75690 - DNA, 189 bp, Glycine max
  Peptide Sequence Number=SeqID_167375
atggataagagcttgaaggtaggagaagatgagtggagagagaaggagagtaggagcacgaaattttgtgcttcaaaagaggagaattataagcaattgggcttgaatccggaattgggcttggacttgaagagagcatacaattttattttatcaaatcgtatcttatccagattttatttcatctag

SEQ ID NO: 75691 - DNA, 275 bp, Glycine max
  Peptide Sequence Number=SeqID_167376
atggttcaacccactaatccaagatcaagtccaagattctccactaagaaatgtgcaaaatactcaaaaggagggcaaaagggtcacttttggggcattcttcagcccttgagccacctagataacttcatgatgaagtccataatgaagaagaaaaaagagaaaaagaagctaaaacgccgccaaatcgtgactgcgactgatttctacatcgtttgtcattcgttcttcatcgctcttcggtcgttcttcgttggttctttgttcttcatccg

SEQ ID NO: 75692 - DNA, 778 bp, Glycine max
  Peptide Sequence Number=SeqID_167377
tggtacctggagatatgtcgcgggggtcaggagaccttggggacatcaggcgagctcctggcagtcaacagatataaggaactgtgaccacaaagcaaggaggcttgtgtggtggctggccagctgtgaatcttgtgtgatatatgggttatggcttctggtaatcgattaccaagggcttgaaaacgaggtcaggaagctaggagagcttctggtaatcgattaccaaggggcctctggtaatcgattaccagtctgtgtaatcgattacacagaggaatgggtcactggttttcatgtcctgaagctgtgtgattcgagtgtggcctctggtaatcgattaccaaggctgtgtaatcgattaccagagatgaaaagccttgagataccccttttacctgcatgtggtggttatgagacgcattgtgttgcggctggagatggagtacctagagggagcttaggagaccctcgaaggcaatatgaggtgccgatttcggggcacgattcgatttacggctacttcattgtccaagtgattgaggtgacgtcatccgaggaagaccctgaggaggaccctgaggaactacctcccgagcctgctgtggatgctcttgactttctagagggtgatgaggacccactccctgaggtggattctcccgaggacgtcatgtcggcatctgaggcagactctacggaggatagtggccctagagagatggcgattattattgatactgaagatttagccatgcaaggaattgaagataattaa

SEQ ID NO: 75693 - DNA, 240 bp, Glycine max
  Peptide Sequence Number=SeqID_167378
atgtgtcataccctaatttcgtccggggaccatctgtttggtgggatgcaacctttgcttgaccgcatcgagcaaaaaaaggcaaagggggtgtatttagtaaacaggggtgtgcaaatagcaatcaggcccacttggaccttccagggtgttccaacagaaggcggtgccttctggtggaagcaacccagctcgcctgggcgtgttaggcagcaaccacctccctctttccccctataa

SEQ ID NO: 75694 - DNA, 99 bp, Glycine max
  Peptide Sequence Number=SeqID_167379
atggatttgaagtatgatgagcgaaagggattgattaaagaaggagctacgaagatttggatgatgccacttccagtgaaggaagataagtcagggtag

SEQ ID NO: 75695 - DNA, 237 bp, Glycine max
  Peptide Sequence Number=SeqID_167380
atggttaaggcaaagggtcattttggtggacttgcagctcgcccaggcgagctaaggcttactcctgaagtaactagctcgcccaggcgagctggttcctttaccctgaagtcatttgggggtccaggtgaactagaggctagtctgggtgagctagggtccaggaaactcaatgaaaagatccttttgtctcccttttttggtatttttcgtattcttgatcaaaacactgaataa

SEQ ID NO: 75696 - DNA, 999 bp, Glycine max
  Peptide Sequence Number=SeqID_167381
atgacatcaaggaaaaggaagagcactgcttctaggtcacaggctcagtatgataccaggagattccaatccttggaagcctggaaccgatattcagataacattctggatcggaggatccttccggaaaggaatgttaagatttatcatattgagttcaacgagtttaaggcaaagttggagaggcgtaacttacacaaatgtctcactaaccttcaagagggaagcataaacttggctctggtcaagggattcgatgcaaacttatacaacccggatgaccagagccgtaagcaagtgaggagtttgttgctcgtctctgcaccaccagctcctcccacttctgccactcctacactagctgcccaagactctcaacgctttgaagccatgcttcagagtattcatcaggggcaaattttattactgcagaacttgcaggtggtatctcctccagggtctattctgtcagtagagcagttcatcaagaaggaatcttggcctggaaccttaccttctactgtgagagagggtgagggtcctagtgctcaggtacctcaacaggtacaggatgcatcttctgaggctaccatccctggagcttttgattttttaggtggaagagtaaatatgagacctgaggaggctatttttcctgagccagttgtgccagttatacatgaaattgtggaagcaagtgggtcacaattgagacaggaggctgctactcctgagaggacatcacagaccccagaagatccaccctcaccatgggtggagctatcttttgctcaacaggtagcagatcctcctgcacctgtacatgcgagaccagctgacccctctactcctattttagagataccagaggaccctaccacactagtcctaacactgaacaccactcctccagccacacccgagcttcattttacagataaggagaacactcaggaccaggatactcagggcactcaggaccagtcacaagaattttga

SEQ ID NO: 75697 - DNA, 165 bp, Glycine max
  Peptide Sequence Number=SeqID_167382
atggactcgggaaggttccagattagtataccaggtgacggctgccccagaacagtctttccaccgcaaaatgtaagggttgtggttgtgggcgatactaagggccctccaaagtgtttggcaagggtatgccaccaaacgcttgcccctcagtggcatatctga

SEQ ID NO: 75698 - DNA, 558 bp, Glycine max
  Peptide Sequence Number=SeqID_167383
atgcaagcttggcactggccgtcgtattacaacgtcgtgactgggaaaaccctggcgttacccaacttaatcgccttgcagcacatccccctttcgccagctggcgtaaatagcgaagaggcccgcaccgatacgcccttcccaacagttgcgcagcctgaatggcgaatggcgcctgatgcgacaagctgtgaccgtctccgggagctgcatgtgtcagaggttttcaccgtcatcaccgaaacgcgcgagacgaaagggcctcgtgatacgcctatttttatagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgaca

SEQ ID NO: 75699 - DNA, 132 bp, Glycine max
  Peptide Sequence Number=SeqID_167384
atgagcaagaggctccaagaagattgggctagagctgctgaagaaggccctggggttctcatgaaccttagggtagggtaccctaggaatataggatttttcagcccttgtattttcgggcacctagactag

SEQ ID NO: 75700 - DNA, 190 bp, Glycine max
  Peptide Sequence Number=SeqID_167385
atgggagtttgcaaaatacatagtgacatccagagcaaagagtctccactattcgccgtccctccagggctgctctcctccgtagagtctgtctcagatgctgacatgacatcctctggagaatccacatcagggagtgggtcctcatcatcctctggaaagtcaagagcatccacagcaggctcaggag

SEQ ID NO: 75701 - DNA, 396 bp, Glycine max
  Peptide Sequence Number=SeqID_167386
atgacagtgaaaaacctcattgggcgcctaggagtacatgacaagacagaccagacactgataagtcaggttactctcactagagaaacgcgagggattagaaccagagaagcggcacgcaaaccgaggcaagattttagcattcaaaagaaaattcagaagctcttctcatctcccacgttgcttttcttctccctttctcctccaccattgttgcccatcaaagctccaaactttgctcaccatttctactccaaattgcaaaaggaagccattttcggagtcatgaagcgcacctctacgttgtgggacttcaaatttcaggtagaaaagtgtgagattttgagggctagagaagctaaatttggggttagtgtaaattggagtctaaagtga

SEQ ID NO: 75702 - DNA, 327 bp, Glycine max
  Peptide Sequence Number=SeqID_167387
atggttagaacaagaggtggaccttgtgccttaggtagtggtacaggcagaggcatgggtcaggatgagcatgatgttgatgttcatgtcactgaggaagttcctcaagtgactgaggatgttcctcctcaggtgactaaggatattcctgatgtgactgaggatgtccctcatgtggacgaggacatgacgactgtgcacgtagatgccacggacgtagctgctgatggtgttgaggggtcacctgttgatcatggccagggattccttggtggcccacgtgacacatcagtgctgacgtcgtttgctaaccatatgtctaattaa

SEQ ID NO: 75703 - DNA, 492 bp, Glycine max
  Peptide Sequence Number=SeqID_167388
atggatgactggacacactatgccgcagtgttaatgtgccttagagacattaggcataacaaatttgaagattccttaataggaactgtagaaacaagtctaggacaaggtctagtttatttcaattgttacccaaacaaaacagtgagtctgatggatagaaacattcttgactctctgttcctaaacatccactttcatgggcttaacatgaaagagggatcaattccaacagccttaatctataggattcagtacaaggctaatgtttctctccaaagaaccataaaatgggatgaggtaactcttcctgaaaaatgggtcatgaacaaatcaaacaagacaactccgggagaactgccaggaaaccacattacaagcgaaacctcaaagagagttgggcttcgtcctcaaaaggaaacaacaccagaaaatctagccttccatggattcaaacagaaaatgcaattgaaacatgaagcagaaacataa

SEQ ID NO: 75704 - DNA, 183 bp, Glycine max
  Peptide Sequence Number=SeqID_167389
atggaggtagccgtagaagcaatcgacatgaagcgcataatcatgctcacaccattctcgataacatctatgaagaacgggggattcgacatcttgctcgacggcatgccacatgtcagtatagaacatggtgctctcaccaaccatggatatggctccactctagtcaagaatgccaaatga

SEQ ID NO: 75705 - DNA, 540 bp, Glycine max
  Peptide Sequence Number=SeqID_167390
atgaacaaaatcaggatcttccacgagaagaaaatataccctgcggaagaagcttccgcaagttcttccgcgacaacaaaatgtagcctgcggaagaaggttctgcaggatcttccgcgggatccgcagaagataacattcttccgctggatcacgcggaagatcctgcagaaccttcttctgttggatcacgcggaagatcctgcagaaccttctttcgttggatcacacggaagatcctgcagaaccttcttctgcaggaatctgcggaagaaccttccacacttcttccgcatgaccccgcggaagaacaccttcttccgctatagttcccagaagccactttcagacgcgcggaagaaggttcttctcacggaagaaccttcgtcttcaacctccaccaccacagggtatttttggtacttcattgaattgttgggtgcaccagcaattttgctgggtgcacctagcaacaccccaactggaaaagggacagcagagaagccaggtccatttactctggtcatgtttgttgcctag

SEQ ID NO: 75706 - DNA, 441 bp, Glycine max
  Peptide Sequence Number=SeqID_167391
atggcccacttggagctctcgattcccatggcgcggctcaacagagcagccgcaccgtcctacctatttaaatctttcgcccctatacccaagtcagacgaacgatttgcacgtcagtatcgctgcgggcctccaccagagtttcctctggcttcgccccgctcaggcatagttcaccatctttcgggtcccgacaggtatgctctcactcgaacccttcacagaagatcagggtcggtcggcggtgcaacccacagggggatcccaccaatcagcttccttgcgccttacgggtttactcgcccgttgactcgcacacatgtcagactccttggtccgtgtttcaagacgggccgaatggggagcccacaggccgacgccaggagcgcgcaggtgccgaggcacgccaagggcgcgcgctgccatccacaatcgcgatga

SEQ ID NO: 75707 - DNA, 285 bp, Glycine max
  Peptide Sequence Number=SeqID_167392
gctcagggtgatgctccacaggccgcaggcgcgccaccaccacctcatcaggctgggcaggctggggcatttgacatggagcagtatttacggcatttgggcttcgcttctttttcatgccctactccagaccagttcagggcagaggttgcatggcccggagattggcccgaggcccaagcgggagaggcacccccagaagctcccggcgatggagaagaggcccacgaggacgaggagatggccgatttgcttgacttcttgggagggagtggagatacatga

SEQ ID NO: 75708 - DNA, 138 bp, Glycine max
  Peptide Sequence Number=SeqID_167393
atgaatgacaaattccttggaaacaagggtgcccactttgtgatgcaatccaaccccgcaagggcattggctagaagactccaagtagattgggctagagatccaaggaaaggccctagggttctcatgagccttagg

SEQ ID NO: 75709 - DNA, 627 bp, Glycine max
  Peptide Sequence Number=SeqID_167394
atggaggtcaatgcagctacagttgttgccgcaagtaccgccacggaattggacccgactcaccaacctggcttcaatcaagtaaatcatccagcctcggatatggtaggtcagggaggcaaagcgttgggaagtatgggcggcccccattttgtgcaggtccagagcaagcattccttcccaccatatggcttgcctcccaactatacaccacccaatgttgcacacgttcctgatgagaatgtcgacaactctgctcccatacccattgagagccaacatccccaatctggtcatgcacaggtctctcaacccatgggggagacacatgaagcacctcgagaccataatctagtcaacttcgagcctcacgtcggatatgccactgaggggcaggcattttgcagcgtacccttgtcaaatacttttgagggccctcagtatcgcccactaccacaaccattgcattttgcagtgggaagagtcccttctgctatggtggaaagggagagatttgatcatatagaggagaggctgagggttattgaaggaggcggagattatgcctttgctgacatggcagaactgtgcctagtgtccgacgtcgttatccctctgaagttcaag

SEQ ID NO: 75710 - DNA, 368 bp, Glycine max
  Peptide Sequence Number=SeqID_167395
atggcttacgaacggggcggagatttcctggaagatgccaggaagatacttaacagggaagcgtttccccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccgtcatgcgccggttaaggctaaactgaaaggacaagttttggtgactgcgctcctccagccagttacctcggttcaaagagttggtagctcagagaaccttcgaaaaaccgccctgcagcg

SEQ ID NO: 75711 - DNA, 219 bp, Glycine max
  Peptide Sequence Number=SeqID_167396
atgagggaggggagttttgggtggagagaaactccccttcccctcgtttttatgtttccaggtgcaggggtgctcgcccaggcaaactcagctcgcccaggcgagctaaccctgtatatttttttgaagacacagctgtgcctcccgcttgtctggagctgggcatgggacgacgatccatcgatcatgggactagcctctactcgtgtccgtccctaa

SEQ ID NO: 75712 - DNA, 1311 bp, Glycine max
  misc_feature (42)..(42): n is a, c, g, or t
  Peptide Sequence Number=SeqID_167397
atggccaaccgcaagccgggcgatgctgaacgggtttacgcntacggcctctatttgtccggtaataatcaggatgatagggcgctggcgcaaattaacgcgctgccgcgcggacagtggaccgataatattcgtgaactggaagggcgtctgcaaagcgacaaagtgatgcgcgaggccaaccaacttcgcgatagcgggcaggaagcgcaggccattgccttgattaaacagcagccggaatcgatccgctacgatctggcgttggcggattgggcgcagcagcgcggcgatagcgcagaggcgatagcccagtaccatcgggtgctgagccagcaggctgataatggcgatgcgcgtcttggcctggcggaagtctatctcgccgagggcgataaaaacgccgcccgcgcgcaggtcgcgcagttgaaggatgcggatacggaatcgatcaacatgcagcgccgggtagcgctggcccgcgccggatttgacgataccgcgggcgcgcaacaaatatttgaccgcatcgtgccgcaggcgaaaagccagccgccgtcgatggaaagcgcgctggtgctgcgtgatgccgcgcgtttccagacgcaaagcgagcaaccacagcaggccctggaaagctataaagacgcgatggtggccgctggcgtgacccgcgttcgctcgcaggataatgacacttttacccgcctgacccgtaacgatagccaggatgactggctgaaacgcgggatccgcagcgacgccgccgatctttatcgccagcaggatcttaacgttacccttgagcacgactattggggatcgagcggcaccggcggttattcagacctcaaagcgcacactaccatgttgcaggtggacgcgccgttgtatgacgggcggatgttcttccgtaccgatgtggtgaatatgaacgccgggtcgttttccactaatagcgatggcggttattcgccgagttggggaacctgtggtgaaattagctgctatggcggcagtaaaaatcagagcgatggcggcgccagcgtagcggttggctggaagaacgacacctggagcggcgatatcggcaccacgccgatgggctttaacgtggtggatgtcgtggggggactgagttatagcggcgatgccggcccggtcggctataccgtcaacgtccaccggcgacccatttccagctcgttgctctccttcggcgggcaaaaagataatcctaacgacggccataccggcactacctggggcggcgtccgcgccgccggcggcggcatcagcctcagctacgat

SEQ ID NO: 75713 - DNA, 195 bp, Glycine max
  Peptide Sequence Number=SeqID_167398
atgactttcgaatcgttcaaaacctctggtgaagttcaacaatatggtggttatatcactgtcaatgaaactcaaggaatagcactgttctattggtttttcgaggccactcacaaaccagaacaaaaacccattctcttatggctcaatggaggaatagagagagatgaatttgatgataatttatggaaatga

SEQ ID NO: 75714 - DNA, 315 bp, Glycine max
  Peptide Sequence Number=SeqID_167399
atggtttttcacttaaggcttgtaatgagcttcaaaataaagaaagggaaacataggctcaaagggctatcaaaggaattaattaaaggaagcatcaacaagaatcaagccaaggctattgtgcaagcaatcaatggggcaaacacaccaaatgattatgatgatggctcaaattctcacaaagggtggagtaaggaagtctcttcccccactgcgtccactaaaaaaaggtttgtaaggaatggcttaagtcggtgtccattgaccttgaagctcttgtttgtggagtcccttttgatctcaactgtaccataa

SEQ ID NO: 75715 - DNA, 339 bp, Glycine max
  Peptide Sequence Number=SeqID_167400
tcgttcggagtccctgtcgcacctagtaaggtgattcggccacccatcacccgggcttttattgagaagtattgcacgcagagacaggcccagagtgatgcaccacaggccacaggcgcgccaccaccacctcatcaggctgacccagctgggtcatttgacacagagcggtatttgcggtactcgatgcgccagcacgcggccaaccacagggggctggggcaggtacatgagtgtctctaccagctaagcctcagcatgcagagccagggcttcgctccttttccgtgccctactccataccagttcaaggcagaggtcgcatggcccggggattga

SEQ ID NO: 75716 - DNA, 357 bp, Glycine max
  Peptide Sequence Number=SeqID_167401
gccgcggacgcgccgccacctcatcaggttggtccagccggatcatttgacacggagcagtatttgcgacatttggttcgccagcaggcggccaaccaccgggcgcatgtacagactcatgattgtctttatcagatgagtctcagcctccagagtcagggctttacttcttttccgtgccctactccggaccagtttagggcagaggtcgcgtggcctggggattggcctgaggcccaggcaggagaggcacttgcaggggcaccaacagaggctcccgatgaggcagatgaggcccgcgaggacgaagagatgaccgatttacttgatttcttaggagggagtggagccgcatga

SEQ ID NO: 75717 - DNA, 93 bp, Glycine max
  Peptide Sequence Number=SeqID_167402
atgacgggagatgcatcaaagtttattcatatttctcccaagaatagtggacacgtgacctatggagacaacaacaaagtcaggtcgaaataa

SEQ ID NO: 75718 - DNA, 255 bp, Glycine max
  Peptide Sequence Number=SeqID_167403
atgaaaaggaaatggcttcgagaaagctttccaaaaagagatctaggagggacgccgcgcctgaagggaccagtgccgctcccgagtttgacagccatcgtttcaggagcgctgaacaccagtagcgtttcaaggccatcaaaggatggtcgttccaccgagagagacgcatccagctcagggacgatgagtgcacagatttttaggaagagtagctcgtcggcgttggacatcgctggtcactcccatggctaa

SEQ ID NO: 75719 - DNA, 75 bp, Glycine max
  Peptide Sequence Number=SeqID_167404
atggcttcttcttcgtcttctcagccaggagcttcggctccaaatagtcataaacccccactagccaaaacatga

SEQ ID NO: 75720 - DNA, 448 bp, Glycine max
  Peptide Sequence Number=SeqID_167405
atggatatgaggagaaatgggttgctcaacatcatggtcattgatacacgtggtgcacaagataagaaagcctgcactcaatgtagatgtgacaatatgaatctcccgaaggactttataatgtcacaagggatatacataaccaagattgactacaaatataaaggaggtctcttttgttgtcaggacaacttacaatgcaagcaaatagagggttttcaaggttcaaggagaatggcagagtataccattccagctggtggtggtggtgattctcctcatgtccaaaaagcaaacatcccaatggaaaatggaggttatctaatttatggcactgctcatatgcattcaggtgttgtaaatgcaactttatatggacaggatggaaggactttatgtacatcaacaccaaaatatggaacgggaaaagaggctggaaatgagaaag

SEQ ID NO: 75721 - DNA, 432 bp, Glycine max
  Peptide Sequence Number=SeqID_167406
atggtacctaatgcatggttaactaagaaaagatgtttcttcgggcatctcaattgcataattacattttccatgcatagcatacgtattcccgagtctttcatctttatgaaatgttgtcgaagtattggcgatcaaattgtcattctttggattatggggttgaaccaagctcatgcttttacggaaagaaaaaaacatgttttacggtgtccttacctaacccgtgctagagctagagtaatgggtgaagtagaggaggtgcaagagcagatgaaggccaacatggaggccatgaaagagaaaatggccacaatcatggaggccatgatgagcatgaagaagataatggaagccgatgcggttgtaattgccgcaaccagcgctgttgttaaggtgaacccgatgcccccatctgatctcaaccaatga

SEQ ID NO: 75722 - DNA, 486 bp, Glycine max
  Peptide Sequence Number=SeqID_167407
gtttcattcatctatggtcttcactccattatggcaagaagatctctttggataaatctgaatagtatcaatgctaatatgaattgcccctgctcctcattggtgacttcaactccattcttctcccaccgaccgtttcaaggagctgagcccaatgcttatgagtgcaagattttgttgattgctattctgacctggggttggggagcatcaacactcatgaaagccccttatacacagttggtagtgcctagaggtaattctccatttaaattcaacaatgctattgtggatcatccaaatttgattaagatatctgttgcagatgagttcagcaacatctccaaccgagtagagctagctgaggctgaatataacagtgtgcttaattctctaaagcaaaatcctcaagatccttcccttcttgctctggcaaaccgcactagagtgcttgagacattatgcttagaaaagcagagtctatga

SEQ ID NO: 75723 - DNA, 633 bp, Glycine max
  Peptide Sequence Number=SeqID_167408
atgggaaatattgaaactgtcctttccagcagtattgctgctgtcttttttgcagcttttgtcgttgctggaactatgtggtatggttcagcaacaacccctattgaattattcggtcctactcgttatcaatgggatcagggatactttcagcaagaaatatatcgaagagttggtgctggactagccgaaaatcaaagtttatcagaagcttggtctaaaattcccgaaaaattagctttttatgattatatcggaaataatccagcaaaaggggggttatttagagcaggttcaatggacaatggagatggaatagccgtcgatggggatggaattgttagggccgatgttccttttcgaagggcagaatctaaatatagtgtggaacaagtaggtgtaattgttgagttctatggtggcgagcttaatggagtcagttatagcgatcccgctactgtgaaaaaatatgctagacgtgctcaattgggtgaaatttttgaattagatcgtgctactttgaaatcagatggtgtttttcgtagcagtccgaggggttggtttacttttggacatgcttcttttgctctgctattctttttcgggcacatttggcatggggggatcctctag

SEQ ID NO: 75724 - DNA, 295 bp, Glycine max
  Peptide Sequence Number=SeqID_167409
atgcaaagaaggtcttctgcaggtgttttgattctcatagacttggaaattaatgcaacttgtaggaaaaggaacgccgaaagaaatagaaagtttttgcaggacattgaggcagcagcaattcaggaagaacctctatcttccgaggcatcttctagttttccaaaaaccggggaatcttacacggtattacttgaagccaatatcatggctgatgagccaagacgagtgaccctggaagattactcaagtacttctgtgctgcaattcttcataagcattgcgcggccagagg

SEQ ID NO: 75725 - DNA, 183 bp, Glycine max
  Peptide Sequence Number=SeqID_167410
atgacattaggtgctgaattcaatgtggaaagcttaacatgtagagattggaacacatcatcgaaagtatcccaaaaggtgcaagaaaagaaaagaactacctatataagcatgaagtttagccgcttcaagaagctgggacttggctttgatatgcttatgaaggatagggacacaggctag

SEQ ID NO: 75726 - DNA, 105 bp, Glycine max
  Peptide Sequence Number=SeqID_167411
atgggtattcttcactttacgactccaccatctcaacgctttggctatagccatgtgtgtgcacttttgaaagacgcggttgggacttgggcgatgaccgcgtag

SEQ ID NO: 75727 - DNA, 267 bp, Glycine max
  Peptide Sequence Number=SeqID_167412
atggcaaggagtgcatcgtcgtacaactttgagtcccaaagtcggatgttgtgtttgtgtaacgtagaggttttactagtgacatcgtggactgaggataatccagagaagggtttttatggttgtggtctatacaggtggcacaatccaattgtcaatagtcgtgagaagaggatcattgtagcattgatgaagaaggtcaaagaaaaaggtttgcaaaccaagataagtgaaatgaagttgaagggaaaatttttagggatttga

SEQ ID NO: 75728 - DNA, 441 bp, Glycine max
  Peptide Sequence Number=SeqID_167413
atgacagtggttgagacggtgctccgcggtggcaccgtcaagcccgtgccggagcttcttggcctagatgctcccactcccaccgccgatgatgcctccgaaggagaagttatttgtaccaacaagtggaaagtccgagatctgaacccaaacttttggttcctgggtttgaggtctgataagggtggttttggcggtaaatgcaagcgatttgaagagctcgccaagcttcagatagctatgatggatctcaatctctggttgacgccaagttttctgcagaaagtggtgagcttcagttgccgacaagaaattcgtgggtcgggatctccgtcgatgaactctgaggagtccgggataacgacaacgtgtttggagagcgggatcagagatcactatgctcctgacggagaccgaaaagtgctaaaccttttcatttga

SEQ ID NO: 75729 - DNA, 1671 bp, Glycine max
  Peptide Sequence Number=SeqID_167414
atgagttctcgtattcggcttctgggtatttgcttgtggctgcacttgacatgcttcaccttcatttttggcaacatagtgagtgtaagaggagatgcaactttgcaagggactgttgccattgatgacaaggttgtgattggaaccattgatgatgattttgtttgtgcaactttggattggtggcctcctgagaaatgtgactatggaagatgcagttggggacttgcttctcttctcaatctggacctcaacaacaagattttcttaaatgcagtgaaagccttttcacctttgaaacttagactaggtggaagtttgcaagacaaggtaatatatggcactgaagataaccaccaaccttgtacaccttttgttaagaacccttctgagatgtttggtttcactcaagggtgcctcccaatggatagatgggatgaacttaactacttttttgaaaaagctggagctaagattatctttggattaaatgctcttgctggaaaatcaatacacagtggttctgcaaaaggaccttggaactacaccaatgccgagtcctttattcgatatactgttggaaatggctacagcatttatggatgggaacttggcaatgaattgagtgggagtggagttggaacaagcattacagcagaccaatatgctttggatgttgctgctttacacgacgtagtttacaatgcatatgaaaagactgagcctaagccactagtaattgcacctggaggtttctttgatgcaaactggttcaacatatttataagcaaatcaggaaaatctattgatgtggtcactcaccacatttataaccttggaccaggagttgatgagcacctggtggaaagaattctggacccttcctatcttgataaagaggctagcacattcagtggcctaaaaaatatacttgcaagtacaggtacctcagcaacagcatgggttggtgagtctggaggtgcctacaatagtggccatcatcttgtatccgatgcatttgtttacagtttctggttagtggcaactccacatgattcagatttcattaatgattccttacaattagggtatttggatcagcttggcatgtcagctgcttatgacactaaaacatattgcagacagagtttgataggaggaaactatggtttactcaatactacgaattttctgccaaatccagattactatagtgctcttctttggcaccgactcatgggaagacatgtcctctcaactaccttctctgggacaaacaagataagagcttatgcacactgtgcaaagcaatcaaaaggaatcacagtactattgatcaacctggacagcaacacaactgttgaagctgaagtgaccttcaacaacaacgctgagagtttgaggcacagaaagatgtctagtcattcaaaaaggatggaactgcctcttgcaagtgaaacagcaagagaggagtaccatctaactccacaggatggggatatacatagccaaacaatggtactaaatggaaaagctctgagtgtaaactcagatggtgacattcctcctttggagcctatatatgtgaactcatcagagccaataagggttgctgctttctctattgtatttgcccatttacctgatgctgttgtttcagcctgttgctaa

SEQ ID NO: 75730 - DNA, 399 bp, Glycine max
  Peptide Sequence Number=SeqID_167415
atgctaggttttaggatacttgggagtggggagctgcatctaacgggatcttctctaccaaatctgcttatctttgcattcaagctgagcagtcttctgaagatcaatgccaaggtttctgccagctttgggacattaaaattcctcctagagctttatcttttgcctggagattactttgggataggcttccctctaaggagaacttatctaggagacaagttgagattaacaatgacctgtgtcccttctgtcaaagcaaatctgaatctgcctctcatctgtttttcacttgtcaaaaagttatgcctctgtggtgggaattcaactcctgggttagggaggaaaaagttcttcattgtaggccaatggataatttcctccagcactcctccatag

SEQ ID NO: 75731 - DNA, 387 bp, Glycine max
  Peptide Sequence Number=SeqID_167416
atgtcgtacaggatgtcacgacatcacgcttcagaacatgcagattatatgtgtccgtatgaacaaccactgtttacaaccttctcacctaaccactacccgtgcgatctctacctaagagccactcttagatatgagaaaccccgctcactccctctcaatcacactcccgtgtttacaattaaatcaaagacacaccagagatcaactctgaacaaaagagatcaactctacacactagagatcaactctacacactcaggtccaacacttgatgttagggtaccatcaaggtggctcacaaaacactcaagtcccaaaactcacaaaataactcttcaatcccggacttggtacagaactcgtgcagccttcatggttatatag

SEQ ID NO: 75732 - DNA, 1539 bp, Glycine max
  Peptide Sequence Number=SeqID_167417
atggggtcaaatcaagatttttcattcactaagaggttcgcacatgttaagttggtgacaccacaacagtgccgagattttgtcggtacttatgggaagattctggacttagccatgatagaagtgcctacagtcgctactaccgctttggttcagtattatgatcaacaaatgtggtgcttcactttcaaagatttccagctagtacttatgcttgaggagtttgaaaagattgttggatgccctttgggaggaactaagcctttcttcccttcgggacactctctgtccatgcctagattatccgaagtgttaggaattacggtgactgaacttagagagaaggagatgaataggaatggagttaggagcttcccgaaggaattaatggaggataaggcgcgagaatgtgcaagtaaaggagagtgggggtatttcatgagtattctagctcttttaatatatggagtggtccttttccctagcatgattgaccggattgatctggtagtagttgatgcgttcttagtctattattatcgatgggaaagtcctgtggttgccatccttgttgatgtgtactatactctagacttgagctgggagaagaaaagcactagagtcatttgttgtttgctcgcactctatgtatggatggtgtctcatttggtgatgcacaatggtaggcctacttgtcaattagaagatttctgcatagcgcctgataagagcaagattaattgggaggagcttttggctagcatgatagctttccctaatgtccctctgatggggacaaaggactgtgtcaactataatcctatgttggggatcaggcaattaggatacctgatctgtggaccaccctcaaatggagctatccaaccgttcattgctcaaggattgaatgaagaacatctcggtctgcaccaacaaattcggaaggcgtgggactcaccaaataagagggacgaggagttaaggaagaaagatgagggttttgtagatagctatccacaatggttggagaatagggtgcaagaagtcaagctgcctaagaagacaaatggtgaaagggttgagatagatgtacctattgagacgaaggaggttagagaattgaaagcaaaattgcagaaatccatggggacgaaagaaaagttgaagggagtagttatcagggtaaggaaagaatgcaatagactgagggatgtcaacatgtcagcaactgaaccattggaacaagaaatgaaaagggctaaaggggaagagacgaacataaaaaggtaccaaggagctttgtcaagcaatagtaatgaactcaagttgagaagggcagagaaggaccaagtaataacggaaaatgtgacacttagagatgagttggaggtttgttgggtgtcaaaggaaagcttgaaggagaaactaggcatgatggaaaagaatatgctagtaattttcgatcaatatgaggtaaagatgatgagggagaggcaagatctggctactatacatgggcaggctttgagaaacgagtaa

SEQ ID NO: 75733 - DNA, 585 bp, Glycine max
  Peptide Sequence Number=SeqID_167418
atggcagttgcaactcccctttatctgaaaaagctgaaaaacgtgcctcttgaaagcaaaccagcaatcctgcaaaagcaaaaccgccagtttgactggcgatttacgaaaccgtgcccagactcgccagcagaggtggcgagttcaacctcccatcaaattgccatcacgagtggtgttttccatgccatgacgaagaagaagaagaagaagaaggttgaagtagctggtgtctcgctaagcgaggcatatgcgcttagcgaggcactcagctcgcttagcgagttgggagaatctggaagagaatctgtcattcatgcacgcgcccaacgcgccatcagctcgctcaacgagtcatttgtctcttctcgcgctcagcccgccaagctcgctaagcaaaaattcactaactcgcgtttagcgagccttcaggatcaaaaggcccttaaaagactgaagttggcgaaaaataaaggagttctttggaagagagacgtaacagagtcgaacaacagagcaagagagaagagcttggacgaaaagcctcaacctttgagagattctgagtttaagagtgattattag

SEQ ID NO: 75734 - DNA, 402 bp, Glycine max
  Peptide Sequence Number=SeqID_167419
atgaccattgatcacacccaaaatccagaactcatgcctctcatgatcagcaacaaaaaggagtgcaaggtaattttaactaaggaagatgtggaagaagaaaagaaggaagagatagaaagaaatgaggagaaagcacaacaatgggagaagtactcacaagtagaaattcaacgagaaagtattctccaagtcaataccactcctcatcaactgattgtcaaggaagaaagacatgaaaaacatgataaacccttaagtgtccttctctccttgaccaccagcacttttcttgctacaatatggaaggtgtttccagcatacatgagtttcatggcgtctctagctaagaggcgaaaatgcaaggaagatgcgttctttgtgaccttcatgccaccttga

SEQ ID NO: 75735 - DNA, 1293 bp, Glycine max
  Peptide Sequence Number=SeqID_167420
atgtggcatgttaacaagcacaatggtagacaagccattgacatggtgttgatggaccatacgggtgcaaagattggcgccactctatggcaagaattgttccctgaatttgagccgaatttattcgtcaaaactacgtttgtcaaggaggttgaacgtcctaagattcctcctaatgtccatgtgattattgaatttgcttatattattactggcgtggcaccgcgtgatacgttagttgatgttgtcagtgttgttgttgaagttattaaacgtaaaacagttaatcctgcatacagagttacagtgaagttgagagataacagtgatgttgagatcatcatgactaagccattggtcattatgttaacccttactaagatcaaagattccaaagacaagtatccccttagtgtccaaaatatcaagcatgggtccaagttgtatgtcaacactgatattgtagaaatccaacaattccgtaaaagtttacgagtgccattttatgttggcggggtaacaaatgaaggaagcgcttctcagtcccagtatagccaacattcccaacgaaactcagtggaaaagttcttgcataatgctcaaatggtgaacttaggtgaaataagtagactgagacaggattgttactgtttgaccgttgctacggtggatgaagtgatgattgatacaccatggagttatgatagttgtccctattgtactacaacatttgatccattaaaaataggtgcagtctgtcgttcgtgccaaaaccaagttactcacaccgttccaaggtataagttagttgtcaaaatggaacaaaatagggagaaggctaacttccatttctgggatgtgacgtgtatcaaaatctttggtaaaatggccgatgaatgtcatcaacagttgattgcaagtgttgacgagatcaaggtgttccctccgtgtgtggatgaattgttgggtaagacctgggctgtcatattcaagtaccattttcagatgcggcaatcatctatgttggatgttagcaaagaggaacatcatatccacacattgacatccacacttggtttacaggatgaaccaagtatagggaagtcaccagctgttggtgctgaaacttcatcacaggattaccatcttacatcagctgattatgatcctggaaagactgtctttgtcactcctgccaaaagaatgtgtgatcaacaagacagtagtgaatttgagtttgacgaatacacaccatatgagctattgacgaacacgcatatgaaagttgagtaa

SEQ ID NO: 75736 - DNA, 378 bp, Glycine max
  Peptide Sequence Number=SeqID_167421
atgaaaatgaatacaaggtctagaagcttacttggattgttgaaagtagttgcgaaaaggaagcagatgcagacactacatgaattgatttttgtaaataaatcttgttttattgttaatgctgtctctaaaccatttccattggatttaatgatgaaatatgtgcaatttcagttgagcttagctcatcagtgggctaagcgtgcatccaccgctaagcacaacctcagcgcacttagtgcgatagaagaatctggcagaacatcaatatcaaggttgcacgctaagcgcgagatcagtgcgctaagcgcaacagttgtcttcagccaggctcagtacatgactggcgctaagctcaaatccacttactcgtgctaa

SEQ ID NO: 75737 - DNA, 348 bp, Glycine max
  Peptide Sequence Number=SeqID_167422
atgtgtctatcggggaaggagagcatgctgatgaaattttctcataaccgaagcactgggtccaacaaagataggagaaaatcactcaaagtgtatcaatctcacacagtgcgtggcgagaaagtcgctagcgcacaggattttgtcagcaatcaaagggagaggaccactttaggtcgtgggcaaggattgacattctcaccctgggtcaaggtttatgataagttgggattttggctcaaggcttgtagaacggctggtcatgatatatgtcagggtttggccagcggttcggggataaaggggatgtcctacattatttccatgatacacatgcaacaacgatga

SEQ ID NO: 75738 - DNA, 504 bp, Glycine max
  Peptide Sequence Number=SeqID_167423
atgaccaaactatgtcagtctctgctgtcatcaagcccgttctggatgacaaaagatgttcggataacctactcgggtatctccgcgtatcatcgggcccgccgcctctggatgatacaagggtgcagaatgaccaaacttggtctctgcttgtcatcgggcccgccgcctctggatgacaaaagggtgcgaataaccgtaaggtatctccgcgtatcatcgggcccgccgcctctggatgatacaaaagggtgcagaatgaccaaacttggtctctgcttgtcatcgggcccgccgcctctggatgacaaaagggtgcgaataaccgtaagacttgaaaagtctccatcggaaaatgctgacatctccggaaagggcgcagatgaccatattggtctctgctcgtcaatcagtgggcctctagagtcgacctctggcatgcaagctggtgcgaataaccataaggtatctccgggtatcatcgggcccgccgcctctggatga

SEQ ID NO: 75739 - DNA, 105 bp, Glycine max
  Peptide Sequence Number=SeqID_167424
atgccgaagcagtgtagtaacaacgaagtgggggacaagaaagaacatttccaaagtgacgaatccaagatcttgagttcagtgggtgtaaattataaaaaataa

SEQ ID NO: 75740 - DNA, 393 bp, Glycine max
  Peptide Sequence Number=SeqID_167425
atgatgacactgctgctcagcaatgtcctgcctagcgatcataactcctatctccctctgcctaagtgccagttggtgtatgccatcctgacacggatgagcgtccacgtggcccaggtgattgctgacgccatctatttgtttgcaggtattccacccaccaggcaccctctagacccggataaatctaaaagggccctggggttttcggcgttgattacgggcctttgccagtcattcggggttcccgtcgcccccagtaagtattgcacgcctaggcaggcgcagggtgaggcacatcaggtcgcagacacaccgtcaccacctcatcaggccgatcctgttggatcactaggcatggagcgttatctacagcacttggttcgccagtag

SEQ ID NO: 75741 - DNA, 798 bp, Glycine max
  Peptide Sequence Number=SeqID_167426
atggggacaaatcaaaatggcaaaaggttttatcaagtcaaggttaaaagtctagatgtcactagcctcaaggaattgggacgattgatgggacctctccaaaggcaagccttccgcaaagtgtacgggaagattccagatttgactgcagcggaggtatttacggaagctgtcgtatccctcgcccaatactatgaccagccgttgaggtgtttcacgtttggggaccgtatctttgatcaacctcttggggggagaaaaccgtatcttttctccgactttcttccttccttgagcaagattgcagctgtggttgaagattcagcaaaagagttggatcgcatgaagcaaactcggaacggcgtagtgggcctgcctcggaaatacttggaaggcaaggcaagggatatggcgagccaagagaagtggggcccgtttacggatatattagctttgttgatttttggggttgtcctctttccgaacgttgacggtttggtagacttagccgccattgatgctttccttgcatatcaccatagcaaggaaagtccagtggtggctgtcttggcagatttgtttgacacctttgaccggaggtgtgagaaaaacagtgcacggattgtctgttgtttacccgctctctatgtgtggttggtttcacacctattccaacaagacacaagacacccgtgtccgcttcaaagttatcgctcatgcgccgaaaaaggaagagtcgattgggaccaacatttggcggggatagggggcagcgcaatcaattggtttcctcgttga

SEQ ID NO: 75742 - DNA, 204 bp, Glycine max
  Peptide Sequence Number=SeqID_167427
atggcttgcacccacattccgcgattctcctcaaatttcagccagcccgtatcaattagacttcacacttttatgcttcggggtcatacaatgctcaatggaatgccccagggctccctccacgataagcacacgttgcgttcgagtcgtatcctcaaaaaatggaggttgaggaaccttggttggggttatggctaccattga

SEQ ID NO: 75743 - DNA, 276 bp, Glycine max
  Peptide Sequence Number=SeqID_167428
atgggtgttaaacattttgaggtggtcaaacgaaggtcgcatgccgacaaacaatggttcccgaatgaaattaggacttgtttgtctctcgatgataaaggtgcggataaccatgaggtatatccacgtgctaccggacccttgagtctgacggatagcaaaatgagacttttttgtagtctcgaccggaagacgctgacatctccggaaaaggtgcagatgaggacgttagtcacaaaatgctatcaggctttgagtcctatgaataacaaatga

SEQ ID NO: 75744 - DNA, 252 bp, Glycine max
  Peptide Sequence Number=SeqID_167429
atggataaaccaagccttaggtcaccatttctcaacgtttttttattccattttgcgctattattcatccccaacaagagatggctccgaagaagctctccacaaagaggtctaggagtgatgcccatggggaaagctctagcgcctctatggagttcgacagtcaccggtttcggagtgccgagcaccagcagcgttttgaggccatcaagggataatcattccatagggagaggcgcgtccagctcatag

SEQ ID NO: 75745 - DNA, 237 bp, Glycine max
  Peptide Sequence Number=SeqID_167430
atgtcggctgaaaaatatcagtcggggatacttcacgaccgatgtcggctattgagttttctattcaatcccttaatgaaatatgcatcatgtcgtcggggggctacttcaagaccgatgtcggctattgagttttctattcaatctcttaatgatgatgtgaacctgagtaggagtggatcgtttgatacaggctacggaggtttggatgacgccacttccggtgaaggaagataa

SEQ ID NO: 75746 - DNA, 568 bp, Glycine max
  Peptide Sequence Number=SeqID_167431
atgtctgtgaagatgcggactacctgcacctggacagaaagaccctatgaagcttcactgtttcctgggattggctttgggcttttcctgcgcagcttaggtggagggcaaagaaggcctccttctgggggggccagagccatcagcctcccaaaaggtaacggaggcgtgcaaccgtttcctcgggccagacggagattggccctcgagtgcaaaggcagaagggagcttgactgcaagacccacccgtcgagcagggacgaaactcacatcgacgggaaggtttggcacctcgatgtcggctcttcgccacctggggctgtagtatgttccaagggttgggctgttcgcccattaaagcggtacgtgagctgggttcagaacgtcgtgagacagttcggtccatatccgtacgagaggaccgggaaggacgcactctggtgtgccagttatcgtgcccacggtaaacgctgggtagccaaagcctccggtagcacagccgagacagcgatgggttctctgccccagcggggatggagcgaaagaagttttgagaattcaagagaag

SEQ ID NO: 75747 - DNA, 122 bp, Glycine max
  Peptide Sequence Number=SeqID_167432
atgtgggacatccccttttatccagaaaccgctggccaaacccacgccttgacatatgtcatgtccagccgttctacaagctttgagccgaaatcccaacttaccataaaccttgacccagg

SEQ ID NO: 75748 - DNA, 453 bp, Glycine max
  Peptide Sequence Number=SeqID_167433
atggcgagaatagccaaggtagtcaaaatctcagcggaagaattggaccgagcaaaacaaaatagaaatggggtagttggaataccaaggaagcacttggaggagaaggcgaaggcattggcggatgaaggtgaatgggcttcgttcattgatgtctcggcgttattggtatttggagtcgttctctttccaaatgtggatggactagtggacctagcgacgatcgatgccttccttgcttatcaccatagcaaggaaagtccggtcgttcctgttttggccaatgcctatgacacatttgaccggagatgcgagaagagcggcgcaaggattgtctgttacacacctgctctttatgtatggctggtcttgcacctctttcatcatgaaagtagacccatctgtcccctgcaaggtcaccgcatatgcaccgagaaagggaaggcaaattga

SEQ ID NO: 75749 - DNA, 843 bp, Glycine max
  Peptide Sequence Number=SeqID_167434
atggatgaaaaaggtaacgtctgccggtctagcatgaagaagctgattgattaccatgtcgccaatggaacctcggcgatcgtttcggtagggactaccggtgaatctgcaacgctgagccacgatgagcacggtgatgtggttatgctgaccctcgaactggctgacggacgtattccggtcatcgcggggacaggggcaaatgcaaccgcagaagcgatcagcctgactaaacgttttaacgacagcggcatcgtcggctgtctgacggtgaccccttattacaaccgtcctacccaggaaggtttgttccagcacttcaaagccatcgctgaacatactgacttgccacaaattctgtataatgtgccgtcccgtaccggctgcgatatgctgccggaaaccgttggtcgtctctcggaagtaaaaaatattatcggtattaaagaggcgacagggaacttaagccgcgttcatcagatcaaagagctggtttcagacgactttatcctgttgagcggtgatgatgcgaccgcgctggactttatgcagctcggtggccatggcgtgatctccgtaacggcaaacgttgcggcgcgcgatatggctgaaatgtgcaaactggccgccgccggtcactttgatgaagcgcgtgtcattaatcagcgtctgatgccgctgcacaataaattatttgtcgaacccaatccgatccccgtgaaatgggcgtgtaaggagttggggcttgtagcaaccgatacgctgcgtctgccaatgacaccgattaccgaccacggtcgtgatatcgtcagggcagcgctgaagcatgccggtttgctgtaa

SEQ ID NO: 75750 - DNA, 453 bp, Glycine max
  Peptide Sequence Number=SeqID_167435
atgaatcagcagatcaccaactacattcgcggcaaggtgctggagatgatcgtcgtgggggtcgccacctggattggcttcctgatcttcggtctgaactactcgctgctgctggcggtgctggtggggctgtcggttctgattccgtacatcggcgcgtttgtggtgaccattccggtggttggcgtcgcgctgttccagtttggcctgggaaccgagttctggagctgcttcgcagtatacctgattattcaggggctggacggtaacctgctggtaccggtgctgttctccgaagcggtgaatctgcatccgctggtgattattctgtcggtggttattttcggcgggctgtgggggttctggggtgtgttctttgccattccgctggcgacgctgattaaagcggtggtgcacgcgtggccggatgtgccagcggtggaagagaagtag

SEQ ID NO: 75751 - DNA, 225 bp, Glycine max
  Peptide Sequence Number=SeqID_167436
atgtcgatgatcatatcagggctgacaggggaggccagcagagggcgcagtgccgtcagtaatccttcagtgaggctgtcctgccagagcgcatccggcaccagtgtgatccgtgcaaaaggggcgcagccaaaacgggtatcggcaaccccgtcctgcccgcgcatttccgcgataagcggggtgtctggcagtaatggacaggcggtccgggcgatgaggtga

SEQ ID NO: 75752 - DNA, 156 bp, Glycine max
  Peptide Sequence Number=SeqID_167437
atggagatgcagcagaagataaaggagaagagcttccttgagatccttgagaagttagagtttagctacacaccccctctaatagctaaggtcacctccttgagaagcttccttcagaagctagagcttagctacacacaaccctctaatagctaa

SEQ ID NO: 75753 - DNA, 390 bp, Glycine max
  Peptide Sequence Number=SeqID_167438
atgggcaagtcaagattctcttcggttctgcgtcaggaattagaggacgatgtcgatatacgatgggtgatctttgagtctgctcaagtggaggattgtcaggaatatctatggcaatggaccaatatagggaataggaaaaacttcttgaagagtattgaactcaatcatggagggagccaaaggaagaaggcatccgatttatcaaaaaacaggctgtcaaaactgcatcaccccaatgccagccaggtacattggcatgaagtaataatgtccgagcaatctcaaaaagatgcctattattcctttcggcaatgccattctgttgaggagtatgaggacaagaggactgatggagaatgtcatgcactgacaaaaaagaagaaatag

SEQ ID NO: 75754 - DNA, 309 bp, Glycine max
  Peptide Sequence Number=SeqID_167439
atgccaaaaaagggtggcaaaagggtcttttccttgagtttccttgaccctagctcgcccaggctagcctttggcacgcctgggccaccaaatgacttcagtgtgaaggaactagctagcctgggcgagccatttacttcaggactaagccttagctcgcctgggcgagctgcaatgaaagatattgagagaaataagagagaagaagaagaaagaagaggcaatgaagtcgaggcattgttgaatcgcgactgtgatcaatctctacatcgttctttgttcgatgttcgtcatgtgaccatcgattag

SEQ ID NO: 75755 - DNA, 239 bp, Glycine max
  Peptide Sequence Number=SeqID_167440
gagaggaggcaggtgagacacaggggagacaggtagctactgccactcccgagagatcccttgaggccacttcagagcctcctgcactagtggtggacctaccctcacctcagcatacagtagacccttccactcctatcttagagataccagaggacccaaccacacctttcctagctatggacacttctcctccagctattccagtacttcatctgacagatgaggaggatgtttag

SEQ ID NO: 75756 - DNA, 213 bp, Glycine max
  Peptide Sequence Number=SeqID_167441
ccaagagtccagccttcttctcatggaggaggtgaggcctccacagctcaggagccacagccagatccgaagactacacctgctgctcaggaggatgagttagagaccactcccccagagtcatttgtaccaaaaactgatccagaggcagatccagtgattgcggaggccagcccacaacatcaccagtatcgacaccagtgctggagctga

SEQ ID NO: 75757 - DNA, 219 bp, Glycine max
  Peptide Sequence Number=SeqID_167442
atgactgattatgacttacacggtctcgacgacggctatagagcaatcattgatgccgtgaatgcaagggacaccccaattgtcacaacgtgcccttcgcgggcgagggagggcgaggctcacgggtgcgcttcccaaaggaggaaagatgcgcggagtcgccaccaacgtttatttgtggaaaacgtcgggaaatccgaaggaaaccggtcaaaatga

SEQ ID NO: 75758 - DNA, 399 bp, Glycine max
  Peptide Sequence Number=SeqID_167443
atggacaacaagaaaaagaggcccattatctgcagaaccaagatagacctcaacaaaactttcaaggaagctaccaaggctattgaggtggctcaagttcaaatcagccttatggcaggagaccacaaaattctgaagttcaagttggacaactggcaaaacaactatttgaacatggaagtggatctttctcagcaaccgcacagtgaaaaagtggaagaaaaagtggtaagtgaagaagagaagaaatcaaatgaacaagccactaacaaagagctatcattgcatggcctggggacaagcctatttttcaggaggaggatgaagacatggcagatcctgttgattatttcattgaaggagactgagctccttaaccatgatcatcaaggagaataa

SEQ ID NO: 75759 - DNA, 231 bp, Glycine max
  Peptide Sequence Number=SeqID_167444
atggctctgaagaaactctccacgaagaggtctagaagggacgccactggagaaggctccagtgccgcctcagagtttgatagtcaccgtttccggagtgccgagcaccaggagaggcgtgtccagctcagggaagatgagtactcggacttccaggaggagatagctcgcaggcattggactcctctagtgactcccatggccaagtttgaccctgagatagtcctatag

SEQ ID NO: 75760 - DNA, 498 bp, Glycine max
  Peptide Sequence Number=SeqID_167445
atggaaatctttattcagtcaattgatcccagtgcatggaatgctattgttaaaggtccatttataccgactaaagaagtaaatggtgaattgaaagattacaaagaaagtttcagtgatgacgaagatgttgagaattttagcttgatggtgaagaagtttgtaaaatttctcaaaaggttcaatgacagaaaattctctaagccttcaaagaaaaaagagagcaacaacaacaccttcacatgctttgaacgtggaaagcaaggtcacatcaaatttgaatatcctatctaccttagaaaacaaaaaaaaaaggcctacatagcttgggaagataatgcatccacatcctccgactcttctagtgaagaagaagttgcaaatgtatgcttaatggcagattcaatagatgactcatcaaccattgaagaaactgaggtaaattctgaatttgaagaagttttggatgcatctgatgaaatgtatgaagaagcataa

SEQ ID NO: 75761 - DNA, 726 bp, Glycine max
  Peptide Sequence Number=SeqID_167446
gacgccttccagcacaagtacgcggtgctggcgatcaactgcttcaacctcgaaaccgcccgcgcggcgattcaggcggcggaacagcagcgcgcgccactgatcctcaatgtgtatcagggtcacagcgcgcattttccgccagcggtggcggcgccgctggtacaggcgctggccgctcaggccgcggtgccggtggcgctggcgctcgaccacggcaaagcttttccgctgattggtcaggcgtttcgcgccggctttaccgggctgatgattgacgcatcggccgaaccgctggcggacaatattcgtcagaccgcagcggtagtaaagatggcgcataccgctggcgtgtgcgttgaaggcgagctggggcatatcgccgatgcgcccacatatgaactggccgatgccgccgtgaagatgacgcggccgaagatcgacttcgagcgactgcagcagctgcacgcggtgacgacgcggccgctggcgctgcacggcggctcgggcaccccggcggaggatatacgccgcgtcagcgcctgtggcgtcgccaagatcaacgtcggcgctgcggtgttcgacgccggtaagcacgcggtgcagcaggcgctgcgccagcatccgcaggccgagctggccgatgtgctggcgctgatggagtccgcctgtcgcgaagtggttattgaatatctgagctggtcagggtcggcaaaccgctactga

SEQ ID NO: 75762 - DNA, 345 bp, Glycine max
  Peptide Sequence Number=SeqID_167447
atgcgaggtgccgattctttcacggccacttccttggtacatccagaggaaccagcacgcatgcttcagcgcactgtggagtggatattacctacacctactccatatctactagtggagccagtcctagtgatagaggtgacgtcatctgaggaagaccctgaggaggacccagaggagctacctcctgagcctgctgtggatgctcttgactttctagagggtaatgaggacccactccctgaggtggattctctcgaggacgtcatgtcggcatctgaggcagactctacggaggaaagcggtcctggagggatagcgacttgcggaggttcttcatcatag

SEQ ID NO: 75763 - DNA, 352 bp, Glycine max
  Peptide Sequence Number=SeqID_167448
atgaaccttactcgcctcaactctcttctctcctggcgaactgaaaccgacccttccccgggtctttactctctacgcttgaagccaccgttctacggcgagttcgagctcgtcttcaacgacaccgttccttattggtccaccggcaactggaccaacgggtcattcctcaacatccccgagatgtccatcccctacttatacaacttccacttcctctcccctttctcccccgccgcggcgttcggattctccgaacgcgccgagtcggaggccggaaaccggcctccgacgatgttccgagtggagccattcggccaaatccagcagtacacgtggaacagtcaagcag

SEQ ID NO: 75764 - DNA, 1935 bp, Glycine max
  Peptide Sequence Number=SeqID_167449
atgctctgcaaattccatttcaaaaagcagctccgtttccctccaatcccttattcatttgtcactcaatgcacccattcatggagcataatcagagcttctgtgccagttcctgatgaaacccatttcagggaccctcacactgttcatttgttttgtgccaatgccctcaaagtttctgccaaaagggcccttcttcctgaagggaaacagctacatgcccatttgataaagtttggattttgccatgttctgtccctgcaaaatcagattttgggtgtttatcttaagtgtacggaagctgatgatgcggagaaactgtttgaggaattgtctgtgagaaatgttgtgtcatggaacattctgattcgaggtattgttggatgtggtgatgcaaatgaaaatgactcgaaccaacaacagtgcttttcttattttaaaaggatgttgttggaactggtggttccagatagtacaacttttaatggtctctttggtgtttgtgtcaagtttcatgatattgacatgggcttccagttgcattgttttgcagtgaaacttggattagatttggattgttttgtgggaagtgttcttgttgatttatatgcacaatgtggtttagttgagaatgcaaggagggtttttcttgttgttcaacatagagatttggttgtgtggaatgtgatgatttcttgctatgccttgaattgtttaccagaagaggcttttgtcatgttcaacttgatgcgatgggatggtgcaaatggggatgagttcacttttagcaaccttcttagtatatgtgattctttggaatattatgattttggaaagcaggttcacggtcatattctgagactgtcatttgattcagatgttttagtggctagtgcattgatcaacatgtatgcaaaaaatgaaaatatagtggatgcacacagactatttgataatatggtgattcgaaatgttgtggcatggaacaccattattgttggctatgggaatcgtagagaagggaatgaggttatgaagcttctcagagagatgcttcgtgaagggttttcccctgatgaactgactatttcaagcactattagtttatgtggctatgtttctgccattactgaaacaatgcaagctcatgcctttgctgtcaagtcatcatttcaagaatttttatctgttgctaattctctgattagtgcgtactccaagtgtggtagcattactagtgcatgtaaatgcttcagattaactagagaacctgatcttgtttcgtggacttcattgataaatgcgtatgcattccatggtcttgccaaagaagcaactgaagtgtttgagaagatgctatcttgtggaataattccggatcaaatttcctttcttggtgttctctctgcctgttctcattgtggccttgtgactaagggacttcactactttaacttaatgaccagtgtgtataagattgttcctgattcaggtcactatacctgccttgttgaccttcttggacgatacggtcttataaatgaggcttttgaattcttgaggtcaatgccaatggaagctgaatcaaatacattaggagcatttgttgcatcttgcaatctccatgcaaatataggactggctaaatgggccgcagagaagctcttcaccatagagccagagaagaatgtaaactatgcagtcatgtctaacatttatgcttcccatagacattggagtgatgtggaaagagttcgtagaatgatgggaaacaagtgtgatgcaagagtcccaggttgcagctggatagagattactaatcaagttcattcattcgtatctaatgataagatacatcctaaagctttagaaatgcatgctacattgaaaatgctgctttggccaatgaaggaaaaaagtggtatgaattcgtga

SEQ ID NO: 75765 - DNA, 426 bp, Glycine max
  Peptide Sequence Number=SeqID_167450
atgactctggaagaaatgaaaagaagactcgataagctgttcatggtggtgattttgtggactctacactcagattttgatcatgtgtgtgaccaatttctagcgggtgagcaagttccttcaatgtacagcctagtaactaggcttcttcgtgttcctacctcggtgaaaggtgaaaactcagttgtagccgttgaaacttcagcagcacctactgaaacatcagccatggtagcatctcgtggaagaggaggtcgtggaaatagaggaggatgcggtagtagaggtggatgtcctcaatgtacacattgcaaaaagcctggtcatactcaagagaagtgttatgccttgcacggttatcctgacaacgtagcacatgtcaccaaatctgaaaaatcaaaatccaaattttctgatgaggactga

SEQ ID NO: 75766 - DNA, 6300 bp, Glycine max
  Peptide Sequence Number=SeqID_167451
atgcacaccacacacggtgtgagaaagagagacagatcagtgtacaagagggttaagagtactcacggattgagagagggaggcattgacagagcagtgtcgagcaggaaagagagagcagtggcgagcacagtaccattgggagacagaaagcggcggggagggaggctggcgcagatcgtcaaggtagggacgggagagcagcctagatcgttgagtaactcagttaaaattttattacagggtttatctcagcagcacaagcgattacgctctttggctgatcatgttcctcatggttataaaaggacatcacttttagaggttcttatcaggaataatgttccattgcttagggccacctggtttatcaaggttacttacctcaatcaggttcgacctggttctgttggtatttcttctggggctgctgacaagattcagctgtctcgctctgatgtttggaccaaagatgttatcaattacttacaaacacttgtggatgaatttttgtcaaagaatgctttgcattctgcttctcatggtcgagagcgatcaccacaaatgtcttatactggctcactgcagaataaaaacgatccattattatctgtttctgatggtgaagggccatccttacattttagatggtggtatattgtgcggcttctgcaatggaatcatgctgaagggctgcttcatccttctcttgttattgattgggtgtttaatcaactacaggaaaaagatctgcttgaggtttggcagctgttattgcctataatatatggttttttagaaactattgtcctatctcaaacttatgtacgcactcttgctggattagctcttcatgtcattcgtgatcctgctccaggtggttctgatttagtagataattccaggagggcatatacagcttatgctgtgattgagatgctccggtatttaatacttgtggtgccagatacttttgttgctttggattgctttcctttaccatcctctgtaatttcacatacaatgaatgatgggaattttgtactaaaatcaactgaagctgcagggaagataaaaaatagttcagatgattttggtcacattatttcatgtattcagaaacatacagaagatcttgtgaaggctgcaagcccaggctatccaggtcattgtctagctaaagttgccaaagctttggataaagctcttgtgctgggtgatttgcgtgtagcatataaatttctttttgaagatctttgtggtggaactgtatctgaaggttggatttccaaagtcagcccttgcttaagggatttttgcagtactcctcctcgtgacataaagtttacaggtaggaaagatctttcccaagtgcatatagcagttagacttttaaagatgaagattagggatgtgaagatttcgcaaaaacaaacaaatgaaaatcacagagccagtcatcttgcgaagcattcaagtcagcggcataattggaattatgtgggtaatgtatccagattgagatctagttcaaagagtactggttcttcagtatttgaaagcccaggtcctctgcatgatattgtagtttgttggattgatcagcatgtggtgcaaaaaggggaaggtcccaagcgcctaaatctatttatggtcgaactcatacgtgcgggcatcttttaccccttggcatatgtacgccagctaatagtgagcgggatcatggatgtgaatgtaaatgtggttgacctggagcgacagaggagacactatcgcatcttaaagcagctacctggatgctttatccatgatgttctggaagaatctgggattgttgaagggtcgcagctcaaagaagccttgcaaatttacttgaatgaacgccgcctcatacttcggggtcatctgagcgtgtcctgtggttccaatttatctgctctgaagaagaaaaaatatccagcttctacaaaggatgaagtttttgcagtgccaattgatcagagaaatgttatttctaccacaatatcttctaaaaatgcgaaggatactaacatcgaagaactaagaacagcaatctcagtactgttacagctacctaattgttcatctaatttgagcactacaggtgatgaatctgagggcagtgatagaagagccattgggtctccgtacggcaagattgatccagtggagggtacacctgggtgtgaagaatgtagcagagcaaagagacaaaggttaagtgaggaaagaagcacatttgtgcaagggcattctccagttcaatctgatgatgacgatacatggtgggtgaaaaagggaatgaaatccccagagcctctcaaagttgatcaaccacaaaagtcaaccaagcaggtcaccaagagtcggctgaagaatgtgcgtaaaactcagagtctagctcaactggcagcttctagaattgagggtagccaaggggcatcaactagtcatgtgtgtggtaacagggtaagctgtcctcaccataaaacagctatggatggagatgggcagaggtctgtcgatagcatccgaacaagtcattttggggatatagtttccattggaaaagcactaaagcagctacgttttgttgagaaaagggcaatagcagcttggctgttgactgttgttaggcaggtaattgaagacgtggagaaaaatattggtaaagttggtcagttcagcaagccttttcctgttgtggatgatagaggctcaatacagtggaaacttggtgaggatgaactttctgtgattctttatttgatggatatctctgatgatttggtatcagttgtcaaattcctcctttggttgctgccaaaggttcttaatagccccaattctacaattcattctgggaggaatgtggtgatgctaccaaggaatgtggaaaaccaagtttgtgatgtgggagaggcttttctgctatcatcactcagaaggtatgagaacattcttgttgcagcagaccttattcctgaagctttgtcatctgcaatgcatcgtgttgccactgttattgcatctaatggaagagtttcagggtcaggggccctagcttttgctcggtatttgttgagaaagtacagcaatgtggctagtgtcattgagtgggagaaaacttttaagactacatctgatgctagactttcctctgaacttgagtctggtagatcagtggatggagagttaggtttacccctaggagttccagctggagtagaggaccatgatgattttttccgtcagaagataagtggtggtcggttaccatccagagtaggtgcaggcatgagggacatagtgcagcgtaatgttgaagaagcgttccactatctttttggaaaagatagaaaactttttgctgctggtacaccaaaaggtcctactttagaaaaatgggataatggatatcaaattgctcaacaaatagttatgggcttgattgattgcataaggcagactggtggtgctgctcaagaaggagatccctctttggtctcttctgctgtttctgcgattgttggcagtgttggtccaactttagcaaaaatgcctgatttttcatctggcaatagtcattcaaatacaatgcccgctacaaatgcattgaactatgccagatgcattctgcaaatgcatatagcctgtctatgcctgcttaaggaagccctgggagaacgccaaagccgtgtatttgatattgctctagctactgaagcttctaatgctcttgcaggtgtttttagtccaagtaaagcatctcgttctcagtttccaatgtctcctgaagcccatgattctagtaacaccatttcaaatgatatgggaagtaactctagtaaggttgtggcaaaaacaacaaaaattgctgctgctgtttctgcacttcttgttggtgcaattatatatggtgttaccagccttgaaagaatggtgacagttctcagattaaaagaggggctggatgtggtacaatttgtaagaagcactagatccaattcaaatggaaatgctcgttcacttatggcttttaaggtggataattcaattgaagttcatgtccattggtttagattgcttgttggaaactgcaggacaatctgtgaagggttagtggtggaactcttgggtgaaccatctattatggctctttcaaggatgcaacatatgcttcctctaaatttggtctttccgcctgcctattcaatatttgcctttgttaggtggcgacctttcattctgaatgctacagttcgtgaagacatgaatcaaatttatcagtctcttacaatggccataactgatgcaataaaacatttgccatttcgagatgtatgttttagagactgtcagggtctttatgattttatggctgcagatgcaagtgattctgaatttgcaaccttgctagagtttaatgggtctgatatgcatttaagatccacagcatttgttcccctacgctctaggctttttctgaatgccatgattgattgtaagatgccacaatctatttatacgaaggatgatgggagccgaatgtctggacctggtgagtctaaaattaaattcacagatagtgagtctaagcttcaggatatgcttgtgcatgttttggataccttgcaacctgccaaatttcactggcagtgggttgtactgaggttgcttttaaatgaacaagccctcattgaaaaactggagaatcgtgatgtgtccttggctgatgctataaagttgtcctcacctagtacagagaaggctgctgctgcttctgagaatgagaaaaattttattcaaatacttctcacaaggttactggttagacctgatgctgcaccccttttttcagagttgattcatctctttggtaggtcactagaggattcaatgttgtcgcaagctaaatggttccttgcaggccaggatgtcctctttggtcggaagaccattagacaaaggctacataacattgctgtgaaaaaaaatctttctgtcaagacccaattttgggagccatggggttggtgtagtctgtctactgatccattaactgtcaaaggggataacaagaagtttgatagcacatcccttgaagaaggagaagttgttgaagagggaatggatttgaaaaggtgccagctgcaagtgactgagagggctcttatcgagatgcttcttccttgcatagatcaaagttctgacgaatcccgcaattcctttgcaagtgatatggtgaaacagttaagttatattgagcaacaaataactgctgttacaggtggaagtaaatcagtaggaagtgctcctcctggagttgaaggtcagccgaataaagtaaataaccgcaaaaatatgagaggtggaagccctgcattaactagacgacaaacagttgcaacagattcttctccaccgtctcctgcagccctacgagcttctatgtcattacgtttgcagttgctcctgagatttcttcctattctttgcactgacagggagccatctgtgcggagcatgagacaatttcttgccactgtaatttttcgtctccttggtagccgggttgtgcatgaggatgtggacatttcggtgaatgctgtgccatctctgtcgataagggaggcggagtcatcttctgaagttgcttctgctgcttttgtggattcttcttctgggagtctgtttgatcgtttgttgttggttttgcatggattattaagtagttatcctccaagttggcttagggcaaagcctgtttcaaagacaatcagtgaacctacgagggaaatttctggaattgaccgagaattgttggagactttgcagaatgacttggatcgtatgcaactgccagacactattcggtggcatatccaggctgcaatgcccatactcatcccctctatgcggtgctctttatcctgccagccaccatctatttccaattccgctcttgtttgccttcaacccagcattacaaatcctgggtctaactccagtagttcaactattcctcagaggaacccagttctatcaagggttgcttctaatgcatcagggaaatcaaaacaacaggacaatgatttggaaatagatccttggacactcttagaagatggtactggatcttactcttcggcaggtaatactgctagcataggaagtggtgaccatgctaatattcgagccaccagctggcttaaaggggctgtaagggtgagacggacggacctcacatatgttggtgctgtggatgacgatggttga

SEQ ID NO: 75767 - DNA, 1104 bp, Glycine max
  Peptide Sequence Number=SeqID_167452
atgaagatcaacaaagcctgcgatcttaactccatctctgtctttcctcctcctctcgtttatcctaggaaagcgaacaatatatcgagtggattgcaagcgtctcactctcagcatcgctcgcagccatctcagcagtcgctttctcagggactttcgtctcagcacggagtgctgtcgcatttctcccaaaactctctcgacgaggccgtcacgactaacgatcagagagttggttctcaagaacatgagaactctttgaggaggatttctagcttgtcccgacctacatattcacgggaagagagtcaagcacctaactcaagatcttcatccaatctaatgctcaaatggaattctgcagatcataaaagtcagttaagtgaaggacttgaacaccgaattggcataatggaaacttcattgagcaggttcacaatgatcttggattctgttcaaagtgacgtaatgcaaactaaaggacaagaagaaattaaagcaatcattgaaaggagcttgaaatctttagctgaacaaatgagccatgtttcaaagaaagagaagttacaggatgtatatttggcagtttctgcgttacctcagctaattgaagcctctctgcaaaatgtgagagaacttcatgacttagatattaagtcaggtcaaggtatttttcttgacttcagtgaggcgaaggtgagtatacaagccactgtagctccagaggtggaaagcggaggctggaagccagtaaaaaaagaaagagtcactttttcagatagaacttctgagaaggtgcagaagaaaaaagaaccacacactcagaagtatataaggggaggtagagactgtgctattgtcattgaatctgatgaggagattgatggaggtttttcctgcttggtccaagaaaacgcaggagtaaaccttcttggcaacttgaccaaggaagcactggaagaaactgagcgaattttgcggaaagcaaggaggcgcaagaggaaaactaagaacagtaatatggatgtcattttaatgcctctttcttggttgtgcaggaggaatttgatactttcagatgcagaaggaaaaaccccgggctaa

SEQ ID NO: 75768 - DNA, 246 bp, Glycine max
  Peptide Sequence Number=SeqID_167453
atgggaacgatattatatggcatctacatcttccaaaattcccaaattaaattatatacgtcaaatcaaaatggaaagtttgaaccagtagttttaccatcagatgatgtgatgagaggaacccttgagaactcagaatcaaaatgttcagaatgctggaaaaaaccacgagggggaggactgatggtgttccttgctgcacgtatatatgcctcataccacaaactgattgcaacagctacctag

SEQ ID NO: 75769 - DNA, 1672 bp, Glycine max
  Peptide Sequence Number=SeqID_167454
gaggtggagggtgttatctggttgtggggagggtgatgtggctcgtgaggaggtcaagggtagagttgatgatgatgatgataatgtggatgggaggaagtcgtgtggtgatggaaatggagggtgtcttcctgatttggaggtgccggagggtgacatgaatgagtcggttattggaagtgggggtgagggaaatgaggttgatggaggtgaaggagatagaaatggagggtatcatgatttggagatgccggaccgcgaggtgaatgagtcggtgaatggaaactcaggtgagggaaacgatgcaatggaagtgggggaagagtttgatagagggataatgtctaaagagcaggtggtggatgtatcagatggggtgaactacagtgtggctggattgttgagtggaggtcagaagtgtggcggcaatgatgataagggcttggtgttggatccatctggtggggatagtgatggtcgaaagaggaagagagacatgttggatttgtctgatggtgatagtgatagtgatagttctgatcgtaagaggatgagagagtttgcgttggatatgctgagctgggttacaggtgccgcaaagaatccctgtgatcctgaagttggttcaatacctgaaaaggcaaagtggaagtcttacagtaatcaggaggtgtggaaacaggtgctgttgtttcgagaatcagcgtttctcaaagaggttctgatccaagcagtgaacaacgtagctggcaggtggcaaggcaaacatgacctctattatgagcccttcttattgaaagcatggatgacttatggatctgtgagcccttttagaaggagtcagaagatgcacccttgcttgtatgaagatcaccttgggacaaactacaatcttagggataggttgaaacgtgacaagaagattttagttggccaatctacaccatctgcacgaagctcttctgattcatctgtaggagctgagaacagaacaccaagtcctcatactgaagatccctctgatgcaaattcaggtcttgacagatgtgccaccgtacgcatccctttgggggcaaatcatcaagctgaaataccagaatggaccggtgtgatttctgaaggttattctaagttttcagggaccccgatatggccattggcaacagcaaataccagactacttattgaaagggaccctataggaaagggaagacaagattcatgcggctgccctgtaccaggttctgttgagtgtgtaagattccacattactgagaaaagggctaaagttcatctggaattgggggcagtattttatgactggaattttgatcaggtaggtgaagatgttaagctattgtggatggaagaagaagagaaaaaattcaaggatgtgatacgatcaaaccctccatcacctgagacatatttctgggaccatatctttagggcatttcctacgaagagcagggcagatttagttagctactacttcaatgtctttattttggagcgcagaggataccaaaataggcatactcccaataacattaacagtgatgacgaggacgatgaagctggaccactgaggaatgttttcggacagcagacacaaaattcgcgtggttccatcttattaacccccaaaaagtcacagacaaagaaaaagtag

SEQ ID NO: 75770 - DNA, 636 bp, Glycine max
  Peptide Sequence Number=SeqID_167455
atggcgtttgtggcgattttctggacctgctccgtcattccggtatttgccgtctatgcctttgcccctaaggtgctggatgcgctgcacctcaggggcaactgggcatcctatggatccgttgccattaccctgctgttcgtggtgggctgcgtcatcgcgactcgcctgattaatgtcctgggacgccgtaagctgctgctgcacagtttcctgtggtcaggccttgcgctgttgctgctaggctttctgcgtgatggtccgtctgcggtgatcctgctgatgttcggtctgtacgcgctgttcatcggaggggcgcaggtgctgcagttggtctatcccaatgagatcttcccgactgaaattcgcgccggtgccgtaggcgtagggacgtcgctgtcgcgcatcggtgcagcggtgggcacctggctggtgccgctttcgttgcagaatattgggattggtccgacgatgtatatcgctgcagcgatcaccttctttggtctgatagtgtcgtggtttatggcaccggaaaccaatgcacgcagtctggaagacgcctcctcattagaggaggaacttccgcgtaacaaggtttcaatgcagggggtcatgccgaaacgacactctctttga

SEQ ID NO: 75771 - DNA, 321 bp, Glycine max
  Peptide Sequence Number=SeqID_167456
atggctcttgggttaaaaaggatgctcgacatgttggtgaagaaggacatgatggagaagattcatctcttctttcaaagattttggataggtttgatggtcttcaaacctttgttggtgaaaggtttgacactttggaattacaagtgggcatgtgcttcaatgagatggagtcaagaatcaccaagaagttgtcatcataaaaaagggggagattgtagaagcaagcttcatgatgaatcaagattgattcaaagaagtattgatgataacaaaggtgatgacaaaaagctcaaaggtcaagaacacttcatgatatga

SEQ ID NO: 75772 - DNA, 102 bp, Glycine max
  Peptide Sequence Number=SeqID_167457
atgagggaaagaggagggctagggaggagaatagggcactgtttggatagggaaatcagaaatcacatgcatgcatggcagcttaaagagctaggcatctag

SEQ ID NO: 75773 - DNA, 323 bp, Glycine max
  Peptide Sequence Number=SeqID_167458
atggatgccttagaaatttacttgaatgaagtagaaagacaattagacaaaaaggtgaaagttgttaggtctgataaagatggtgagtattacaaaacatacaatcaaactaggcaacacctaagtctatttgctaaactccttcataaacgtggcatttgtgcacaatacacaatgcctgttgttgttcgaaacaacaatgaagaagagcaacacaataatgagcctatgatacacaataaacctattgtcaaagaacaacaagaagtagcattaaagaggtctcaaagagaaatgagaccaactatttcaaagactatgtg

SEQ ID NO: 75774 - DNA, 714 bp, Glycine max
  Peptide Sequence Number=SeqID_167459
atggataattggggtactttggttgattgtccgttcgaacaagcattcgctgagtcccttcagaagtttcaaattgcttgttcaccttggccaatgaatgctttaaatgagattgttggcgaggttaagcgtctacgttatctcggcaatgatccctcttcttgtggttgtgtgatgagaagcacgctcggtcttccttgtgcatggttatgtgagaccgaagtcagcatcaaggaagagattgagaccatatctaaaatatttgaggaacttgatgttaacactaaaggtgcatcgaagaaattgatgaaaataagtcaaagatccacaaagtgtgatctgtcttactgggagtatgttgatgcttttcattttgttcaaagcaacaactcttcagtgaaatgtagtgcattatcttctaaaccgtcgaagccaacaaggataatcccgatgttggatcaatttgtgccatttatacagaatttcattcacaatgttgtggatgtgaaagcggacgattcttggccgttggtgtgcaacgaattgattaaagaacttggcagatggtcacatgactacaccaacctcttcggtggcacagagagatttgaacaattaaggttgtccctacttgttgatgggttttccaaggttagtgtggacaagtggatggatataacggagatgggatatgtcattgcatcacagtataac

SEQ ID NO: 75775 - DNA, 276 bp, Glycine max
  Peptide Sequence Number=SeqID_167460
atggccattattgtcaatgcggaagcatactccgcacagtggtggcctcttgggaatgaagcggcaattcctccttttgatgaggcatggacactaatccctgacccaactacaattcgtgcgaaaggtcggccaaaatcatcaaggataaggaatgagatggattgggtcgaaccatctgaccaccgacaaaaatgtagtagatgtggagcagaagggcacaataggcgtcaatgtccaatgcaatctgaccgtgggagtaattcgtttaattga

SEQ ID NO: 75776 - DNA, 192 bp, Glycine max
  Peptide Sequence Number=SeqID_167461
atgggcaccatcaagtgcaatgaccatggacaaattaaagcgcctatgcatccccgcagcaaatgcttagattctttaaccactctagtcccccacgaatgggccatccgacaaggaaaaatcaacatgcagcagggacaggcagttattctcatagctaagttcccttaccttaactatggtgttaaaacg

SEQ ID NO: 75777 - DNA, 467 bp, Glycine max
  Peptide Sequence Number=SeqID_167462
gactctgccagtcattcgaagtccccgttgcacctaccaaggtgattcggccgcccatcacccgggcttttattgagaagtactgcacccagagacaggctcagggtgatgctccacaggccacaggcgcgccaccaccacctcatcaggctggcccggctggatcgtttgacatggagcagtatttacggcatttggttcgccagcaggcggccaatcaccgggcacatgtacagacccatgattgtctttaccagctgagcctcagcatgcagagtcagggcttctcttctttttcatgccctactccagaccagttcagggcagaggtcgcatggcccggggattggcccgaggcccaagtaggagaggcgcccccagaggctcccgacgatggagaggaggcccacgaggacgaggagatggccgatttgcttgacttcttgggtgggagtggagctacatga

SEQ ID NO: 75778 - DNA, 321 bp, Glycine max
  Peptide Sequence Number=SeqID_167463
atgggaaattccgcgtgtcaacgggcttgtcccgcgattgacgaaggtcgcagaagacacgttagtctctacgtgctagcaggcttttctcttacagacagcaaagaatgtttatacggaaaaccactcggtatttccgcccgcttttcgtcttacagacagcaaaaagtttatacggataaccactcgggtatttccgcccgtcagcgtgactcaaaagtcagtatgacagatcttgtgagcgcggaagatgacgtaaatctccgtgtgtcaacgggcttgtcggccgcgattgacgaagggcgcagaagacgacgttag

SEQ ID NO: 75779 - DNA, 165 bp, Glycine max
  Peptide Sequence Number=SeqID_167464
atgtttgcttacagtcctctcgctaagcgcatcttttgtcatgtgctaagcggagagtctcaagcgcttagcgctcaaccctcgcacctcaagctgatttggtccactaagctagccaaggctaagctaagcccattccgattcaatctaaatccagctaagtga

SEQ ID NO: 75780 - DNA, 75 bp, Glycine max
  Peptide Sequence Number=SeqID_167465
gtcttccggaagttacgaatgcaaattccagaagaaggtcttccggaagtggtcattccggaccttcctccttct

SEQ ID NO: 75781 - DNA, 828 bp, Glycine max
  Peptide Sequence Number=SeqID_167466
atgctggtggagttattgatggtcactgtagaggctgccacggctgagacagcgcagtgtcgtggaccgtatgtactcctgcaatgggtacgtgatatctatgagcgacgatgccaggcagaacattggacagctgcggctcacacgtttcttcttcatcttttgggttgcactcttttcgctaacaagagtgcaaccaatgttcatgttgtgtttttggagacccttcgtgacctcagtcagactaggaggtacgcatggggagtagttatgctggtgcatatgtacaaccacctgaatgatgcttctatcagcaccagccgacagcttagtggttacatcacgatgttgcagagagagtcatgcggtagtttggatacacctagatcattcctgctccgcctgccgattcatgggtgtcgtttgatgatatacatgacaggtggatgcactattcggaccatatggctgcagcaggtgacagctgcgttgtgccagggcagtgtgtcagcgactacatggactggttcttttgcgttgtgccagggcagtgagccatcagatcctcgggcaaatggtcatgctacgcagcccagagttgccactcaggatccagacacagatatctgtccgatcacgaagccagcagcaccgtcgacatctgcaaggtccgatgtggccgagccgagacatgcagtggaagcttgccatgcgattgcggagaggttggagagccatctcaacccaggggtggtcacgccaagcacatcgacacatgagctgatcgaagaatgcctcaggattatcaggagtgtcacacaaaactag

SEQ ID NO: 75782 - DNA, 348 bp, Glycine max
  Peptide Sequence Number=SeqID_167467
atggagaattgcactacgcatgactccaaactcgtgggtggaggacgcaagaaggggctgaacgaaaacgcaattcatcgggctccgaaaaaggcaatcactacgcatgactccaaactcgtgggtagaggacgcatgaacgagaaaacgcaattcatggggctccgaaaaagggttgagaataggagaattgcactaagcaataactacgcatggttccaaactcgtgggtggaggatgcatgaacgaaaacgcaattcatggggctccgaaaaagggttgagaatggagaattgctctaagcaatcactatgtatggctgcaaactcgtgggtggaggatgcatga

SEQ ID NO: 75783 - DNA, 285 bp, Glycine max
  Peptide Sequence Number=SeqID_167468
atgcgggggtatcgcatggttatccgcacctttcgtcaaccaggggcaaacgagcccgttgacgcgcagagactaacatcgtcttctgcaccttttgtcatcctgaccgaagtcaggggcaaacgacctgttgacgcgcaggagactaacgtcgttctatctgcacctttcgtcaaccatgggagaagcgggtactgcatggttatcccaccttttgtcaccagggcaaacgagcctgttgacccgcaaagactaacatcatcttctgcaccttttgtcatctag

SEQ ID NO: 75784 - DNA, 333 bp, Glycine max
  Peptide Sequence Number=SeqID_167469
atggcatttttaggagaaactagcagtcagacgattgtgaattccagtttgggtttcatttttccaaatgaatcgatgattcacaacgatagtggtgtttactttcaaacttccactccagtagtcattcgagtaccaaacacttgtgattttgcaaccctaaaaaccagaatacacaatacccttcagctaaccgacaaacaatttttggatgaaatttaccaccgacagccattcacggatacaggatgtaccattgatgaactaaaggatttgataaagcaagttacacctcaagggattccccctcatggaattcatgaatcacaaacg

SEQ ID NO: 75785 - DNA, 421 bp, Glycine max
  Peptide Sequence Number=SeqID_167470
atggcttcccgaattttatgcaaatctatatgtccctaaggacaaagaaccaaagcaagtaagggttcgagggcacctgataaaattttatgctgattccctcaacacctttttggagactctagtggtcgtggagcaaagggggatcttgccctcttactccaagtttgctagattaaggcttgatcctcaagagcttgcagcccggttgtgtctccctgggagaggatttgtacttaatgtcgagggtctgtcatggaagctcttgaggaaagatcttactactctagcccaaacctggagtgttctatcttattctaacttggccccgacatcccatacttctaatcttaatctggatagggacaaatttcactcattgctcaatccaactcctcgcggcttggatttccagccctga

SEQ ID NO: 75786 - DNA, 321 bp, Glycine max
  Peptide Sequence Number=SeqID_167471
atgcttccgtttgatttccggtgtgtcacggaaacttacggattgtgcatcaatatttttttggtttttcggcatgtcctggaatttcacaaattgcctaatgatggatgccaagcacctcacaaggaccaaagaaaggtcgcatgtcatcaagcaaagattgattcaaggagttttgatgataacaaagatgatgacaaaaagctcaaaagtcaagatcacttcatgataacaaagatgatgacattcaagaatgagttcaagattgagtcaagaacacttcaaggatcaagaatcaagttcaagattcaagactcatag

SEQ ID NO: 75787 - DNA, 468 bp, Glycine max
  Peptide Sequence Number=SeqID_167472
atggataccttgacagcagtatcagcgagttgtacagaagttgcagtttttgaaagtgggcctttggtggaggaagagatggacaagaggggtcctgaagatgggtgtggattctcaggcatgttacctgagatagcgtgggagaagatccgtgcccaaattcaatggctaggttttgctttatttgtgacaaaaaataagagtggaatttcatgccttcgccaccaacaagcactccgccgcccgacgacgcctacgttgcggagtccatcgatgatgatcccctggtggcgtctagtggccaggtcatcgtcagtgtccagagccgctaccacgtcgtgtattgcccgtgaacgacatttgtgtgctcggcatcaccgttgccaaccacgacaacttggtgaacgtgttcgagtgcatccacatcgtcaactaggccatgaacgtcgtggtgacgacgtgccgtag

SEQ ID NO: 75788 - DNA, 1452 bp, Glycine max
  Peptide Sequence Number=SeqID_167473
atggcagtggccaatgggagggttctttgtgtcggaaaccgttcatttgtccaggaattcgaaggatatggaactcaagttttggatcttggtgggaaggttgtggttcctgggttcattgattcccatgtgcatttcattgatggtggattgcaggtgaagctgagaggtgttaataaaaaggaagaatttatcagaaggatcaaagatgcagcacaaagcacaaaacaaggttcctggattttgggtggtggatggaacaatgatctatggggaggagatcttccagctgcctcttggatcaatgatgttactcctaataatcctgtttggctgtcaagagtggacggccacatgggcttggctaactcagtggcacttacgttggctgggattacaaatttaacagatgatccaagagggggaactatattgaggactgccaatggagaacctactggagtattaattgattcagcgaggacacttgttacgtcccagattccagaggattcagtagatgatagaagggaggcattgcatagagcaagcaatcttgccctaacaaggggggtgacaacggttgttgatatgggaagatattatcctgggttttcaaccgaactttcttgggatgatttttcagtcggacatgccttgagcgaatggatttatataggtggtgtcaaagctttcgctgatgggtctttaggttctaatagtgcgttgctttatgagccatatgttgatgatcctgacaattatggtctacaagtgactgagcttgaagctcttctcaacatgaccacagagtcagatttaaatggtctacaggttgctattcatgctataggggacaaagcaaatgaccttatcttggacatgtatggtttagtagcttctacaaatggaatgagagaccgacgattcagggaacttcaactctgctttcagattgagcatgcccagcagttggcagctggaaccccaggtcgatttggaaaacaacgggttgttgcttccatgcagccggatcaattgttggatgatgcagactctactagcaaaaagcttggcaaggatagggctgaaaaggaatcatatttgtttcggtcactcttaaataacaatgcattagtggcatttggttctgactggccagtggtagatatcaatcccttaagtggtattaagacagcaatgaaaaggaggccccccaactggcaaagtgcatggattccatctgaatgcatttcattagatgatgctataaaagcttacaccatttctgctgctcgtgcaagcttccttgacaaagatcttggatccttatctccagggaaactggcagattttgtcatattgtccactgattcatggaaagactttgctgaagatgcatctgcaaatgttgaggaaacatatgtttctggtgtgagagcatatccttga

SEQ ID NO: 75789 - DNA, 1743 bp, Glycine max
  Peptide Sequence Number=SeqID_167474
atgggttacttcgacctcaacatcccctaccctgatccttcccctgccaacaagcccactgagcaaggtaaccgtacgaggctggcagtgaaggccatggagtttggctacaccggaatcgcttacaaccgcacgatcaagggcgtcatgtccgatcaccaccgttgctccatctctcccctcaccctctcctctctcctcaacgtccttccctctctctccctctccgccaacctccaccgccacctactccatgtcccactctccacccccttccgtcagtacactcgtctcaccgtctgcgtcgatagtgcttcccaggctcaagccctcaattcgggtaaccctattttgaaaacctatgatctggtcgctgttaagcctttgaatcagatcgcgtttgatcttgcatgtgagagaatggaggtggatattatctctattgatttctcagctaagttgccctttagattgaagcaacctatggttaaagctgctactcagcgtggggtttgttttgaagtcacgtactctggtttatttgctgatattcaaataaggagacagctaatttccagtgccaagttgttgatggattggactcggggacaaaacattgtattttctagtgctgctcctacggtgaatgagcttagagggccctgtgatgttgcaaacttgttgtcattgtttgggctttccaaggagcgagctaatgcggctatttctaaaaactgtaggattcttttagctaattctttaaggaaaaagcgattttacaaagagacaataagagtagaagttttatcatcagatgcagcatctcattctaaggaagaccggtatcaagagttactaaagtgggaccctatctccagtggtgaaggtgatatcctgttggatgatatgcaaaaatcttctctagtctcctgtaaagcatcaaaacctgcaaaagccattgactttgcttccgtggtcaaaagccttccatctcatggttttgaaatcaaggatatcttacctgcaaataatgctttccctgtctgtggagacaataaaataaatttcccgccagttgccgaaaaactaagtcagtcaacacatgtacctaacaatttaactgagaagtccaacatacttgtttgtcctgagcaagatgaaaactccgtaccagatgctataacaagaggtcaaattttgaggtgtgacaacatttttgagaataatatatgtagtggaacaactgatgctgtcaatttgaaggagacaaacaccccggcagccattgactctatttcagtggctgagggccttccgtcccctggttttcatgataaatgtaataatgagaaaagttctgatgttaatttaaatgaacaaattgggaggatttgtgaagctttgccaaatgaagatttaaaaattgcagagcaaccagtcttggagttaaacacatcaatttctgatacttcgatggaggacaaacgggaaactgatgcacttgaacttgatgagatgaaaatggaagatgattccactgctgcaaaacatttattgccagatgttataatgaaagataaaaggcttagtgaagtgagcactgattctgatcagtttgcctcagtggcaagtataatgaagtatatttccattatctctaggtggattgagagtgaagcgaaggacgcctcagggactacctttattccccttcaggcgattgctgaatccaacgccttttaa

SEQ ID NO: 75790 - DNA, 300 bp, Glycine max
  Peptide Sequence Number=SeqID_167475
atggaaaatgaaaaggggaaaagtgaacaaagaagacaacaacatatgggaaatatatgtcatcgctgtggttgcaaagaccattgctcaagtgcatgtcaaacaccaaggcatctagttgaacagtaccaagaatcacttaaaactaaggaaaaacagataaaaactcattttggttatgaagagggtgattttaggtatggtcttatggatgttactcatctgaatattgctgatttctttgctgatcctgatggaaaaattgatcaccttattggtgatgggagcgtcaagaaataa

SEQ ID NO: 75791 - DNA, 1017 bp, Glycine max
  Peptide Sequence Number=SeqID_167476
atggctatcattgatgtgataaatttgttcaacatcaggtcttcaagtcttggagtatttatttgcatcaagtgttctggcatacatagaagtctaggagtccacatatcaaaggttctatcactgaagctagatgaatggacagatgaacaagttgatgcattagcaaagttgggtggcaatacattattaaataagaagtacgaagcttgccttccaagtaacataagaaaaccaaaaccacattcatccattgaggagcgctctgaatttattcggagaaaatatgagatgcagcaatttgtcgactgtgatgacaatttgtcatgccccattatcccatctcaaggaagaagcatatcacttgctcttgctcagagtagcacttcatactacaattcttttatggacaagaaaccatctgaaaaacaacaaagcaaacatcgtattgggaacgcattccgaaacagctggggaagaaaagattctgagcacaaggctgcaaagaagagtacctctttggcaggtatggttgaatttgttgggctgattaaggttaatgtggttaaaggcactcacctagccattcgagatgtaatgactagtgacccttatgtcatcctttctttgggtcaccaatcagtaaaaacacgtgtcataaagagcaatttgaatccggtttggaatgagagcctaatgctatcaattccagagaacattcctcctctaaaagtgcttgtgtatgacaaggatacattttcaactgatgattttatgggggaggctgaaatagacattcaacctctagttattgccgcaaaggcctacgagaaatcgaatattaatgagtccatgcaacttgggaaatttgtagcaagcaacgacaacacccttgttagagatggtatcatatctcttgatgaagggaaaatcaaacaggaaatctcagttaggctacaaaatattgagaggggtgagttggagcttgagcttgagtgtgttccccttactcaatag

SEQ ID NO: 75792 - DNA, 1948 bp, Glycine max
  Peptide Sequence Number=SeqID_167477
atgtctcttcctgcattgacaatggaagaagcttttgaaaagtattgcaatgggataatggattatggtccatggtggagtcatatgttaggttattggaatgagagcatagccaacccaaacaaagttttgtttttgaagtatgaggatctcaaagaggacacaaacttccatgtcaaaagaattgcagagttcttgggttgtcctttcactcaaaaagaggagagtagtggagtaattcaaagcataatcaagctctgtagttttgagaatatgaaggatttggaagtgaataagtcaggaaaaatagggagaggaggcattgagaaaaaagactttttccgcaagggagagaaaggagattgggtaaactactttaccccttctatgcaagaaaagttatctgcaatcgtggaagaaaaattaagtggatcagtgacaatgatgtacaatgatcctcagcagcagcagcagcagcaccagtaccagcaacaacagcagcagcagcatttccaccaccagccgccgggtccggagttccaccgcggaccgctgccgccgtcgcttcctccgccggtgatgcggcaaggctccgcctcgtcgacgaacctcgcccctgaatttcatcatcccggccccggaggacccccgcctccccattacgacgttggcgagtggaatgaaggaggagttgattgtgaacttgagttgtggacaggaactttggggttaaagggttttggggaatgtattgcatatgatttgagctggatgggtgaaactgagaaatgctttagggaaatctttggcagtaaagtagttacaagactagaagacaagtgcagcagtgatgagaaattgagcatgctgaggtggtcgattcactggagagaaagattagagtggactccaacaggccggcgacttattaccggttcacagactggggaattcactctttggaatggacaatcttttaattttgaaatgattcttcaggcacatgatcaagcaatcagatccatggtctggagtcataatgacaactggatggtctctggtgatgatggaggcgcaataaagtattggcagaacaacatgaacaatgttaaagccaacaaatctgctcataaagaatcagtccgtgacttaaggacagatttgaagttctgctcgtgctctgatgataccacagttaaagtttgggattttgcacgctgtcaagaagagtgttcattaaccggggggaaagaaagagagggagagcttaacagaatggactggtggcagcattggaatggagatggggatgagagaatcatggaaaaggaggagagggagaatggttatttggaggagggagtaactgaagagggtggcagcagtgatcatacaacaaagttttggtgcagaaataggccaggagaccctgctcgtgatagatttaacactggcatgcaaggatatgctgagcaaagtcctgttgctggtcggacaggtggtaattttccaatagctgaaggcccaacaactccaggaccatttgcccctgggttgactcgaaatgagggtaccattccaggtgttggagttgcaatgcccttatctattccttctcttgacatgcctcaaggggagcagaagcagccccatcctgtttcaatgggtgctcctcctcttcccccaggtccacatccctccctaattaatgccaaccaacagcaaccataccaacagaatcctcagcagatgccacaacatcaacaccaggctctaccacagcagatgggttctttgcctatgcctccaaatatgcaacaactacagcacccttcccattcacccttcccaaatatgcctcgccctccaccccaaatgcctattggcatgccaggatctataccagggatttcatcagtgcctacatcacatccaatgccaatgccag

SEQ ID NO: 75793 - DNA, 408 bp, Glycine max
  Peptide Sequence Number=SeqID_167478
atggctgatggtagtagtagcaacaccaagagaaattccctcatcctccatcaccccacaaacttaaagggtggttggaatgctgccatcttcatcatatttgtggaatttgctgagagatttgcttatcaagggttggcaagtaatctcatccaatatctcactaatgttttgaatgaaccaatcacacaagcagccaaagatgtgaacacatgggttggtgcctcctctctcttccctttgcttggtggcttcatagctgattcctatctgggtcgcttcaacaccatactcttgtcctcagtcatttattttgcgataatgaacaacacaattgttgggtctctttccattaactacacctgcaacgagaagagagaaaaggttgaagataatcccaatccttaa

SEQ ID NO: 75794 - DNA, 1257 bp, Glycine max
  Peptide Sequence Number=SeqID_167479
atgagaagaaagagcaggggcaaacgtaggcgtgcggcatctgcaacaactctgagtccttcttccctctccgccattcccattctttgggatgcgtatgataccatctgcattcactgcaataacaaaggcgaggaggccaaggaggatggacttttgatttgcagcggaaggggctgccccgtcgctgtccatgccacctgcctcgccaccggacctaaatttgacggttccggtaacttctgctgcccctactgctggtacaagcgcgccgttgacacgtgtcgacgcctcagggagaaggccctggaagccaagggagacttgtcacgctttctggacaatcacgaccacgcacgtgcggctgcacatgtggatctggttgttcaggatagtgaagaactcatggaggaaacaggaacacaagcacagtctaaagataataaagatgaggagggagaggcacgtgtgaatcaggttcatgatagggaagaaactgagacagaaccagaagggaataaagaaaaggagggaaaggttcgggataatgaagaactcgtggaagaaagagaaagaaaaacagtgacagaagcacaatctcaagagaataaagctgaggaggataagtttcaagatgatagtgaagaactcgtggtggaaacagaaacagaaacagaagttcagtgtgaagagaataaagaggagggtaaggttcgggatagtgaagaacatgtggaggaaatggaaacagaaacaggagcagaagcgcaacctgaagagaagaaagatgagggtaaggttcgggacagtgaaaaactcgtggaggaaacgcaaacggaaacagaaggacaatctgaagagaagaaagatgaggagggaaaggtggctgtgatgagtagttctgtgagtgagacctatgattcggattctgtggctgtatcgatgaagaaaaggaaggataagaagaagaaggttacttccgcaaggaaatctttgtcgttacaacaagagcataagaataagcattataagactagagggaaagttgccaacgaggaggaagttaccagcttcaaaactacgagtttggggcagcaaccacagagaatgaagcagagttcactggctgcaaagcgtaagagattactttggacagcagaagaagaaaaagttctcaagctaaaattcaaccagggctatggtgggagtgggatggaagttttaattatatctgcacaagaaaacagaccagagtag

SEQ ID NO: 75795 - DNA, 105 bp, Glycine max
  Peptide Sequence Number=SeqID_167480
atgacgaacaaggccaaaggaaaaggcaaggaggtcgctggaaaaggttctgccggcaagcacaaggcgccttcgacgatgacaagaccggccctgttcgaatga

SEQ ID NO: 75796 - DNA, 252 bp, Glycine max
  Peptide Sequence Number=SeqID_167481
atggggctcgggataagatttgtgggtggaggatacacgaacagcgctacgcaatcagttcgtgggactctagactcgatgacgaatagtgctaggcaatcaattcgtggggcttcagactttgatggtggaggatgcatgattgacaatcaattcaaggggttccggataagatttgtgagtggaggatacgcgaacagcgctaggcaaccagttcgtggggctccagtctcgatggtggaggatgcatga

SEQ ID NO: 75797 - DNA, 135 bp, Glycine max
  Peptide Sequence Number=SeqID_167482
atgggtgccaagcacctcacaaggaccaaagaaaggtcgcatgtcatcaagcaaaggtccccggacgaaattaggggtaaattttgcattgaaccatatgctcttctagaatctaagcaaggtatcaggagataa

SEQ ID NO: 75798 - DNA, 375 bp, Glycine max
  Peptide Sequence Number=SeqID_167483
atggccaccacatggactcctctaaaaacagtccccagtggagtcgccaactgtcgcaatctacccttcggcgggcggggcgacgcggggctcacgggtgcgtcttctaagaaaggaaaatgcgaggagtcgccaccaacgtttattcgaggacaatgtcagaaaaaccggaacgtgtggtctacgaactttaatcgtgaaaggttcgggagttgtatttacgcacggggaaggagagaaacgttaaggcgttggaccattaacgatctcttggtttttgaaagtagagaaatgttaaggcgttggaccattaacgatctctgggtggttgacaaaagcggggcttttcctcctacgtatcctcaattgcgatga

SEQ ID NO: 75799 - DNA, 351 bp, Glycine max
  Peptide Sequence Number=SeqID_167484
atggcctcgaggaagagaaagacaactgcctcccgacctcaggagccctacgacatgacgagattcatctctgagtatgatgagttccgttgggagctcaagaggcacagatggcataaagccttgaccaggcagcctaatggtcgcattgatgtggccccggtcaaggagttttatgcaaacttatttgatccgaaagacaagtctcccaggcaggttcgagttcaagggaggttgattaagttttatagggagacggttaacgcatttctggagacccccgtggttttggagccaggggagtgttacactgcttactccagattctgcagcacacacccagatccttag

SEQ ID NO: 75800 - DNA, 453 bp, Glycine max
  Peptide Sequence Number=SeqID_167485
atgggtgaagtagaggaggtgcaagagcagatgaagaccgacatggaggccatgaaagagcaaatggccacaatgatggaggccatgatgagtataaaggggataatggaggtcaatgcggttgcaatagccactaccaacactgttgttgaggtggacctgacccccccatatggcctcaaccaaataaatcatccaacctcagatatggtaggtctggaaggcaaagagttgggaggtgcaggcgacccttatttagtgcgaaaaacaagcatgccttcccaccatatggcttgcctcctaactatacgccacccaatgtggcgtacactcccaatgagaatgtcaataactccactcctatactcatggagagccaaaaacctcaatctgatcatgcacatgtctctcgacccattggggagacacatgaaatgccctaccataatctag

SEQ ID NO: 75801 - DNA, 324 bp, Glycine max
  Peptide Sequence Number=SeqID_167486
aagtactgcacccccaagcaggcacagggcgaggcaccacaacagcttggggacgaccagcagcgggcaacaggcgcactgtcaccacctctagagtccacctcaactcatctacaaaggctggagcgttacctacgactcgtggccaaccagcaggcgaccaagtccaaagccaaagaagaagcaccattgaagagggttccagtgtggccccacaagccgacacaggctttggcaaacactgatttcagagcatggaacatcagtagcatttcgaggccatcaagggatggtcattcctcagacagagacatgggcagctaa

SEQ ID NO: 75802 - DNA, 219 bp, Glycine max
  Peptide Sequence Number=SeqID_167487
atgtgttacttgggaaaccttggcaatatgatagagatgttgtccacaatgggttcaccaatcattattctatcttgcataaaggtaaaaagtgcctttgagttgcctcaaggttttgatacacccttaaaggagtttgaggatgtcttcccacaagacattccccatggcttgcctcctttaagaggaattgagcatcaaataaatcttgtttcatga

SEQ ID NO: 75803 - DNA, 147 bp, Glycine max
  Peptide Sequence Number=SeqID_167488
atgggacagcagagccgagacagggcagaggagagagcacacggtggcatcgttcaccgtgatggagatgtagtgaccctgggtgacggtgcacagtggtggctcaacggcacaccctgggcgagagccgaagcagacgccgtcgtg

SEQ ID NO: 75804 - DNA, 258 bp, Glycine max
  Peptide Sequence Number=SeqID_167489
atggcttcagaaaaagctgtgggatggttaatgtcattagatataggggatcatcgacctcatgatcgggcctatctgcaggttttgctgatcctacagctccctgtttatccaacagattgtggtcacaagtattggaacatcgcactccaagtgagaagtggccgccatggtgctatacacattacaatagacattaagcattcaaaggtctacaaagtgagcacgacttacctcaatcaaaatgagaccctgtga

SEQ ID NO: 75805 - DNA, 438 bp, Glycine max
  Peptide Sequence Number=SeqID_167490
atgactagaggcaatccatctgacttacaaccctttgatcctgagatagataggacatttcatagattagttagacatcatttagtaccttttgagcatcctgagcattctgttattggtgattttgagcattatagttttgaacattctgagaacatgacacagcctccaccccgtgagaggactctaagggaaatggctgcacctgatttcacctacgaaagcttgtgcatccaataccctgatgaggatgtcccatatgttcttaaaactggactgatccatttgcttccaaagtttcatggccttgcaagtgaagacccgcacaaacatctgaaagaattccatattgtttgctctaccatgaaacccccagatgtcaaggaggatcacatatttctgaaggcctttcctcattctttagagggagtggcatag

SEQ ID NO: 75806 - DNA, 315 bp, Glycine max
  Peptide Sequence Number=SeqID_167491
atgtacatcaagtatggctccaaatatatcatgaagcatggccaacaaaacatgttatccaatgaaacaaaaacccccacacttattcccaaaacaattccaaagctccaaaattccttaaggatatggaaagggaaacaaggctcaaaagggctatcaaaggaattaagtcaaggtaagtccatttggctagaagcttataagaacaaaattgcctcaatcatttccaaatatgcatgtgaattaggaagcatcaacaagaaccaagccaaggctattgtgcaagcaatcaatagggcaaaacacaccaaatga

SEQ ID NO: 75807 - DNA, 437 bp, Glycine max
  Peptide Sequence Number=SeqID_167492
ttgaaaggaaagatattgagctggtagacgaggaagaagcacaaattggtgctgatcgttctagtgaaacctctaataaatgtgagatttataaggaggaagcacggaatgcagcacagaagcataaagcaaagagggcggagagtgtgaatgctgatgtagaagcctttgctgaagcactagaacatatgaagaaaagagatacaggccatcaaagtgtgtcattggagaataagacaggagattcaactgtgctgaagataggagattcggctaaagttgtgataaaacaagacatgaagggaagaaagcataaatatgggtttaacaacaataaacgtgagaagccagagaaggtaagggtggtggatgatgaaactggcgacaaacatgagctgtatgaagtcctaaggatgccatctaaaacaaaatactga

SEQ ID NO: 75808 - DNA, 309 bp, Glycine max
  Peptide Sequence Number=SeqID_167493
atgacatggaaatacgatttgttcattgatgttggaaatgcattggcatgtgcatgttgtgtatgttcgtggggggcactgtgcactgacctttcagggtctttggcactagcttttggccacgttcatacgttggatgttgtgtatgatcgtggggggcactgtgcactgaccttgtcggatggcccatatggggctgtcacctgggtagggaacaccttttgggctcccagggctgatcacctatgggaggggggctgttatgtgcacaaaccgggtggtctcgacaaactcagcacagttccctaa

SEQ ID NO: 75809 - DNA, 608 bp, Glycine max
  Peptide Sequence Number=SeqID_167494
atggcagcgcgcgcccttggcgtgcctcggcacctgcgcgctcctggcgtcggcctgtgggctccccattcggcccgtcttgaaacacggaccaaggagtctgacatgtgtgcgagtcaacgggcgagtaaacccgtaaggcgcaaggaagctgattggtgggatccccctcatacctgtcgggacccgaaagatggtgaactatgcctgagcggggcgaagccagaggaaactctggtggaggcccgcagcgatactgacgtgcaaatcgatagctggagcccgcgggcgagttctatcggctgggtttacggtgcccaactgcgcgctaacctagaccccacaaagggtgttggtcgattaagacagcaggacggtggtcatggaagtcgaaatccgctaaggaggcgcggcggtcgctgcaaaacccagggcgcgagcccgggcggagcggtcgtcggtgcagatcttggtgggacgggggaagcccgtctgatagcgctctgtgcgcgtactccgaaagggaatcggcctgcccaccctggaaacggctcagccggaggtagggtccagcggctggaagagcaccgcacgtcgcgtggtgtccg

SEQ ID NO: 75810 - DNA, 225 bp, Glycine max
  Peptide Sequence Number=SeqID_167495
atgcaaaaaggaaactgttcaattacatctagctctgataccattatatctgattctctgtccatgggtaccaatttacagcttgtgattcaaaagctgaatggtaaaaattatgttgaatgggctcaatccgtgaaactggcccttgatggcaagggaaagttgggctacctgatgggagacacctctcaaccaggagtgaccggcccctttctcccaagatga

SEQ ID NO: 75811 - DNA, 222 bp, Glycine max
  Peptide Sequence Number=SeqID_167496
atggcagaagagcatgaccagaggattacccttgaggattactcaagtagttcagtaccacaatttatcaccagcattgcacgtcctgaagtgcaagctaacaacatcaactacccacattctttaattcatttaatacaagggaacttatttcaaggattacctaatgaagatccctatgcacacttgacaacatttttttttttatatgtaacactatga

SEQ ID NO: 75812 - DNA, 181 bp, Glycine max
  Peptide Sequence Number=SeqID_167497
atgactgggagaccgacgataactaccaattctaacacagtcaatcgtggatctactaatcccacaaggagcggtaatgttagtaacaacaaaaacactagtgatggaagaccaaaggtaccctcccgggtatttgctatgagtggatcagaaactgctgccttcgacgatttgatacagg

SEQ ID NO: 75813 - DNA, 1146 bp, Glycine max
  Peptide Sequence Number=SeqID_167498
atgggcggtcattatacgcgccgcattaatgtttatggtgaaatcaccaccttcccccgctcagtcaatgtgtttgcaccccagcagggttttatctcggaacgcttcgtcgaagtgggcgacgtggttaaaaaaggccagcgtctttatcagattgatgtcagccgggtgacggataacgggaaagtgagcgccaatacgcgcctggcgctggaaaaccagttaaaacacgttgacagcatcatccttaagttgcaagacaacaagcgcatgacgctggaaaatctacgcgcgcaaaaaaaacagtatgaattggcgcacatgcagtccaaacagctgttggataacgcacgagaaggggtggcatttgctcaggacaacatgcgttcctataaggaatatcagcagcgcggtctgattaccaaagatcagcttagcggacaaacctattcgttttatcaacaacaaagtctgttccaaaacctgcatagccaacacattcaggaatcgttgcaaattacgaatttggaaagcgacatcgttacgcgcgcggcagatttcgataatcaaatttcacagtaccagtttcagcgtaatgatttgcaacggcagttagcggaagccgatgccagcggcgcattgatcgtgaacgccccgagcgatggccgcattgaatctctcagcgttaccccgggtcagatggtcaatagcggtgacagtctggtacagattattccacgtaatggcgcgatttatcagctagttttatggttgccgaacgccagtgtgccttatgtttcagcgggggacgccatcaacattcgttatgatgctttcccctatgagaagtttggccagtttcccggcaggatagaaagcatcgcttatgtgccggcctccatgcaagaaatgtcaacttacagcagttctcccgtgcatcagcccaacgcgcaaacggcatcttattacaaggtcaccgtttccctggatgaaacgcatatcagttaccagggcaaggcgttgcagctcactaacggcatgcgggctcaatccacgctgtttctggaaaaaaggcctttatatcaatggatgttctcgcctttctacgatatgaaaaacagcctgatggggccaatcaatgactga

SEQ ID NO: 75814 - DNA, 516 bp, Glycine max
  Peptide Sequence Number=SeqID_167499
atggacgacgtgggcgccagctcacagtcgtccttgcccactgtgaacccaacccctgacccagccgccccagcagagcctcaagcccctgaccctgacctttcccttcctttactggatgacaacgctcgtcgcgccgaactaaatgagcgcggggggtttcttcattttggggacttgtcggatcagcagaaagacaaagtgctaaacgcacaagtcaaaatcgaaagggccattgagaaagctctgctctccgacgggtattcccgggatgagctttctcaaaggaacaaaagggatgagattaggggctttttgttctaccgtaatgggaaacttctttcgatgaaaacatatgactcatatgtaaaagaagtcgaattagggacccaccggagccaaccctataagtttttatttgagcgggggtatcctcaaataataacgaggcccgtcccagaaatggggcggggaaggagaagtgggcatgtgggtctccttcacttgactatttag

SEQ ID NO: 75815 - DNA, 450 bp, Glycine max
  Peptide Sequence Number=SeqID_167500
atgtttcctttcgactcccgacatgtcgcagaacttaacggattgcctaacgatgggtgtcaagttcctcgaagtggtcaagtgaagggaaaggcaatcaattcatggggctccagatatgatggtggaggatgcatgaacagcgctaggcaatcaattcatggggctccggactcgatggcaatcaattcatcgggctccgaacttgatgatggagggtgcatgaatagcgctagacaatcaattcacggggctccggacttgatggtggagaatgtacgaacagcgcaaggtaatcaattcatgggaatccggactcaatggtggaggatgcatgaacaacgcttggcaatcaattcatggggctccagacttgatgatggaggatgcacgaatagcgctaggcaatcaattcgtggggctccggacttgatggcggaggatgcatga

SEQ ID NO: 75816 - DNA, 297 bp, Glycine max
  Peptide Sequence Number=SeqID_167501
atgtcgatctccccctacggaaggatcgtgcccacaagacacccagtggacccggagaagtctaataggtccctgaggtttccagctttggttacaggcctctgtcaatcttacagggtgcccgtcaccccagcaaggtcatgccatcgtgacatagggatcgcacccgcaagacccccagtggacccggagaagtccaacagggtcttggggttttcagctctgattacaagcctttgtcagttctacggagtgttcgtcgcccccaacaaggtcatcaagccccctgttaactag

SEQ ID NO: 75817 - DNA, 342 bp, Glycine max
  Peptide Sequence Number=SeqID_167502
atggccacccctatgagcactacttgctatttggataaagatgaagccggtgaatcagtagacataaagaaatatagaggaatgatcgaatctcttctttatttattaatatcaagccaatcccaaataatctcacctaagcactatgatgaggacatgaccaagagcaagggcaaggatccacttgaaggacttggaggacctatgacaagggctagagcaaggaaagccaaggaagctcttcaacaagtgttgtccatactatttgaatacaagcccaagtttcaaggagaaaagttcaaggttgtgagttgtatcatggcccaaatggaggaggactaa

SEQ ID NO: 75818 - DNA, 585 bp, Glycine max
  Peptide Sequence Number=SeqID_167503
atggcagccaaacgcttcatcattgaagagagcatcgcagaggcgtttgaggcgcgtttcagcgcagccgtgcaggcactgaaagtgggcgatccgctgcaggaagagacttatatcggtccgatggcacgctacgatctgcgcgatgaactcgatcatcaggtgcaggaaaccctgcagcagggtgcacgtctggtgctgggcggccacaagatcgagggcgtcggcaactattatgcgccaaccattcttgccgacgtcacgcccgcgatgaccgcttttcgtcaggagatcttcgggccggtggcggcgatcaccgtcgcgcgcgatgcgcaacatgcactgcagctggcgaatgacagcgagtttggcctgagcgccaccgtgtggagcggcaatgaagcgctggcgcaggaactggcagagcagctggaaaccggcgcggtgtttatcaacggcaacggcgcctcagatccgcgcgtcgctatcggtggcgtgaaaaagagtggttatggccgcgaactctccagcttcggcgtgcacgagttctgtaacatccagacggtgtggaaaaaccgtcgctaa

SEQ ID NO: 75819 - DNA, 541 bp, Glycine max
  Peptide Sequence Number=SeqID_167504
tcggattccccttgtccgtaccagttctgagttgactgttcgacgcccggggaagaggccccgaagggcccgttcccaatccgtcccccgaccggcacgcgacgacccgctctcgccgcggaagcagctcgagcagtccaccgacagccgacgggttcgggactgggacccccgtgcccagccctcagagccaatccttttcccgagaggctgttcaccttggagacctgatgcggttatgagtacgaccgggcgtgggaggcactcggtcctccggattttcaagggccgccgggggcgcaccggacaccacgcgacgtgcggtgctcttccagccgctggaccctacctccggctgagccgtttccagggtgggcaggctgttaaacagaaaagatactctttccggggccccgccgacgtctcggactccctaacgttgccgtcagcccgccacgtccccggttcaggaattttaacccgattccctttcggagtacgcgcacagagcgctatcagacgggcttcccccgtcccttag

SEQ ID NO: 75820 - DNA, 255 bp, Glycine max
  Peptide Sequence Number=SeqID_167505
atggattctttgatgggttggaatttgaaggattggaggtcgtatgggggttgggttagggacatggagattgtgccttgtttggatgagaataacttggtggtgggtgcgacgcgggaagaatatgtaacgggctttccgtggaaaaatgagagtttcgggtttgaagagagggttgtggttgccatggcagccatcgtttcagatgatgatatttggattaagagaaaagaaagccgtggtcaagaatcataa

SEQ ID NO: 75821 - DNA, 1254 bp, Glycine max
  Peptide Sequence Number=SeqID_167506
atggcttctcgcaagcgccgtgccgtgcccacaccaggggaagcgtccaactgggacatttcccgcttcacatctgagattgcttggcacaggtaccaagacaacattcagctccggaacatccttccggagaggaatgttgaactgggacccgggatgtttgacgagttcctccaggaactcaggaggcgcagatgggatcaggtgctgactcaccttccggagaagcggattgacgtggctctggtgaaagagttctattcgaacctttatgatccagaggaccacagtccacgattctgcatggtgcgaggacaggtcgttcgttttgatgctgacaccattaacgacttcctcgacaccccagttattttggaggacggggaggagtatacaacatacaccagatacctcagcactcaccccgatcctgacaccatcgcggccacactgtgcactccaggggggcgctttgtccttaatgctgatggtctcccctggaagctcctgaggaaggacatgacgacacttgctcagacatggagtgtcctttcttattacgatcttgcgcccacttctcacacttctgatgttaatcttgacagggcccgcttgatctacggtttggtgagccgcatggacatggatgtgggcagctttatatcacagcagatcagccagattgcccagtccagcacctcgaggctcgggttcccagcgttgattacagcgctgtgtgacattcagggggtggtttctgataccctgatctttgagtcactcagccctgcgatcaacctagcctatgtgaagaagaactgctggaaccccgccgacccatcgatcactttccctgggcctcaccgcacacgtaccagagcttcagcatcagctttcgaggcccctctccctacccagtctccgtctcagccatcccagcgaccgcgacatccacctgcttccaccgcagcatccatggacatgcatgggcagatgctgagatcccttcacgttggacagcagctcatcatggagaatatgcacaggctgtccctacacctgcagatggaccctccgctcaccactccagaggcttatcgtcagcgagtcgcctggccaggagaccagccctccactgacaggggggaagagccttctggagccgctgaggatcctgcagtcgatgaggacctcattgctgacttagccactgctgactggggcccatgggcggacttgggcggaggcagttga

SEQ ID NO: 75822 - DNA, 939 bp, Glycine max
  Peptide Sequence Number=SeqID_167507
atggtcactcaaagagcatcattttacctttgtctccttgttattctgataactcaagctactgcggagccagacgaccaatacccagtctgcctcagtcgtggaggagactatgcccctaatagcacctatcacaccaacctcaatactgttctttcaaggctcacttccaacacgcaaatcgactatggcttctacaattcctcctacggccaagactctgatagagtctacgcaacaggcctttgcagaggagatgtttcccgacatacttgccttacttgcctcaacaattctagcttttttctcctaaagaactgtccacatcagaaggaggctgtgggatttggaggatatgataaatgcattttacactatgcagatcagtcaatgttcagttaccaagattcttctttccggttctatttttgggaggaaactaatgtaacgaattgggatcagtacagttatgtgctcaatcagttgctgtcaagactaagagtgaaagctgcaacatctaactccaatctcaaccgtaaatttgctgctggaaatgcaacagttccgactccgagttcccaaactatatatgctgttgttcagtgctatcctgatctgacagccgcagaatgcaacgactgcttaattggcgctttctcagaaatacccaaaaattgtaataacaggtcaggttgtggagttactatattaagctgtaactttagatatgagaactccagcttctatgagcctacgcctgatacgataacactacaattttcaccacaaggatctccatctcctacaccatccatcacttcaaattcctcagagagtacttatcatggtatttattattacagcatggttacaagtacaatattgatccctaaactcaatccttcaccaaccaatgtctatttggtacatcataagtga

SEQ ID NO: 75823 - DNA, 495 bp, Glycine max
  Peptide Sequence Number=SeqID_167508
atggcgccagagtatgcaatgcatggacaattttcagtgaaatcagatgtcttcagttttggtgtattagttcttgagattgtaagtggccagaaaaacagtggcattagtaatggggagaatatggaggatctactaagcttcgcatggagaaactggaaggaggggacagctataaatattgtagatccatcactaaacaacaattcacgaaatgaaatgatgagaagcatccatattggtttactttgtgttcaagaaaatttagctgacagaccaaccatggctaacattatactgatgcttaatagctattctctcagtctcccaattccggccgaacctgcattttatatgaacagtagaactcaaagccgtccagacatgcaatcatgggagtataattcaagggaaacaggaacaagtgaaccgatacttaaatcagctcaagaatcagaaaatgaagcttcaattactgagctataccctcgctag

SEQ ID NO: 75824 - DNA, 2172 bp, Glycine max
  Peptide Sequence Number=SeqID_167509
atggctgtgctttcattaaggtcactttcctttgtttgttgtctccttctcataacaaatttcacaactcaagccagcgcagacaatagtccacaaaacttcttctatttctgtgatgatcataacaacggtagaggaaactacacagtgaacagcacctatgacacaaacctcaacaccgttttgtccactctcacttccaacacagaaatcgactacggtttctacaatttcacgtacggcgaaaacaccgacaaagtgtacgccattgggctgtgtagaggagacgttaagccagatgaatgccgcaactgccttcaacattcgagagccaatctcacacaacaactctgtcgaaaccgaaaggaagcaattgggtggtacgaggatgagaagtgcatgttgcgctactcagaccgctcaatattcaacctcaacgaaattggacctgcgtattttatgtggagcatgctcaatgcaacacaagttgaccagttcaataaagtggttaaggacttgcttgatggcttgaaaaccaaagctaaatcaggtgactctcaaagtaaatatgctacagcaagtgtgagtggtccagataaccgaaccatatacgggctggtgcagtgcacgcctaatttgtctgggccacagtgcgatgactgcttggttcagtccatcaaagaagtctcgcattgttgtaatagcaggttaggtgttagaattgttaggccaagctgtaatctcagatttgaaactgcatctctcttctatgggactccagcatatccaccatcaccatcaccatcaccttcaccgtcacaaccattactgatgccaccaccatcctctacggtcactaataacaattcctctggaggaaactacacagccaacagcacctatcacacgaacctcaacacccttttgtccactctcacttctaatacagagattgaatacggtttttacaattcctcacaaggggagaacactgacaaagtgtacgccattgggctgtgcagaggtgacattaagccagatgaatgccgcaattgcctcaacggttccagggccaatctcacagagctctgtccaaaccagaaagaagcaattgggtggtacgaggatgagaaatgcatgttgcgctactcagatcgctcaatattggatctcatggaaactggacctgcgttttatgctaacaacatggacaacgcaacggacttggatcagttcaataaagatgtcaacaccttgctgggtaacttgaaaaacgaagctgcattaggtgactctcgtcttaagtatgccgtaggaaatacatctggtcctgataataagctcatatatggtcttgttcagtgcacaccggacttgtcagggtcagagtgcttcgattgcttgtctcagtccattgaacgtatcccgatagattgctgtaaagacagaaaaggtggcagggttgttagaccaagttgtaatatgaggttcgaaacctcctttctcttctatggagatacagcatatgtatcaccaactcccccttcctctaccaccactaacactacctcagaagatgaccttaataaggcttataaggagaggattaacctcacttacatacccttctttggaaatatacccgatcttcagaacatgttgatattttattatcttaatcggtggaatgtccaactgaggattctgacttgtgcagtaaaaagcaacaaggcaactatcatcgccatagcaatagcagtaccagttgttgtattttttgctgtggtgctcatttttttcttcatctgtataagaatgaggaagccaggggaaaagtttgaagctcaacaagaaacatatgatgatgatgatgataatgaaattgacatttctgagtcattgcaattcagctttaacaccataggagaggctacaaatgacttctctgattccaataaacttggacaaggcggatttggggctgtttacaaacttgttcatactccaatattgttatgcagtggatacatggcacctgagtatgcaatgcatggccagttttcagagaagtcagatgtttttagttttggtgtattggttcttgaggttgtaagtggccagagaaatagtggcattcgtcacggagagaatatagatgatctactgagtttt

SEQ ID NO: 75825 - DNA, 1689 bp, Glycine max
  Peptide Sequence Number=SeqID_167510
atgaaaaactgccccacagcactacttatcttcttcattgggtttgtttcctcaagtctgtttcaagtttcagttgcatctattgtttcaacaggagatttcaataaggacttctttctgatatggtctcctacccatgtgaacacgtctgctgatggacatgcaagaagcttgaaactggaccaagaatctggatctggttttgcgtcaaaccagatgtttttatttgggcaaattgacatgcaaatcaaactagtgccaggtgattctgcaggcactgtcctggcctattatcttacctctgatcaacctaatcgagatgagatagactttgagtttcttggcaatgtctctgggcagccatatattctacaaacaaatattttcgcagatggaactgacaatcgagaggagaggatttatctgtggtttgatccaacaaaggacttccatacttattcggtgttgtggaatatgcaccagattgtgttaatggtggatatgattcctataagagtttatagaaaccatgcggacaagggtgtggcatttcctagatggcagccaatgagtctgaaagcaaccttgtggaatggtgatagctgggcaacacgaggtggccaagataagattgattggacaaagggtcccttcatagcttcattcagaaattacaagattgatgcttgtgtgtggaaagggaacccaaggttttgcagagcagctagccctaccaattggtggaaccaatacagctctagcacacttacgtccacacaaagaaggtggttcaaatgggtcaggaaataccacatgatttatgattactgccaagacaatgagaggaacaaaggtgaggagaaagctcagggatcgtcaatcaatcgtgagtctgagactgagctctcatctctcaatttaaaaccctactcgccgttgccgcccaaccaccttctgtccaccgtcgccgtcgtcgcctttgcagtcggaaggttgcaccacgtcaccagcacatcaggccgtcgcgttggaaggtctcaagattttgagacagctgacaagagacaacaagatatggcagagaggagcaaagagcttctcaagtttgagcataacggcacacccctttcttccttagaatccactcttcttgtttgtgataataaaaaagaatcagacagtcaaactaggagactcccccctgatggcatgctcctcactgccccacttcccccaagccaacttttagggaaggttaaagacttcctaggagtgatgtcagaagcaaataagcggctggaacttgatgcaaaggacaatcctgagaattatgatattgaagagttaactggaaatgaatcggaagttattgaaatggatttgatgcttggtgtagctgatctccatacacaagaggcagtggctgctgctgaatctgcaatttccacttgtcagtctgtgattccattggctgctgatggtagtgaaacagattcggaagaaagtagtactgataatgacagtgatgatgatattaataacagtgatgattatttagacgatggaaacaacagtgaaaagccttcgtctcttgttcaaaaatctatttccagtaaggataatattcatggaaaaacaaagggaaatggccattccaaaaaacgtccaaggatagttgagctatcatga

SEQ ID NO: 75826 - DNA, 243 bp, Glycine max
  Peptide Sequence Number=SeqID_167511
atgaagaagcaggtatcgcgtcttgctgatagggctatgcttcagattgttacaaaccgtactcatcagtttttccctgctggggcttcttccgctaattcctcttccaattccaacccactgccaccaacgattcagaactttatgtttcatgatgggagcatgatgcgtcaccatgggtttgattatggacgtagtgcagctagtttagttcatgtatgtgacatggttagcactgattag

SEQ ID NO: 75827 - DNA, 948 bp, Glycine max
  Peptide Sequence Number=SeqID_167512
atgaaaacaaagagtatctttggagtgggtcaagaaaatgctgtgcctacaaaagttgtacgagagacactctgtaaacttttgacggctcgatttgttgaacgttgccctgcccctgagcctgttgtttctacctcatttaaggaaactactactaggaagcggggtgccaagtctgccaagatatttgaagcaccagagacattagaacaacgcgtagtagatgcagcagtgcctggggatgtaatcagattttcactcgctgcagataccagatgtagtgttgatagagaaacaaactcagatgatgctcaaatgattagtgttgaagaagaagttgcaaaagaggggcaaattctttggcgtgcaaatttcgaggagtttatacgtcatcttaggcataaggtattgattgagaatgtaagaactcagcatgatgatggaactgctactgtcttaagtgcagtattggaggcaacaagaagtgtacagaaaaaagtgaaaacggaaaattcagttcccttgtcactggatacaattatcacagaggtgatgaagactgatacaggacgaactatgactgtagatcgtattagagcttcccttgtccagttgggttgttcaccgagcatgattttagaggaatcatatagtattgatttgaagaaaattattgaaccggctcgaaatgaagaggttgagtcaattgtgttgaaaaggtatggaacggatggctacagaattttcaggctactggcaaaggattgctgttttcacgacacagatcagatgtttattgttgttgttcttgttctctttaacactagaggtgcaaactgttggaaaaattgtcttaattgtggacacaccttagcccaccttagttgcagtctctttggaggttgcctaaagtgcaaccttgagggtggtggtttagtcccacattga

SEQ ID NO: 75828 - DNA, 558 bp, Glycine max
  Peptide Sequence Number=SeqID_167513
atgattgcggagacagagccctttggcagcgaagagaatggtgaagaggaggagaaggaagggatggttgagatttgtgttcctgaccgtggcagcacacacaatagaaagggagaaacgaatgtcgaagagaaggatgttgcgactgaatggctttgtgtgggaccggttactggcagctgggaaggggtcggaggaaagtgtgtggtgcttgttaacgggaaggtgaaaagttgtcatgggaaggggaggcaacgtggtttctactgttggtggaaacagtatggcggcataggtggtgacttcgcaaaggcagaagatggagagggttgtctgggtactatgatattcagtatccgaagaatgtcatcaagtttggaagcaatggaagtttgggctgcagtagtggaagtttggattgcagcgagtttggtcatggcggcctcaagacgatccacacaggcggtggaaagttcggtgtccgccattgaagagtggcaggttggaccaattgttagcggtggttcccttaaattcgagactaaggacaatctctaa

SEQ ID NO: 75829 - DNA, 420 bp, Glycine max
  Peptide Sequence Number=SeqID_167514
tgcgagtcttccggaattcttccggatgaaccacttcttccggaaagttcccggaagacgttttccggaagtcttccggaagaagtgttcttccggaagacgtttggttacttccggaagaacacttcttccggaaactttccggaaaacgttcttccggaacttccggaagaacccctaaggggtcttccggaagactcctccgtcagcgatttccgccattttttccggcgtcctctcgtcttctcccctctcgtcttctaccctagcaaatgggtccaagggctgtcggagaagctcgcggagaagaagcttgtcggggaagagagaagagaagaagctttttgcggaagagccacagtgagaaaaagagagaatgcttccgggaagaaaagaaatgctttttatatttttaactga

SEQ ID NO: 75830 - DNA, 537 bp, Glycine max
  Peptide Sequence Number=SeqID_167515
atggtgagagccttatgcattgttttgcccattatgagggtgagtcttggtacaacaataagattgttaactttcgacctggtggccatgactcataaggtacaagagcacaatcatcctcatatacttcttctccaaattggaaacacattctgcaaactcccaggcggtcgtctcaaaccaggagagaatgaaattgagggcttgaagaggaagttgactagcaagcttggtgctaattcaccagctcttgtgcctgactggcagataagtgagtgtgtagcaatctggtggaggccaaattttgaaaccataatgtatccatactgccctcctcatataacaaaacccaaggagtgcaaaaagcttttccttgttcatttatctgagagggaatactttgcagtgcccaaaaatttaaaacttcttgctgttccattgtttgaactctatgataatgttcagagatacgggccagttatatccactattcctcagcagctatccagattccagtttaaaatgatcactaattga

SEQ ID NO: 75831 - DNA, 294 bp, Glycine max
  Peptide Sequence Number=SeqID_167516
atggatggttgcgtggtgggatttgagagaactggagaagtattttgtaactggcaagttgttgcgtgcgaagtgagtaaattactgttagatcacctctttggtttgtttctttcccagcatccgaaggcccaggatccttcttctaatgtaaatgactcacctcttcggtttggtctcccacttcaaatccaaaatttcaacatcagcaacagtttcgagacaactaaatttgcatttatgttcttatcttcgtttggaagaatgacaagcaagcaatccgaagcattgtag

SEQ ID NO: 75832 - DNA, 117 bp, Glycine max
  Peptide Sequence Number=SeqID_167517
atggcaggttttgattggcggttgggtcatgatattgtggttgtgggtgtagtagattgtggccgagatgataagtggctggggactccgcaaatgggggatagataccacgagtag

SEQ ID NO: 75833 - DNA, 882 bp, Glycine max
  Peptide Sequence Number=SeqID_167518
atgggggctggtgtttcttcatgtaataaagttgaaaaagaaggaggagggtctatttcttcatcatcaagagattcaagacccggtcttggtgacatcccagagagttgcatctcctccttgttcatgaatcttgatccacccgatatttgcaaattagcaagagtgaatagggcctttcatcgagcttcctcagctgattttgtatgggaatcgaagttgccaccgagctacaagtttcttgctaataaagttcttggtgaagaaaatattgctactatgactaagaaagagatttatgcaaaactttgcctacccaatcgttttgacggtggcaccaaagaagtttggttggacaaatgtagtgggcaagtttgtttgttcatgtcatccaagtccttgaagattacaggaatagatgatagaagatactggaattatattccaactgaagaatccaggttccagagtgttgcatatcttcaacaaatgtggtgggttgaagtggtgggggagctagagtttgaattccctgtggggagttacagcttaattttcagactccaattgggcaaggcctcaaagagattgggccggcgcgtgtgcaacgttgatcaagtgcatggctgggatatcaagcccatccgattccaactctccacatccgacggccagctttcactctcagagtgttacttgtgtgggcctggggagtgggtctactaccacgttggagatttcgtggtcgaaaagcccaatgagccaataaatatcaagttttcgttggcccaaatagattgcactcacactaaaggtggcctctgcgtagatagtgccatcatttgcccaacggagttcaaagaaagactcaaacaaagttag

SEQ ID NO: 75834 - DNA, 828 bp, Glycine max
  Peptide Sequence Number=SeqID_167519
atggcaagaagagatcttgaaagtggcggtggagtaaccaagaacaacagaagtgcagaggaaaactactctgcgcccgaatcttcccatgtttatgattctgagacccattggacatcatggctcgtgcccatgtttgtggttgctaatattgctgtctttgttattaccatgtacatcaacaattgtcccaggaacaacattcgtttccaaggtcgctgcgtggcaaggtttcttggaaggttctcttttcagcctatgcaggagaatcccttgcttggtccttcttcttcaacattgaccaagatgggagctcttcgatgggataatgttgtgaatagacatcagggatggagacttgtcacttgcatttggttacatgctggggttattcatttgctggctaatatgttgagtctggtcttcattggcattcgccttgaacaacaattcggagaccacatctctgtgggtgcttctggtgccctttttggacttcttggcgcaatgctgtctgaacttatcacaaactggactatatattccaataaagcaatggctttaataacccttctagtgatcattgtaatcaaccttggcattggcattttgccacaccgacgtcttcctgccggtgttcagatgaagtcaaagtacaagactcaccaatatgttctaggggttgtgtctcttattctgttgattgcagggttatcgactgcattggtgatgctatttcggggtgagaaagggtatgaccactgccattggtgtcgctacttaacatgtgtccctacttctaaatgggaatgcagcaatgacagttaa

SEQ ID NO: 75835 - DNA, 1383 bp, Glycine max
  Peptide Sequence Number=SeqID_167520
atggacgctcccctgctgctggccaaaggcgagggggcggcgctggtgacggagaacggcgactacgtggcggtgagggagctgaaggaggtgaagaaggtgttctggattgagacgaagagagtgtggcagattgcgatgcccattgttttcaacatatggtgtcagttcggtgtgaattccgtgaccagcatgttcgttggacacctcggcgacattcagctctctgctatctccctcattaactccgtcattggcacttttgcctttggtttcatgcttgggatgggaagtgcaactgagacgctttgtggacaagctttcggagctgggcagtttcttggtcaacaggaagatatagctgatcttgcagggagtttctctattttagtaattccacaatttctttcacttcccttcaattttccaacgcaaaagttccttcaagctcagagcaaggttaacattattgcatggattgggttggtggctttaattctgcacattgggatgctctggctcttaatttatgtgctagattttggcttagctggtgcagctttggcgtttgatatcacaagctgggggatcacagtggctcaacttgtttatgttgtgatctggtgtaaggatggatggactggattgtcatggctggcttttaaggatatttgggcctttgttaggctctctcttgcatcagctgtaatgctttgccttgaagtttggtatatgatgagcgttatagttcttgctggcaaccttgataatgcattggttgctgttgattccctctctatatgcatgaatatcaatgggtgggaagccatgctcttcattggagtaaatgcagctgtcagtgtcagagtttccaatgaacttgggcttggacatccaagagctgccaagtactctgtctatgtgacagtctttcagtcgcttttcttgggaatctttttcatggctattattttggcgactagagattattatgccatcatttttacaaacagtgaggttttgcataaggctgttgcgaaactaggatacctccttgctgtgacaatggttctaaacagtgttcaaccagtggtttcaggtgttgctattggaggtgggtggcaagccctggtggcctacatcaacataggttgttattacttatttgggcttccactggggttccttcttggctatgaagcaaatttgggggttgagggactttggggtggtatgatatgcggaattgttatccagacgttgctgctcttgttgatactttacaaaaccaattggaagaaagaggtggaacaaacaactgaacgcatgcggatatggggaggacaagacattggagttgataagatagtggcttctacataa

SEQ ID NO: 75836 - DNA, 753 bp, Glycine max
  Peptide Sequence Number=SeqID_167521
atggcttcttcatcaatgttatgtccgaagctggggagttgtgcagtgtcacatacaaagttccaagcttttcatctctcttcaatgttctctccactgggtcgaggccttgtctcaccttggagtggtttaaagcatctgggtatctcagctaaagcaaagcctcttattcacatagatagaaagggtgggtgtaagggtaaggtggtttatgcttctctctttggggttggagctcctgaggctttggtaattggggtcgttgctttgttggtttttggccctaaaggtcttgctgaggttgctagaaatctgggaaaaacattgcgtacatttcaacccaccattaaagagcttcaggatgtttcaagggaatttaagagtactcttgaacgggagattggtcttgatgacaatttaagtccaacccagaacacatacaattccaacatacgcaataccacaccaacttcatcatccacttccactgttgaccctaatggcacgccagatcctactaaagcatacagctctgaggagtatcttaagattacagaggagcagctgaaggcatctgctgcacaacagcaggggcaaacaccttccaaggaaggtgacaatgagcctcaaatccagccttctgctgaggaaacagctactactgtacctccacctcagaagccagaaatgggcagtactattggcacaagagatgagaagggtcaggcaattttgttaccagctagtcattag

SEQ ID NO: 75837 - DNA, 366 bp, Glycine max
  Peptide Sequence Number=SeqID_167522
atgaagaacaaggacaagatggacgggcttatgaaaatgagcagcttcgaggtcataaccagcaaaaagatgcattcattcagtgataaggcatccctttattggcaggcaatggtgattggttcagcaatgctagtcagtccacgaagctatagtgatttgacacaggctcaagtatctcaagcaaatcagaggcagttcaatgtacaagctcctattcaagttgaaaactgttttagtgagcaaatcagcaatagggctcctctctcctggcatgtaaactgtcattattttggtagtttcctaccaaaagttagtattagcaacatgccaagggagagttgccctttggctgctttagcttaa

SEQ ID NO: 75838 - DNA, 951 bp, Glycine max
  Peptide Sequence Number=SeqID_167523
atggaagtcaatcccacccacgacggtggcgatgacacctcggaaacgccactgccgccaatggtggacccatctccgtctccgtctccgcaaatgaaagaagaggtgatggacgcggagcaaggcggtgacgtatcgcttccaatgagcgttgttccggcgtcgttgacagtgtcaactgaggcagcggcgaaacgatcgtcgaaggaccggcacacgaaggtggagggacgcggccggagaatccgtatgccggcgacgtgcgcggcgaggatctttcagctgacgcgggaactgggacacaagtccgacggagaaacaatccggtggttgctggagcacgcagagccggcgatcatcgaggccaccggaaccggcaccataccggcgatcgcggtctcggtcggcggcacactcaagattccgacatcctcggaagcgagagcccagggagaagaagacactccgaaaaagcgaaggagaagagcattaaagagcgaattcatcaacctgaacgaaaaccaggtttcggtgtcttcagggctggcaccaatcgcacaaagcagcgcatatggaagtggtggtggtggacttgttcctctgtggcatggtaacggtgctgctgctgggcctttcttcgtgtttccgaacgcttcaaacccacctcagtattgggccattccggcaaccgcggccccgtttttcaacgtccaggcccggcccatttcggggttcgtttccgccttgcagatgcaacatgataaccaccaccactctttaataaacgctgctgcctcgggttctgttaaatcttcgtccactgtgagtgtcactagcagtgctgcttccactcaaatgctcaaggatttctccttcgaaatttatgacaagaaagagcttcaatttttaggtgaaggctatgaagatgacatgtggcattttttaagttaa

SEQ ID NO: 75839 - DNA, 699 bp, Glycine max
  Peptide Sequence Number=SeqID_167524
atggcccctctgccagcagaaaacatcttaccaatcattttcctcctcttgataatattttcagtatccaaagctgaacttcatgctcattactatgaccaaacatgtccacaagtggaaaaaataatttcagagactgttctcaaagcttctaagcatgacccaaaagtcccagcccgtatcttgagaatgttcttccatgactgtttcataagggggtgtgatgcctcaatattgctggactcaacagccactaaccaagctgagaaagatggccctcctaatatctcagttcgatcattctatgtgattgatgaagccaaagcaaagcttgaattggcttgcccacgcactgtttcttgtgctgatataattgccatttcagctagcaatgtggtagccatgtctggaggtccatattggaatgtactgaaaggaaggaaagatggaagagtatcaaaggcatctgataccatcaacttacccgctccaacctccaatgtgagccaactaattcagagctttgctaagagagatcaatcacttgttggtgatcacaggactagatggtttgttgaagcatttgtgaaagaccagagcttgttcttcaaagagtttacagcttcaatgttgaaacttggaaatttaagaggctctagaaatggagaagtgagacttaattgcaggattgtgaattga

SEQ ID NO: 75840 - DNA, 1869 bp, Glycine max
  Peptide Sequence Number=SeqID_167525
atggctttctcttgtaaacttgacagcttcattctctctgcctataaaccccaaaactccattctcccactttcaatccaaccttcctccttccttccatctccttcttctttgaagcctcagaagcttcccttcagaattcgctatggttctaccatcagagccacgtcatcatcctcaaccccttccgcaaccattgccgaacctgaaggcattaagattaaatcgattccaaccaagcccattgatggacaaaagactggaaccagtgggcttcgaaagaaggtgaaagtgtttatgcaagacaattaccttgcaaattggatccaggctctgtttaattcattgccaccggaggactacaagaatggtttgttggtgttgggaggtgatggtcgatactttaatcaggaagctgcacagataataatcaaaattgctgctggaaatggtgttggaaaaattctgggaaggtattttgtcaacaccagccgtttctgctgttataagaaagagaaaggcatgccagcaaatggtggatttattatgagtgcaagccataatcctggcggacctgaatatgattggggtattaagtttaattacagcagtggacaacctgcaccagaatccatcactgacaagatttatggaaataccctgtcgatctctgagataaagatagctgacattcctgatgttgatttatcaaaagttggggttacaaattttggaagcttcagtgtggaagtaatagacccagtttctgactatctggagctattggagacagtatttgattttcagctaatcagaggtcttctttcacgtccagattttaggtttatatttgatgccatgcatgcagttactggtgcttatgctaaacccatcttcgttgataaactcggtgctagtctggattcaatttcaaatggaatccctttggaagattttggacatggccatcctgatcctaatctaacatatgcgaaggatcttgtcaacattctgtatgctgaaaatggacctgattttggagctgccagtgatggggatggtgatagaaatatgattttaggaagaagtttctttgtaactccttcagactctgtagcagttattgcagccaatgcaagagaagcgattccatacttcaagaacggtgttaaggcttcacatatttttagacatagttctcaaataacaagagatgggccctggattcaggtccccactggttggaaattttttgggaatcttatggatgctgggaatttgtccgtttgcggggaagagagttttggaacaggttctgatcacattcgtgagaaagatggcatctgggctgtcttagcttggctttctattattgcacatcgcaacaaagacaagaatcccggggagaaattgatctccgtatctgacgttgtgatggagcactgggcaacttatggaaggaatttcttctctagatatgactacgaggaatgtgaatctgaaggtgccaataagatgatagaatacctacgagatattttgtctaagagcaagcctggtgatcagtatggaagttatgttctccagtttgcagatgattttacatacaccgatcctgtagatggaagtgtggtatcaaaacaaggtgttcggtttgtttttacagacggttcaaggattatatatcgtttatcaggaactggttctgcaggggctacggttagagtgtacattgaacagtttgaaccagatgtctctaaacatgatgttgatgctcaaattgccttaaaaccattaatagatttggcaatatccgtgtcaaagctcaaagacttcacagggagggagaagcctacagtcatcacataa

SEQ ID NO: 75841 - DNA, 2301 bp, Glycine max
  Peptide Sequence Number=SeqID_167526
atgacagtggaggttaaagaaggtgaggagcagaagccactacagtttacgacaagtatgtctatgtcaaggggtgaaaggaatgtagtgcaaggaaggggggaggcatgtctcttcactttgtcccgaggaatggaggactttggccatgaaagctatgctttcactgtcaaaaacctccaacatggaagcattttcaagaaatgttgcaaaaggcaccctgcagtggcttggagaggaaatgcttcaccaggaaacaaacaagggggaaacatagtagcacaaaatggaacattagttcccggttttgcacaagtaagaaggtacaaggccaaagaagatttgagaattttgaaagaaggacctttgacaggagggagaattggtcagggagggtttcatttgcatggaagagaggaatatggttttggttggaaatggcttccattaagagatcttagcagtaatgttgatatggtcttctgcacaagaagtagagcagttgacagtgtgcaaaccccaacacccccattgccaatcctccctctcccaacatattcccagttgaaatggcaacaaagggagatcataatgtttttccattttggtgtgaacacattcagtgacagagaatggggcactggccaggaaaacccagcaatcttcaatccaacggggctcaacaccacccagtgggccactgtggcagcagatgcaggagtttcattgatgatattaactgcaaaacaccatgatggcttctgcctctggccttccaagtacactgaccattctgtcattagcagcccctggcaaggtggcaagggtgatgtggttcaagactttgtcaatgcagccactgcacaaggaattgatgtaggggtctacctttcaccttgggatagacatgaccctagatatggcaatgatttgctctacaaccaatactacttggctcaactacaagagttgctcaagaaatatccaaatgttagagagatttggttcgatggagcaaagggtgccaatgcaaaaaatatgacgtattacttttcagattggttttccatggtgaaggagctgcagagttccatcaacatcttctctgatgcaggtcctgatgttaggtgggtgggagatgaaacaggttctgcagggtatacatgttggtctaccattaatcgaacctctctatccattggaagtccagacatcattcagtatataaacactggtgatccaaaagggacagattggctaccggcggaatgtgatgtatccattcgaaaaggatggttttggcacaaatcagaatcaccaaaaaagctaagcgagctacttgacatttattacaattcggttgggagaaattgtgtgttacttctcaatgtgcctcctaatacaagtggccttataactgaagttgatgccaatagattgaaagagtttagaagtgcaatcaagacaattttccatcagaatcttgctgaggattgttttgttaaagttagtagccaaagagggggtttcgggccagaaaagatgctagacagtgaccacttgtggtcatactgggccccaagggacgatgatgatgaaaaggaccattgggttgaaatttgggccaaggaagggagattgagattcaatgtggttagaatacaagaggcaattggtcttggtcaaaggatcaaacggcatgaaatctatgtggatggtaaattgatcatcaaagccacaacggttggttataagaggcttcataggcttgatgggggtgaagtgcacgctcgtggtgtgaggataagaattagaaaggcaagaggagtgcctcttatctcttctattggcttgcattatgatcctttctggcactcaaagaagaaaggggagagaaaatcgtgggaaggggaaggaggaagcaaggggaccacgggaggggaagggaggaagaggggggagggggaagggcatgttgggaagaaagaaggaggagagagggagaagaaaaaactgaagaaactgaagaaagagaggaagtggaaagttgggaagaagaagctcacaaacagtcttacgatggtttcaaatgatgacgttagttcacaatttccacaattttctacccaaattgggttagacgagatcgtcattgacgaaataggaagatcgttgacaaaaaggaagtctcaagtcgcctttgcagttaaagaagatacacacctcattagttcatggcttaacatcttaactgatccaattgttggtggtctaagatcccaatttgggatctaccactaa

SEQ ID NO: 75842 - DNA, 282 bp, Glycine max
  Peptide Sequence Number=SeqID_167527
atgcaccaagactggatgatccagcttcagatatgttatgtgtacctatatagatctggattagatggctggaagcctgaaagtgtgaaaatcaatagttataacggcagggctgttactttctattacaacacatatatccccagagatacatggtatggatttaatttgtgcaatggtgcttcttcttcttcgtatcagtttatggtgtgtttaatgtttgaacaagaagggcccccaatagtatctgctgaacctttcatgtttcatctgagggagtaa

SEQ ID NO: 75843 - DNA, 942 bp, Glycine max
  Peptide Sequence Number=SeqID_167528
atgaatgaaacaggaaagaagaagcatgttagggaaccaccttcagttcctttcatatgggaagtaaagccaggcattcctaagaaagattggaagccagagccagagccagaggtccctaaaactccactcaaactaattgcctcagtcccctttgtttgggaagaaaagccaggaaaacctcttcccaatttctcagtggaccaccctgtgcctccaaagccattacttattcatgttgcatcatcttcagcattttcttttgcatgcaactttggccatgatcatgacaaagacaaaggaagcttaagcagcagtgacaatgaaagcataactaccttagaccttgaagcatttagctttgatgaagatgagtcttttgttagttcagttccctcattgcttgcaaattgtcttgtgccatcagctaaagtttccactgccattccactgagggaaaccaccccatcctcaccagcctcctcctcagagacagacagtggcacaagcagctatgcaactggcatgtcaagtccaattggtgctacgttccttgagtgtttatttcccttgtttccacctaagtctggcttccttgaaagggatgagaatttggaaaaagtaacttcaagcccgcaagaactaagagagaaagagcttgttcatgaaaattgtgccagtgacttggtaaggaagccaccaacacttggagagctgattatgataagccgaagaagaagctgcagaaggaaagcaattcaaatgaaaaagtgggatccaccaaagaaaatcactagaaagcaagcgtttggatgcttctccgttgtaactgacagcaatatgattgaagggctgctaaagaggaagtactttcccaaactgaaactggtctcttgcaacttatgggtttcatgtgttaagaatgtcgaaagtggattctga

SEQ ID NO: 75844 - DNA, 825 bp, Glycine max
  Peptide Sequence Number=SeqID_167529
atggcgtctgctgcgtttattgagcctcttccagtagtggaatttgttggccagctattagcaaaagatgtgctgtcaaggccattgtcagatgctgatcgcattaagattaagaaagcccttagaggagttaaagttgaagtaacacacagaggaagtgtgagaagaaaatatcgtgtttctggattgacttctcaaccaaccagagaacttgtgtttcctgttgatgagaactcaactatgaaatcagtagttgaatacttccaagagatgtatggtttcactattcaatatactcaccttccttgccttcaagtaggaaaccaaaagaaggctaactatttacctatggaggcctgcaaaattgttgaggggcaacgttatacaaaaagattgaatgagaagcaaattacagctctgttgaaagttacttgccagagacctcgcgatcgggaaaatgacattttacggaccgttcaacataatgcttatgatcaagatccttatgcaaaggaatttggaattaaaatcagtgaaaagctagcttctgttgaagcacgaattcttccggccccttggcttaaatatcacgaaagtgggaaagagaagaactgtttaccccaagttggtcagtggaatatgatgaacaaggaatttaatccagagtctgttattcccatctacaatgccaaacctgaacaggtggaaaaagctttgaaacatgtttaccatgtgtcagggagcaaaattaaaggaaaggaattggagcttttgttagcaatattgccagacaataacgggtctctctatgcacaaggccaataa

SEQ ID NO: 75845 - DNA, 2172 bp, Glycine max
  Peptide Sequence Number=SeqID_167530
atggggtcggcgccgtcaacgccgcgcaggggtggcgcattctcgccggaggcggcggagtatctgatcggaactttcgtcggcgacacgcccttccccctctcatcggagttctggcagaaattgctggagctccctctcaatgttcaatggcccactcagcgtgttcaacaagcttgcgagctattagccaaaaacaattgtcacaccaggcatcttgcgaagattttgttccatctagcgtgctgcttgcaagagtccatgtcttcttctggtgcatcgcccttggtctatgaaaaggcttttaatgcagtgtatatcagttcgatatttttaaagcacttgattgagagcgaccaaggtgagaatatccagttatacccgtctcttgaagataatgaggatgtgcagaaggatgttttaagagatcaaaccattgaaaatcttgttatgcgtaatgtgctgagctttatagcatcagtagaagtgagtcccgacacatttctcctacatctagagctgcttaatttcatgattattgcaatgtcaactcaacttctctgtgggccatctcctggaccaaatgatgtgaacccctttctcgatgcagcaatggatcaggacagctctctggttggtgcagttgttcgcagattgcttctaaatttcatggtccgttctaatgttccatctaatagggctacttattccatcttgtatgatggaaatcagagtagtgtgctacagagagttggttctgcagctgcaaatattgttttatttccatttagttatctggtcagttcgggtggtgaagaatcaaaaagtcctattgcagatatcagtattcatgtgcttcttgttctcgttcattatcataaatgtcttgtgagtgaggactacgcgaatcacaaatcttccacatcagattctttactcaaagaaaatcctcacttttctgacaatccttactgcaaggccttagagcatgcaattgattgtgaatatattgagggcaatgcacatagtgctccacacataaagcttccctttgcttcattgtttgatacacttggcatatgcttagctgatgaggcagctgttctactgctttactcattgttgcaagggaattctgcctttctggagtatgtattagtgcggacagatctggatacattgttaatgccaattctggaagctctatacaatgctccaagtaggacagctaatcaaatttacatgttgctaattatacttctcatactcagtcaagattcttcttttaatgcaagcattcataagctgatattgactggtgttccatggtacaaagaacgccttctccatcagacttctcttggttccctcatggtcgtaattcttatcagaactgtacagtataatttgtcaaaactacgggatgtctatctccaaacaacatgcctggcaaccttggcaaacgtggcacctcatgttcatcgtttgagtgcatatgcatctcagagattagtcagcctttttgatatgctttcacgcaagtatatcaaattagctgaacgcagagataataagctccatactgcaaaaggcgactctgaaggaaacaaccttgtagaagatatgactcttttggtgcagtcaactgaattgcacatttatactgacttcttgaggcttgtactagaaataataaatgcaatcctgacttatgcactacctcggaatcccgaggtagtgtatgcaataatgcacaggcaggaagtctttcagccattcaagaatcatccacgcttcaatgaactgattgataacatttatactgtattagattttttcaatagtcgtatggatgctcaaagagaggatggtgactggtcagtccacgaagtgctacaagtcataattgtcaattgtcgttcttggaggggtgatggaatgaagatgtttactcaactgcgcttcacatatgaacaagagagtcatccagaggagttttttatcccatatgtctggcagctagtgctatcccgttgtggattctcattcaacacaggagccataaatttgtttccagttgatctacaaacagaaagacttgaaaatggggtggtgggaaccacactccaaaatggtgattttgacaagcctgagtatcagcttgatccataa

SEQ ID NO: 75846 - DNA, 96 bp, Glycine max
  Peptide Sequence Number=SeqID_167531
atggaagcgatgaaagacactggtgaaactgatagcctcataggtgtgctcggagaaacagattcacaccaaatttttgcccagcttgatctttga

SEQ ID NO: 75847 - DNA, 1074 bp, Glycine max
  Peptide Sequence Number=SeqID_167532
atggcttctacgaaatcctccttgcagtacacccgcgccaacaacatcgccagcagtttaagtcttaatttcagaaccaccgcgaccgccgccgcgcctggcggcgggaagacggtggggaggtggctcaaggacaggaaggagaagaagaaagaggagaccagggcgcacaatgctcagctccacgcggcggtgtcggtggccggagttgctgcggcgatagccgcgattgctgcagccaccgccgccacgtccggggctggtaaggatgagcagatggcgaagaccgacatggcggtggcgtcggcagcgacgctggtggcggcgcagtgcgtggaggcggcggaggctttgggggcggagcgtgagcaccttgcgtcggtggttagctcctccgtgaatgtgagatccgccggtgacattatgactctgactgctgcggctgccacagctttgcgtggggctgcgacattgaaagcgagggccctgaaggaagtgtggaatattgcagcagtgattcctgtggagaaaaatttggcagtagctggtggacataataacaacaataacgcaagtaatggaaattctaagagtagcttcagcggtgaacttgtccctgaagaaaatttcttgggtatatgcagtagagaattattagccagaggttgtgaactcctcaaacgcacacgcaaaggattatggggtttagtcaatggaaagggattttatctgatgagagaattgtgtgcaggtgatcttcattggaaggttgtatctgtgtatgtaaacaggatgaatcaggttatattgaaaatgaagagcaggcacgttgctgggaccatcacaaaaaagaaaaagaatgtggtgcttgaagtgatcaaagatgtacctgcttggcctggtcgccacttgcttgaaggtggtgaggatcgccgctactttgggttgaaaacagtgatgcgtggtcttgtggaatttgagtgcagaaatcagagagaatatgatgtgtggactcaaggtgtttcaaggcttctctctattgccgcagaaaagaacaacaaaaacagaatttga

SEQ ID NO: 75848 - DNA, 537 bp, Glycine max
  Peptide Sequence Number=SeqID_167533
atggagtggtctattactacattagaattgaaggggggcggagatgggacagggacaggcaagatgggtggacaaattactgatgatgagaaagaagtccctcagtgtcgaaggctaacaacatttgcatgtagacaacagacaactgtagctgttgctaaaaatgttgaccatgtggatcatgcagctgatgagcttcatgagcagcctcgggagctagttacagatcatgaacatactgagttaaagttaacctttcatgggaggaaggtagggaaatttggaaggtctgcacttgagattgaaggcatagtgacagctactgaattaagttctctgattatatgtttgttggagacaagtgctttccatacctttgatgctattgatgtagacaaagtcgtggatttgttaattgagttgcttgaagccaatacacaagaagcaagagatgagattgagcaatgcaaatgggcatatgtttgcctagcctcactcagagacatttatcgtagcaaatatgacacaagacaatga

SEQ ID NO: 75849 - DNA, 1743 bp, Glycine max
  Peptide Sequence Number=SeqID_167534
atggacacgccagataggagcaagatcaacacccctctttcccaatttgaggattcgcctgtatttaactatatcagtaatctatctcctatagagcccgttaaatcagttcaccttactcatacattcaactcatatagcttttcatcacctccatcggttttcacatcaccccatggcaactgtcacaaggaatccagattcctcaagaggcataaccttttggagacatccaaacctaaggtttggtctgaagatgtaaatagtgtttattcatctgaagagactcttgcagattcaactcaagcatgtcatgaatcaagtgagcaacaggaaaatactgctcaaaagatttccattggagatgcctcaattgagccatgtaacgaaaacccaaatatctcaattgagcttccacaagtcttaaaatgtaatttgggtagccctgggtatgaacctctactctgctgtgatgaggctaactctcttttggaattacccggcaatggcaagccagcatcagatgttgcttatgttccagaaggctctgaaaaagattcaattgagggtgagatgcatcttctggggttatgtcagattgaggaggcaaaagttgaaggcccaaattgtggtgtggatagtttaattactgaagtctctgatctgttaatgcttagccccccaaatgtgacagaagcttttaagggtttaaataaacaattaaatccttcaatagagcttggcaatttcatgactttgataccacaatctgccaccaatgatggtcaacaaatgcacattggtaatgcagttgcttctggttcagaacatgaaattgaagatcatccttctgaatcagcagctgccacaggcacaggtcagagacaggacaatcttgccaatgttgctttggtggctagccatccaagtgaaaatatggataataagcttgtttatgcgagacaccgtggtatacgaagacgctgtctagattttgagatggccattgtgcaatggaagaacccagctgataattcaaacaccaactcaagtacagcaatatctgatgaggggaatgttggtaatgaaaagcaactgcttcccacaaaacacagtggggattcacggaggcaacctaatctgcactgctctccttcatctgtgcaactctctgcaagccaagaacttcaactatcattggtacctgcatcgtcagaaatagatttggtgccatcagagaatgaggttcagcctggttctgttccttctggattagaagccgagcccgaagaagaaacagaagcatgcgaaaagggtgtggtggaaaatgcttccctgaaaactgaaacaaagaataccgaagaccatccggaccaatctcttgctacaacaccattaccactttccagatcattgcttccattatccttttcatcaaagtgtaagccaccaagatcttctgttattaccatctccagttccggattgcttgtggggcaaaagcttgggaaatcaaatgctccgtggtctcaatctcaacctaaatgtgaaaagcctttggaaactgttccagatgatgactcttctgtcacctgcatcaaaacttcttctcccaatggcaagaggatctcctctcctaattgtaaggtgggatcatcacctactcgcagagccttcctccacccctcttccattggttcacgtttgcagtttgttgcagttggagctgtatgcttagtgtga

SEQ ID NO: 75850 - DNA, 570 bp, Glycine max
  Peptide Sequence Number=SeqID_167535
atggacccttcaaatcttaagattcccatgccaagctgtggtcaaaagcctgttccttccaaggcgtgttgtgttattgctgagtttcttcctggtggaacattgaaacaatatttgtttaaaaataggcagaacaaacttccatataaggttttgattcagctggctttggacctctctagaggtcttagttatctacattcaaagaaaattgttcaccgcgatgtaaaaactgacaatatgttgtcagatgccaatcaaaatgtgaaaatggctgattttgatgttgctcgtgttgaagctataaatcaaagtgagatgacaggtgaaactggaacctatgaattatggcaccggaggccttattcaaagctaagccttgttgctgtgtcacgtgcagttattagtcagaaatcaagtggggcagcagaggatgattttatctcctacataggcaagtggcgtgatgctggggcttccctgtttggtggctgcagcaagactactcctaatactatgagaggcacagctgaggcaacatatgggaaacttaaagacaaatgtatataa

SEQ ID NO: 75851 - DNA, 432 bp, Glycine max
  Peptide Sequence Number=SeqID_167536
atgacgaagcgttggcgttgcaacgcgaaagaggaggaggctcttctgatccaatgcgtgttaccgtatctaaccccgtcagaactcgccgacctgcaaatccctccacaaagattggtgaactcgcagggtggcttctcttctgctcttttggttgtgagggaacatcttccttctggaaaggcatgtctgagaacaggaaatgttgcacggtttgtaaatcattcatgtgacggtggtaacttgagcacaaagctagttagaagttcaggatctttgttcccccgcctctgcttctttgcttcaaaacatatccaagtagatgacgaacttacttttagctatggagaaatcaggaaaaggcctaatgggttgccatgcttttgcaacagcccttcttgctttggaacctcgccctctcaagacacttga

SEQ ID NO: 75852 - DNA, 1512 bp, Glycine max
  Peptide Sequence Number=SeqID_167537
atgatgagagcgcggtatccgttgttgctgttgctgggaattgttttcctggcatcagtttctgtcttatttggcattatacagaagcagcaatgcctacagagttgcgagatcgagcgagcaggatccgtacaggctgcaacaatcgtgaggagcaacaagaagaaaaagaagaaagagaacatcaacgagcacaaccccaaccaccacactaggagaggggaccccatgagggtaagaaggcggaaaaggaacaagacgaccgtgagcaacctcgtccgtttccacgtcctaatcacaaatagcacaaacagcacaaacggcctcatggaaatcctgaagaatgtgaaggttcggatgagtcagtcacaaaaacgaaacaacctttatcacttcagctctaacagcttcgacactctcttcaagaaccaatatggtcacattcgtctcttccagaggttcaaccaacgttctccacaacttgagaatcttcgagactaccacgttgtggagttcaagttcaaccccaacgccctctttctcccccaccatgctgattctgaattcctcttggagaggcttcatcctggcgatgccctgagaatccctgctggaaccacttactatttggttaaccctgactacaaggaaacattcccgattgtgaagatcatcaatctttgtcttttccgtgtagagtttcttcctatccagcaatcctacttgcaagggttcagcgagaatattctggaggcctccttcaacaccgaattcgaggagataaacagggttctgttgggagaggaggggcaacaacaaggcgtgcagaggctgcaagagagagtgatggtggaactgtcaaaggaacagattcaggaacttagcagacatgccaaatctagttcaagaaaaaccattacctccaaaaacgaaccattcaacttgagaagccgcaaacctatctattccaacaagtttggagctcttcttctaccacacttcaattcaaaggccatagtgatactagtgattaatgaaggagaagcaaacattgaacttgtgagtctaagagaacaacaacaggaagaggaacctttggaagtgcaaagcttatccatttgtcgtcaaatctcaatttccttgcttttggtattaatgccgagaacaaccagagaaacttccctgcagacgactgaaaagatgtttgaaagccacatatacaacaaatacataaaacgcaggcaagaagcaatattcaaaacatcactcattcagagggctccctttgattgtgataaaataaattggaaaattgttattggtggaagagaattagaaagttgtttggggagcgcaccctggatgaccattgacccggccaatcatcctccgctactgcggcaccgcctccatgatcctcgccgagttaatgggctccatcatcacctcagcgtcgccctctgcatctccgattgcctccgctgtctcctcctccccccaaactcaaactag

SEQ ID NO: 75853 - DNA, 1056 bp, Glycine max
  Peptide Sequence Number=SeqID_167538
atgagaaccgtttttctgcaatcgaaaacaaaatccagcacatcatcatcggatgaagataacaacagctgctacttccccggttgcaagaaagatgcaaactgcaactgcgaaatgtgtttggccagcatcaatgccaccctcgatctcatgcccaacagcgtccacaaaggcaccctcaccaagctttctgcttccaaacccaacgttgcgtgcaccccaatttcttttgatgcttctattctgtccacacccagatccagcgagtttcagctatcttcgtccactcctctctccaaatcaagagccagatcggacttgagcaagaaaatggagaagcataagaagggacaacaagcctctggtttcagtttcttgaggttgatgctcttttttggattcttcttgtctgcggaccttgtttttccattggtggtttctggggtttttcagccttccttgtcaccggatgtggtgaaaagggttggtgagaaatgtagccttgtgcgtgatttgaatggaaagttgaggcttttgcagaaagagttggctagtgttgttgttggagaagtttcaaattgcagctttactgataccttatgggaaatcagccaggatggattgctattgaattcaaggtgcacactgtacaaatcagcaatagaagaggtaacgatctggggatggcctttgcaaacagcaggattgctcacaaatgggttctcttctcggacattcactctcttatcaggaagagtcactcagtggaatggtggacaaattggctattcaattcggacggctaatgcttcatgggtgcaaccaaagtgggatgcttcagcagtgcaattagaccccaacacttgggttcttgaatatcagatgagttatatttttgatggtacgaggttgcattctgcagcattggagttcctcaaatataggatttcaagaattgttgccaggctgaagaaagatttctggctttttatcgcatttgaagataaacagtacaatggattcacagcaaaaaatggacctcaaatcccaacttga

SEQ ID NO: 75854 - DNA, 177 bp, Glycine max
  Peptide Sequence Number=SeqID_167539
atgaggaggagaccagtcagggtcacgctgttttgcgagaatgcttcaaccatatgggatcaacataagcttaaaagagcactcaaaccgggtgtatttatcctcaaggcctacactccgaagagtccgtcaggacctctccctcctgattcaggtttaacacagaaaatattttag

SEQ ID NO: 75855 - DNA, 624 bp, Glycine max
  Peptide Sequence Number=SeqID_167540
atgaatgtgccgcgtcctccaaacctgcttggttcttttctggaatcagccgttttaagtcgctcctccctcctcggccgtgccgtccacgcgcacatcctcagaacccatgacacccctctcccctccttcctctgcaaccacctcgtcaatatgtactccaaactcgaccttcccaactcagctcaactcgttctctcactcaccaaccctcgcaccgtcgtcacctggacctctctcatctccggctgcgttcacaaccgtcgtttcacctccgccctcctccacttctctaacatgcgccgcgagtgcgtcctccctaatgacttcacgtttccctgcgtcttcaaagcctcggcttcgttgcacatgcccgtcaccgggaaacagctccacgcccttgccctaaagggtggcaatatattggacgtttttgtcgggtgcagcgcctttgacatgtacagcaaaacaggccttcgacccgaggctcgcaacatgttcgatgaaatgccgcacagaaacttggccacgtggaatgcgtatatgtctaatgcagttcagatggtcggtgtttggatgcaattgcagcgtttaagagtttctttgtgtggatggagagcctaa

SEQ ID NO: 75856 - DNA, 432 bp, Glycine max
  Peptide Sequence Number=SeqID_167541
atggtgagtagctcaaaactgggttttgataccatcattaacaaaaaaattatggaattgttcaaagcagtaactgagcttggatttgttggtggcaaatcaaagtcattatatggaagagatggtcatttgggcataacactggttaaatttgctggggacgaatcaggctttaaggaggccattcgacttgctgaacactttgagaaggaaaaccatggacgtaaggattgggcccatgtgcagtcacaaacattaggaaaggatgatgagaataatgcaaaccttgtgaaggtggatgagaaaaaaggagataaaaggagggtcttgtacggctatcttgggactgcttttgatcttgacaaagttgattttgacacaaggaagaaggctgtcatagagagcaggagagaatacaaaccacccatgtag

SEQ ID NO: 75857 - DNA, 159 bp, Glycine max
  Peptide Sequence Number=SeqID_167542
atggagcttcttggtaagcgttgggaaatgggatctgagaagggagaagcggaagaaaaaatgaatagatcgatacgctgtcgtatattggggattggggttggttgtccgatatttagcccgagattctgcatcaatgtggacaaaactcttccgtag

SEQ ID NO: 75858 - DNA, 1137 bp, Glycine max
  Peptide Sequence Number=SeqID_167543
atggggaagaaaacagagctgaaagatcacaaggagacaaccaaagttgaagctgttcttgagcttctcagaaaacaaacacctctcactgttaaacaggagaagttttgcaactatgcttgtgtgaaacggttcctgaaagcaaaaggggataatgtgaaaaaagctgcgaagcaactcaaggcttgtcttgcttggagagagagtgtcatcactgatcacttgatagcagatgatttctcagctgaactggctgatgggttggcctatgtgagtggtcatgatgacgaatccagacctgttatgatttttcgtttgaagcaagactatcaaaagttgcattcccataagatgttcactcgtttgctggcctttacactggaggtggccatttcgaccatgccaaaaaacgtagaacaattcgtgatactttttgacgcaaggcctgaggggcacacagaaagtgtccggagtgccccagaggagtctccaattaatggccatattagagagggcttttacagatcagcatctgctttcatgaacctattgctaccagcactgaaaattgtggccgagtactacccaggaaggctatgcaaagcgtttgtcatagaccctccctcgcttttcgcttacttgtggaagggtgtgaggccgttcgtggagttatcatcatggacgacggtggtatcatcgttggatttcgaagagtcgttggacttcaacgacttcgctgcatacccgcgagcctcgtccctccgattcgaaggcgcgagcgtgaaatcgacggcgaagatagggtcgtgctcctcgtcgcggttctccttcaccgtatctcatcaccttgactcgttgaagccatgcactcatctcaccgctgaacgcgcggtcgctctcgttcgcgtcgcccgtcgcgagaaccccccgcggccccccggccaccagaaagggcctcttcccgtccacccccctgccgcagcgcgtgacggagacgccgcggacctcgtttcttcagtcgccggcgacgttcttccggcgagagagccacgtcgccgcgaagggagagaggtgccgcgaatcgttcttgccgtatgtgaagttctaccgaagaccgtacgacgagatggtgtatag

SEQ ID NO: 75859 - DNA, 219 bp, Glycine max
  Peptide Sequence Number=SeqID_167544
atgcttcaaccatatgggatcaacataagcttaaaagagcactcaaaccgggtgtatttatcctcaaggcctacactccgaagagtccgtcaggacctctccctcctgattcaggataggtttggtgccgaaaaagagagagttttgggaggaggaaaagggaaaacgaaagtgagaggaagaggagatgtagaagctatcgccagtctcaaaaactaa

SEQ ID NO: 75860 - DNA, 66 bp, Glycine max
  Peptide Sequence Number=SeqID_167545
atgggagaggaagcacagaggggaaggggcatgtacatatggttcattttggattttaaacagtga

SEQ ID NO: 75861 - DNA, 1407 bp, Glycine max
  Peptide Sequence Number=SeqID_167546
atggctggcggcggcgagtttgaggcaaagataactccaattgtcatcctttcatgcatgatggctgctaccggaggtcttatgtttggatacgacattggcgtttctggtggggtgacatcgatgccagcattcctgaaagagttctttccggaagtgtacagaaagacagtggaagaggaagagttggacagcaactactgcaaatacgacaatgaaaagctgcaactattcacatcgtgtctgtaccttgcgggtttaatagccacattcttcgcgtcacatataactcggaggcagggaagaagagccaccatgttgatatcaggcttcattttcatcgctggagttgccttcaatgctgctgctcagaaccttgccatgctcatcattggtagagtcttacttggttctggagttggttttgctaaccaggccgtgccagtttttctttcagagatcgcaccttcacaaattcgtggagcattgaatatactgttccagctgaatatcacccttggcattctcttttccaaccttgtcaactatgccaccaacaagctatctctgggtttgggtggtttaccagcattgcttcttacgttgggggctttcatggtggtggacaccccgaacagtctcatcgagcgtggccacttggaagaaggaaaagttgtgctgagaaagattcgtgggattgacaacattgaacccgagttcttggagcttcttcacgcaagccgtgtggctaaagaagtcaaacaccctttcaggaatatcctcaagcgcaagaaccgaccccagctagtcatttgcattgccctgcagatttttcaacagttcactggcatcaatgccataatgttttacgccccagttctgttcaacacattgggattcaagaacgatgcttctctctactctgccgtgattattggtgctgttaatgtcgtctctactgttgtctcaatctattcagtagacagactcgggaggagaatactcttattggaagctggagttcaaatgttcttatctcaacttgtgatagcagtcataataggaatgaaggtgaaggaccattctgaggatctctcaaagggttatgcagtgctggtggttgtgttggtatgcatctttgtgtctgcatttgcatggtcatgggggcctcttagttggctgatcccaagcctttctctcaatgctgtgtttcttcaagtttggcatcttcttgttcttctctggatgtgtcttgctcatgtccacctttgtgcttttccttctccccgagacaaagaatgtcccattgaagagatgactcagagtgtgtggaagcagcattggctgtggaagaggtttattgaagatgattgtgttaaagaagagaaagtagacactggcaattga

SEQ ID NO: 75862 - DNA, 75 bp, Glycine max
  Peptide Sequence Number=SeqID_167547
atggagaaacccttgcggcctcggtcatacatatttggtgcattgatcaccatgccaaccatgcgcccagcttaa

SEQ ID NO: 75863 - DNA, 788 bp, Glycine max
  Peptide Sequence Number=SeqID_167548
atgtcttttgtgcggaattatcaagcagaagatcgtagtttacatagtggttactggtccacctttgatggaaacaactatggtaacaacaataggaaaagaagcaggaacaattattataacaggaattgtaacatttacaatgataaccggacaaaatttggggaccattttaatttttacaatgctgatcatgctaattatgctagatatgatgctgttcgatcatctttgaaaaggagaaaatattcagcccctgtttggcaagaaagccagcagtactatgttccacccatggtccatgacaatatcccttcagcctataatttccaaggtcctccgacaagatctgatggtgatgcctctacatcagctagctgcaagcgtgattgctctatttttgaagatgataaacctgtcttcatgtcaagggacgaaattgatagacactctccatcaagaaaagatggtattgatttgattgctactgctgctctttttcttactgcaaagtcagaggaagctccacgtcatttgaataacgattggtttgaacagtatcgggagcgggtgcttgaggctgaacaactgatacttactactctaaattttgaactcaatgtgcaacatccatatgtacctcttacatctgttcttaacaagttgggtctatcaaagactgttttggtgaatctggcattaaacttggtcagtgaagggacaaaactagttggctcaaatcaaatctgtatgcaatgttctgagctgttggctgatgtcctcttcag

SEQ ID NO: 75864 - DNA, 1571 bp, Glycine max
  Peptide Sequence Number=SeqID_167549
atggaggataactatagtgttcaagattttcaaaaagatgaaaagggagcaattgtgttgatgacggaggaaaagagagcaacagtggtggcagtttcagatggaagttctgtggagggcagtcttgagatatttgaaaataaggaggcgcagttagcaaaaaatgagctggaggaagcaattgccgaggaaaagtttaagatttgtaccacaaatgactggcttcggcctagtttcagaaaaataaatttgtttgggcctcttagattgagtagtaagaagtccagaggctttctcatcaactgcggggcccactccgcggcccaattccaaaaccgcacttggctccccgactctgccttcatctcttcgggcacccccctgaacgtgaccacccctgttctgttccccactcttcacacccttcgctccttccctcgccgagtcaataagcactgctacaatattcccgtgtatcgcggcgcacagtatttggtgcggaccacctacttctacggcggagtcaacggcgccgaccacccctcgccgccggtgttcgatcagatcctcgatgggaccctctggagcgtcgtcaataccacccgggattacgctgatggaaactcttctttctacgaaggggttttcttggctcaggggaagatcatgagcttgtgtattggctccaatacttacaccgattctgacccctttatctctgctctggagttcgtgattcttgagggttctctttacaattccacggatttcactagatatggccttgccttgattgcacgacacggttttggatattccggaccacccattcggtaccctgatgatcagtttgatcgtgtctgggagccttttgggcagagtaattctaccaaagcaagcactgataatgtttctgtttctggtttttggaatcttccacctgcaaaaatatttgagacacacataggatccgatcaattagaaaccttggaacttagatggcccacggcatcacttcctagctccaattccaaatactactacatcgctctatactttgctgatgacaccgctggatcaagaattttcaacattagtgtgaatggtataacttattaccataatttgaatgtgatcccatcaggcgttgttgtatttgccagccagtggcctctttctggtcccacaacaataactttgacccctgctgctagttcttccttgggcccctcaatcaatgctggtgaagtttttgatgtgctgccacttggaggaagaactttaactcgagatgttattgctttgcaaaaggtaaaagagagcctccgaaatcctccacttgattggaatggtgatccttgtatgcctcggcagtactcatggactggcatcacatgttctgaaggaccacgtatccgtgtagtgactctaaacttgacaagtaaggatctttccggatctttatcaccttttgttgccaatatgacagctctgactaacatctggcttgggaataacagtttatcagggcagattcctgacctcagttcactaaagattttagagacact

SEQ ID NO: 75865 - DNA, 1761 bp, Glycine max
  Peptide Sequence Number=SeqID_167550
atggaaatgttggtggtttgtaccatcatccagtttcagttctgttctgttctgtgctgtttcttcatgctagcccattccagagacggggttcaattaaaacaaagaggagagaagaaccaaggatgtgaggcaattagacaaatgccagaacatcagcagttcattgttgacagtggtgccttaacacatcttgttgatcttttgaagaggcacaggaatggcttaacttctcgtgctattaatagtctcattcgtagggccgcagatgctattactaatcttgctcatgagaacagcagcattaaaacccgtgtcaggatggagggtggaattccaccacttgttcatttgcttgattttgctgatgcaaaggtgcaacgagcagctgctggtgctctgcgaaccctggcttttaaaaatgatgaaaataaaaatcagattgttgaatgcaatgctcttccaactttgattctaatgctacgttctgaagatgctggtgttcattatgaagcggtcggtgtgattggtaatttagtccactcttcccctaatataaagaaagaagttcttctcgctggagctttacaaccggttattggattacttagttcctgctgctctgaaagccagagagaagcagcattgttacttggacaatttgcagcaactgattcagactgcaaggttcacattgtacagagaggtgctgtccaacctttgatagagatgcttcagtctcctgatgtacagctcagggaaatgtctgcttttgcattggggagattggcccaggacccacataaccaggctggtattgcacacaatggtggcttagtgccgctgctcaagcttcttgactcaaaaaatggctctttgcaacataatgctgcttttgctctttatggccttgcagataatgaggataatgcgtctgatttcataagggtaggtggagttcagagactgcaggatggagaatttattgttcaagcaactaaagattgtgttgccaaaacattgaaaagattagaggagaagattcatggccgtgtgctgaaccatttgttatatctcatgcgagtttcagaaaagggttgtcaaagacgagttgctttggctcttgcacatctttgctcttcagatgatcagagaataatttttattgatcactatggtcttgagttgcttattgggcttcttggctcatctagctctaagcagcaacttgatggtgctgtggctttatgcaagttggcggataaagcctcgaccttgtctcctgtggatgctgctcctccttctccaacaccacaggtctatttaggagagcagtacgtaaacaatgctacgttgtctgacgttacatttttggttgaaggcaaacgattttatgctcatagaatttgtcttcttgcatcatcagatgcatttcgtgcaatgtttgatggtggttacagggagaaggaggcaagggacatagagattccaaatattagatgggaggtttttgagttgatgatgaggtcttttgatgtcactctggatattgctcaagatcttcttcgagcagccgatcaatatcttttggaaggacttaagagactctgtgagtacacaattgcacaggatatatcgctagagaatgtgtcaagtatgtatgaacttacagaagccttcaacgcaatatcattgaggcatgcatgcatcctttttatcttggagcaatttgataaattgagttcaaggccagggtattaa

SEQ ID NO: 75866 - DNA, 1746 bp, Glycine max
  Peptide Sequence Number=SeqID_167551
atgagtgaatatgcagttgctagctggttatttgagagagactatcctcatccggctgttgatttaggagtagccaaagcattaggtagacatgtggaggttagtgaacggcaacgaaaacgaaaacaatttccagcttctatcacacacagctttatcaatggacagcagcatcaaagtccaagagctttaattgaggcatatggtagtgacaaaagccaacaaacttcaagcagcaagtctttgttagttgaaccactggatataaatggtatagacaacatgtcaacttcattgcagaatactgaagaggaggagtttgattgggaagatatgagtccaaccttattgtcttcaactattggtttctccagggaaaggcctgttgttccagctaatgcaactttgtcagagcaagatgccagcaagggatggggtattagagattttcgtcatgcaccattgggtgaggtacctagattccaaaatcaaatcaattatagtctaggctcttctcaacctcatgatccttcgaagatttctcttcatctgtctaactcatcacaacataactttaataatagggggcgagcaaggagtctcacgatccctcctgttgataacattcgaaatactgatataaacccatatctggttcgacctacatcttttgaaataaggccttctacaaatttgaatgtcactcgacctcctaccttaaatccaataactccattgcaaaaacgtgttaggaatcagtttgaagctacacatactagtgaccctattgtgaaccatgtaaataaatcttcgtttatgccagaacagtcatttgaccgtattgagaacaaggatgcaagtatttctaagatacatcagttgcctaatcagcatcccggactaatttcatccaaccagcaaaatcacgggcaagcaccacagctgcagttttttccatctcaggatccaacgccctctcaatttagtcctgggagttcattgcagctacatgatgcttctattagtacagccatgtcaaatccgttacatggtatacaattcccttcaccagtccaaagctttgcaaataaccctttcattagatatactagtttaattagttctctaatgtctcaaggcgtgatctcattggctaaccagctgcctgcacaggattctattggaactgagtttaatccagatattctgaaggttcgtcacgagtctccagcgaacgccttgtatcgtgatctccctagacaatgcaaaacttgtgggctccgattcagatgccaagagaaacacagtagtcatatggattggcatgtgactaagaatcggatgtctaaaagctgtaagcagaagccctctcgcaagtggtttgcgagtcttaagctgtggcttagtggtgcagaggcattgggaacagaatcagttccacattttttggcaacagaaagcatagattatgaagaaaggaaagatcatgaagagtttgcagtgccaacagaagaggaccagagtacatgtgcgttatgtggagagtcttttgatgagttttacagtgatgaaatggaggaatggatgtatagaggagctgcatacctcaatgcacccgctagaaaaacatcagcaggcatggataggtcacagttaggccccataattcatgctaaatgcagatcagactctaatctgcagtgtgccaatgaagaggatactcgaaggaaacgaatgcggagttga

SEQ ID NO: 75867 - DNA, 360 bp, Glycine max
  Peptide Sequence Number=SeqID_167552
atggcagaggatgatggttacacgaaagatggaacagtcgattactgtggaaatccagctaataaaaaggaaactggaacctggaaagcctgcccctatatcttaggaaacgaatgttgtgagagattggcttattatgggatgagcacaaacctggtgctttatttcaagaaccggctaaatcagcatagtgctactgcttccaagaatgtctctaattggagtggaacttgctatatcacaccattgattggggcatatttggctgattcctaccttggaagatattggacaattgctgttttttcaataatttatgctattgtgagtatggtctcttcaattgtctatgattactga

SEQ ID NO: 75868 - DNA, 1635 bp, Glycine max
  Peptide Sequence Number=SeqID_167553
atgacttccaaaacgcaccgtttcactacctgtcaccgtcacccttccacacccgtcaccggtttctgtgcctcctgtctccgtgaacgcctcgccggcatcgattcctcctccgccgaatcgccggagctccgccgcaccaagtccttctctgggcgcaccaccgacgctccctcctcctccgccgccccggagccccgccgcaggtcctgcgaggtccgactgccgccgttgggaggctcgctgtcggacctcttcaacgttgacgacaagaagaagaagcctccgaatcggaatgctgagatctgttccagcaccaccggcggcggaatcggagagaaagagcgcggcgacccggttagggtttccggcgatgatgacggagagggtaagacgatgaaggagttcatagatcttgaattgcggagcaaaaagaacacagggagagatttcagagacatcgcggcaagttttcgcgaggctgcttccgtattcagcaaaaggttgatgaaatggcgacggaagcagaatgcgaagagaaaccgctacaacgacggcttaggcgccggcgccggcgttggtccggtcgaaaagctagggctaaggacattgcatgaggcccaatctgaggtcggagaatacggcatcgcgttaggtagaagatcgtgcgacactgatccgaggttatccgtggacgattcgcggttttcgttcgaagctcctcgagcttcatgggacggttatttgataggcaaagcgtaccctggggtttcccgaatggttcgtgttggtgatagggttttgcttgaagaagaagaagaagaagagggagaagagagtttggagaatggtgaagagtgttgtcctggtggttcagctcagactaaacattactactcgaattggcataggaggaggaggagtttcgataggtcgaattcgcgtaggaagtcgtcaatgggggaagttgatgaattgagagcgatatctaatgctaaggtttcccctgcgaccactgagttgttctatggtgcaaaggtgttgatcactgagaatgatttgagggatgcgaatttgaaaccaattaatagtgttcaatctgataatgtaatgggttctgcttccaaggatgatgcttgtgatgttgcaattggggatgatcaaaagggattgaacaggtttcacaaatggggtaggttgtggagtaagttggggttaatgcagaagagaagggaagataggttggaagaaggagagtatgctggtggtggtggtggtgatgtggttgataagccaattgcagagtcttggcagaagctgaggagggtagttaatggacaagtgagtgagtcggttagccagaagcttattcgtagctatagtgttagttgtagagattctagtagaaccgcgggtttagtcagtggctttgtgggttctgagactaaaggccatgttttcaatggaaggcagaagtttatgcttcagagaaaccggagtgttaggtattcaccaagtaatgttgacaatggcttgttaaggttctatttgacacccttgaaaagctataggagaagcagatctggaaagagtagtttaaagagttcaaatcccacagccagaagtttcttttga

SEQ ID NO: 75869 - DNA, 285 bp, Glycine max
  Peptide Sequence Number=SeqID_167554
atgtcccgtctcgttatcagattgcaaacatatttaccaaaggacttcctttggtgctatttgaggattttcgagacagtctcagtgtccgtcgacctcccgcttcgactgcggggaaaaattctcaggcaatcagtttcaaactgtacattagaaaacaacaaaaaaaccgatgtttccattgtccatttaaaagctaaagcttcagctatatgggctcaaaacaatttggaagcaaaagagaggctgctgccaaaacatctccattatgatccctgtaaatag

SEQ ID NO: 75870 - DNA, 1152 bp, Glycine max
  Peptide Sequence Number=SeqID_167555
atggaggaggacttgaacatcttggaggttaacactgagccttgcaacaacaatgctattacaagtgcaaagattgcaccaccacagggaaagaaccttagtccaaatgtaacaaagaagtgtctatttctggtcaccaaacttcgcttccaaatgctcggcaatttcacaaccaatttgcgagaggtcatttttgggactaagcttgcagtgctttttcctgctgtccctttagctgttgttgcagatttttataaacttggaagaccttggatttttgctttgagcctacttggactcacccctctagctgaacgtgtcagcttccttactgagcaaattgcgtattacactggccccacagttggagggcttctgaatgcaacctgtggtaatgcaactgagatgatcatatctttgctagcacttcaccaaaacaaaaaacaggcagatgtaaactcactacttttgttgctggggttgctatgccatttgctgccattactgctcagatatgccttagcaggagaatatccttctatagccactagtaatctacaattgtcaagagcaagcagcattgttatgcttctagcatatgctggatacatcttttttcaattaaaaacacatcgacaactttttgatgcacaagaggaagatgaaaatgaagatgaagagaaggctgtgataggattttggagtgcattttcttggttggtcggtatgacacttatcatatctctgctttctgaatatgttgttgcaaccattgaggctgcttcagattcttggggcatttctgttagcttcattagcataattttgttaccaattgttgggaacgctgcagaacatgctggctcaatcatatttgctttcaagaacaagttggacatatctttgggggttgctatgggatctgcaacccaaatttctatgtttgtggttccatttagtgtggttgttgcatggataatgggtatagaaatggacttggatttcaatctccttgaaactgggtgtcttgcttttacaattattgttacagcattcactttgcagatcaagcatagagtagggtcaatttctgagctagaccataaattgggcctcttcaaagagataggtgccactatcgtccccggttga

SEQ ID NO: 75871 - DNA, 603 bp, Glycine max
  Peptide Sequence Number=SeqID_167556
atggcgaaaacgacgtcgttgctgctctttacactgctcctcttcggaaccctagctctcatccaggcgaagaaatcgaaggaggatttgaaggaggtgacccacaaggtttactttgatgttgagattaatggaaaagaagcaggtcgtattgtaatgggtctttatgggaaggctgttccaaaaactgcagaaaacttccgagcactttgcacaggggaaaagggaactggtaaaagtggaaagcctctccattacaaaggtagctcattccatagaattattcctagctttatgcttcaaggaggtgattttacacaaggaaatggaatgggtggagaatcaatttacggagagaagtttgctgatgagaacttcaagttaaagcatactggaccaggacttctatcaatggcaaatgctggtcctaataccaatggttcacaatttttcattacaactgtgacaactagctggcatgttgtttttggtaaagttctttctggaatggatgttgtttacaagattgaagctgaaggaacacaaagtggcactcccaagagcaaggttgtgattgttgacagtggtgaactccctctataa

SEQ ID NO: 75872 - DNA, 66 bp, Glycine max
  Peptide Sequence Number=SeqID_167557
atggggatgaataaaaatgtgatgttggagttgagaaaaacttattgcctaccaaacatctcctaa

SEQ ID NO: 75873 - DNA, 1962 bp, Glycine max
  Peptide Sequence Number=SeqID_167558
atgtttttatctaatcttgttttgcatcatgtaccatgcttcaatgattcaatttgtggctgcattttatttaagaatgaacttcatcatccagtgcagactaatgaagaaaatacaagtttgaataagaagatcttcggattgcaaaggaaatggagtgatatttgtcaacgtcttcatcaaaatcgatcattacctgaatttgatattaccaaagcaaggttccaagctacttcccacgaggggtttcaatttggtccaggaagtagcagcaaaggtccactccatagtgaaatccaatatcctaatcaaatttcctacatgtctaaagtgtcacagagtgcatttccatttaaacagatattaccagtttcagtaccttttgacactgttagtatcactgatgaagcagaccacataccaaaagtttcaaagagtcatatgcatggtacttggatttctccttcccctaaggccaatatgagccttcttgatcccacaacatcttcttccctgactcctgtgaccacagatttgggattgggaacaatatacacatcagctgctcatgagccagacacaccaaaactaagtgatcataagaagcctcttcatcacttgtcagactccctttcaaccgattttgatgctatgaatgagagtacttcacaccaaatcgctagatcttcttcctgttctggtccaaatctagaagggagatttgaaactgtagatttcaagtcattttaccatcttctcactgaaaaggttggctggcaggatgaggccatatatgctatcaatcgaactgtgtcccgttgtagatcctgcgctggaaagcgtagtagtggctcacatgttagagcagacatatggcttgcatttctcggaccagatagacttggaaaaagaaaagttgcatcagcacttgctgagattttatttggaaacaaacaaagcctaatcactgtggatttgagctcccaagacaggtcttatccaacaaactcgatttttgaattccaaaatacatattgtcatgatgtgcttatgaggaagacagtgttggactatgttgctggggagttaagtaaaaagccacattcagttgtctttcttgaaaatgtagatcaagctgatttcctggtgcagaatagtttgttccaagcaataaaaacaggtaaattcccatactcacatggaagggaaatcagcatcaacaatgcaatgttcattgtaacctctagtgtgtttaaaggtagtggctcttttagtttggagggggatcctaaaatgtttccagaggaaagaatcctagaagctaaaagatgtcaaatgcaattatcacttggacatgcttctgaggatgccaaaaggagcggttgcacaaatgtgaaggttgcacagagaaaagggacctccaaaacaacatttctgaataaaagaaagctaatagaaagtggtgattccaaagagaaagcatcatgcaaaacattgaaacaggtcggggaggcatcgaggtcctatctggatctgaacatgcctcttgaggaggttgaagagggcaacaattacaatgattatgaaagtgacgcctggttaaatgatttgtgtgatcaagttgatgaaaaagttgtttttaagccattcaactttgattctattgctgagaaagtaataaaaagcattgacacgcaatttcaaaagatgttaggatcagagtttatacttgaaattgagtatgaggtcatgacacagatacttgcagctgcttggttatcagacaagaaaaaagcagtggaggattgggttgaacatgttcttggcagaagcttagctgaagctcatcagaagtaccgctttgtacctgaatttgtgatgaaactggttaactgtgaaagaatttttttggaagaacaatctcctggagtatgccttccagctagaattaacttgaactga

SEQ ID NO: 75874 - DNA, 273 bp, Glycine max
  Peptide Sequence Number=SeqID_167559
atggcttccaataaatctaatgttggtagtggaagtggtgatgttgtcgttagtgggagtggaagtggaaatggaagttattctaaggtgaaagctcatttacttcaagttaaaggtcaaggaattgctatttgtaaaaaagtggcccgacaagatagaattgaaatgacgagggcagaagaagagtttgaaagaaaaaaagagtcgagagctaaagatgttcctttaccatgtcaatctcaatcggaacttgattcctcctctaaaaaatga

SEQ ID NO: 75875 - DNA, 255 bp, Glycine max
  Peptide Sequence Number=SeqID_167560
atgaagaatttgattcaaacttggtggtggaggaatggcttgtgttgtcatggacatacatggaactcacttgagccaatattgaaagcaaattcgaagtgtaagtgggggagaaagagaaacgagggggtgttgggagaggagggagtgtgcgacgcaaaggttgtggtcttgtcgtgcgagtctgaagtgagagaacactgcgcgataagcggcgcgcgacatcaacggggtggcgacgcctgtaaaacttaa

SEQ ID NO: 75876 - DNA, 225 bp, Glycine max
  Peptide Sequence Number=SeqID_167561
atgtgtatgcgtgtctcgcgtttcccgtcaaatattttaagagtacttttacatgagagtaacaaaaatgatgatggtggtagtgttagcagtaaaagtggtagaaatatcaatggtggttgcagtgacaatggtgatggcggcggtggtggtggcgctgccaatgctgtaggtgacgacgataataatgatagcggtattagtggtggcaaccaatggtactag

SEQ ID NO: 75877 - DNA, 351 bp, Glycine max
  Peptide Sequence Number=SeqID_167562
atggtacctagcagcaatgacaacgagggtatcaacggggcgaacagcataagagaggtaaatcgcagggagagagttatcggagccgttgaagcaggtgcaaggaagaggaacgatgagattttggcccacatcagggtcggaaatggagttaacctcgcggagctggtcgaaggagacgaggccggcgtagacgacgtcgacgatggaggagggtgtcggagggacggagtaggagatgggaactttgaggaagaacttcgaggggagaatgtggtgctccatgtcggggtaagagatgtcgatggcgttcatggtgagaagcgcgatgggatcgatttggaagaatga

SEQ ID NO: 75878 - DNA, 90 bp, Glycine max
  Peptide Sequence Number=SeqID_167563
atgttgtgggtggtgaagggtggggctggagtgtccacagtgggggattgggtggtgacagagaaagaacatagtgcaaagtcgaagtga

SEQ ID NO: 75879 - DNA, 429 bp, Glycine max
  Peptide Sequence Number=SeqID_167564
atgaaacttcaaacctcggaagattcccttcccgctccgataaataccgcaatctccaaattcaaatcaaaatcgcaaatcctcaaattcgatttcctaccaatttctctcgagaaaatgtctggtcgtggaaaaggtggcaagggtttgggcaagggaggcgccaagaggcacaggaaagttcttcgcgataacattcagggtatcacgaaacctgcgattcgtaggttagcgagaagaggtggtgtgaagagaatcagtggtttgatctacgaggaaaccaggggggttctgaagattttcttggagaacgtgattcgagatgctgtgacctacaccgagcacgctaggaggaagacggtgactgccatggatgtggtttatgcgctcaagaggcagggaaggaccctctacggttttggaggctaa

SEQ ID NO: 75880 - DNA, 1326 bp, Glycine max
  Peptide Sequence Number=SeqID_167565
atgtctctccggcgtggagtccctctttctctgttggtcctcttcctcctcctggtatctccggcggcgaccttggccttccgcaagaagcacaagatcccggggccgatcaaaaccatagtggtgatagtgatggagaaccgctccttcgaccacgtcctcggctggctcaaatcctcccggcccgacatcgacggtctcaccggcagcgaatccaaccctctctccgtctcctccccctcctccgccacaatccccgtcactgacgacgccctcttcatcgacgccgaccccggccactccttccaggccattcgcgagcaaatcttcggttccaacgacacctctgcagtccctcccccaatgaacggcttcgcccagcaagccgagtcaatcctcctgggcatgtccaaaaccgtcatgagcggtttcaaaccccacaccctccccgtctacactgctcttgcaaaccaattcggtttattcgacaaatggttcgcctccgttcctgcttccacccagcccaaccggttctacatccactccgccacctctcacggcgccatgagcaacgtccgcaaggacctcatccacggctttccccagaaaaccatcttcgactccctcaacgagaacggtctctccttcggcgtctactaccagaacatccccgccacgctcttcttcaagagcctgcgcaagctcaagaatgcggtaaagttccacgactacgccttgaagttcaagaagcacgccgagaaggggaagcttccgaactacgtggtggtggagcagaggtacttcgatgtggaggtttttccggcgaacgatgaccacccctcgcatgacgtggcggccgggcagatgttcgtgaaggaggtgtacgaggttttgaggaagagtccgcagtgggaggagatggcggtgctgattacttacgatgagcatggtgggttttatgatcatgtggcgacgccggtagaaggggtgcctaaccccgatgggatcgttgggccccacccttattactttcggtttgataggttgggggtgagggtgcccacgtttattatctcgccttggatcgacaagggtactgtgattcatgaagcagaggggccaacaccatattctcaatatgaacattcctctatccctgccacagtaaagaagcttttcaatttaaaatccaatttcttgacaaagagagatgcatgggctggtacctttgaaaagtacttttacattcgagatactcctcgtgatgattgtccagtctctagtccaggcatccaatgcaagcaaccttttccagaccagacatga

SEQ ID NO: 75881 - DNA, 366 bp, Glycine max
  Peptide Sequence Number=SeqID_167566
atgaacgcgctaagcacacctgctgcgcttagcctgttcatcacaactgttaatttttttggatttccagatgatcccgctaagaggaccatgctaagcgccaatatgcttctgttttttagtcctttgaataaggctaagcgcaactgctatgctaagcccttgttgtctgtcaaggaggctaagcgcgccctgtgtgctaagcctaagggtcattcttctaaggctgagctaagcccagcatgctacgctaagcccaaaccctcttctgttttgaaaattatggcatcaaagaagagaaaggcacctgccacaccttcccaggtccgatatgaccgatctaggttcacttctcctgaggcctag

SEQ ID NO: 75882 - DNA, 273 bp, Glycine max
  Peptide Sequence Number=SeqID_167567
acttatcaaggtaatccttgtggcgtctacccagacttatcttccttcactggaagtggcgtctacccagacttatcttccttaaccggaagtggcgtctacccagacttatcttccttcacggaagtggcgtctacccagacttatcttccttcaccggaagtggcgtctacccagacttatcttccttcaccggaagtggcgtctaccctgacttatcttccttcaccggaagtggcgtcatccaaaaactctacagcctgtatcaagtga

SEQ ID NO: 75883 - DNA, 237 bp, Glycine max
  Peptide Sequence Number=SeqID_167568
atgagggacgacaagaggtcttcgtacgtgattgggatcggggtgaattctggagttggccttgggggaaagttcctcatcgcgttggaactggcgccaaagtcggcgttgccggccgggcgagtcggggttggagccggagcttggggggcctccctcgggatgggtgcaggcgctctaggttgtgcaagtgctgaaatggaagagtccccgacgcgagctgagaagctcgagtga

SEQ ID NO: 75884 - DNA, 435 bp, Glycine max
  Peptide Sequence Number=SeqID_167569
atgtctgacctttacgcgctgtttggcggcaccttcgatcccattcattacgggcatctgcgtccggtcaccgcgctggcgcagcaggttggcctgcaaaaagtgacgctgctgccgaacaacgtgccgccgcaccggccacagccggaagccagcgcacaacagcgcgtggcgatgctgcgttgcgccattgccgatcgtccgctgtttgatatcgacacgcgcgagctgacgcgcaccacgccgtcatggacggtggacacgctggaaaccctgcgcgccgagcgcggattctctgctaacgttaggaaaatggcatcgctggcaggaactgctgtcgctgtgtcacctgctggtctgtcagcgtccaggctacgccgcgcagatggttacgccagagatgcagcagtggctggatgctcaccgcgcgcatga

SEQ ID NO: 75885 - DNA, 132 bp, Glycine max
  Peptide Sequence Number=SeqID_167570
atgactgaagacatttttgtctttgaaatgtgtgcggattattgtataggacgtctccgcatgctacctgacttctcacagataaccattgggtatctctgcatgtcacccgattctcacatgtcggggtaa

SEQ ID NO: 75886 - DNA, 879 bp, Glycine max
  Peptide Sequence Number=SeqID_167571
atgctttttggtcattggctcaatggtaaagagattcctgacccttaccgcaaaagtgacgaagcgtttaattcggtgtaccagctaattgagctagcaagccagtcttgggctgccaagctagccacaactaataaaccggcaacgccggactccgatgaaattgacttggggcgccttctaggtgaattaatcgatcatcgtaaattaatcatttctgtaaccgccgtattcacactattggcgattctctatgcattgctagctactccaatctaccagtcggacgcattaatccaagtagaacagaagcagggtaatgcaattttgagcaatattagtcaaatgttgccagatagccaaccgcaatcggcgccagaaattgctcttttacaatcacgaatgattcttggcaagaccgttgacgatctgaacctacaagcccaagtgacacaaaagtattttccactggttggccgtggtattgcaagaataatgggtgagaaaccaaagacggtcactgttagccgtctttacttaccaagtaatactgatgatgacgaagtgccaaatatcatgatcacggtgaaagataaacaacactatcaggttaatgcaattgatgcagaaccaggagatcagtttatcattcgacaatttacaaaactaaaggctattgctgatcttcagagaatattcaatgtctccgatcagggtaaagacacagggatgttgacgctaacgttaactggagataatcctgatttaatttctcaaattcttgatagcataagtcagaattacttagcacaaaacattgctcgacaagcggcacaagatgcgaagagtcttgattttctgaatcagcagttgccagta

SEQ ID NO: 75887 - DNA, 522 bp, Glycine max
  Peptide Sequence Number=SeqID_167572
atggtggtgacggttaaaaagctcgtagttggaccttgggttgggtcgatcggtccgcctccggtgtgcaccggtcggctcgtcccttctgccggcgatgcgctcctgtccttaactggccgggtcgtgcctccgcatgggataacaccacaggattctgatcctattgtgttggccttcgggatcggagtaatgattaacagggacagtcgggggcattcgtatttcatagtcagaggtgaaattcttggatttatgaaagacgaacaactgcgaaagcatttgccaaggatgttttcattaatcaagaacgaaagttgggggctcgaagacgatcagatacccgtcctagtctcaaccataaacgatgccgaccagggatcagcggatgttgcttttaggactccgctggcaccttatgagaaatcaaagtctttgggttccggggggagtatggtcgcaaggctgaaacttaaaggaattgacggaagggcaccaccaggagtggagcctgcggcttaa

SEQ ID NO: 75888 - DNA, 126 bp, Glycine max
  Peptide Sequence Number=SeqID_167573
atgatcttgagggggagactgctgctgctgatgatgactgatattccgctgtgcttgattactctgataatggaagttgctgatcccacttgcataactgctcgtacctgctcaggaagtgtctaa

SEQ ID NO: 75889 - DNA, 489 bp, Glycine max
  Peptide Sequence Number=SeqID_167574
atggatgaagttgatatctttgtccctcatcctttcacaaacgcatctttgcttattcaactttctccgaaatgtgggtgcaagccattggtctatttgctcaagcgacctatgctcctgagttttgacttccaagaccgttcaatcagagattactcgtcttgcacgttgaaagtctgtcttttagagagaagtgagttatcaagaataggatgttggacaaatggcctcagttatcttaagaaggggggggttgaattaagatacaaatattatgccccaattaaactttcactctctcttttcggattaacaatgcacacagggacaacccttcccttgtgttcaggaatcctatacaacaagagaccacggtctcttaatcccttttcagaaataagaagaagagaagaagagatctctcttaaaagagatagattgtacaatgaagatcaatcaaaattccttattgaatatgcaaatggttga

SEQ ID NO: 75890 - DNA, 294 bp, Glycine max
  Peptide Sequence Number=SeqID_167575
atgacgactctttgcaaatccagaagaaggtaccaaagggtaataattttcatttctatgggaaatctggacacttccaaaatgattacccaaagtagatttgttacaatcagaaccataagtccaaatgagaagttcgtcttcatgggaaatagagtgaaagctccaacggaagcagtcggaatttatcgtataaaactcgacactagacatcatttagatttactggaaagtctttgtgtacctagtttatctaagaatttagtttcattatctaaacttgatgttacttga

SEQ ID NO: 75891 - DNA, 300 bp, Glycine max
  Peptide Sequence Number=SeqID_167576
atgtatcagtatccttttcagggtcatcacactgatacttctgcaagcgagcattcattcggtggtgttgcgaaaacacatcctcatttttcatggctgactatgaccccttcacagcaatatcatggcccaattccaacacctaatgccccattaggtacacaatggaatgtatcgggaccaatacctaatatgggtgacttattaggtgttgatttgcgtcacgaattttctgctgagcctgacgaagaagaagcggggagacatcggggtagaagaaatcctgatcgccaagcatga

SEQ ID NO: 75892 - DNA, 426 bp, Glycine max
  Peptide Sequence Number=SeqID_167577
atgaatcctaatgaaaccatacaggacatgcaaaagagattcacacacataattaatcatcttgcatccttaggaaaaatctttccaaatgaagatcttatcaataaagttttgagatgcttaagcaaggaatggcaacccaaggaacatgaaatggaattgatgagattgaatcaaaataaggagaatgataagaaaaagaaaggaattgctcttaaagcttcatcttcaacccaagaaggaagtgataaggaggattcaattgaaatagacgaagatgatgatctcagtctttttgtaaaaagattcaacaaatttctaagagtcagaggaaatcaaagaagatcaaattttcaatcaaagaaaacggcagaagattcatcctctactccaaaatgttatgaatgcatcaacatggacatctaa

SEQ ID NO: 75893 - DNA, 258 bp, Glycine max
  Peptide Sequence Number=SeqID_167578
gggcagaatcgtcttaggccacagtccgaggtcgagacaaagctaaaagcagaaaccaatcaagaggctagggtcatgaccgacaaatcgtcatcccttcccagctcgggacaagcggaaaacgccactgtaagacagcctagggatggccttaggcctagggtgcatcctgaagcaatggggcatgccacattgcccccactcgcttgctattcatgcctaaacatgcgcccaccaagtgctcgggggatcctctag

SEQ ID NO: 75894 - DNA, 309 bp, Glycine max
  Peptide Sequence Number=SeqID_167579
atgtatccattgagaaaaacactcttaacgtccattttaaatagcctgaaatccataatacctgcaaaagcaagcaatgacctaatggcttccaaccttgcaacaggtgtgtcataccctaatttcgtccggggaccattgtttggtggcatgcaaccttcgcttgaccgcctcgagggggtgcaaatagcaaccaagcccacttgggccttccaaggggttccaacagaaggcggtgccttttggtggaagcaacccagcttgcctgggcgagctgggcggcaaccacctccctcttttctcctataa

SEQ ID NO: 75895 - DNA, 438 bp, Glycine max
  Peptide Sequence Number=SeqID_167580
atgactagaggcaatccatctgacttacaaccctttgatcctgagatagataggacatttcatagattagttaggcatcattttgtaccttttgaccatcctgagcattctgttattggtgattttgaacatcctgattttgagcattataattttgaacattctgagaacatggcacaacctccaccccgtgagaggactctaagggaaatggctgcacctgatttcacctacgaaagcttgtgcatccaataccctgatgaggatgtcccatatgttcttaaaactggactgatccatttgcttccaaagtttcatggccttgcaggtgaagacccgcacaaacatctgaaagaattccatattgtctgctccaccatgaaacccctagatgtccaggaggatcacatatttctgaggcttttcctcattctttag

SEQ ID NO: 75896 - DNA, 360 bp, Glycine max
  Peptide Sequence Number=SeqID_167581
atgcaacaacaacagcagcaacaacaacaaagacaacaagcaactgaggctcttcctcaaccttgcattattgggaacaataaatttgagaatgccatgctagatctaggagcattagttaatgtcatacctctgtccattttcaattctttatctcttggacctttacaatctatagatgtggtgattcatttggcaaatgaaagtgttgcttaccccgcaggaaacatccatttttatctgatttgcatacttgtcattccttatgcattgaatctgaatctgagtttgaatttgatcctgtatctgatttttatcctgagagtgaatttgaacttgaatctggttctgattttctag

SEQ ID NO: 75897 - DNA, 811 bp, Glycine max
  Peptide Sequence Number=SeqID_167582
atggctacctcaccaaaagaaacttcagctcctggttcaccctctgtaccatcatctccatcatccaccaaagcaccatcaaaccaggaacgacctgaattcaatatccagcccatacagatgattcctggtcaagcccctgttcctgaaaaactggttcccaaacgacaacagggagtgaagatttctgaaaaccctagccttgcaacaagtcctagggaagtagacacagagatggataagaagatccgcagtattgtgagtaacattccaggtccaccccaaatgtttctgttcctgatgcaccattggaattcaacatccattccactcccaaatgctgaaaggtcggaaattcggttcaacgcagacttcctggaaagagaactgggaagagctgccttggatgcaaggagtcatggacccctcatcacggctgctggactgctgaagactgtcaccaagttgggagattgctatgagagtctagtcagggaattcattgtcaacattccctctgacataacaaacagaaagagtgatgagtatcaaagagtgtttgtcagaggaaaatgtgttagattctcccctgctgtgatcaacaaatacctgggcagaccaacagatggagtggtggacattactgtttctgagcatcaaattgccaaggaaatcactgccaaacaaatccagcattggccaaagaaagggaagctgtctgcagggaagctaagtgtgaaatatgcaatcctgcataggattggagctgcaaactgggtacccaccaatcatacttccactgttgccacag

SEQ ID NO: 75898 - DNA, 327 bp, Glycine max
  Peptide Sequence Number=SeqID_167583
gtcaatggtgatacattgtttttgaccagtaatttcaaggaattcaaggtagaaaaccatgaaagtagcacttgggatgagaacaatgctctgaccagcactgttgactatcttgccagcatagatagtgcaacacatgcaagcttagatatcaattctgatctacaattagcaatagccttgcaacaacaagagtttgagcaacagccaccacgccaggataattcacagcagcaatcatccattagcggtagctctagactggtcacaggtcccaagccaatggatgggatcattttcaattttgtcgggaatctttattattaa

SEQ ID NO: 75899 - DNA, 789 bp, Glycine max
  Peptide Sequence Number=SeqID_167584
atggacctcatcaaggctgctggactactgaaaacagtcaccaagttgggagactgttatgaaagcctagtcagggaatttattgtcaacattccctctgacataacaaacagaaaaagtgatgattatcaaagagtgtttgtcagaggaaagtgtgttagattctcccctgctgtgatcaacaaatacctgggcagaccaacagatggagtgatggatattgctgtctctgagcatcaaattgccaaggaaatcactgccaaacgagtccagcattggccaaagaaagggaagctttctgcagggaagctaagtgtgaagtatgcaattctgcacaggattggagctgcaaactgggtacccaccaatcatacttccactgttgccacagaatcatttgctgtcaaattacccattgccttcccaactgtattgtgtggcattatgttgagtcaacatcccaatattttaaactacactgactctgtgatgaagagagaatctcctctatccctgcattacaaactgtttgaggggacacatgtcccagacattgtctcgacatcagggaaagctgctgcctcaggtgctgtgtccaaggatgccttgattgctgaactcaaggacacatgcaaggtgctggaagcaaccatcaaagccaacacagagaagaaaatggagctggaacggatgatcagaagactctcagaaagtggcattgatgatggtgaagcagctgaggaagaagaagaagcagctgaggaagaagaagaagcagctgaggcatag

SEQ ID NO: 75900 - DNA, 234 bp, Glycine max
  Peptide Sequence Number=SeqID_167585
atgattcatttggatgaggccagatgggggcatcgggttcactttagtaacagcgctgatagcggcaactgcaaccgtattatcttcttcatgctcatcatggcctccatcattgtggtcattttctctctcatggcctccatgtcggccttcatttgctcttgcacctcctttacttcacccattactctagctcttgcacggattcggggaaaatgcaaggatcatgcatga

SEQ ID NO: 75901 - DNA, 1676 bp, Glycine max
  Peptide Sequence Number=SeqID_167586
atggagaatgttccaggagcgtacaatgctgctggctcaactttgttagagaatgatgacgaattaccaactaccactgctgttgcacttgctgcacataattcacaacctctgtctcggagaacaagatcgctcaaaggtgacaatcagaatagtctccagattgatggatcatataggccagcatctatggatggaggttcttttgatggccatgatgaggcagattcaaatgaggaagctaccttagatgggaatatggcaacagcgagaatcaatggtaatgatataccaaaggattctaacaatgctcttcgtcaaatgccaacatggctctcaaattcgacacctgatgaatttcttgaaacaattagaaaaagtgatgctccgcttcatgtgaagtatctccagaccatggttgagtgcctttgcatgcttggcaaagttgcagctgctggagctattatatgccaaagattgcggccaacacttcacgagataattacatccaagattaaagctcatgcagagcttttgaattcatcaaggtccattggtcagggttcccggactggaacaggtaatctgcacttcataaaaggtcaactagaaagttatcagttgccaaaacagaagcataagaatggaatatctattgctggaactctgttggctgtgagtcctgtatcgcctcttatggctcctggtgggaaagcacaggttgctgctaaggagcttcttgattcaattttggatgctgttgttcgaatatttgagaatcatgtcattgttggggagcttttggaagcaaaagcaagtcagcatgctgacttaaacacgccaaaatcattgccagtagatgtaaactggagccctgattctgaagcatctcaagttaccggagggtacagcataggtttctccctgacagtgttacagagtgaatgccaacaacttatatgtgaaattctgcgggccactcctgaagctgcatctgctgatgctgcagtgcaaacagctaggcttgcgagcaaagtcccttctaaagataaaaggcaagatgagccctattgcaatggtatgtttgcagccttggatggatcagaagatggtcttacctttgcatttcgctttacagatgctacaatatctgttcctaaccagggagttgatcttgttcgccaaggttggagtaggaagggtcccaatgtgcttcaagagggttatggttctgcagcagttttgcctgaggaaggcatatatttagcggcatccatataccgacctgtgcttcagttcacagataaagttgcttcaatgctgccaacaaagtattcccaactcggggcacatgtggctactacttacacttcgtcaattgagaagggtcgacctgtgttacaaggattattagctatagatcacttgacaaaggaggtgcttggctgggcacgagcaatgcccaagttctctaatgatcttgtgaagtatgtgcaaacttttctggagaggacttatgaaagatgccggactgcatacatggaggccgccgttcgtgacagatgcgtcgctgccggagctcgtcgccgctgtttgtgccggtgcgtcgctgccggaggtcgtcgcggctgcatgcgcgtgcggctgcgggtgtcgcggctgggtgcgcgtgtggg

SEQ ID NO: 75902 - DNA, 207 bp, Glycine max
  Peptide Sequence Number=SeqID_167587
atggcatggaattccctgttctcctcggggaattccctgttgacatcccaaaccctaggcttcccgccattattcaaccgttccaaaaccaaattcttcccattgcagctcaagagaacgatgcggtatcctccaccacctctgatcaccaatgagaaagtagcttcttgcattcgtacgtatatatgcagcacagaatcatcgtag

SEQ ID NO: 75903 - DNA, 996 bp, Glycine max
  Peptide Sequence Number=SeqID_167588
atgtctgacccttctaccctcttaccctcctcccaccaccaccacaaccaccatgtgccactcatccaaggcggcgccaccgcaccctcctcctcctccaccaccctagcccgagaataccgcaagggcaactggaccatccaagagaccctcattctcatcactgcaaaaaagctcgacgacgagcgcaggctcaaaacccctgctgcatgtagcacctccaccaccaccaccagaaccagcggcgagctccggtggaaatgggtggagaactattgctggagccatggctgcttgcgaagccagaaccaatgcaacgacaaatgggacaacctcctccgcgattacaaaaaggttcgcgactacgagtccaaatcaaacgacaacgacaacaacaacaacaaacacttcccttcttattggaccctcaacaaacaacaacgtaaggaacagaacctcccctccaacatggtcttcgaagtctaccaaaccatcgccgatgtcctccaacgaaaacaaacacaatcccaaagacaacatcaacaacctctggctattccattagttacttcctcaccctcaccacttcaaacacttccaccacctcctctaccaccaccgccgcctccgccacctcctcctccgccagttagctccaccactccggtaggctcagagagatcggaatcatcaggaactgagcacagtgaggatgatgatgatgggtcggaatcaaaacgtaggaaagttaagaaccttggttcaagaataatgcaaagtgcatcggtgttggcacgagctcttaggagttgtgaggagaagaaggagaaacggcaccgtgaaatgattgagctggagcaaaggaggattcagatggaggaagctcggaatgaggttcaccggcaaggcatcgcgacccttgtcgccgccgtcaccaacctttccggtgccattgagtcactcattaataattctgaacgccatggccaaagataa

SEQ ID NO: 75904 - DNA, 454 bp, Glycine max
  Peptide Sequence Number=SeqID_167589
atgggagcaactcaatgggaaagcacgtgtattctatccacccctgtctcagtttcaggggatgcggataggttggtgaatattgctgggagtgttgctagcaaggttgagtgcagcggtgaaggtgaaatttccggcgtgaagctttgcggtggtcggtggcggcaaacaaggtacgcagatggcgtttgtgcgtcgcggacgtacggatggcttccggatcaaatggataaagatgagtggatgtatgaaataatgtctgaacgagcggatatggattatgaaaatgcagaatcatgtggtgcgaatgaaccacatgttgattgttcggaagcgttcaagacttctcagtgccgagagaatgttttgcggtgggctcgatccgtggctcatgaaaacggatttgtggtggtgattttaaggtcggacacaaacacaagtagtagagggagaa

SEQ ID NO: 75905 - DNA, 186 bp, Glycine max
  Peptide Sequence Number=SeqID_167590
atggtggtggtggtgttgttggctgagtctgttgctgcggaggaatgccattatcatccaattctaaacttgttgtttcttgctcagggggcatcatctcagagagtagttatccactcagatattaaccagaaaatgaaggaggtaggagtagaactaaaccagaaggaattaagagcaaggtag

SEQ ID NO: 75906 - DNA, 516 bp, Glycine max
  Peptide Sequence Number=SeqID_167591
atggcgccgccatcccaaacccgccacgccaccgctattcggtggcgttttttcgaaaaaccgccatggccgccatttaacaacactggaaacaaccactggctgatcatcataaagaagttaagaacacaattctatgatcaaatggctgttcttgagaagcagagttatatgcttattgggaggcatgatattgagaaattgatgaggattgacccctcaagtgcatatttaccgaatctgcttggtcagttaaatgtggaaagtaattcatctgatgccgaaacaattgaggctgaattagaacttggtgaattactgctaaatttgcgtcctattaaacaggaaaacctaatccatgatgacaacaaacttattctgttggcatcccttagtgactcattagagtatgttgcagactctattgaaaggttttgggtggtggagcaatcccactcccagcaagaaagttgctttggtggcattgtggagggattgcaaagattggtagaatga

SEQ ID NO: 75907 - DNA, 511 bp, Glycine max
  Peptide Sequence Number=SeqID_167592
atggtgaccaaggcgaacgcaagaatggagacatgcatggaagctatggagaaagcaatagaggagaatcgtgaagcagtggaattgcagctgagctcgattgaagggatgatccaaaggttggcggcggcatgggagaaaaaaactcctgagacgaatgtgcacgtagttgacaagagcggagaagatgaagcggttagggaaaaggacaagctggaggcggtaatggtcgcgatggatggggaagctctgggttggttccaatggtgggaatcttggaatccaaatcattcttgggatgggttcaagattgctgtcacccaaaggtttcaggcttcaagcttggaaaatccttttcaagagccatttctggtggaagtgttcctcacggggttaaaggaagagattagcattgaagtaaggcttcatgaaccaaaaaacatgatggaagccatggttaaggcccaaagagtggaggataagaacagaatttcagggaagttacttgtgg

SEQ ID NO: 75908 - DNA, 5721 bp, Glycine max
  Peptide Sequence Number=SeqID_167593
atggagaaagcgataaaaaacaaagttgctaaagcggtggtacctgcaatagatgttatgtttcaagctttaagtgattttggtgcaaaaattgtgcccccaaaaagaattttgaagatgcttccagaactctttgatcatcaagatcaaaatgttcgtgcatcctctaaagggttgactcttgaactttgccgttggattggtaaagatagtgtaaaatcaattttgtttgagaaaatgagagacacaatgaaaaaagagctagaggcagagcttgtaaatgttacaggaacagcaaagccaacccgtaaaataaggtggatgctgattttgatggttttgaattttcccatcccaatgtatggacattaccattttattctatcatgtcgtagatctgagcaagataaggaacctgaacaggaagctgtgtcagaggttgtgggtcctggcccttctgaagaatctgggaatgatgctcctcaagaaatcgacgaatatgaacttgttgatcctgttgatatattgattcctttggagaagtcaggattttgggatggagttaaagctaccaaatggtctgaacggaaggaggctgttgctgagctaacaaagcttgcatcaactaaaagaatttctcctggtgatttctctgaagtttgtcggaccttaaaaaagcttattacagatgtgaatattgctgttgcagttgaagctgtccaggctattggcaatcttgctcgtggattaagaactcatttttcttcgagttctcgttttttattgcctgttttacttgaaaaattgaaggagaaaaaacctgctttggctgaggcattgacgcagactcttcaagcgatgcacaaagctggatgcatcagccttatagatattgttgaaggcagtaacaagggtgttattatgaaggtgcacaaggattatgtgccaatctgtatggagtgcctaaatgacggtactcctgaagtcagggatgctgccttttcagcattggcaggaatagctaagtcagttggcatgagacctctggagaggtcgctggagaaacttgatgatgttagaagaaagaagctttcggaaatgatttcaggttctgaagatgctgtgcctggggcttcttctgcagcttctgtgcaaaatacacgtgtaagtgcatcttctgcggagtcctctgaaagtgcatttgtcaaaaggtcagctgcaggcatgcttagtggaaagagacctgttcagtcagttcctgttgctaagaaagggggggttgtaaagtcggggacaaacaaaaaaacagatggagttccacaagtgaaggcttcaaaatctgttgaaccacctgaggatgttgagcctactgagatgagtcttgaagagattgaaagccgaataggttctcttatacagtcggatactatcactcaattaaaaagtgctgtgtggaaggagcgtctagaagccatttcttcactgaaacagcaagtagaaggcttacaggaccttgaccaatcagtagaaattttgattcgtttagtctgcactttacctggatggagtgagaaaaatgttcaggttcagcagcaggttattgaagttatcactcatataggttcaactgcaactaaatttccaaagaagtgtgtagtactttgcctttcaggactaagtgaacgtgtagcagatattaagacacgtgctcatgctatgaaatgcctgagtactttgtctgaagcagtcggtccaggattcatttttgaaagactttacaagatcttgaaggagcataagaatcctaaggttcttagtgagggaattttgtggatggtttctgctgttgaagattttggtgtctcacatataaagcttaaggatttaattgattttcttaaagagattgggctgcagtcaagtaatgctgctactagaaatgcatcaattaagttcttgggtgttctgcatagatttgttggtccaggctctaaggtttttctccttgcagacattaaagggtttcttactgatgtaaaacctgcactgctcagtgccctggatacggagtatgagaagaatccatttgagggagcatctgcagttaccaagagaactgtcagggcatcagactcatcttcgactgccgttgctgggggactggatagcttgcctcgtgaagacatcagtggaaaaatcacaccaactcttctgaagagcttggaaagccctgattggaaggttcgtatggagtctgttgatgctgtaaacaaaatattggaagaggctaataagcgcattcaagcaactggaactggtgagttgtttggggctcttaggggacgacttgttgatagcaacaaaaacattgtcatggcttccttgacaacaattggcaatgttgcatctgcaatggggcaagctgtagagaaggcaagcaagggtattctgtctgatgtattgaaatgtcttggtgacaacaagaagcacatgagagaatgtgtgctgaatacattagacgcttggctggctgctgttcatctggataaaatggtttcatatattgcaattgctttgatggactctaaacttggcgctgaagggcgtaaagatctttttgattggttatcaaagcaactttctgagttaagtagttttgctgaggctgcacaactgctgaagcctgcctcttctgcaatgacagataaatcttccgatgttcgcaaggcatcagaggcttgtattaatgagatactgagagttagtggacatgaaatgattgaaaagatggttaaagatattcatggaccagcactgacactagttcttgagaagttgaaaccatatggagcttttcaaggcacgttctttgagtcatttgagtcaggtagggcagtttcagtgggtgcaacatcaaaagcaaaggccgggaaatcaactgccaatggtgtttcaaaacatggaaatagagctgtatcttctagagttgtggcaacaaagggcaccaagtctgaatcaatatctgttcaagatatagcggtccagtctcaggccttgttaaatatcaaggattcaaataaggaagatcgagagagaatggtggttcgaaggtttaagtttgaggatccacgtattgagcaaattcaagatcttgagaatgatatgatgaagtatttcagagaggatttacataggagactcttaagtgcagattttaagaagcaagttgatggacttgaaatgctgcagaaggcacttccatccattgctaaggaagttatagaagttttggacattcttctgaggtggtttgtgttacagttctgcaaatcaaacacaacatgtctattgaaggtgctggaatttcttcctgaacttcttgacactttgaaggatgaggggtactctttgacagaatctgaagtggcagtgtttcttccatgcttagtagagaagttagggcataacattgagaaagtacgagagaaaatgcgggagctcaccaaacaatttgttgccatatattctgcgtctaaatgtttcccttatatattagagggtttgcgctcgaagaataaccgaactcgaattgaatgtgctgatcttgttggatttattattgatcatcatggtgcagagattagtgggcagctaaaatcattgcaaattgttgcaagtttgactgcagaacgggatggtgaaactaggaaagctgcattaaatgcactagctactggttataaaattctaggtgaggacatatggagatatgttgggaagctaactgatgctcagaagagcatgttagatgatagattcaagtggaaggtccgggagatggaaaagaagaaggaaggaaagcctggtgaagcaagggccaatttaaggcgctcagtcagggaaaatgggtctgatgtcgcagaacaaagtggagaaatggctagatctcttactggtccaatgttgaggaaaaattatgctcaacctgatagtaacattgatagacagttgatgccccatcctatgactgttgctagtggccccacagattggaatgaagcactcgatattatttcttttggttctcctgagcagtctgttgatggaatgaaagttgtttgtcatgagttagctcaggccactagtgatcctgaaggaagtgctatggatgaacttgtgaaagatgcagataggctagtttcatgccttgcaaataaggttgcaagaacttttgacttcagtttgactggtggtgcctcatcacgatcttgtaaatatgtgctgaacactctcatgcagacttttcagaataaaagattagcgcatgcagtaaaggagagcacacttgacagtctcattactgagcttcttctgtggctcttggatgatagggttcctcatatggatgatggaagccaattgttgaaagctttaaatgtgttgatgcttaagattttggataatgctgatcggacttcatcctttgttgtcttaatcaatcttttacggccactagattcatccaggtggccttcaccagcattaaatgagtcacttgcttccagaaatcagaagttctctgatctagtcgtgaaatgccttatcaagcttacaaaggttcttcagagcactatctatgatgttgaccttgatcgcatacttcaaagcatccatttgtacctgcaagacttgggaatggaggaaattaggagaagggctggtgctgatgacaaacctttacgaatggtaaaaactgtactgcatgaacttgtcaagcttcgtggtgcagcaataaagggtcatctttcaatggttcctatcgatgctaaacctcaacccatcatccttgcctacattgaacttaatcttgagactttggctgctgcaagaatgttgactgcatctggtcctgggggacaaaaccattggggtgattcagcaaccaataattcagcctcgggcacccattcagctgatgcccagttaaagcaagagctggctgctatatttaagaagattggggagaagcaaacttgcacaattggtctatatgaactatatcgtattacccaattgtacccaaaggttgacatatttgctcagcttcaaaatgctagtgaggcatttcgcacctacattagagatggtcttgctcagatggagaagaatgctgcagctggaagaactccttcaagtttaccgatgcctacccctccaccggcatctttaaatatatcttctccggattttgcacctctctcacctgtaaacacaaatccactgggtgatgctaaattaaatgtgaaacctgatccgacaaattttaatttacccccatcatcatacaatgaggagaatagggccgtgaatgccattacttctagagcattaaattctgactatacattaggtgaccaaagaaatgatagatttatgacaggagtaaccagtggaacattggatgcaatcagagagaggatgaagagcatgcaattagcagctgctgctgggagtacagaatctggtggtaggcacttaacaagtgcaaatgacaacttgaatcatggacttcctcctcctagccagattcctcatgcatcagagcatgttggtactgagaatacaatgcacggtggggtacttcctatggatgagaaagcattgtctgggcttcaagcacggatggaaagattgaaaagtggatctcttgaacctctgtaa

SEQ ID NO: 75909 - DNA, 201 bp, Glycine max
  Peptide Sequence Number=SeqID_167594
atgcacaccgtgagcagtagcaacggcagcggcggcggtgtgctggcatcgcgaacgagtttgcggtcggtgacagagacggtgaacgggtcgcataagttcgtgataaagggatactcgctggcgaaggagatcggagtcgaaaaacacatcgcgagcgagatgttcacgtgtaagttgcttccgttaaggacggtttag

SEQ ID NO: 75910 - DNA, 468 bp, Glycine max
  Peptide Sequence Number=SeqID_167595
atgaatattcagtatgaagacaaagaacggttagcatcagtttataccatgtattctcattctcctatggcagaacaagcaataaggctggtgagggtggtcggggaggaggttgtaaaggataatgccaaaggatcagacatcgaccttcgagttgtcgtagtcgacaccgcagaggatctccggcacggcaatgtggaggagcttgtcgtggaagtgctcagtgaaggcagagaggccgaagtcgaagaccttgaggtgcaaaaagctgctgacgactcacttagcgaggcagattggctaagcgagactcatccgcttagcaaggcatccaactcgcttagtggatggaaaatcctagaagaggataacgagctttcgagagctaaaaagtccaagagtcttcaaaacactgaagttggaggaaatgagaaagggaactggtcaagagccacaaggagagtctag

SEQ ID NO: 75911 - DNA, 273 bp, Glycine max
  Peptide Sequence Number=SeqID_167596
atggcctcctatgatggtgatcttcttctaaactcatcttctcctggaagtggcgtctcctctctctcttccttctccattcttcttccattcatcttccaagaagcaaaggaattgattgatgaagaagatcctaggcctgcaagctccaatggagcttacatcaggaagggaccagtcactagagccatgagcaagaggctccaagaggattgggctagagctgctgagcaaggccctagggttctcatgaacctcaatgtagatttctga

SEQ ID NO: 75912 - DNA, 465 bp, Glycine max
  Peptide Sequence Number=SeqID_167597
ggccctgggatttccctcgctgatcataggactctgccagtcattcggagtccccgttgcacctaccaagggtaattcggccgcccatcaccagagacaggctcagggtgatgctccacaggccgcaagcgcgccaccaccacctcatcaggctggccaggctggggcatttgacatggagcagtatttacggcatttggttcgccaacacgtggccaaccaccgagcacatgtacagacccatgattgtctgtaccagatgagcctcagcatgcagagccagggcttcgcttctttttcatgccctactccagaccagttcagggcagaggttgcatggcccggagattggcccgaggcccaagcgggagaggcgcccccagaagctcccggcgatggagaagaggcccacgaggacgaggagatggccgatttgcttgacttcttgggagggactggagatac

SEQ ID NO: 75913 - DNA, 348 bp, Glycine max
  Peptide Sequence Number=SeqID_167598
atggaagcgcagttaatccatgatcgcgtggtgatggagtgcctagagggagtttgggagaccctcgaaggcaatgagagatgccgattccgtggcacgattcgactcactgctacttcattgccagtccaagtgatagaggtgtcatcctctgaagaagatccagaggaggacccagaggagttacctcctgagcctgctgtggatgctcttgacttacctgaggatgatgaagacccactccttgatgttgattttccagaggatatcatgtcagcatctgaggcagactctatagaggatagcggccttggagggacagcgaatagtgaagactcttcatcatag

SEQ ID NO: 75914 - DNA, 306 bp, Glycine max
  Peptide Sequence Number=SeqID_167599
atggtagccataaccccaaccaaggttcatcaacctccatttcttcgagaatacgactcgaacgcaacgtgtgcttgtcatggagaatccccggggcattccattgagcattataggggcctgaagcgtaaggtgcaaggtctaattgatgcgggctggcagaaatttgaggagaatcgcgtgattttcaagtgcaagccattggtctatttgctcaagcgacctgtgaccattcaatcagagattactcgtcttacacgttggtggggctgccataaaacaacaagtaaagttcaaaacaaataa

SEQ ID NO: 75915 - DNA, 278 bp, Glycine max
  Peptide Sequence Number=SeqID_167600
atgatgacaaaggtgatgacaaaaagctcaaagatcaatcaaagaacaatgcaagtgaatcaaagatcaatcaaagaacaactcaagtaaatcaagaagaattcaagactcaagaagaaagtttagagtcaagaatcaagattcaaggttcaagatctcaagaatcaagattcaaggttcaagatctcaagaatcaagatcaagattcaagactcaagattcaaaaatcaagagaaggctcaatcaagataagtatgaaaagtttttctaaaaattga

SEQ ID NO: 75916 - DNA, 270 bp, Glycine max
  Peptide Sequence Number=SeqID_167601
atgaaccccaaggaacgttggtcccttgtgtctagtgataacaagcaagaagttatacccacttcttgcaatgaacccaaagatgttggtcttttgtgtctagtgatcaaccaagaagcaaatgttgcttcttgcaatgaacccaaggaacgttggtcccttgtgttcagtgtttgcaaccaagaagaccttttcttgaaaacagtcaccaagagtaggtctcttgaaaagctttttgtaagaatggaggaaaggaagaaaatagaatag

SEQ ID NO: 75917 - DNA, 426 bp, Glycine max
  Peptide Sequence Number=SeqID_167602
atgcatttacggacacgagagcccagaaaatcatctctccttactgcgcatttgggggcgcagtgccccatgtgtgcagttaagaagacgatatggatctttcgacttcccacgacaaaagacgagacccacatacaacgcatgtgtgacggcatgatgcagatgcgcaaaagcgcaataggggaatgcacagaaggtatggaataccagcgacaacatattataaagagagaaagctctagacgaggtttcactattatcaagcaagtcgacaaaagcggggctcttgcgcctacgtaccctccatcaaagaggaaatcagacctacgtagttcttcctttaagggtgaatcaagcgattctttttacttgaaaggtgatcattttaaggcgttggaccttaagaacgatccatttacttggtaa

SEQ ID NO: 75918 - DNA, 258 bp, Glycine max
  Peptide Sequence Number=SeqID_167603
atgaaagataagagggctgaggaagaaaaactagaaaaacaaaagaaaaagaaggatagtaaggccttgtcttcaaaggccaagggggaggaaaaagaggaaaaggattcctccaagaagattgttaagaaggaaaatcattttgcaacaaaagagataccccctgggctacctcctttaaggggaatagaacaccaaatagatttagtcccaagtgttagatcaagtggcctcagaataattaggaaggggggttga

SEQ ID NO: 75919 - DNA, 387 bp, Glycine max
  Peptide Sequence Number=SeqID_167604
atgtccaaatcttgtggatttgggatgaccggccctctcgatgagtcgatctcatgctttctcataagggtggacccttgggtacttgtacctatcacttttagaggactacacctcctcgccaacagagggctgcacgccctcaccttcagaggactacatgtcctcgccttgagagggctacacgccctcaccttgggactacacgtcctcaccatcagagggctgcacgccctcacctccagaggactacatgtcctcgccttgagagggctacacgccctcaccttgggtactagttaccctcaccgtcagaggactacacgtcctcgccttgagaggactacacgtcctcaccatcagagggctgcacgcccttacctctag

SEQ ID NO: 75920 - DNA, 213 bp, Glycine max
  Peptide Sequence Number=SeqID_167605
atgacaatcaacaagtctcagggacaatcactctctatggttggactttatttaccaaaacccatctttagccacgaacaattatacgttgcattatcaagggtcaactcaaggaaaggattaaaaattcttattcatgataaagaccagaaaaacatgacttctactaccaatgtagtttttaaagaggtcttcaaaaatcttacaagctaa

SEQ ID NO: 75921 - DNA, 369 bp, Glycine max
  Peptide Sequence Number=SeqID_167606
tctcacaagttatccagaactacgtaggtctgagttcctcattgaggatacgtaggagcaagaaccttgcttttgtcggccgccccacaatctctgtcatactgacactgaggtcatgtgagcccgatgacatgcgtgagacaaattatggtcatttccgcacactttttctccattcagagcacgaatcgtgtccgagtggccgcagagacaaattatggtcattttgtgcccttttgtcattcagggacaagacaaattatggtcattctgcgcctttccatccaagttcgatcgtgtccgatggcacacagagacaaattatggtcattctgcgcctttgtgtcatccagaggaacgaattcgaca

SEQ ID NO: 75922 - DNA, 693 bp, Glycine max
  Peptide Sequence Number=SeqID_167607
atgaccaccctgactcagatatggatgactttgctgctcagtaacatcctgcccagcgaccataattccgacctccccctgccgaagtgtcagctggtgtacgccatcctgacgcggatgagcatttatgtggctcagctaatcgctgatgccatctatatatttgcaggtataacgcctaccaggcaccctctggacccggataagtccaacagggccctgggatttcctgccttgatcacaggactctgccaatcgtttgacgtccccgtcgcacctagcaaggtgattcggccgcccatcacccgagcttttattgagaagtactgcacgcagagacaggtccagggtgatgcaccacaggccgcggacgcgccgccaccacatcaggctggtccagctggatcatttgacacggagcagtatttgcggcatttggttcgccagcaggcggccaaccaccgggcacatgtacaaactcatgattgtctttaccagatgagcctcagcctgcagagccagggttttacttcttttccgtgccctactccggaccagttcaggcccgaggcccgggcaggagaggcatcagcggaggcaccagcagaggctcccgacgaggcagatgaggcccgcgaggacgaggagatgaccgatttactagattccttaggagggagcggagctacatga

SEQ ID NO: 75923 - DNA, 198 bp, Glycine max
  Peptide Sequence Number=SeqID_167608
atgcatctacgtgatcaaggatctcataatcactcacaaactcatctcaagctctcaaactggctcctgcttcaagctctggtctctgcagaacttcacacagcaaaatctctcaaaactctctggaattggacctttctctctctagaaaccctagacatgcaaagctctgaatcccagtctaaactccctctctaa

SEQ ID NO: 75924 - DNA, 327 bp, Glycine max
  Peptide Sequence Number=SeqID_167609
atgcggagataccttatggttatccacaccttttgtcaaccagaggcaagcgagcccgttgacacgcagagactaacgtcgtcttctgcacctttgtcatccagagacgtcaagtccgatgacatgcggagatacccaagtggttatctgtacaaacgatttctgttaatcctggcccgtgaagtcaggtggcgggcggagatacccgagaggttatctgtacaaagacgaattctgttaatcttgatccgtgaagtcaggtggcaggtggagataccttatggttatccacaaattttgtcaatcaaaggcaagcgagcccgttga

SEQ ID NO: 75925 - DNA, 165 bp, Glycine max
  Peptide Sequence Number=SeqID_167610
atggataagagcttgaaggtagaagaagatgaacggagggagcggaagagaaggagcacgaaatttagtgtctcaaaagaggtacggttcagcccactaatccaagatcaagtccaagattctccactaagtgtgcttaggtgtcatggagcatctaaagcatga

SEQ ID NO: 75926 - DNA, 399 bp, Glycine max
  Peptide Sequence Number=SeqID_167611
atggagacgaactcttttataaatgtgaaacctacaacgacaattggtaaaaatctagcggatacaacgccatttgatctagaaattaccaagactgaaaggaagaatagaaagaaaaagaaagaagaaaccactataacaccagaaaataacatggttgaaagaggaggagaaggaaatagaccaccgaggaggactcttggtgactatgcttatcaccaaggccccaaacattacaatagcatagtcattcctccttttagcaataaggtcgtggagttaaagccaacactgcttagtctaattggctcacatctctttgctggaatggatcatgaggatccatacaccacatttgtctaccttcatggaactatgaagtactatgggagcttctga

SEQ ID NO: 75927 - DNA, 270 bp, Glycine max
  Peptide Sequence Number=SeqID_167612
atgcctcctatagttgtcatgactcttgcaaaagtttatgtgaagaacttagcgactattatagagggcaccatagttcacatactaaacatcattcctaaagaagagaaaagcatagaaggctttaagaggttgaacaactctttgcttgccatcatattagcaaagagagaaaatttccattggctacccttagctttcaagggtatgccctatattggtggacttcccttgctagggaatgaaggattcatgggaatcctccagtag

SEQ ID NO: 75928 - DNA, 702 bp, Glycine max
  Peptide Sequence Number=SeqID_167613
atgacttcgtaccccattgcccagaggctcttcgctatgcgaaggggcactagtgtaaccacttttaaagaaacaagtgaagttgagtcgaaagatctagaagatggaacacacaaagccaaagcaggaactgcagcttttcttatagagcttgagaaaaaaagatccattaaggtgttagggaagagcactttcattggattggctataactttctttgctggagtttgcttctctctattctctccagcattcaatttggcaacaaatgaccaatggcacactttgaagaaaggggttcaccacttgagtgtttacactgccttcttttacttttcagtctcatgctttgttattgccatcattcttaacatcaccttcctctaccaccctgtcttaaacttacccaagtcatcactgaaggcttatttgagtgactgggatggaagaggttgggctttcttggctggtctactttgtggctttgggaatggcctccaatttatgggaggtcaagctgcaggatatgcagcagcagatgctgttcaagcacttccactagtgagtaccttttggggcattgttttgtttggagagtaccgcaaatcatcaagaagaacatatgtgctacttgggagcatgttgcttatgtttgttgcggctgttgctgtattaatggcatcatcagggcatcgaaaatga

SEQ ID NO: 75929 - DNA, 297 bp, Glycine max
  Peptide Sequence Number=SeqID_167614
atgtcccaggctagtaataaggctttcaaaggctttggtaggaagctggtcacccataaactgaattttgggttctgtaaggtgaagcacaatggtatttttacagaattcaactgcaaggtgaagcacagtggaagaggaaatctactgcctcccagccctatgacaccaccaggtttacatctgagggagcctgggaatgatattcactcccggaacattcttctggagaggaatgtgattctttacatcactgagttcgatgagttccaccaggagctcgagaggtggaactag

SEQ ID NO: 75930 - DNA, 351 bp, Glycine max
  Peptide Sequence Number=SeqID_167615
atggaggtctcgggagggggagggaggaagaagaggaaggggagggggaaggacatgttgggaagaaggaaggagaaaaaagaagaaaggaagaagaataggcacgagaaagggaagagaaaaagaagaagaagaagaagaagagacaggagaaagggaggaggagaaagtcgaggtgttgggaagtggaacgttgggaaggagaagaggcatgagagagaggaagtggaacattggaaagaagtggttggtaacaatgtaatgcttaatgcatatgccatttgcaagaaagactcggtgttccaaattgagcaaaaatcaaatgccaaggccgatggcagtggtgagtag

SEQ ID NO: 75931 - DNA, 963 bp, Glycine max
  Peptide Sequence Number=SeqID_167616
atgacccttatgcccttactcaggtcgtgccctccttacttcactcgggtcgtgcactccctccctcacttaggccgtgccctcacttcgtccttcactcaccgactgacaaagtgtctcctatgtgtcacgtcctcgtcgtgtgccaccatcatcaaagaggtaagaaccctactgtattttgttgctgttagtttcaacatcaggagtcttctatttcagcagtccaaagccagggtcaataatccaaaaacgcttcttcttcgaatagtagttgaaattggatgtattgagagggctctatggtacaaagggatcgagctgccaatagggtgcactacaactacctgtggcattcgcgactcttccaatgacgagaactcattccctaccagcggagatccttataatcaggtttcttttaagggagatgctgggaagtcttttgaaaggcgtggttatggtggaccacgaggtccttaccgtggtggtggtggtcatcgtggaggtttcagcaatggtgaaattggtgaagctgaagaaggacaacctcagagagcatttgatcgttgtaatgggattggacgtggaaatgaattcaaacgtgaaggttcaggacgtggtaattggggaacccaaactgatgaacttgctcaggtaactgataaggttgcaaatgaaactgaaaagaatttgggtgatgagaagcctacaatcgaagaagatatagttgatggagggacaaattttgtgcgaacactggatcccaaagctgtcaatgatgaaaattgcactggaaatactagtgatggtggcaacaacacatgtaattctccgtcactttctctctcttggggtataaggaggtgcaagaacttggtgaagtgcaggctcggagaagaacaagatgaaagtgaggaggaagctaagagagccacggttttgtttccaaacaagaaatga

SEQ ID NO: 75932 - DNA, 198 bp, Glycine max
  Peptide Sequence Number=SeqID_167617
atggatactttggagttcagtgcacaaggaacggtattacctgaggaagttgaagatggtggaactttgcaattggctgaagagaagaaaaggagaaaaaggaggaaaaagagggacatgaacctttcacatgaggttgaagacagagaactcttcatttctgaaacagaggaaaacaggggagggagaaaaaagtga

SEQ ID NO: 75933 - DNA, 1137 bp, Glycine max
  Peptide Sequence Number=SeqID_167618
atggccaaaggtttaagcctagctaggatgcacacatggaataacttgagtttgggacagtcattttcgaacttagtcgctttcagcaaaggcaaagcagatggatacaaattgatggagttcatcaaacagaaaccaaccatagtggaagattcatctgaaggaaactacccttcgaggccagacgtatttatctttcgcaatttctcaatctttttccctgcaggaaaaactgttgcggctgttggtggtagtgaatctggaaagatcacagttgtttccctgatagaaagctacaatgctgatcattttgaaatgcccaagcagacactacaactaaaatggttaggctatcaaattggattggtgaatcaagaacctgcactctttgcaactactattcttgagaatatactctatggaaaacctgttgcaacaatggctgaagtggaagctgctacttctgctgcaaatgctcatagctttatcaccttgcttcctaatggctataacactcagtggattttgcacgacgaagacgaagtgccacctcttgctgttcagattcaagggaatgatgattccgtttatcagcgatcttcttctgttggggtcactctcatcaccggttatcttggtgcgggcaagtccactctagtgaatcatattttgaacacgcagtatgggaagaggattgctgtcattttgaatgagtttggtgaggaaaaaggcgtggaaagagcgatgatcaatgaagggggtaagggtgcactggttgaagaatgggttgagcttgccaatgggtgtatatgttgcactgtcaagcatagtttggttcaagcacttgagcagcttgttcagagaaaggaaaggcttgaccatatattgctggaaaccactggattggcaaatccggctcctttggcatctgttctatggttggatgaacagttggaatcagaagtgaggcttgattctattgtcacagtggtggatgctaaaaatttgcgcttccagcttgaagagcatcgtgggtcatcttcatttcctgaagcatattttcagataacatttgcggacattataattcttaacaaggttgatttggtatgtgcagagagctctggagaaacttga

SEQ ID NO: 75934 - DNA, 129 bp, Glycine max
  Peptide Sequence Number=SeqID_167619
atggatggaactcagagtgatgtgtgttcgggtttaatgcagttagggttttgttttgtttctttgagatttgggttagagaagatggagggtagaaatggttccgttgagccttccgtgttggattaa

SEQ ID NO: 75935 - DNA, 249 bp, Glycine max
  Peptide Sequence Number=SeqID_167620
atgaaggagcacgtcaagtttcagggtcacggcttggagtgtttcgccaagggaaatatggtgaatgcatcaaatcttgcagcatcattccctcacgatcatgagtgctcagatgaaattcttgaggctgttgcacgtaaggttcctcctatgagattaaagctaaataggtttgagaggatttctaggtctcctccaagtccagacgaaggactaagatcaatacctgctccaaagaatttttggtga

SEQ ID NO: 75936 - DNA, 276 bp, Glycine max
  Peptide Sequence Number=SeqID_167621
atgtctccttcacctctaggatctcacaatcactcacaaactcatctcaagcactcagaatggcttccgcttcgaacttgcatctctgcagatcttcacacagcaaaatctctcagaactgtctggaacttggacctttctctctctagaaccttcgtgcatgcagagcttctcaagaaatgtccaaactccctttgcaaatctgattttaggccactgaaggttgcgcttagtgaattctcgctaagccagcagcttggcttagcgaaagagtga

SEQ ID NO: 75937 - DNA, 324 bp, Glycine max
  Peptide Sequence Number=SeqID_167622
atgactaggggcaatccaggtgatttacaaccctttgatcctgaaatagatagaacctttcatatattatttaggcatagtgtgcatcctgatcattctgtgcattccgagcattctgtgcattttgagtattctgttgcaggtgaagatcctcataagcatcttaaggagttccatattgtctgttccaccatgaagccccctgatgttcaggaagatcatatctttctaaaggcttttcctcattctctggagggagtggcaaaagattggctgtactaccttgctcccaggtccattaccagctgggatgaccttaagagg

SEQ ID NO: 75938 - DNA, 357 bp, Glycine max
  Peptide Sequence Number=SeqID_167623
atggaaaccacatcgaaacgctttgagcagctcaatatttgtggtaaagtacattttaagtcaaagttgcgagaaattgcttatcttgatatgaactccatgtgtccttctccagaaaaggtgaagaccaagggtgctccaaaaaaaccactgaccaaacaagaaaagtcaacaaaacgcgatcggtcctattgggagtatgttgatgcgttacactctgtgcaaaataagatggtgatgcaatcctaccccgcaagggcattggatagaagactccaagtagattgggccagagatccaacggaaggtcctagggttctcatgagccttagggtagattttgagcccgtgggctaa

SEQ ID NO: 75939 - DNA, 350 bp, Glycine max
  Peptide Sequence Number=SeqID_167624
tggctatgcaatttagaatgcatcaagaagttttagattgtgtggctacattctttggaaccaaaggcattgatggtggaagcagtcaatattgtatcattatcatgattttgcaaagaatattactcggtgaaagagcagtctatgcaatgatgctggtgtttccacctgaattttctccattgaaaactattttatttggaaatccttcccaagacaccgttgaaccactgatggaggctttggaggaagattataaagatggaaatgagattaatgaatcaaggcagtttattggaggagtattggatcttgaaaagagaatcaatagactagatacattgacttag

SEQ ID NO: 75940 - DNA, 150 bp, Glycine max
  Peptide Sequence Number=SeqID_167625
atggggctaaaggcagaaaccaatcaaggtaaaacggtacttagggacggacgcaagaagaggctagggtcacgatcgatagatcgtcatctcatgccctgcactagactagcgggaagcgcaactggggcacagcctagtatcctttaa

SEQ ID NO: 75941 - DNA, 468 bp, Glycine max
  Peptide Sequence Number=SeqID_167626
atgtatgaataccttgaagagcaaagagtccctgatcttgagagtattttggcagacttcatgacataccaagccagctctaaaggatcttgttatggaatgcagcagcagggaactcaatttcaaaggaaccaatcttctacaggctatcactgggagtcatgttggctaccagattatgatgataaagcggaaggagttattaatctggatgatctactaatgcaatttaaagatgcagtagagtcaatgcaacatgcttttagaagaattgcaactcagattagtaagttggtggatgacatggctaacactgaggctagacaagaggaagagcgtgtagagattgaaacgtatcaagaaagcatttttcaagttacctccatccatcatcatatgaccactgaagaggaaacgtctaaagtctccagtactccagaatactcctgctcggccgctgctggctat

SEQ ID NO: 75942 - DNA, 324 bp, Glycine max
  Peptide Sequence Number=SeqID_167627
atggcgaagaacgttcatagattgatcatgaaaatgtcacggaagcattacggaagtgtcaaaccccttccccttagccccctacacccttttatagccaaaataagggaggagattgacgcccaactcgcccagacacttgttagcattgcgacacctcttgggcttgaggttattcctcaagtaaaggagttgttggatgagggtttggtttgtaagagcttaaatccttgtgctttgttggtgcccaaaatagcaccacacattaagctggtgaggaaccatgttccctcatccgaagatgcccaagaaagaggtttttag

SEQ ID NO: 75943 - DNA, 180 bp, Glycine max
  Peptide Sequence Number=SeqID_167628
atgatgttgatgctgagaatgacaatgagacgagacaatgttgatgttgatgataacattgaggaatacttgtacttggggcatgtccctcgatttggaactcccttgagactcaggctgatcaccgtagggggggagttgcctgtgcatgacaaggtgacctcgacacttactgcctaa

SEQ ID NO: 75944 - DNA, 117 bp, Glycine max
  Peptide Sequence Number=SeqID_167629
atgactatgaaaaagaggctaagttttgaagtgcaaaaagtagcagttggtctaagcgtgcatccaccgctaagcgcagcttcagtgtgcttagcgccaaggagaatctggcagagc

SEQ ID NO: 75945 - DNA, 231 bp, Glycine max
  Peptide Sequence Number=SeqID_167630
atggtttttcacttaaggcttgtaatgagcttcaaaacaaagaaaggggaacataggctcaaaggggctatcaaagaaaataattcaaggaagcatcaacaagaatcaagccaaggctattgtgcaagcaatcaatggggcaaaacacaccaaaagattatgatgatggatggctcaaattctcacaaaggtaatcactttcaaattgaggaacaattacccatttcttga

SEQ ID NO: 75946 - DNA, 135 bp, Glycine max
  Peptide Sequence Number=SeqID_167631
atggcagaggaatggagaaggaggaaaggtgattggagatgccacttcaacgagaagatgagtcaagaacttaaagttatggttcagcccactaatccaagatcaagtccaagattctccactaagtgtgcttag

SEQ ID NO: 75947 - DNA, 1035 bp, Glycine max
  Peptide Sequence Number=SeqID_167632
atgtattacccctcgcaggtgaaaaacgccagttacaactacggctatttccagccgtattacatgccggcgggcgaacaggaaacccgcagcgtttatctgcaggatgcggtcagcttcggcagcctgaccgtgacgccgggcgtgcgttacgatcatgtgaccaataccgggcaaccgaaccgggcgccgcgctataacgacagcgatccgctcgtgggccatgattacagcagcgtgacctataccggctggtcgccgcatttgggcgtgatgtggaaagcgacgtcgaatctgtccctgtttgccgacgttagccgcacctggcgcgccccggtgatcgacgaacagtacgaagtgcaatacgccgcttccagcgtgcccggcaccagccgcggcctgcaggtggaacgcatgacgggcgtgcgccttggcgcggtgctggacttcaacgatgtgtcgatggcgcgagacagcctgcagatccgcactacgctgttccgcaatcgcggcaaggacgagattttctatcgtcgcggcgtagtgtgcgacgccgcacggcatgggggccaatgtgggcaaccgttgtcgaactatcgcaacttgccgggctataccattgagggcgtggagctcgaatcgttttatgacagcgaaagcctgttcggcagcctgtcgttctcctcgattcgcggcaaacgcgacgcttcaccgcgcgatccgtggggcaacgaaacctggattgccgaaattccacccgttacggcacacgcgatgctgggcatgaaagtgccgcagtgggacatggccttcggctggaccggcgattttgtgcgtaaacaggatcgttcaccggccgacggcgatccgatggcgttgtctgggcgctgccgaaaacgtcgggttatgcattgcacggcctgttcgcctcgtggcagccagcggtttgcagggcttcgaaagctcgcgtcgcggtggacaacctgttcaaccgcgattattacccttacctgggcgaatcggtgtccggcgtag

SEQ ID NO: 75948 - DNA, 802 bp, Glycine max
  Peptide Sequence Number=SeqID_167633
aggactgcacgtcctagcctttagagggctacgcgccctcgccttaagagggttgcacatcctcgccttcagagggctgcacgccctcacattcaaaggacttcacatcctcgccttcagagcactacatgtcctcgactttagagggctacacgtttttgccttcagagggctgcacgccctttccttcagaggattgcacatcctcaccttcaaaggactacatctacttgactttagagggctacacgtcctcgccttaagagggttgcacatcctcgccttcagaggactacaggtcctctcctttaaagggctgcacgccctcgcctttagaggactggatgtcctcgccttcagaggagtacatgtcctcgactttagagggctacacgtcctcgccttaagcgggctgcacgttctccccttaaaagggctgcacgtcctcgccttaagagggttgcacgtcctcgccttcagaggactacacatccttgacttcaaagggctgcatgcccttgccttcagaggactgcacgtcctcgccttcagaggactgcacgtcctccccttcaaaggactgcacatccttccctttagaggactgcacgtcctcgcctttagagggctacgcgccctcgccttaagagggcagcacatcctcaccttcagagggctacacgctctcactttcaaaggactgtgtcgcaacctaccctttggcgggagggcgacgcgtgactcgcgggatgcgtgttccacgaaaggaatacgcgcggagtcgccaccaacgtttatttga

SEQ ID NO: 75949 - DNA, 164 bp, Glycine max
  Peptide Sequence Number=SeqID_167634
atgggggtgcaaatagcacccaggcccacttgggccctccggaatattcctccagaaggcgccgaggcgcttccgaaacgtttccgtaacgttttccgtgaggaatttcgcaaagatttcaaccgttcttcattcgttcttcatcgttcttcgatcttcaacgg

SEQ ID NO: 75950 - DNA, 271 bp, Glycine max
  Peptide Sequence Number=SeqID_167635
gcgagtttttgcttcatggatgttgatttgttcgggcatcggtttcaccatgtctgcttgcctaatgttatttggtgtatttgttggttatgatttacgcacggttgaaccaatggccagattggatcaacaaaattggaagataggcaacatgtggccatggatgggaggatcaaggaaagttgctatcgggctagctaaactgttttgtgttgctttattggttgctttgttctttgaatatgcttcctctgtttacgttatttcctga

SEQ ID NO: 75951 - DNA, 1564 bp, Glycine max
  Peptide Sequence Number=SeqID_167636
atggggatactcagtcaatacgataacccagtgaatccatctgtaggtttaatcattgatggcattgacttcagtcgcctgggcggtgccgcgaccatgtttgatattgatgccgtagaggtgttacaaggacctcaaggcactaaatttggcccgaatgccatcgctggcgcgattaccatgcgtagtgcagagcctaccaaagcgtttaaaatgcgagcgcaagccggtgcgggtgaatataacacgcgtaattttggcgtggcagtaggcggcactatcgttgaggatcagttactcggacgcgcttctatttatacgcacaaatctgatggctacatgcaaaatgacaccttaggtcgtgatgatacgcaaaagcaggatgagctgaccttccgcagtaaattcaagttatttgcgactgagaacttaaccctggatttcaccttgatgcatgtgaatgtgaataacggttatgacgcatttaccttggataattccaggcacagtacttcaaaccaacctggtgtagatacgcaaaacactaacgcttttgctgtgaaagccaattggcaagcctccgatgcaatcatgattcaatctgaagccagttatttaaactcttcatctacctacagttttgatggtgattggagaacgttagatgacaatgaaaaacataatcgtgaccgcgataattactcctttgaagtgcgcgtgctatccgacaaggctggccgaatttttaacagctcaactgactggaccgtcggtttctatcgatttgtgcaggatgagcagtttaattctcgtgttgattacaggagttatgggccgacttacctgacacagttagcaggcaaatacaaaactgaaaatacagctttgtttgggcaactggatagtcatttgacagataagttaaccttggtgtcaggtctgcgactagaggattttcaggcccgctactctgatagtggcttcgtcgagtccgcacctagcagcatgaaaaagaatgtgagtgagatattgttcggggctaaattaggcttaaattaccaagccaatgagcaccaattattgtatacctccttaacccgcggttataaacctggcggcatcaataacaatgccagcctgtctcaaaaccaaaggcagtttaatacggagtatatgtggaactttgaaaccgggcttaaatccagctggctggatggtactttgattacaaatctggcagccttttacgccaagcggctgaatgctcaaacgcaaagttcggctcaagtgcctagtacgggaatttttaccgagttttatgataatgctgcgcgagccactcaccaaggggtagaggctagcatagattggtttatcactgagcaatttcgcatgatgggctcattaggggtgcttgatgcaaagtttgatagctatcagaatccagatccgaccgcgtataacccgcaaggccgtcaagtcgctcatgcacccaaatatacttttaacctgggttctgaatattttgccaatgaccattggacgctgcgtgcgaatgtggaag

SEQ ID NO: 75952 - DNA, 114 bp, Glycine max
  Peptide Sequence Number=SeqID_167637
gaagtaaccaatgtgccatcttccatcagacgacacgtgaagttgaaaatgacttacaccaagaaaactggccaaatgacgtttgaggtggcaaaggaaattgctaacaagatt

SEQ ID NO: 75953 - DNA, 450 bp, Glycine max
  Peptide Sequence Number=SeqID_167638
atggcggatttaggtggcggatttgcgaaaaaacgccaccgaatagcggtggcgtggcgggtttgggatggcggcgccatggcggccgccatagccatggcggtcgtggcggttatggcggggtggcggaaaaatggcgggatttgcttagtttttgtccgcggtaggagttgggccgacccgacccaaccctacccggttatatttccattaaatgttgtcccacgccgcacccaacccttccctcacctctgcgtccttccctcacctctgcgtccttccctcaccccgccgcacccagccgccgccgcgacaggcgacacccgcacagtccgcgcacccaaccgccgccgcccgcgacacccttacacgaagacgaaggccatcttcgcgcgagccccggcaacgcagcctcccgcgaccgcgacgcctcttctttctgtctcgtga

SEQ ID NO: 75954 - DNA, 504 bp, Glycine max
  Peptide Sequence Number=SeqID_167639
atgaaaagaacaacttacctcatcatgatggtcatcaccggcatcagcaaacctccaacaaagcccaaattgcttctctactttcgtggcggccatgagattcttccactgcgggaagccgacatcagcgatcatggctgtaagggagcactttggaaagaggatttagtgaaagaggaggtgagatttggtgttgatttgaagggcacggaaggcagtaatcgattaccagtagccaacattcttttcaaactgatttacaaagctgtaattgattaccataatcatagaattcaagggactaaccgcctaagaattctttgtcttaacacattggagtgtacatcctttgtggtacaagtagagcgtacatctacttgggttgtattactgagaacaagagatggtacatctcttgtggatcagttcaagtggagtgtgcatccacttggttgttcaaagagaacaacagagggtacatcctttgtggatctttgcttgtaa

SEQ ID NO: 75955 - DNA, 1074 bp, Glycine max
  Peptide Sequence Number=SeqID_167640
atgatgctgactgtctgtaaaggaccaacctcatttgaggatatcaaaacagttgctggtgttcaatatcctacatataaagaagcatgtttcgctatggctaccatgaacaaacctgaagaagtgtgggcacaaacttggcattggttaagtgatgacattgtgtataatcgtcgaaaatcaacaaccactccagaattacatgttgatgatgacaacctgatgaatctggtattacttgaagttgaacaattgttacaagctaatcaaagatcacttagagactatccttcaatgttgtatcctgagaatggaaatttcgcaactcatttagacaatgtcctcatattgtctacgctaaatttcaacaacgaagatcttatatcagaattcctttaccttttttctcaaatgacagcacttgatcaaagtctgagagatattattaaggcgaaatcaagttctgataaaaattttagtggtaaagttatggtatttggtggagatttccgacagattctgtcagtcattcctaggggcaaattctgccaatcattcctagggacaaccgctctgatattcaacatagatgcaacagatagaaaagaaactgcagcttttgcacagtggatccttgatattggtgatgggattgttgggcagcaaaatgatggttatgctacagttcaaattccacaagatctgttaatcacagaatatgatgatccactctatggcatagttaattttacatttccagatttgtgtcaccattacaccaaccctgaatacttccaatctaaagtgatattagcttcaacaaatgaaactgtgcaacaagctaatgattatatactatcattgatcccagccatgcatggcgccaatgctgatggcatcttcgacagggacgagccacgtggcatgtcgccactacaactggcgacaaaggactgcatgtcgccactccaaaggtgcatggaagcgctgctggaaggcgccactcgaggtggcgatttgcttgagagggaggcgccagtggggttagcacgttcagcttcaggtgggatttaa

SEQ ID NO: 75956 - DNA, 450 bp, Glycine max
  Peptide Sequence Number=SeqID_167641
atgaggtgtcgtgagaggggaagtgagagaagaatttgcatgggaattttcatgcaaagcgccaacatgaatagcgcctcactcacgcacgcgacacgtggctgtgtcgcctctgccactggcgacaccagtggtatcgccacctgcaatgacgctttggtcatgcagagtggagtcgctgctgaacgtgctaaccccactggcgcctccctctcaagcaaatcgccacctcgagtggcgccttccagctacggacggagcagctgcaggtgctgcagcctacgcttgcagctctgcaaaactgaagtcgctggtcaaaccagcgcttccatgcacctttggagtggcgacatgcagtcctttgtcgccagttgtagtggcgacatgccacgtggctcgtccctgtcgaagatgccatcagcattggcgccatgcatggctggtacataa

SEQ ID NO: 75957 - DNA, 213 bp, Glycine max
  Peptide Sequence Number=SeqID_167642
atgtcaagaaacaaagagaggcactgctttgacaagacttcgcataattggatctactacgatgaagaccaccttccacaatggagtttcaaaggaggaaagggaactactgattctgtgagagctggtgccatagttcatctagatctggtgtgttgggggcataaagatgcggtggtcgttgtgttagtggaagggctactagagacataa

SEQ ID NO: 75958 - DNA, 178 bp, Glycine max
  Peptide Sequence Number=SeqID_167643
gattctattgaaaaacattattgatgtcaaagcagatggtaaccgtggctatcgggaaataattgtcttattgggtatgggtgaagaatcacggttgttgatgcgcaaccatttgcataaagaactgacaagctggtcggaagagtatatcaacctgcttggtggcatagagatttga

SEQ ID NO: 75959 - DNA, 162 bp, Glycine max
  Peptide Sequence Number=SeqID_167644
atgactagagggtgtcacagtctgcgtctgaataccccacaacatctatttatggttctgcccggtggtgtggatagtgctgctagccctcgctttgtggcgccgagacctgactcgagggggcgtgttgcgagtcccacatcgggtggttcacgaggatga

SEQ ID NO: 75960 - DNA, 324 bp, Glycine max
  Peptide Sequence Number=SeqID_167645
atgcgcttccgtgactgcaaccacattgtggagttcgtgtttgtggagttcgtctctgccacttatcgattgaggctgtgcttccgtgactgcaaccacattgtggagttggtctttgtggagttcatgtctgccacttatcgattgaggtcgaagaaaactacgaaaggaaagggtgggaagcgattttggaagtccattgtggttggctttaagactcccagggaagccatcgaagagtttgtagaaaagatcccacttggttcagctccccacacccaagaatccatcaaggctgcattagtgcttactgctgcagtctag

SEQ ID NO: 75961 - DNA, 267 bp, Glycine max
  Peptide Sequence Number=SeqID_167646
atggcaagaaatgtggtgcctaagaaggatgtggttgaaaccattcaaaggtttaatatacaagtcaataatttgactcaagttttgttaaggtctcagcatcagggacataggattgatatttggtcagctggagtcactctactctacatgttttcaaatcatggctctcttgagcatcatggatttgcaaggaacaagttttggaacttagatcccaatcccccagcatttccaacaaatagcacaaacaaagttttcaaataa

SEQ ID NO: 75962 - DNA, 558 bp, Glycine max
  Peptide Sequence Number=SeqID_167647
atgctcgctcactcacaccttgcgatgttctatctgttctactcacttagccactggcagctccctcttcctcaccttaccaccacaatcttcgccttctcccccctcccacacttcctcgccccttcccccgttgccaggctcctcctactcgcctccgccctcgaggtctacctcatggccatcatgagtgtcgccattgtcgtctctgtcgtcgaagagaggatttctgcaagtagaaggagtgaagctgctaaatttgctcaattatggaatgaagttatttgcagtttccgtgaggaagatatcataagtgataggaaaggcttcgaagccaaactctttagttgttttttctcggagatggatcttttgatggttccatactcattagatcctagcttgaaaataattcagtggccatcgtttctgcttgcaagcaaggtacacatagaggtcacaataggtactaaggtatttcttaaagcatccacaaactttttccatattaaggcttacaacacaaagaatgaattatactcaagcatggaagcgtaa

SEQ ID NO: 75963 - DNA, 252 bp, Glycine max
  Peptide Sequence Number=SeqID_167648
atggaaaaaagttcatctcttagaagcaaaacaaacggagggaggctttcatgttgggggcgtctcaagttgaagcttccatgggcgaagagaacaagttcttataaacccattggtggttttaactatgaccctttaagctatgctcaaaactttgacgagggatgggtagaggatgatgaagaatctttacatcgtgggttctctgctagatatgcagcaccttcctcacataaattgttcaagcaatga

SEQ ID NO: 75964 - DNA, 492 bp, Glycine max
  Peptide Sequence Number=SeqID_167649
atgcaaggcacattgtttagaagtaacaagttcatggggcatgcaagcgtgcctcttgtgtcacagccagctgagaaagaaagccttcttgtagaatttgacgatgatgatgacgacgatgacacagaaaccgaggaccaagacgttgaaggagaaagaatcgttgctcggaacaatgacaatggaaagggtccacctgttattggtggagaaaatgtggataagaaggctgatgagttcattgctaagtttagagagcaaataaggcttccgagaattgagtcaatcaagacgagtacaaggagtgcaagaaactcttcaagcacaacctacatttcaaagatagctttagggaacaacaataccctgtggttgtgtatgcacacaaagcgatgcattgtgtgtttgcataggatactgtcttccattgtgttacttattctaatgactgtgccgcgaagcaaaatagggaatgaaaagaaagaatcgtga

SEQ ID NO: 75965 - DNA, 369 bp, Glycine max
  Peptide Sequence Number=SeqID_167650
atgagggggctgaaggaaagaggtcccaaggattccttgaaggatcaggcctcacagggttcctttgtcgcccaaggacgtcaagatgtactgactgttgtcattggccgaccagaacaccgtggtcgtgtgcgtgctactagagccggtgtcacaatcaaacaatactttggaccgactccaaggacctcccacacgtcttcgtcaatggctctggaagacctggagcagctgacgcaaaaaatcaaggaccagctggaggagtcgatcacagaaaaaaatgactcgacaagtaatgttgtccttcagcgagatgcaatcccagtttcaatcgtagatgcaatcacaggtactcgtactacatcctga

SEQ ID NO: 75966 - DNA, 596 bp, Glycine max
  Peptide Sequence Number=SeqID_167651
ttgttgcaataccttctactattgaagttgggattgtggctcctatgactgtcttggttcagaagcttcaaaatgccttgtcctccttggagcgtttccgtgctgtgctgagtcattcatctaggtcatctagtgggagtgcacgcctctcctctggactaagtgttttatctcagcccttcaatgaatttggtcaaaagtccattgtacccactaggaattctaaatctgggacaactcatgcagaagctggtgtatcctttcctactacctgtcgccattctactagatctagatcatctgttaatataggtgatacatctagaaaggaaataactcaagataaaagtacaagctcttccaagggtaagggaaaagttgtattaaagcctgcacaagaggtggcaagaggacctcagaccagaaatgctactcccagaagagcagctttagataaagatgcacaaatgaagcctgtaaacgatgactttacttctaaggatgaagatttggatatatcccctgttgaaattgatgaggcattggtgattgaagatgacgatatttctgatgatgaagatgatgaccacgaacat

SEQ ID NO: 75967 - DNA, 384 bp, Glycine max
  Peptide Sequence Number=SeqID_167652
atgcagagttcaaaacatgatgtctaccttggagcctaccagaatggcggacactggcaaatagtcgtcattctgcctaaggaaaaccttgttgtctggttttgttccttgcataacaggccagacaactatcttaagggaataattaagagtgcttttaaaggacttgatgatactccacaacctaaatccaaggctggtgcttggtggattgttgttaagtgtaatagacaaaaaggaagcactgagtgcggctattacgccatgcactggatgtccacgataatcttaggaactttcaggaataattgggaaacgtattttaacgatgttagaccattggaagcaaagagattgaagtcacttcgcatccactggacatag

SEQ ID NO: 75968 - DNA, 474 bp, Glycine max
  Peptide Sequence Number=SeqID_167653
gtgctcggggacgggtacgaatggacactaggcccgtggtcaacaaatcactatcctgcgtccggctctggacgatcgagaagcgctactgggaggcagcctaagatggctccgaagaaactctccaataagaggtctagaaaggacgccattggagaaggctccaatgccgcctcagattttggtagccaccggttccggagtgccgagaaccagcagtgcttcgaggccatcaagggatggtcattccacaaggagaagcgtgtccagctcagggaagatgagtaccctgacttccagggagaggtagctcgcaggcattgggcacgactagtgacccctatggctaaattcgacacggagatagtcatagaattcaatgccaatgcctggcccactgaggaaggggtttgggacatgcgtccgtgggtgaggggtcactggatcccctttgatgcaaatgatatcagctag

SEQ ID NO: 75969 - DNA, 369 bp, Glycine max
  Peptide Sequence Number=SeqID_167654
atgcggggttaccttttggttacccacacctttcgtaacccaggggcaaacgagcctgttgacgtgcaaagactaacatcgtctcttgcaccttttgtcatcctgacccgtgaagtcaggattaccttatggttacccgtacctttcatcaaccagggggcaaacgagctcattaatgtgaagagactgacatcgtcatctgcaccttttgtcatccagggacagtttttactctcgtcgtccggaaacattcaagcccaacaacgcgcgagattcttcactgctgggcagagacgatcgggtgcaatggcgaaggaaagtgtcgtggttgtccaactttgtcgttttcaagacactaaagtttgttga

SEQ ID NO: 75970 - DNA, 273 bp, Glycine max
  Peptide Sequence Number=SeqID_167655
atggcttgctccggcattccggggaaagattcaacaagcgattctcctcaaatttcagccagcccgtatcaattagaccttgcaccttacgcttcagagccctacaatgctcaatggaacgccccggggcatctccgtgacaagcacacgttgcgttcgagtcgtattctcggagaaatggaggttgatgaaccttggctagggttatggctaccattgaattatcaagtggtcttcgtcattggaagtgtggtagacagactttgtggttga

SEQ ID NO: 75971 - DNA, 324 bp, Glycine max
  Peptide Sequence Number=SeqID_167656
atgtacacacgaagtttcacaaatccacaattccttaaactaggcctaactcgcaaaaaggtccccagtggagtcaccaactgtcgcaacgtgcccttcgcgggcgagcgagggcgaggctcatgggtgcgctttccaaaagaggaaagatgcacggagtcgccatcaacgtttatttgtggaaaacgtcggaaaaaccgaaggaaaccggtcaaaatgaaaattctaagttcgggagttgtatttacgtttgaggaaggtcgacaaaagcggggcttttgctcctacgtatcctcctttggagaggaaatcagacctacatag

SEQ ID NO: 75972 - DNA, 645 bp, Glycine max
  Peptide Sequence Number=SeqID_167657
atggtgaaagttggaacctcttacgtgccgatcaacgtctcattttcgccaaaagttggcccagagcttcccggtatcaacagggacaccaggatttatttattctgcgaagtgatcttccgtcacagctgtccctcctgttcagctactgacggggtggtgcgtaacggcaaaagcaccgccggacatcagggctggcaaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttggctggcgcaacactgccttgtcacgcacgatctcggcgtaggccacgatgttggcagccgacggcgtggtactggccagttcgatcaggtaggcgatcaagcttatcgataccgtcgacctcgagggggggcccggtaccagcttttgttccctttagtgagggttaatttcgagcttggcgtaatcatggtcatagctgtttcctgtgtgaaattgttatccgctcacaattccacacaacatacgagccggaagcataaagtgtaa

SEQ ID NO: 75973 - DNA, 240 bp, Glycine max
  Peptide Sequence Number=SeqID_167658
atgttcaaattagatgcagtgataacagaagtctgtcatacgcaaatgaagataacagtttcatcaggaaggaagatatggttctcccaagtttattatcaattggtaccagagttcaccatgtctctcaattgcaatcaagcagcacaggtggtgacaccaggcattgctgtgttcacttgggattatagtcaaatgactgcatgggctttggggctgcaaagtgtgatgggatgttag

SEQ ID NO: 75974 - DNA, 66 bp, Glycine max
  Peptide Sequence Number=SeqID_167659
atggttgtcactaccagcactgttgctaaggtgaacccgatgcctccatctgatctcaaccaatga

SEQ ID NO: 75975 - DNA, 246 bp, Glycine max
  Peptide Sequence Number=SeqID_167660
atgaggacgcgtagccctctaaaggcgaggatgtgcagtcctctgaaggcgagggcgtgtagccctctgaaagggaggacgtttagtcctctgaaggcgaggacgcgtagtcctctaaaagtgaggatgtgcagtcctctgaagattgactgtccttttgaaagaggcgataattcatgcaaccttatcctatctttgcaaatctctctgggaactccctcagagtgtttgttctgtttgatttag

SEQ ID NO: 75976 - DNA, 321 bp, Glycine max
  Peptide Sequence Number=SeqID_167661
atgatcaaggaatccaaggaattggcatcaatgtcaatggatgctctctttggaaaattgcttgcatatgaacatgagctgattcaacaatctcatgcaaaagaaacagaaaagaaaagggattacactcaagcttgggaagataatgcgtccacatcctccaactcttctagtgaagaaaaagttgcaaatgtatgcttaatggctaatacaaaggatgactcctcaatcattgaagaaactgaggtaaattctaaatttgaagaagttttggaaacctttaatgagatgtatgaggaagcacaagggcttgctgtttga

SEQ ID NO: 75977 - DNA, 207 bp, Glycine max
  Peptide Sequence Number=SeqID_167662
atgcatattgcagcttatggaatgaaggaatttcttgtacctcagaatttttcagccccaacaatccaaccaattggatctgtccccatgaacgctggcagctccaccttcttagaccaaatgtgcatttcctccatctctaacattggctctcccttgaagatccggcagattggaccaatcgttagaaaccaagaattgaaatga

SEQ ID NO: 75978 - DNA, 915 bp, Glycine max
  Peptide Sequence Number=SeqID_167663
atggccaaatttgatccagacatagtcctcgaattttatgccaatgcttggccaacagaggagggcgtgcgtgacatgaggtcctgggtgaggggtcagtggatcctgtttgatgcagatgttatcggccagcttctgggatatccgttggtgctggaagagggccaagagtgcgaatatggccagaggaggaaccggtctgatgggttcgatgaggaggccatcgcccagttgctatgtataccggggcaggattttgcccggactgcagcagggaggcgagtgcgaattatgcataccaacatgaccaccctgactcagatatggatgactttgctgctcagcaacatcctgcccaccgaccataattccgacctccccctgccgaagtgtcagctggtatggcgcctaccaggcatcctttggatccagataaagtccaacaaggccctgggatttcccgcgctgatcacaggactctgccaatcgtttggagtccccgttacacctaccaaggtgattcggccgcccatcacccgagcttttattgagaagtattgcacccagagacaggctcagggtgatgttccacaggctgcaggcgcgccaccacaacctcatcaggctggcccggctgggtcgtttgacatggagcagtatttacggcatttggttcgccagcaggcggccaatcaccgggcacatgtacaaacccatgattgtctttaccagctgagcctcagcatgcagagtcaaggcttctcttctttttcatgccctactctagaccagttcagggcagaggtcgcatggcccggggattggctcgaggcccaagcaggagaggcgcccccagaggctcccggcgatggagcccgaggcccacgaggacgaggagatggccgatttgcttga

SEQ ID NO: 75979 - DNA, 492 bp, Glycine max
  Peptide Sequence Number=SeqID_167664
atggagaggagtatgattgatgctgccaatggtagagctcttggtgatataactcctactgaggctaggaatttgattgagaagatggcttctaactcccaacaattcagtgcaagaaatgatgttattgtccttagaggagtccatgaggtggccacggattcatcttcatctactgaaaataaaaagcttgaaggaaaacttgatgccttggttaacctagtaactcagcttgccatgaatcaaaaatctgcatctgcacctgttgcaagagtctgtggttggagaaatcatccaaatctgagatgggcaagtcctccacaacaacaacagcctgtccctcctttccagaatgctgctggtccaagcaagccatatgttcctcctctaataccgcagcagcaacaacatcaatcacaacaaatacaacaagcaactaaggctcctcctcaaccttccttagaagagttagtgaggaaaatgaccatctag

SEQ ID NO: 75980 - DNA, 729 bp, Glycine max
  Peptide Sequence Number=SeqID_167665
atggctacctcaccaaaagaaacttcaactcctggttcaccctctgtaccatcatctccatcatccaccaaagcaccatcaaaccaggaacgacctgaattcaatatccagcccatacagatgattcctggtcaagcccctgttcctgataaattggttcccaaacgacaacagggagtgaagatttctgaaaaccctagccctgcaacaagtcctagggaagtagacacagagatggataagaagatccgcagtatcgtgagtaacattctgaaaaatgcttctgtccctgatgctgatgaagatgttccaacatcgtccaccccaaatgtttctgttcctgatgctgagaaagatgttccaacatcttccaacccaaatgctgaaagtcctctcttcctccagcaaagaggatcaacagaggaagatgatcaagccacagaggagacccctgcaccacgggcaccagaacctgctccaggtgacctcattgacctagaagaagtagaatctgataaggaacccattgccaacaagttggcacctggcattgcagagagattacaaagccgaaaaggtaaaacccccattaagaggtctggacgaatcaagactatggcacagaagaagagcactccaatcactcctaccacatccagaaggagcaaaggccttccaagaagaggaaagaaatttcctcatctgattctgatgatgatgtcgaactag

SEQ ID NO: 75981 - DNA, 351 bp, Glycine max
  Peptide Sequence Number=SeqID_167666
atggccccaaagaaactcccttctaagagagctaggaagaccgctacaggagaaggatctaaaattgctaggaggcactggacacaactggcacagcccatgactaaatatgatcctgaaattgtcatggagttttacgcaaatgcctggactactaaggaaagagttatccataagcgctccaaaagatgctatcaaccaaatcttaaggaatccattgatcttagaggagggacaacaatgcaaatacacaaagaaaaagtgatgcaatcctacctcccaagggcattggatagaagactccaagaagattgggacagagatgcaagagtaggctctagggtagattaa

SEQ ID NO: 75982 - DNA, 295 bp, Glycine max
  Peptide Sequence Number=SeqID_167667
atggataaatttgatatctttgtccctcatcctctcacaaacacatctttgcttattcaactttcaccgtgtcgtaacctaccctttggcgggagggcgatgcgagactcacgggagcgtcttccaagaaaggaatacgcgcggagtcgctaccaacgtttatttgaggaaaacgttggaaaaaccgaaaaagacgtggcgaggctcacgggtgcgctttccaaaggaggaaagatgcgcggagttgccaccaacgtttatttgtggaaaatgtcggaaaaaccgaaggaaaccg

SEQ ID NO: 75983 - DNA, 236 bp, Glycine max
  Peptide Sequence Number=SeqID_167668
aactacgtaggtctgattttctcatcacaattgaggaatacgtaggagcaaagggaaacgcccttgtcgactacaaaaagtggcgactccgcgcgtattcctttcttggaacacgcacccgcgagtcacgcgtcgccctcccgccgaagggtaggttgcgacagggtgctaattttgtgttggacaatgatgtaatcaaagaattggcagatgctcatggcaagactgcagcctag

SEQ ID NO: 75984 - DNA, 378 bp, Glycine max
  Peptide Sequence Number=SeqID_167669
atgtcaggatttacacgtgattctcctcaaatttcagccagcccgcatcaattagaccttgcaccttacgcttcagagccctacaatgctcaatggaacgccccggggcttctccgtgacaagcacacattgcgttcgaatcatattctcggagaaatggaggttgatgaaccttggctagggttatggctaccattgaattatcaagtagatatgggagcaagtcagcataggacactagaattggggtggtgttcgtcagactttgtggttgatttaggggtgacctttgtggataactgggcggtgggtaaggagaaggtttgttattggctgagtaatgacattgttgggttggtgggaaacttggctgtatag

SEQ ID NO: 75985 - DNA, 589 bp, Glycine max
  Peptide Sequence Number=SeqID_167670
caacatccagcccagtgatcataatttcgacctccccttgtcgaagtgtcagctggtgtatgctgtcctgacacggatgagcattcacgtggctcagttgatcgctaatgccatttatctatttgtaggtatggcatcgaccaggcaccctttggacccggataagtccaatagggccctgggatttcccgcattgatcacaggactttgtcagtcgttcggagtccccgtcgcgcctagcaaggtgatttggccacccatcacctgggcttttaatgagaagtattgcatgcagagatcggcccagggtgatgcaccacaggccgcagacgcgccaccacctcatcaggctggtctagctgggtcatttgattcggagcagtatttacggcatgtggttcgccagcaggcggccaaccaccgggcgcacgtcgcatggcccggagattggcctgaggcccaggcaggggaggcacccgcagaggctcccggcgaggcagatgaggcccgcgaggacgaggagatgatcaatttgcttgatttcttgggggggggagcggagccacatgatttggagatccctagatcc

SEQ ID NO: 75986 - DNA, 54 bp, Glycine max
  Peptide Sequence Number=SeqID_167671
atggccgaccagcaggctaacaaatccaaagccaaaggtagcaagataccttag

SEQ ID NO: 75987 - DNA, 234 bp, Glycine max
  Peptide Sequence Number=SeqID_167672
atggagctcagcctcagccctattatgccctctcccctcggcggggatttcctcttcagcgaaggtgaggtaattgttggctgtgatgttattgacgatcccctcaaagccttatacggagatgtcttgggctacgtgagcttcattcaagacttttaccaacaaagctcggtgaggctcagagctcatgagcaagtccagaagggagactctagtcggggtcttgttgagtag

SEQ ID NO: 75988 - DNA, 246 bp, Glycine max
  Peptide Sequence Number=SeqID_167673
atggaactccagatacacgcgtatatgcagcatgtgactggccagcaggcggctaatcataggggtcagagccaggacctcagtcctttcccgtggcctacccctgagcagttcggggccacagttgcatgccctggagatgatctcaattttcagacaggagcaggacccgtaggggcccacggagacgaggatggagctcaaaaggatgatgatatggctgatgtgctggactacttcctttga

SEQ ID NO: 75989 - DNA, 390 bp, Glycine max
  Peptide Sequence Number=SeqID_167674
atgcacagcctacgagagttggctcagaacaagccaattgtacctctggagtattttcttgagaaagtagtctggcctgaagctcaacttccattagtgagaaccaatgaggctactccgttggagcccacaccggcacaggttgaaccaatgccagccgagccacgaactccagtggtgaatccacctccttctcctgagcttgaagtagttcccccatctccacctctgattatcatctcttatgcatcatcaaatgaagctgttgccccttctaattcgccagctgaagaaacagttgacccccctgcttccccagttggaggaattgttgatctttctgattcgtcatctggagaagttgttgctctcactgattccccagtatag

SEQ ID NO: 75990 - DNA, 429 bp, Glycine max
  Peptide Sequence Number=SeqID_167675
atggggatacttggcgaagcttcctcaattggtttttgtttaggaactgctttagtttttatggtttctcctaaagcttgtatgctagaggtagtgtctaatccttggaggtttacagtagggaactggttatgtgactcagatctggttagtcctactggaattgaacgggttctaaccgaaaaagaccttctggatgactcatattcagacctagaggcttctatccttgatgaaaaagaatttctcctattgaaggttatctctacctttccggagttatcttgcttaatatgctctatggttggagcgggtcggggaatagacggttttaacaggactctagatgcacaagtattcatgaccttgtactggatccaatatattaaggctgctgggattgatccttctttcatgtcaaggccatga

SEQ ID NO: 75991 - DNA, 327 bp, Glycine max
  Peptide Sequence Number=SeqID_167676
atggccttataccgcgagaaaggcctctattacaactatgatgagaagtggagctcctctcaccgttgcaagggtcgcgtcttattgttcattgctgaccctgatgaccctgattgtgccaccctcaataacccaagccctgccctacctccttcccctaatgacccttgtcccctcgagcccaccccaaccaacccccacatcagcctttatgccctggttggccttcccgctactgatacttttcgtgtttatggctacattaaacacgcttgtatcactattcttatagacagtgatagcactcataatttcgtccaaccatga

SEQ ID NO: 75992 - DNA, 153 bp, Glycine max
  Peptide Sequence Number=SeqID_167677
atggagaagtctttaaagaaaaattttagtgaaaagaaattgaagaaagcatacatcacatgggatgaaaatgatatggaatcttctgaagattcagaaaatgaagagataaacatcttccttatggctaaaagttatgaaagtgatgaagag

SEQ ID NO: 75993 - DNA, 399 bp, Glycine max
  Peptide Sequence Number=SeqID_167678
atgccggtgcttatccctcaccccttggctatggtggatttccgaaaagtgtgtgcacatctgttaatgagtgcatgtgccatggaatacctgattctcggcagttacaggttttatgagcctatattgctatttctaactttatctttggcatgcattttgctcgtaactgacgacaatgatctctttttgcagaatggtgatattattaacattgatgtgacagtctacctggatggatatcatggagacacatcaaagacatttttttgtggggaagtcggtgatgaactcaaaaatcttgttaaggtaactgaagagtgcctggagaagggaatagctgcgtgcaaggacggtgctctctttaggaaaattggaaagagaatcagactttattag

SEQ ID NO: 75994 - DNA, 240 bp, Glycine max
  Peptide Sequence Number=SeqID_167679
atgagatcattggttgttggtgaggttaccgcaacactggaagaggccatagatggagtggaaggagacggggatggtgaagttggcaaaggcggcagagttgatgagggaggtgaggagcgagttgacggtgcaaaggggtccaagctagaggccatagatgacatcagaggaggcgaggacggtgaagctattgtggttggcgaaggcaacggagttgacgaaggaggtgaggagtga

SEQ ID NO: 75995 - DNA, 462 bp, Glycine max
  Peptide Sequence Number=SeqID_167680
atggaggagttgattaacaaaacacaactctctcccaaaataatttcaacgtcatcacgtcgactcggcggctccacaaaagaatctcacttctcatccactactattgtcattctactcccacgaacaaaggttcacgatcatcacaggtaccaaccacacggtacaaaaattgcgagggaatgtatgacaatggaagaagaaaaagaagtgcaaacttgtcaggaggaattagatggtatggaggaaaaacctgctgggcatgtggtatttaaagaattgaagaaaaatagtccagcagaaaaggctatagtagaggtgaagacccttcctgaacatttgaagtatgtatttttaggagaaaatgaagtcaattcggtgatcatcagcagttctttaaggaaggaagaggaggatcaactggtgaaggtattgaagaaacataaggcaaccattggatga

SEQ ID NO: 75996 - DNA, 297 bp, Glycine max
  Peptide Sequence Number=SeqID_167681
atgaaggttgttaatgtcaacaccgcgcgtgaaggatgcagagggagcgaggtgaaaaccctagactgctcttggaacagtcgtgggtgctcaaagctcaaagctttctacactaacaagttgattgtgctttacgtggttttcaagcttgacgagagttacacgccgagcaaagtttccatccgtgccggtgatggttttcacaacttgaaggagattaagaccgtggaactcgtgaagccaactgggtgggtttatctatccttgtctggagctgatcctagatttctagcatag

SEQ ID NO: 75997 - DNA, 369 bp, Glycine max
  Peptide Sequence Number=SeqID_167682
atgtgcgctctgcaaggaatgatcccgctaagcgcgatagatggttaccgcctaaagtcactaagcgagacactctcgctgagtgtgatatttctttttgtcctttttttcagatggcctccaagaaatgtcaagcctccaccagtagacctcaggttgcaaaatcagcctggaattccaccagattcacctctgaggtggcttggcatagatatcaagataattttcatctttagaacatttttccagagaggaacgtccaaactggcctataccgactatgacgagttcttggaggagctcgagaagagacattgggacaggaagctcacaaggcttgcaaagaagaacatagagtggccttggtga

SEQ ID NO: 75998 - DNA, 258 bp, Glycine max
  Peptide Sequence Number=SeqID_167683
atggctgggtcaacgggtcagggggttcagatattaaaactcatgactcaatccaaaattcaacagggtttattggttcgatttggtatcaccatgattgccactgtagtcattattgttgttttcaccaccatcgctgataatggtggccgcgatagcgataatcatggcgacgaaggtggtggctacaacgggggtcatgacggtgataatgacaattacagtgatgattgtaatgagttaattgagatattttag

SEQ ID NO: 75999 - DNA, 612 bp, Glycine max
  Peptide Sequence Number=SeqID_167684
atggagctacatgacatacctacaaagaagagtattcttgagctcacatcacaagacgcactactagcccaaaataagctcctagccaagcaaatagagaccctcacagagatgttaagaaagcttcctcaacaattgcacgcagtgcaacctacccattcttcaatcatgcaaattgggggatgcaatatttatggtggggcccatgagtcaggcatgtgcatggctcaagatgatgcatctaaagaggtcaactatatgaccaatccacaccgtcaagggttccatcaaggagggcctccaagataccatcaagggggaaatttctctcaacatcaagtccaaggttggagatcccatcccgggaataacttcaatgaagatcaaggcggtccatctatttggcctcccaatcaagggcttaatctatatgagaggaccaccaagctggaggatactttgactcaattcatgcaggctcttttgtggccaacatggagaagaatccaaaggaggagtgcaaggaagaaagatgattggagatgccacttcaaggagaagatgagactagaagaagctcaccaccataggaagccatggataagagcttga

SEQ ID NO: 76000 - DNA, 474 bp, Glycine max
  Peptide Sequence Number=SeqID_167685
atggaaaaatacctcccagcagcacggacgagctacgcgaatgagccaatggctacatccagaaggaggagatgtctaggtttggaaatgagatccgacaagccggacaaaagcatgacaagagagaaaaaggtaccaaggttgactcatgactcacataagtcggacaagctccagcctttcccgaaagagcccagggatgtctcctccatctctaggacctcacaatcactcacaaactcatctcaagctctcaggacggcttcctcttcaagctctggtggctttgttcatgctcgtgcgcttagcgcaattctgaaccgcttagcacgcattagtgaatttcgacttagcgcggcttttctcgctcaacgggatggcccttcgctcagcgaacaagcacaactcatccttcttccagattcttcctcgctcttagccgaggattgttgcactcagcggatagctcgctaa

SEQ ID NO: 76001 - DNA, 801 bp, Glycine max
  Peptide Sequence Number=SeqID_167686
atgactttagcccaggtgtggagtgttctctcatactccaacctggcccccacatctcacacatctaacctgacagtgggcagagctaggcagatctttggcttagtctctcgcatggacatgaacataggagctctcatttctagccaaatgacttatatagcccagtctaactcttctagacttgggtttcctgctctgatcaccgccttatgtagagccagaggggttgtctctaacatcctcacttttgagcacctgagcccggtcattaacttggcctacatcaggaagaactgttggaatcctgatgatcttacaatttctatccgaggggctaggagggtgaaggcgaggccaactgagcttccttccacatctgcagttccttctccaacatccacttcagcagctcctttagtcccaggacagaccattccttccgttgagcagtttctagagagagtagcctggcttggggcccaaccttctcttcacagggaagatgaaggtcccacagcccaggtaccacagcatgtagaggatgcatcatctgaggccaccgttctagagccattcattatagaggaggaggcagtgagacacaggttagacaggaagctgttgctactcctgagaggtcacatcagatccacccacaccagtggtggacctatcctcacctcagcatgcagcagacccctccactcctatactcgagataccagaggacccgactacactagtcctaagtctaaacacttctcctccaactactccagtacttcatctgatagatga

SEQ ID NO: 76002 - DNA, 198 bp, Glycine max
  Peptide Sequence Number=SeqID_167687
atgtttgcttatagtcctttcgctaaacgcaagcttcccgctaagcgcatatttggtcatgtgctaagccgagagtctctgttgcttagcgctcaacccttgcatctcaagctgactcggtccgctaagctggtcaagggtgagctaagcccatttcaattcgatctgaattgggctaagcgacggcctgctcgctaa

SEQ ID NO: 76003 - DNA, 132 bp, Glycine max
  Peptide Sequence Number=SeqID_167688
atggagggtctaatgctcttggagataacaggaaagccctcatcaaaggtcatgtgtgttggaccttgtggcctcaataatcttaagagggataggcttagaatgcagaagaagcaacaacaatcaatttaa

SEQ ID NO: 76004 - DNA, 387 bp, Glycine max
  Peptide Sequence Number=SeqID_167689
atgtcttccaaggttattttgataatgccaaagaatcaagagttaagcaagttccaaagattcaagaatcaagtttcaagaatcaagattcaagattcaagaatcaagtttcaagattcaagattcaagaataatcaagatcaagattcaagaatcaagagaagactcaatcaagataatagaaggtacatctacttagggattgttatactgagaacaagagagggtacatctcttgtggatcagttcaagtggagggtacatccacttggttttttcaaagagaacaagggagggtacatcccttgtggatctttggcttgtaaaggtttttacaaggttgaaagaaatctcaagaaccgcatgttgcttggggactggatgtag

SEQ ID NO: 76005 - DNA, 276 bp, Glycine max
  Peptide Sequence Number=SeqID_167690
atggaaaaagatgaatcaattgatgagatgttcaatagatttactatgataataaatgatctaaaatccatggtgaagacgtataatactcaagatcaaatcagaaacatcctaaagagctaccttaaggaaatcatggatgaaattcagcctaaaaaagggaagaacatagcccttaaagcaagtatctcttcaaggaagtttgtacatcatccaatagcttttaaagaagaaggcactacttttaaagaagaagaatctatagaaaaggtttag

SEQ ID NO: 76006 - DNA, 408 bp, Glycine max
  Peptide Sequence Number=SeqID_167691
atgtttggcttctttgtgtttcaagtttttcgggtatctggacatcctccaagagctcctagaattttgcaagtatcttggtctccccctttgccaggttggtataaatgcaatattgatggcgctgccagaggaatgccgagattggtggcttatggtgcagagcttattggagccatggaagctattgatattgcttttaaaaaagatggcaaacttgggtgttatggaacatgggtcactagtgggaatccttgcctctctgtgttgggaaacccttctttagagacaggatgggtgcctgcttgtgatgtcgttatgccctggtgccaacctagttggggttatgctttccatgagaatctgaatcgagaaatagatgtgttgcttgaagcaacatctggttga

SEQ ID NO: 76007 - DNA, 611 bp, Glycine max
  Peptide Sequence Number=SeqID_167692
atgggggttaagtacctcgaggcggtcaagcgaaggttgcatgccaccaaacaatggttcccggacaaaattaggtggatagatcaagttcgacgtcaagctttccgcaagacatatgggaaaatctgggacttgactatgatagaagttttcgtggaagtcatcgcatccttcactcagtactatgaccagccgctaaggtgcttcacatttggggactttcagttggtaccaaccgtagaagagtttgaagggatcttgggatgctcgctaggaggaaggaagtcgtatctgttttctgggttttacccctccatggcaagagtagcaaaggtggtcaagatctcggtgcaagaattggaacgagtgaaacaaaatagaaatggggtggttgggataccaaagaagcgcttggaagagaaagcgaaagctttggcggatcaaggagagtggacttctttcattgatgttttagcactattggtgtttggggtcgtcctctttccaaatgtggatgggctaatggatctagcggcgatcaatgcttttcttgcttatcaccatagcaaggaaagttcggccgttgttgttttggttgatgcctatgacac

SEQ ID NO: 76008 - DNA, 417 bp, Glycine max
  Peptide Sequence Number=SeqID_167693
atggagacgtgtttggaagtagaggaattgttacagcggatgatagatcaaggtcgactagaagtcggcattgaaggaaaagaagagcagcacatatgcatgcaatctacggaggggagcggtgttgcgaagcccaaacccttggtgatatacttcactaaaagtgcagcttcgcaaaagcccggacaccccttaatggccaaacctgttcctttcccgtaccaaaatagtcacgcggtcccgtggagatatacacctccggggaagaaggaagaagaagtcactgacgtcagctcgctgtcagctaaatggtcgtgtgttcgcacctccggacctaccggtccaacccgccgacgtcaagggaaaaggaaaagtggtggaggaacaagatggcgaagcaccccacgcttcgaataa

SEQ ID NO: 76009 - DNA, 183 bp, Glycine max
  Peptide Sequence Number=SeqID_167694
atggccacgataatggaggtcatgatgagcatgaggaagataatggaagccaatgcggttgcagttgccgctaccagggctgttgctaaggcacataaaatgccccaccacaatctagccgacttcgagccttgcctcggatatgccactaaagggcaagtagttggtgatatacccctgtaa

SEQ ID NO: 76010 - DNA, 192 bp, Glycine max
  Peptide Sequence Number=SeqID_167695
atggataagactataagactaaggatcaagtctctaatccaatatcaagactctctaaatgcactcaatgttgtattcatttatggcatcatcaaagccaaaaagggggagattgttagagatagggggagaagcatgagcaatatggtgaacaacctaaggctgaagcttgaagctcaaggaaaagcttga

SEQ ID NO: 76011 - DNA, 282 bp, Glycine max
  Peptide Sequence Number=SeqID_167696
gagatcacgcctgccaagaccaccccagtggaccgaagaagtccaaccagggtcttggagttgtcaagctctaattacgggtctctgtcagttctacagagtgctgacacctccaacaagggcatcaggccccctactaatcgagctttcatcgagaagtattacgtctccaggcaggcgcagggcgaaacaccacagcagtctagggatggccagcagcgggcaacagatgcaccgccatcacctctagagttcacctcagctcatccacaaaaaggttaa

SEQ ID NO: 76012 - DNA, 192 bp, Glycine max
  Peptide Sequence Number=SeqID_167697
atgaatgcatgtcccaaaaacatgtgcaaaccaaactgccccatggcttgtttccctacaaaaaatcacgcgctaatgccattgaggcatttcaccgaacacttggtgggcgcgcgtttaggtgtcaatagcaagagaacggggacaataggtggctcgcccaggcgagcccagctcgcccaggcgagctaa

SEQ ID NO: 76013 - DNA, 589 bp, Glycine max
  Peptide Sequence Number=SeqID_167698
aagctggcaaaagacaacgccaggagtgagcgaggagtaccgcgacgacgtcgagtcactgcgtcgcggcgtcacccgcgcggcacggggcatcccgggcggtgccatcgatctgtacgaccacatccgcggcccgctgcagcccggtgaaccggcacgccgcgaagcggagaagaacggccatcacaccagcatgctgcgcatggacgatgccaatcacctgggcaacccattgttcaacgatgcgatccgcggcgtgcacgcgcaggacgtccgcgtcggccgcgtgccggatgtgatgagcacgcagttggccggtagcttggcggcggagatgcacgctgcaggcggcaagcgcatcgacgaggtggtgatgaatgccgacgcctcacgcagcttcgcggtgcagggccagggcggcgacccggcacacctgcgcgtgtcggtggacacagcggtggcgatgaacacgccgctggagcagagcagccagcggattgatcagcaagccgcgggacagcgcttggcacaggaccgcgatcagcaactggaacaacagcagaaccagacccgcagcatgcaggcctga

SEQ ID NO: 76014 - DNA, 165 bp, Glycine max
  Peptide Sequence Number=SeqID_167699
atggagtcgccaactgttgcaacctacccttcggcgggagggcgacgcggggctcgcagtgtgaaaggttcgggagttgtttttatgcacggggaaggtattagcaccccacgagtccgtcacaagggacggcagactttaatcaagtgtgcaaatatgacttaa

SEQ ID NO: 76015 - DNA, 549 bp, Glycine max
  Peptide Sequence Number=SeqID_167700
atgaaggcccaagtggagaaagatgaatgcccagaggcagaggcactatcaagacaatttatgttgctgaaggcccaatctaatttgaaggcccaaacttatcaaggtaatccttgtggcgtctacccggacttatcttccttcaccgaaagtggcgtctaccctgacttatcttccttcattggaagtggcgtttaccctgacttatcttccttcaccggaagtggcgtcatacaaaacctccgtagcctgtatcaaacgatccgctcctactcaggttcacatcaccatacttatcaaggtaatccttgtggcgtctacccagacttatcttccttcaccggaagtggcgtctaccctgacttatcttccttcaccggaagtggcgtctaccctgacttatcttccttcatcggaagtggcgtcatccaaaccttcgtaacctgtatcaaacgttccacccgtaaggttcacatcacttttttagaccccgatcgttcatctttcctggccgacgtcgactgtcatttttttttatcatatcggtga

SEQ ID NO: 76016 - DNA, 312 bp, Glycine max
  Peptide Sequence Number=SeqID_167701
atgcacaaaaaaagatcttctgcaggtgaattgattcccgttgatttggagattaacaccatttgtagaaggcgtaatcaggagaaaattagaaaatttttgcaggacttagaggcagcagcaattccagaggaagaacctcaatcttctgaggcattttctagttttcctattgcagaacattctcatttagatcctagtgaagactacatcatggctgaagagccaagaagagttactctggaagattattcaagttctaatgtgccacaatttttcaccagcattgcacaaccagaagttcaagcataa

SEQ ID NO: 76017 - DNA, 303 bp, Glycine max
  Peptide Sequence Number=SeqID_167702
atgggaaaagaacaggaaattgataaagttgccacaaccatggaactacactctcctttggaaaaagcattgattaatcaaatgaagtgtctgactaaagaagaagagcatgaagtgcagacttgccttaaagagttagatggtgcaagagaaaactctgagggacattcggcatttgaagaattgaagaatagtgggcaaatagaaaaaccaaaagtagaactaaaaaccttgcctgcacatttgaagtatgtatttttggagggcaaaaattcaaaacctgtgattattgttagtcggtga

SEQ ID NO: 76018 - DNA, 312 bp, Glycine max
  Peptide Sequence Number=SeqID_167703
atggttgatcgaggaggagaaggaaatagatcaccaaggaggactcttggtaactatgcttatcaacaagaaccaaagcattacaacaatatagtcattcctcctttcaacaataaggtcgtggaattaaagctagcattgcttagtctaattgtcttgcatccctttgttggaatggatcatgaggatccatacacgcatttgtctaccttcatggaactatgcagtatcgtgggagcttctaacgaagatgttgaagctgtctacctaagagcttttccattttcattagcatgtaaggcaaaaacatga

SEQ ID NO: 76019 - DNA, 147 bp, Glycine max
  Peptide Sequence Number=SeqID_167704
atggctcgcacccatattccaatggaagcagagatgaattacacgcaattctcctcaaatttcagccagcccgcatcaattggaccttgtaccttacgctttgaggtcatgcagtgctcaatggaatgccccggggcttctccatga

SEQ ID NO: 76020 - DNA, 237 bp, Glycine max
  Peptide Sequence Number=SeqID_167705
atggcagcggaatggagaacaagaagagttgagaggagacgctacttcaaggagaagatgagtcaagaagaagctcaccaccataggaagccatggataagaccttggaggcaggacaagaatggagggagaaggagagagggagcgcaaaatttgtgcctcaaaagagctatggttcagcccactaatccaagatcaagttcaaaattatccactaaatatgcttacgtggcatga

SEQ ID NO: 76021 - DNA, 117 bp, Glycine max
  Peptide Sequence Number=SeqID_167706
atgcatgacgcgatcaaggaacaagccaaaggactatcggtgacaatgcatcaccaaaagagaaaaactctagatgaggctttcactattatcaagcgagtcggagacccagcatga

SEQ ID NO: 76022 - DNA, 192 bp, Glycine max
  Peptide Sequence Number=SeqID_167707
gaatttaaagatgtctttcccaaggagattcctcatggactgctaccttcaagaggcataggacatcaaattgatctccttccaggagcttcattgcctaacagggcaaatgctttccaagaaggaaggaatgatgagaatccaaaaactgctcagatacagggatctatgaccaagagtaggaccaaatag

SEQ ID NO: 76023 - DNA, 539 bp, Glycine max
  Peptide Sequence Number=SeqID_167708
atggcagaggtctccacggaggccattgcctccctcacccaatattatgaccagcctttgaggtgcttcacctttggggacttccagttaacacccacggtggaagagtttcaagagatcctaggatgccctctgggaggaaggaaaccatacctcttctcgggattctatccctccttagctagaatttctaaaatagtcaaaatctcgacacagggattagaccgcgggaagcaagtcgaaaatgtgttggttggggtaccaaggaaatgtttggaagcaaaggcgagagtcttggcaagtcaaggcgaatgggccccattcatggacatcttggtacttttgatcttcggggtggtcctctttccaaatgtggatgggttggtggaccgggcagcgattgatgcttttctcgccttttacgaccgcaaagaaatcccgtttgtcgttatcttagccgatctatatgacacattcggccgaagatgtgagaagaacaatgcaaggattgtttgctatatgtcggccttctacgtatg

SEQ ID NO: 76024 - DNA, 566 bp, Glycine max
  Peptide Sequence Number=SeqID_167709
ggccgatgggtttgacgaggaggccattgcccaactgttatgtataccgggtcaggatttgcccggaccgctgcagggaggcgggtgcggatcatgcgcaccaacatgactaccctaacccagatggggatgacattgctgctgagcaatgtcctacccagcactctctagacccggataagtctaacagggccctggggtttccagcgttgatcacgggcctctgccagtcattcggggttcctgtcacacttagtaaggtgatccggccgccgatcacccgagccttcattgagaagtattgcacgcctaggcaagcgcaggacgcaccgccgccacctaatcaggctgatcccgttgggtcattaggcatggagcggtatctacagaacttggttcgccaacaggcggccaaccaccgggggcaggtgcagatacatgagtgtctctaccagctctgcctcagtcagcagggccagggagctcccgacgatgcagaggacgcccgcatggatgaggagatgacagacttgctcggcttcttgggaggaagcagagccacgtga

SEQ ID NO: 76025 - DNA, 234 bp, Glycine max
  Peptide Sequence Number=SeqID_167710
atgtcacgaaactttacggattacgcaatcatcgcctctttgacttctggaatgttatggaactttacggattgcacaacaatgcttccttttggcttccggcatgtcgcggaacttcacggattgcctaacgatgggtgtttagtacctcgaagtggtcaagcgaaggttgcatcccaccaaacaaatggtccccggacgaaattagggtatgacacagatctaccttcatga

SEQ ID NO: 76026 - DNA, 387 bp, Glycine max
  Peptide Sequence Number=SeqID_167711
ggcgcgtcccattcgccattcaggctatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtatcaagcttatcgataccgtcgaccaccagattctccactaagtgtgcttag

SEQ ID NO: 76027 - DNA, 402 bp, Glycine max
  Peptide Sequence Number=SeqID_167712
atggaaaggagtatgattgatgctgccagtggtggagcccttggtgatatgactcctgttgaggctaggaatttgattgagaagatgacttccaactgccaacaattcagtgcaagaaatgatgctattgtccttagaggagtctatgaggtggccacggattcatcttcatctactgaaaataaaaagcttgagggaaaacttgatgccttggtcaacctagtaactcaacttgccatgaataaaaaatctgcacctattgcaagagtctgtggtctatgttcttctgtagatcaccatacagatctctatccttctttgcagcaatctggagtcaatgagcaacctgaagcttatgctgcaaacatttataatagaccccctcagcagcaaaaccaataa

SEQ ID NO: 76028 - DNA, 504 bp, Glycine max
  Peptide Sequence Number=SeqID_167713
atgttggatcaatttcatcagtgcatcaaggattctattgaaaatattattgatgtcaaagtggatgataactgtggttatcgggcaatagctaccttattgggtatgggtgaagaatcgtggtcattggtgcgcaaccatctacataaagaattgataagctggttggaagagtatatcaacctggttggtgacatagagagatttgaggaattaaagtattctctacttgttgacagattatctatggtatgttaccaagaacaagtggatgaatattacggatatgagatatgtcattgcttcacgatacaacgagatcgttgttcctctttcacgacaacaatgcatgacattttttctcttagaagtttttttatgagaccattgtcctttaccaccattggcattgttgtagaatacacattgtcattctcaagcaaagtagtggcccactccgtacatagggtagaatgcagcgttgcacaaatttgtatatgctga

SEQ ID NO: 76029 - DNA, 195 bp, Glycine max
  Peptide Sequence Number=SeqID_167714
atgattatgaggggtcaaaacatttatagtagtcaagaggagacactacttcttccccttcttctagtggaagtgaagatgaagcaaggggtgaagagtctagtgaggaagtctacccccatgaagaagcacaagattagtttccaagttaacctcactatcattccctacccaaaaccttataaacttcaatga

SEQ ID NO: 76030 - DNA, 825 bp, Glycine max
  Peptide Sequence Number=SeqID_167715
atggaggagttgattaacaaaacacaattctctccccaaataatcctaacgtcatcacgtcggctcggcggctctacagaagaatctcacttcttgtcctctactgctgtcattctgctcccacgaacgaaggttcgcgatcatcacatgtaccaaccacacggtacaaaaattgcgaggggattggcggattttctccaccgaatccttgaggaggattctgaggattctgctccgattaaagtgttcctcttggtgtgggggttcgacgacaagcaacaacggctcgcgatggccaccaatggtcttgggtggtggaaaaatgaagtgttagggtttgggtggtgttttggagaagaggagagtgaaaaatcgtcgaaattccctcttgggttggaattgcgattagcgcacccctgctcgcttagcgtaattccctctcggattggaattgcgcttagtgcgtccttctcacgtagtgacacatcaaaagttgttattttcaaaatcccaatggtcagactgtggaaacatgtcttaggaagctctaggaaaaatttgaagatgatccaacgtttccatttgcctaacagagaggtgactatcaccttggatgacgttgcgtcgttgttacatttgcctgttgtagggtcattccacagcttcgagctacttcatgtcgatgacgctgtcgagatgttggtggagttactcgaggtcagcgctgcaaaggcgagagttgagaccattcagtgtcatgggtcttatgtgcgactattgtggatgcacgacctgtatgagctgaagattaaggcatgtgactag

SEQ ID NO: 76031 - DNA, 810 bp, Glycine max
  Peptide Sequence Number=SeqID_167716
atgactcactcaaacagaaatgaaaatgaaggaaaatgcatgaaacaggagcaaaaacgagttgattatagtaggaaagcccgtgaaatccaaaaaagggttgcattggcgtcaaaatcgtcttcaacctttaccggattgcaaacatccagtacatccattgcatcagttctatggatgctctcgttgtcgaggaggcataggtcgttgtgtaaccaaactattgtggcatggcagaggatgctcgttggtggagatggagggtgcgagaacgggaggggtgagaagcagaggctccgcatccgtgaagaacgcgatgcccccaggcctccaagaagcgccaccttctacacctacctcatcaccacgctcatcaacctccttgaatacggtggcgccggttctgagttcgccgtcaagaggcgattccgtgacgtggtggcactctcgaaacagctggcagaggcgtaccgcgggttcttcatcccggagcggctggacaagagcatgatggagagccaggtgatgcagaagcaggagttcgtggggcaacggcgcgtggcgctggagaagtacctcaggaagctggcggcgcactcggtgatcgggcggagtgaggagctcaggctgtttctcgaggccaaggggcggcttccgctggccaaaaccacttacgttgcatcacggatgctcgatggcaccgtgagactgccaaggcaactgtttagtggagaggcggagttgggagagatggctcagctggccaagggcaggagggacttgctcaagattttcaaggagttgaagtag

SEQ ID NO: 76032 - DNA, 426 bp, Glycine max
  Peptide Sequence Number=SeqID_167717
atggatcggaatggtgagtcaaccaagaggacaatgcggtatagtcttgtaaaaaattctaatccctacatgaagcaaaagaaagatggccatggcacaaagaccaacatggggaataacatagttatagcaacaaatagtgggacaggtaatgctactttgtatcggtactacaaacaatgtgttgatgataataaacctgacatgttggttgtgttggaaacgagagtggatccaaggaaattgaggcacactttctctatattgggttatgatggtgtagattttgtggatggtcagggttttgctggaaggattattgttgcttggagaactcatatatggtgcagagtcaaatttgacgatggtgactattggtggttctccatattggttaatttgaaaaatcgagatgatactggataa

SEQ ID NO: 76033 - DNA, 213 bp, Glycine max
  Peptide Sequence Number=SeqID_167718
atgtaccttctcttgttctcaattacaacaacccaagtagatgtaccctctacttgtaccacaaaatacactggtaatcgattacaccatttgatgcattcctacaccccaagggcattggatagaagactccaagaagattgggccagagatgcaagagaaggccctaaggttctcatgagccttagggtagatttcgggcccttgggctaa

SEQ ID NO: 76034 - DNA, 213 bp, Glycine max
  Peptide Sequence Number=SeqID_167719
atggatgatggaaaccttgacaagaccaacaatctcaaagaacctttgcaagaaatggaaggcctaatgactagagcaaaaactaaaagatttaaagaggttttgcaagatttggtcatggaggttcaagctaaagaagatccaacaaaatttgagtacaatacaaagtttgtcacatgcttgcaacttgaagataatatcagtccaatttaa

SEQ ID NO: 76035 - DNA, 382 bp, Glycine max
  Peptide Sequence Number=SeqID_167720
atgaccaacaaggagaggaatcatgatccatgtgtggttgtcttcaaaagcttggatttcatattgcatagcaataacccatttgggatttgtacaagcttcctcccaggatgggattggcttaagagtaagcagtgcgtcatggttgaacgacgtagtgcaagtgcgtatggtgtattaacaaggatggttggggataatggttgtcagatgtatcggtactgttactgggaaaagaagatgtggtctcggttctattattggaatccttttgtaggtagtggagagatctgttgggctgatgtgcaaggctcgactccactgtccatagttgtgtggttcaaggagttgaacgagctttgcaacatggacctacagtcat

SEQ ID NO: 76036 - DNA, 336 bp, Glycine max
  Peptide Sequence Number=SeqID_167721
atgttttccaagaaggagggaatgatgagaatcataaaattggccaaatacaggctaaaggtccaagtgaaaaaagacgaacgcccaagtggagaaggacaaagcccccgagtggagaaggatgaaggcccaaaaacttttggcattttcataaaatttggggagagcttctctctgggttccttgttgaaccaatctcagacttatcaaggtaatccttgtggcgtctaccctgacttatcttccttcactggaagtggcatcatccaaatctccgtagcctgtatcaagcgatccgctcctagtcaggatcacatcaaaaagtataggttgtaa

SEQ ID NO: 76037 - DNA, 321 bp, Glycine max
  Peptide Sequence Number=SeqID_167722
atgagttcttatagagataatttgtttaagtctttggacgctttcacagttgttacaattgacgacgaggattctgatgtcttttggtttcatgttagtgttggcaaagaggttgtcgagggcaccgaacctgacttgtttagcttcttccttagcggaggccatgaagggatgcgagggattggttttggtgcaccgtcaaaaacaccgcatgtcgtggatctcgatggcaacaaagatgaggattccgacaaaggtgatggtagagatgagggagaggaggaaggagaagcaaaagaaaatggaatgggaggaatatag

SEQ ID NO: 76038 - DNA, 336 bp, Glycine max
  Peptide Sequence Number=SeqID_167723
atgactcctacttatgatgccctactatattacaatgggaggtggaacatgtcacaccaacgtgactttgtgagttactcgttcactggaaaaaatccaaaaatatttgacattccttcgggatgtaacatcaatggactggaggatgtgatcaagcaagtttcacctcaagggattcccccttatggtattcatgaatcacaaacgctgatgaaaccgtatgtttattattttcaagggtggaccactgctttgcctgataatggcaatgtgtattccacaacaacgccaatggtggtaaaggacaatggtctcataaaaaaacctgttacataa

SEQ ID NO: 76039 - DNA, 628 bp, Glycine max
  Peptide Sequence Number=SeqID_167724
atggtcattttttggaacattctagacctaagctcgcccaggcaagcatctggctcgcctaggccatgggaaagcttcagccttaagcaaccaactcgcctgagtgagctgataccttcaagcctaagcaactggctcgcttggacgagcttcccttgcaggggaagggttttaggggttggaaaactgaagaaagagaggaaaaacacagaaaggagaaagagaaggagaaaagagaaaaatcgaggcgctgccgaatcgaatcgtagatcatttcctacatcatttctcttgctagccttgtaccctgtgcaacagtcggagatgaacgtgcttttatctattttctttcgccatcccgttgtaagggagtggaggttgatctatggtcatgttgggttcctaactcgcttgataacagtgaagcctcatctagagttttcctcttctggtgatgcattgtcgctgatagtccctatcgccacaattccttcaatggtgattttcaaccatggagatgtagtggaagataaaggagaagaggatgagcttcaccaccaagagagtgccttggataagaagcttagagaggaagcttcaatggaggaaaataatgagagagagagag

SEQ ID NO: 76040 - DNA, 558 bp, Glycine max
  Peptide Sequence Number=SeqID_167725
atggccccgaagaagttccctgctaaaagagctaggcagactgttataggagaaggatctagtacaactccaccttgccgctttgaagtgattaaagattggtcttttctcaaagaaagacggttccaactagttgaggtggtcatggagttttatgcaaatgcctggcctactgaagaagacgtcatggataagcgctccagagtgcggggcattgcacctcctaggcacccaatggacccagaaaagtccaacagagcattgggatttcctgcattgattacaattataacaactagggcaagatcaacagtagctactgacagcagacgcaccaccaccgcctccacatcagccaccatccttggagtccatctcagcccacatgcagaggatggaactccaaatgcacacatacattttagagccactattgcatggcctagagacaggcctaattttcaagaggaggcaggacttgcagatgctcaaggagctgcccaaggggacgaaggtggagttgaggatgatgtagacatggcatatctgcttgattaa

SEQ ID NO: 76041 - DNA, 441 bp, Glycine max
  Peptide Sequence Number=SeqID_167726
atggtaataaaaaagaatgaacgcgttttacgacacccttatcgaacacgtgccaaggctagaaccatgagcgagatagaggaagttcaagaacagatgaaggctgacatggaggccagcaaagaccaaatgaccactatgatagaggccatgatgagtatgaggaaaatgatggaagttaacgtggctccagtcgctaccacaagtgccacagcagaggaggacccgactcactcatctagtatcaatcaagggagacacccgaagtaccccgagaccacactttggccgacttcgagcctcacctcagatatgccactgaggggcaagcatttggtggcgtacccctgccaaacaccttggggggccctcaatactgctcgtagccacaactgcaacccctacatttcacgatggggaggttacctcctaccatggtag

SEQ ID NO: 76042 - DNA, 132 bp, Glycine max
  Peptide Sequence Number=SeqID_167727
atgaaagtgagcaaagactatttgaactttcaaccctgtactttagaaggtgtggaagcaaacaagtggagatggtttgagagatgtattggagcacttgatgagactcattccggttatagtttcgcctaa

SEQ ID NO: 76043 - DNA, 1704 bp, Glycine max
  Peptide Sequence Number=SeqID_167728
atggttagaacacgaggtttaggtcatgctttagctagggttatagatagaggtagacaggatgagcatgatgtagtcaatgtgactgaggatgtccctcatatggttgacgatgttgctcagaggagtgaagatgtgcctcagatgaccgtggatgtagatgcgactgttgcagaggacttaggtcgtgatggtgctgaggggtcacatgctgatgagggattccctggtgggccctgtgacccatcagttccgacttcatttgcggagcatgtcgcacatgccatttggactggacaggagcgtcctgagctaaagttggtgtcgcacgggaggaagatggcgttaattgggaggccagtgcctgcgattgaagggctggttgtcgccacaggattaagtccattgatcgagtgttcagttgtaactggcgatcctagacttatatccgcatttgtggagaggtggcacagggagaccagcaccttccaccttccagtaggagagttgacgatcacactagatgatgtgtcgtcactcctccatctccctatcagtggcgccttccacagcttcgaggctttttccgtggacgaggcggtatttttgttgatggagttgcttgaggtgtctggtgaggaggctagagccgagacagtacgagcgcgtggggcatgtgtacacctctcatggagtgcaacaaatgttcatgtcgtgcatctagaggcttttcgtgacctgggtcagagtaggggctatgcctggggagctgcggccctggttcatatgtatgaccagttagatgaagcttctaggaccacgacacgacagattggggggtaccttactttattacagcaatttttgagtgtgcatcagtgtgtcatcgataatgcgtatgaggagacgtcccctcgtgcctctgggtggctgacgacgaaggctcatatgaagggaattataggagcgtcgtaccgggcacattgtgatgctttgacggtcacagacgtgtgttggtttccttacagtgaccatcgaggggttagggggtttgagctgatttcatcgttccagggtcagctgagatggggtcctacgatggtcacagttcgatcggagagggttctacgccagtttgggtacattcagagcatccctccactgcctgtatctgcggattacatggagtggtttttccagatatctcacccattcatgataccgatccaggcaggtgaccagcctagacatgcacctgccccagaccatgaggactacatgcagccgaacatcccacaggttccagtggcatttgacccccctcgacatgcagtggatgattacgaaggctatgggcgatcgcagaaagggacaaagttacatgatatcatgcaagattgcctgaagatcgctaggggggtgccaatgcagatggaaatgttagggctcgacaaagatgctgcacagagcattgatgatcttgtatgcctaggatcttcttcatcaatggattcctttgcttcttggaagatgaatggcagcggaatggagaaggaagagagagagaggagatgccacttcaaggagaaaatgagtctagaagaagctcaccaccataggaggccatggataagagcttggaggaagaaggagatgaatgaagggagagggagaaaaaagcacgaaattttatgctctaaatga

SEQ ID NO: 76044 - DNA, 222 bp, Glycine max
  Peptide Sequence Number=SeqID_167729
atgtcatccagtcacaacacaaaaattgatgaggacatgaccaagagcaagggcaaggatccacttgaaggacttggaggacctatgacaagggctagagcaaggaaagccaaggaagctcttcaacaagtgctgtccgtactatttgaatacaagcccaagtttcaaggagaaaagtccaaggttgtgagttgtatcatggcccaaatggaggaggactaa

SEQ ID NO: 76045 - DNA, 378 bp, Glycine max
  Peptide Sequence Number=SeqID_167730
ggaaaaagtggtgtgtctctcaaggactccaccttgttcggtcttttattgttagaacctatcaaagctaacttcaggtctttggcattgaggtgcaagttgttgatttcacgatttctagcatatttggggtgtcttgacttggttggttttctattgagccttgacttccttgctcccactccaacccagcttcacactagtttgttgcttgaattattggtagtgattgagttctttattggattgttgctctgtttttggactgtgctgctcatcatcacagacatgcagagtggatcccagtctgaatcgtttgatgtagaaatgggagatcgcttagaggatatgatttgtgatcttggggggatcctctag

SEQ ID NO: 76046 - DNA, 137 bp, Glycine max
  Peptide Sequence Number=SeqID_167731
atggagtcgccaactgtcgcaacctacccttcgatgggagggcgatgcagggctcacgggtgcatcttccaagaaaggataatgcgcggagtcgccaccaacgtttattcgaggaaaacgtccgaaaaaccggaaag

SEQ ID NO: 76047 - DNA, 438 bp, Glycine max
  Peptide Sequence Number=SeqID_167732
atgttcagcccttctggtattgagaatttcctcaaaattagtgagaaaaattgtttccgtgaaaaaaatccaagtcgaggtgctttcgtaacgatatcgagacgttttcgtaagcgatttcatggagattcttcaccgttcttcattgttcttcgttcgctctttgtcgttcatcggtcttcaaccgttcgtagaccacaccttttccgatttttccgacgttttcctcaaataaacgttggtggcgactccgcgagttttcctttcttggaagatgcaccggtgaaccctcgcgttgcccttccgccaaagggcaatggtgaacccttccttaaggaagatgccaatgttgtgatgactagaagcaagaggattcaagaggactctgaggagaaggaagattcttctccaaaagttgtagatgacatccttccttga

SEQ ID NO: 76048 - DNA, 624 bp, Glycine max
  Peptide Sequence Number=SeqID_167733
atggagtctgttaatagaggcatttggagtgcagtggttaatggatataccattccagcccatgtagttgataacaagactatagagaaaccttatgaatcttgggtatccgtgtgcacaactgtcaaagagatgtgggatttaatccaagtaacacatgaaggaacactagaagtgaggaaagctcaaaagaattcactaatccaagaatacgaaaccattaggatgaagcaaggggaaactataagggatactagcattccatcaactaacaaaagtaaggatgacaatgcagaagggtcagatgctaaaaatctgaacttgctcgtgagaaggttcaacaaattccttaagaaaaataagaactatggaaatagaaccttttaccctaagaagaatctcaagaaaggagaaccatcttcctccaatggatacacttgcttcgagtgtgaaaaggcaggtcatattaaggtagattgccccatctaccaaaagaagcagcaaggagataagaagaataaaggttcattgaaaaataaaaagaattcatatatcgcttcagatgatgatgaattaacaacttccagcgataatagtgaagaggatgaagcaaatttgtgctag

SEQ ID NO: 76049 - DNA, 270 bp, Glycine max
  Peptide Sequence Number=SeqID_167734
atgtcggcagaaaaatatcagttgtggctatttacaacgaccgatgtcggctattgtttttctatacaatccctgaatagtatttggatgatgatgtctattggaaatgttcgatcggcgtcatccggcgatgcttcttttttaaacctcgatcgcttaacttttcgggccgacgtcggcttgaattttcttcgatcagtatcggtgaatcaaggaaatgttcgatcggcgtcgtccggtgatgcttcttctttaaacctcgatcggtga

SEQ ID NO: 76050 - DNA, 204 bp, Glycine max
  Peptide Sequence Number=SeqID_167735
gcagctgtgtctccagcaaaacctccatataggctggatcatgaggttgatgatcccctttatttgatgacattgacaatcccacagctttttttaaagcgtcttctggttatgtgggatgctactgtgttcggggtgtttaatgaacacttcccgttgtacataaagcacgaagatctctctgaaattgcacacggtggttaa

SEQ ID NO: 76051 - DNA, 351 bp, Glycine max
  Peptide Sequence Number=SeqID_167736
atgggttttccacctacctcccctccttctcctccttcggacgcatcggctttgccgtctgccgtgaagcggacacgcaaagcctcacgtctacgatcgttgtccactaaaccacttggtgctgagagaccagtggtccatgttgatcctgctactgggaaggctgacggtccccacaggaagaaattaagaacatatttggggattgtggcgcgtgataaggtggacgtcacctacgagaactggaaggaagtccctactgctcagaaggacctgatttgggaggatattcaggcagaatttgatatcccagaggcttctgacagtaggatgaaaaggaagttactttag

SEQ ID NO: 76052 - DNA, 332 bp, Glycine max
  Peptide Sequence Number=SeqID_167737
atgagcaccgcatcctcaaccgcatcaactgagaggaaaaatgtcatcatgcgaccaccactgatcatgcaatttatcgttgccttcaataatgacaagaataccatacaacttccagccttctatcatactcaatgggcacgcaactatcctgagatggttcatctcacccacaatggagccatttatgaaaaactcccgcattgtacagaagttcctcttagagcttgcagcaaccacatgacagtcttaaggcggcatggccccccactgcaatggaaagttgaaacgctgaatcctgccattggtggaaaaggtgttgtccaaccatg

SEQ ID NO: 76053 - DNA, 282 bp, Glycine max
  Peptide Sequence Number=SeqID_167738
atggggagtcaaatccctcaaacaatttcacataatcatattataatcaaaggaatcaaaatggttcaaaaacacaaaacaccaagagcactcaattttatcaaccaattcgcattaaggcatcaattgtggttccctaagattcctcaagcttttcctctggttgctctgttagagtttccaagcattagagagaaggagaagggattgaagcctcaattttactatcttcatgatgatccaacggttaacgtgttcgggatcatagttttaaggagatag

SEQ ID NO: 76054 - DNA, 114 bp, Glycine max
  Peptide Sequence Number=SeqID_167739
atggagaagctccctgagcagccgtcacaagccttaatgtgcaatactgaggaaattcggataacaactgagatgaatcttcaaaagatcaaagttaatgcggatgtgatttga

SEQ ID NO: 76055 - DNA, 405 bp, Glycine max
  Peptide Sequence Number=SeqID_167740
atggcttccatgatggaggtcatgttaggaatgaggcaactcatggagaaaaacatggtcaccactgctgccgttagttcggctgtcgaagcaaacctaactctcttagctactgctcaccatcctcccccaaatacggtaggacgaggaaggagcacactggggcacaacagcaacccccatttgggatacaaccggatggcttacccttatggattgccacctaattacacaccgccagtcaggcaagatgatgcgggtcatgtctcctcccccatcctagaaggggagcctcctcgacagcccgacgaggtccacgaagatcatcaagagtatgcccaaggggatgtcgagttctaccccccgatccccgtcgaggcaccgacacccaacactttgccttag

SEQ ID NO: 76056 - DNA, 456 bp, Glycine max
  Peptide Sequence Number=SeqID_167741
atgacattgctacttggcaacattctgcccagcgaccgcaatgccaatctccccctgcaaaagtatcagttggtctgtgtcgtcccgacatggggatcgcacccacaaagacgcccagtggacctgaagaagtccaacagggccctggggtttccagctctggttacgggcctttgtcggccctatagggcgcccgtccccccagcaagctcatgccatcatgacatagggatcgtgctcgcaagacacctagtggacccgaagaaggccaacagggtcttggagttgccagctctaaatacgggtctttatcagttcaagggagtgcctgttgcccccagcagggtcatcaggccccccttaccaatcgagctttcatcaagaagtgctgcgcccccagacgggcgcagggcgagacaccacagtagcattgggatggccggtagcgagcaatag

SEQ ID NO: 76057 - DNA, 312 bp, Glycine max
  Peptide Sequence Number=SeqID_167742
atgggcccttttgggagaggttggcgcttgtctggcttgttccttttgcctaacttgttgagatttgttggttgcgtactgcacgctaaagcattcgatgagggtgtcaaagatgtctatggacctaggtgggagtccaccgtaccaggtcaatgttgcccccttgagggacgtctggaagacactaatgtagctccatgtagagcttgtagaccttggatcttctccatcaatggattcctttgcttcttgaggtctgattgcagcagaatggagaaggagaaagatgaatggagacgccacttcaagtag

SEQ ID NO: 76058 - DNA, 594 bp, Glycine max
  Peptide Sequence Number=SeqID_167743
atgtaccttcaacttcagaggactacacgtcctcgccgtcaaagggactacacgtcctcaccatcagggggttacacgccctcaccttgggtactagttaccctcaccgttgagaggactacacgtccttgccttgagaggactacacgtcctcaccatcagagggctgcacgccctcacctccagaggactacatgtcctcgccttcagaggactacacgtcctcaccatcagaggggctacacgccctcaccttgggtactagttaccgtcaccagtgagaggacttcacgtcctcgccatcagagggctgcacgccctcacctccagaggactacctgtcctcgccttgagagggctacacgctctcacctgtgggtactagttaccctcaccgttgacgccctcacctctagaggactacacgttctcgccttgagagggctacacgccctcaccttgggtactagttaccctcaccgtcagaggactacacgtcctcgccttgagaggactacacgtcctcgccttgaagggtcatgtaccttcaacgccttgagaggactacacgtcctcgccttgagaggactacac

SEQ ID NO: 76059 - DNA, 471 bp, Glycine max
  Peptide Sequence Number=SeqID_167744
atggaggaaaagaaaaagaaaagatccaaggaagtagcccaatctgggagcaatgacactattgttgatcctttatgtcccattagacaacatgtgaagtggaagatggccttcacgaaaaaatttggtcaaatgacgtttgaggcggtaaaggaaattgcagataggattgattcccaggaagagcaaggctcacaaggaagctttgttgtccatggacgtcaggatgtactgactgctagcattgggtggctagagcaccctagtcgtgtctatgctgttggaaccgatgtcacgatcaaacaatactttggagtggcttcaaggagctcccgcatgtctacgtccatggctcccaaagacctggagaagatgacacaaaaaattaaggaccagcatgaggagtcattaaaaaaaagtgactctacaactaatgttgtccttttagctagatgcaatcgtagatgttaa

SEQ ID NO: 76060 - DNA, 342 bp, Glycine max
  Peptide Sequence Number=SeqID_167745
atgaagccatttgttcaagtcaagcgttcctttgctattggtgttggtgctgtgactttctttggttaccgtaaggatcggaatggtcaatggctgaagaaagacgcactccctcctcaagatgagcgtactccttcacctcctcctcagcgtgaagattcaacactcctgaatgaagtccttaccgaattacgaggtcttcgttcttatgttggtgaacgtttcgactcattggatacacgctttgccggtatgtatattcgcctcacacaagttgaagaagatgtctccttcatccgtacttgttttgatccaccaccaccgcctccatcatcctcttag

SEQ ID NO: 76061 - DNA, 276 bp, Glycine max
  Peptide Sequence Number=SeqID_167746
atggtcgggactgatgataggaagaaagagaaaataacaacttttgacatcatgggggtgtgtgagagaaaaagaaagaaaaaagggaattattcagatgatgttgattccaatagtgttgagaatgtagtagctatgtgggagaggagactttcgttgaaacttctgcttgctgccttgaatggaaaggattctgcagtagccacgtgcagattttgcaggctcatgggtactaccactgctgagctgttgttgaatcggtttaaggatacttag

SEQ ID NO: 76062 - DNA, 147 bp, Glycine max
  Peptide Sequence Number=SeqID_167747
atggaaaaaacgcaggagagaaagagtggacggagcagaaacagaaaaaatccaggaaaacagagaatgaacaataatacggagtggtttgagaattatggagcattcaatggagtagggcaagattggaggtggagagtcatctga

SEQ ID NO: 76063 - DNA, 825 bp, Glycine max
  Peptide Sequence Number=SeqID_167748
atgaccggccctctcgatgagtcaatctcttgctttctcataaaggtggacccttgggtactagtacctatcacctttagaggactgtatgtcctcgccatcagaggactgcacatcctcgcctgcagagggctgcacaccctcgcctttagagggctacgcatcctcattttcagggctagtagtttccttttatcggttcctgggccaccccttgatattggagggcaaccaactgtgcgagcacatccagagagggagactatcacgcatctactatgcataccggggcaagatttcacccgtgccgctgcaaaaagacgagtgcggatcatgcgcaccaacatgaccaatcttacgtggatatggatgatgttgccatttagcaacattctgcccagcgaccacaatgccaatctccgcctgcagatgtatcggttgggatcacgcccacaagacgcccagtggacccgaagaagtccaacagggccctggggtttccagctctggttacgggcctctatagtcctacagggtgcccgttccctcggcaatgtcacgtcatcatggcatagggatcacgcctgcaagacacccagtggactcgaagaagtccagcagggtcttggagttttctacggagtgcctgtcacctccagcaagggcatcaggccccctactaatcgagctttcatcaagaagtactgcgtccccaggcaggcacagggcgaaataccacagcagcctagggatggccggcagcgggcaacagacgcaccgccatcacctctagagttcacctcagctcatccacaaaaaggttag

SEQ ID NO: 76064 - DNA, 612 bp, Glycine max
  Peptide Sequence Number=SeqID_167749
atggtctgtaatgaccatgttgatatgaccggcagattgcttgctggctcattcacctttgaatgtcgcattatgcattttatcctttgtcgagttttgcttccacgttccaccaatcttgctcaggtctctgaggaggatttaatcttgctatgggctcttcaaatcggtcaccaaattgattgggcccatcttgtcaggtaccgtatgcataaggcattacgggccaatgcacctctttcgtatcctcatcttgtcactctatttcttcattatttcaatgttcctttagaggatgaaccttttgttaaggttaaaagatcatttgctattgatgctggtgctttcacctcctttgggtaccggaaggatatggatggccaatggatgcgtaaacaagaccttccacctcctattcctgatgaacacacaccctccctaccaccacaacgagatacctcctattccttattgaatgacgttctcactgagctacgggatctttgggctttcatcggcgatcgcttcaatgcaatggactcatgtatcacgcgtctcgaagacgacatgagcttcattcgacattgctttgatcctcctgtggattcttag

SEQ ID NO: 76065 - DNA, 90 bp, Glycine max
  Peptide Sequence Number=SeqID_167750
atgccaaaagataggggggggattgtcatcatcaaaaagggggagattgtagaagatctttggtgttttgatgatgatcaaaaagcttag

SEQ ID NO: 76066 - DNA, 447 bp, Glycine max
  Peptide Sequence Number=SeqID_167751
atgggtaaagcagaggaggtgcaagagaaggtgaaggccgacatggaggccatgaaagagaaaatggccacaatgatggaggccatgataagcatgaagaagatgatggaagccaatgcggttacaattgccgctaccagcactgttgctaaggtgaacccgatgcccccatctggcctcaaccaaatgaatcatccaacctcagctatgataggcaagatttgggaagtacgggcggcccccatgatgtgcaaattcaaaacgagcacgccttctcgccatatggcttgcctctcaactatacaccacccaatgtggcgtacactcccaataagaatgtcaataattccactcctatacccattgagagccaacaatcctaaactgatcatgcacatgtctcttaaactgtgggggagacacatgaaattccccaccacaatctag

SEQ ID NO: 76067 - DNA, 243 bp, Glycine max
  Peptide Sequence Number=SeqID_167752
atgcagagttcacaacgcgatgtctatcttggagcctacctaaatggttccactgcagcggacactggaagatggtgtgcgttaaaaggtcttgatgatgctccacagcctaaatcaaaggtttcagctaggtggattgtcgtcaagtattttaaagatcctagaccattggagccaaagagattaaaggcattgcggatccagtgggcacagttttatctccgagttagagatcaagcctag

SEQ ID NO: 76068 - DNA, 740 bp, Glycine max
  Peptide Sequence Number=SeqID_167753
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccaggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 76069 - DNA, 60 bp, Glycine max
  Peptide Sequence Number=SeqID_167754
atggttcaaggcaaatttgtcccaaatttgagggagttattatcaaggaatgaaagctaa

SEQ ID NO: 76070 - DNA, 216 bp, Glycine max
  Peptide Sequence Number=SeqID_167755
atgacaagggctagaacaaagaaggccaaggaagctcttcaacaacgagcgtctgcgaagcgcaacactcagtggctaagtgcgaggaagaatccagaagaagatgagttgtacaggttcactgagcacaccgctccaggtcatcaagcgcatcgctttaactcatccgctaagcgagagaagcgcgctaagccaaaaatcactaatgtgcgctaa

SEQ ID NO: 76071 - DNA, 726 bp, Glycine max
  Peptide Sequence Number=SeqID_167756
atggagaggagtatgattgatgcagccagtggtggagctcttggagatatgactcatgttgaggctaggaatttgattgagaagatggcttccaactcccaacaattcagtgcaagaaatgatgctattgtccttaaaggagtccatgaggtggccacagattcatcttcatctgctgaaaataaaaagcttgagggaaaacttgatgccttggccaacctagtaactcaacttgccatgaatcagaaatatgcatctgcacctgttgcaagagtctgggtcaatgttcatttgcagatcaccatacagatctctgtccttctttgcagcaatctggaatacaatccaggttggaggaatcatccaaatctgagatgggcaagtcctccacaagaacaacagcctatccctcatttccagaacactactggtccaagtaggccatatgttcctcctccaatgcagcagcagcagcaacaacaacaaagacaacaagaaactgaggccccttctcaaccttccttagaggagttagtggggcaaatgaccatccagaatatgcaatttcagcaagaaacaagagcctccattcagagtctgacaaatcagatggggcaaatggctactcagttgaaccaagctcagtcccaaaattccgaaaaattgccttcacaaattgtgaaaaatctgaaaaatgtgagtgccatcaccttgaggtctggctag

SEQ ID NO: 76072 - DNA, 433 bp, Glycine max
  Peptide Sequence Number=SeqID_167757
gctgccgtcccttgggacggacgtgtggggtgctaataccatccccgtgcgtaaatacaactcccgaacctttcacttaaaagttcgtagatcgcgtcttttccggtttttccgacgttttcctcaaataaacgttggtggcgactccgcgcgtattcctttcgtggaacacgcatcccgcgagtcacgcgtcgccctcccgccgaagggtaggttgcgacactccagaagcaacagccttctggaggaaggatctggaaggcccaagtgggccagattgctattcgtacccccctttttactaaatgcacccccttctacttttttgctttcgaagaagttacggaaactcacggattacgcaaaaacacctcttttcgatttccgccacattatggaatttcacggattgcgtaagcctgcttccttttga

SEQ ID NO: 76073 - DNA, 252 bp, Glycine max
  Peptide Sequence Number=SeqID_167758
atgctgacatctccggaaagggcgcagatgaccacattggcctctgctcatcaatcacacttggggtcactgaatgacgaggtggggataaccgtaaggtgtctccgtgggctaccagctcttgggtcatgcatttcgtttctaaatgaccatttagaggaaacactgggttcgacaaaaatagaagaaaatcactcaaagtgtatcaatctcgcacaggacttcccttgggaatgggttcttttggtgtaa

SEQ ID NO: 76074 - DNA, 126 bp, Glycine max
  Peptide Sequence Number=SeqID_167759
atgagaggttttgagtcggagtgcaaaatcaaggtcaaagaagatgagacgcaggattggcaaaaggccatgcttgaaggattcgcgccttgggtgaatcatggtggttgggtcccttgccaatga

SEQ ID NO: 76075 - DNA, 1175 bp, Glycine max
  Peptide Sequence Number=SeqID_167760
atggatgatcctatccaccttgagacgtttaaccatgattgcttcagggagcttctagtgaacaccgctgagttgaacaaaatacgctctcaggatctagactttttccttgtgcttgatttagagggtagggttgagattcttgagtttccagttctaatgattagtgcgaaaacattgcaagttgaagacattttccacagtggaaattgggatttgaaaacaaaggtccctcagcaatgtgaagtgtcaaagatagagcttcctccatattttatggagtggattaatctcaaagatgtctatctgaacttttatgataggagggccacaggaatggttacaatgatgaaggaactacaaataccaatggtgggaagtcatcatcttggcattgatgacactaggaacatagcaagagtactgcagcacatgctactagatggtgcactcgtccagattactgcaaggaggaatcctagatctcttagagatgtcaagaaatcagatgaagccaatagcagcaactcttcagaggtttttcattctttaatgataaaacctagaattaaagaagacaacagaatgccgatatttgccgtcaaagcagatggaggtgtgatatattcagataaagtaaatgaacactttatctgggatgttgctccagcaatgtgtgattcagactgttcttgtgatgaacatgatggagacacagatgaagagacagatgatgatgaggaggatagatggaagctagatccaaggccttgcaaactgcctccaccaccgcaaagaagaagcgaccccgagaatggaccatggacggggataaagaagaaatacccagaagaccctttttggaaagaaaaaaggatggcggaaatcctaggttggacacatccatccctaaagattccggcagcacctataccttgcatgatgttttcctccacatcctatgatcaagagtttccatttcttgacaaaaagacagacccaatgacaaaggtttcaaccaagccctacataattccgacagaagtagggccagaaggaaagctcaaaagccctagccaggccgaagaagtcttaaactggcagacagataatgccagagctcagaatcatttcttgaaaaagatagatgagaagattgacaggatatgtaccct

SEQ ID NO: 76076 - DNA, 546 bp, Glycine max
  Peptide Sequence Number=SeqID_167761
atggagagaagttctaatgattcccttgatccactttctgattcatcttttgacaatcgaggctcaaaaccttctatgtcttctagtgaagcaattcaaaatttcaggactgcaaccaaggtgagtgagatgctgggaaatgtcaatacaagtagtgctctttcagcttttgaaaagatggaagagaaaggtggtgttggcgacgttggtagtggttgtggtgacgatgacaaaggtaatcttattggtagtggtggtggtgacaatgacggtgatggtaacaatattaatggtgatgttgatatcgatgacaatgatgatgacgatgatgatggtgttggtagcggcaccaatggttgtgacaacattggtaatagttgtggtggcagtgatgaaggtggtggtggtagcggtgatggtgatggtggccgttgtgttgtggtagctagtaatgacaaaggtggtgggagtggtaatgacaatggtgatggtgatggtggcaatggtagtgatggtgacagcaaagagtatcattgtcaaatgtga

SEQ ID NO: 76077 - DNA, 222 bp, Glycine max
  Peptide Sequence Number=SeqID_167762
atggcaggagctagtgatggtggtggtgattatcatcaactagatggatctcagcatttgttattggacgtaatgacaacacagatgcaacaattgatgaaccgtaacaatgaagagctctatggacgaattgaaggcaggagtgacccagacgcctaccttgattgggagatgacgattgagcatgtattctcctgcaatgattatactgaagaacggaag

SEQ ID NO: 76078 - DNA, 585 bp, Glycine max
  Peptide Sequence Number=SeqID_167763
atgattcttcctcctccatccctccgtgtcgttttaccaccccgttgtcgtcatcagattgcattgtcgccgttaaggtcgtctccaccaccgctgttccttttttgccgtcaagcatgtgcacgtaggcaacgggaagctgcccctagttttgaggatgttcagcacatggatcacgcagctgatgaggtccacgaacagcctaaagaagcaactgttgatgatgaagttgttgatgtcgagggttttccaagcggactacacgacacatcagttctgaatggctatgctaatcatgttgcagtcattgtatggaatagagagggacttatatcggtttttgcggagagatggcataatgaaattagcagtttccatcttcctgtagtagaggtgactatcaccctcaatgatgtggcctttttgcttcatctgcccatcacaggcgcattccatagctttgagactgttcatgttgaggaagtggtgttgctattagtcgaattacttgaggtgagtgcagatgaagcaagagctgagacaatacaatgtcatggggcatatgttcgactatcatggctatga

SEQ ID NO: 76079 - DNA, 177 bp, Glycine max
  Peptide Sequence Number=SeqID_167764
atggtggtgtttgggggcgattttgatgatgatggtgctaagagtaacatagcgggttcacaggccaccgacgaggattttctccaccttcacttcaccgtcgctggcgtcaagatttccgcactagcgctccggcggcaccatcgacgtcactggcctgatgcagggcaagactga

SEQ ID NO: 76080 - DNA, 411 bp, Glycine max
  Peptide Sequence Number=SeqID_167765
atggcagctcgtggtggccactggtggtcgtgggtggtggaaaaggtgttagggtttgggtgggagtttggagagggggagagggggaaaaatcgtgtttttcacactgaagaacatatttataatctgcaaatctcacttagcgagctcgtcttgctaagtgggagtccacttttcgcgcttagcgcgacaattcatgctaagcgtaactccctctgcactaattctcgctcagtgcaattccctctcgggttggaattgcgcttagcgagacatcagaacttgttatattccaaatccaaacggaagagaccagtcactagagtcatgagcaagaggctccaagaggattggactagagctgctgaagaaggccctagggttctcatgaacctcagggtagatttttga

SEQ ID NO: 76081 - DNA, 335 bp, Glycine max
  Peptide Sequence Number=SeqID_167766
atgaggacctctaaggctcgcccaggcgagctaaggcttactcctaaagtcatgagcttgcccaagcgagctagagcttggccaggggagccagatgctggcctgggtgagctggggcctagaaaatgcaaggaaaagacccttttgccctcctttcttgaagatcaacgaacaatggtccctgtcgcaacctacccttcggcgggagggcgacgcgtgactcgcgggatgcgtgttccacgaaaggaatacgcgcggagtcgccaccaacgtttatttgaggaaaacgtcggaaaaaccggaaaagacgcgatctacgaacttttaagtgaaag

SEQ ID NO: 76082 - DNA, 378 bp, Glycine max
  Peptide Sequence Number=SeqID_167767
atgaccataatttgtctctgcgtgccatcggacacgactgtgtctgaatggcaaaaggtgtgcggaatgaccataatttgtctccgcatgtcatcgggcccgccgcctctggatgacaaaagggtgcagaatgaccataatttgtctctgcgtgccatcagacacgactgtactgaatggcaaaaggtgtgcggaatgaccataatttgtctccgcatgtcacatgacctcagggtcagtggggataaccgtaaggtgtctccgtgggctaccagctcttgggtcatggtaacaaaaagcggtgtggtcgacaaaagcgaggcttttgctcctacgtatcctccaatgaggaactcagacctacgtagttctggataa

SEQ ID NO: 76083 - DNA, 476 bp, Glycine max
  Peptide Sequence Number=SeqID_167768
atgaggacctctaaggctcgcccaggcgagctaaggcttactcctaaagtcatgagcttgcccaagcgagctagagcttggccaggtgagctggttttccttaaccctaaagttttttatggcctaggggagccagatgctggcctggagatgttgttgaattacaagagtatgtggaattggatgacttactacataaagcagtacgggttgaacaacaactcaagaggaaaagtgcagcaaaaaggaactcatccaacaatttcaactagaactggaccaacagatccgagaaggagggagacaactcgtccaatccacatggaaagcagaggacatattgcttctaactgtccaactaggaggactatgatcatgaaggtagatggagaaatcaccagtgaatatgaaatcagtgaagaagaagaggtggaagaagagctcgaggaggaagctatgcaacatgatagcgaatg

SEQ ID NO: 76084 - DNA, 954 bp, Glycine max
  Peptide Sequence Number=SeqID_167769
atggcccagatgacatcaaaggcagcaaaagaaattttggatagaattgactcgttagaagagcagacgacacagggtagttttgttccccatggttgggatgacatcttgaatacggccattggcaaactggaacatccaggtcaagcattggctgcacgtcttagcactaaaggaagtaatgtagaaactgctgatgttgacccatcaggcaacaaaaatgtgagcttaaaacccactatggggttatacgtgcaacgacaacatactacagtgttggtggccttggggaaaatatgtgaggggggatctgccattcacaatgtcacttatgttgatgatgttgtaagggtgagtgttgacaaagttatagaaggtgacgccgaagtgcccttcccgacatcaaagattcaatatgagttcgatactagtccaaggaaacttcctgaaacaaatgaaagggggacgaatgattttgaccatgatccgttgcgtcaactgattaaaagcctatatttcatgtacgacacacctgttgagttgaagtgggatggaagcaaatttgggctttcaaatgttgatgcttcattcttcttgacattctctgatgtaaatgaaatagtagctggatacaaatgtttgaacatatctatactacagttatggatgttgtttttggatgagtggagctcaactttaggtcatgcttccgtgtatggattccttgagccacaatcgatacaccatgcaaaggatcgacgtgctgaatgtgagcattacttacaagcatggctcaaggaatcgcaacgagaggggccattggcaactggtagtactgtgtcctacgaccaatacgttgatcatgctattattataagcagtgcaatgaagtcagcaaacacaactgcgaaaggtacaaataatccagcaactcctaagtggattgaagtcaag

SEQ ID NO: 76085 - DNA, 93 bp, Glycine max
  Peptide Sequence Number=SeqID_167770
atgggagaaagtaaaaaaaaacaagaagaagaagaagaaggaaagaaagctcctgatcaaggatcgaaagaaaaagaagaaatgtgcagaaag

SEQ ID NO: 76086 - DNA, 231 bp, Glycine max
  Peptide Sequence Number=SeqID_167771
atgtcatcagcattacacatttttcatgattcaaaaccttttgcattactagcatttcaagagaaggttgcaagcatctgtatcccaaaaatcatgttcatattaggctacaacggaaggaaaaggagaagaggagaagggaggcaccatccactagggaataagccaaggaagaaggagcttcaccaccaagaattgccttggataagaagcttgaagaggatgctttaa

SEQ ID NO: 76087 - DNA, 423 bp, Glycine max
  Peptide Sequence Number=SeqID_167772
atggcttacgaacgggggggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccggtgtcattccgctgttatggccgcgtttgtctcattccacgcctgacactcagttccggtccgaccgctgcgccttatccggtaactatcgtcttgagtccaacccggaaagacatgcaaaagcaccactggcagcagccactggtaattgatttagaggagttagtcttgaagtcatgcgccggttaa

SEQ ID NO: 76088 - DNA, 123 bp, Glycine max
  Peptide Sequence Number=SeqID_167773
ggattccttacaatcaaaaccataagcacaaatgagaagttcgtcttcatagggaatagagtgaaagctccagtggaagcagtcaggacttatcatttaaaactcgacactggcattatttag

SEQ ID NO: 76089 - DNA, 270 bp, Glycine max
  Peptide Sequence Number=SeqID_167774
atggctaagtttgaccctgaggtagtcctggagttttatgctaatgcttggcccacagaggagggagtgcgagacatgcgttcatgggtgaggggtcagtggattccttttgacgtagatgccctcagccagttcctaggtgacccgctagtgttggaggaaggccaggagtgcgagttcagccagaggaggaacatggccaatgggatttcgcccggaacgctgcagggaggcaagtgtggatcatgcgcaccagcatcaccaccttga

SEQ ID NO: 76090 - DNA, 225 bp, Glycine max
  Peptide Sequence Number=SeqID_167775
atgaacccagatttcaaccaaccacgaggcgggtgctcgcgggaggtcagcatacaccccgcgcagcaacattgttacatgtttgcgttggggaaacgatatttgagttccttggcgcacgaagcgccggggtttgtgtttgtcgcgaggacgaggaggccgggcgcacggggcgccgtggtcatcccctccctcccgacggtagatgaatgtgggatcctctag

SEQ ID NO: 76091 - DNA, 267 bp, Glycine max
  Peptide Sequence Number=SeqID_167776
atgtggaccaccacgggcaaaataggggaggagcttgccacccagctcgccccaggcgagcaaggttgcttcctccagaagcaacagccttctggaggaagaatcaggaaggcccaagtgggcctgattgctatttgtacccccctttttactaaatgcaccccctttaccttttttgctttcgaagaagttacgaaaactcacggattgcgaaaaacacctcctttcgatttccgtcacattactgaattttcacggatcgcgtaa

SEQ ID NO: 76092 - DNA, 2565 bp, Glycine max
  Peptide Sequence Number=SeqID_167777
atggagatcagcgcgccgaacacgttcggcacccacaaaggcgtcgtgctgacgcatttcctgttagtggcgctggcgacgtttctactcgccttgctgagcctgtcgctgtccagcgaagccagccacttcaccccgctgtggtttccgaccgccgccgcgatagcggtgctgtaccgccacgccccgcgccactggggcctgccgctgttggccagcggcctcggcatcgtgctcgccagcttcttgctgttcggcgtcagcgccacgcccatcaagctggccgccatcaacctgctggaagcggcggtttgcgccctgctgttgcgccgcatgctagacccgtacgatccgttgaacgatctcgccagttggctgcgttttgtggtctgcgcagtgatttttaccccgctgttcagcgcgctgctggccgccggcctggtgcccgcgccaggccagcctttttggcagccgttcggtacctggttcatttccgaagcgataggggtgctgtcgctggcgccgatcggcctctcttataaccgtcgcaccctgacggcgctgaacccgtttccattattgctgacactgatggttacgctggctttcagctttatggcgctgacctacctgccttttccgttcacgttcgtgattttgccgctgctgtgggcagccatcgcactgccgcgttttgaggcgttcaccgtttgcttctgcaccctcttgctgatcaccgtgatgatttcgctagggttgctgcatttccaggcttccggcaagcaccttggcgatctcggtctgtacttgccgatgctgctgattttaatcccggcgcacgcgatggcggtggtgatgcacgcctttcgggtggagaaacagcacatcgtcgagagcgaaagccgctttcgcagcgcgctggagtattccgccatcggcatggcgctggtgtcgccgcaggggaaatggctgcaggtcaatcaggcgctgtgcgcgctgctcggctatacgcccgaggcgctgcataagctaacctttcaagaaattacgcatcccgacgatctcaccgccgatctcagccagttgcacgacctgctcgatggccatatcagcagctacaccatggagaaacgctacatccgcagcgacggccagaccgtctgggcgctgctggcggtctcgctggtacgcgacgccgaagggctgccgctgtacttcatctcacaggtggaggacatcagcgatttgaagcgcagccaggcggaaaacaaccggctggtggagcgcattacgctggccaatcaggtgggcggcgtcggcatctgggaatgggtgatgagccaggaaaacttcacctgggatcagcgtatgttcgaactctacgatctcaatcccgaccaaacgccgacgctggcgctgtggcgcaccctgttggtgccggaagatcgcgaccgcaccgatcgcgagctggccgcgctgttggccgaccccaagcctttcgtcatggaataccgcatcgtgacccgccatggcagcgtgcgccatattcgcggccagggcaacgtgatcctcgacgatcagggccggccgctgcgcatgatcggcaccaatatcgacatgaccgagctcaagagcctcgccgaagcgctgcacgaggagaaagagcgtttgcacatcaccctcgacgccatcggcgaaggggtgatctccaccgacagccacctgcgcattacctttatgaatccggtggccgagcagatgtgcggctggccgctcgatctggcgatcggtatgcccgtcgccggcgtggtgcgcctgaccaacggcaaagacggcccggaaatcgaaaacctcacgcaatatccacggcagtggccggcggattacgcattggtgctgcacagccgcgacgggcgctatttcgacgtgcagcagtctgtctcaccgctgaaaaccctcgacggtgaaaccatgggcgcggtgatggtgctgcaggatgtcaccgcctcgcgcgaactgatgaaaaagctcagctacagcgcctcgcacgacgcgctgaccggcctgccgaaccgcgccagcttcgagaagcagctgaaagcggcaatcgtcgccggcggggaaccgtcaccgccgcattcgctggtgttcctcgatctggatcggttcaaggcggtgaacgacaccgccggccacgcggcgggcgacgccttgctgcgggacatcgcccagctgatgcggcaccagctgcgcaacagcgactgcctggcccggctgggcggcgacgaattcggcctgatcctgttcgactgccggccggagcaggccaaatcgctgatgcaacaggtggtcaaccaaatcagccagcatccgttctactgggaagggaaaatttatcgcgtcggcgccagcgccggcatcacgcgcatcggcggcgacgccaaaagcagcgagctgctggcccaggccgacatcgcctgctacaccgccaagcaccacgggcgcggccaggtgtatctgtatgaagcgcggcaaaaacagctgctggagcggcagcatgaattg

SEQ ID NO: 76093 - DNA, 321 bp, Glycine max
  Peptide Sequence Number=SeqID_167778
atggcgccaggccagaacggcgacgatgatcgcaatcgccgcaaccagcaggcgcagcagcagggaacgacgttgggcgaagacggcataaaaatgaaggaaatatggaggaaccgtcagcattgtcctaataagtgggcaaatcatttaacccatggagcctttgtgatgagcaagaaacaactgggccgttcaggcattcaggtgccggcgttaaccttcggcggcaacgtgttcggctggacggcggatcaagcgacctctttcagcctgctggatgcgctggtggacaatcagcttaactttatcgataccgccgat

SEQ ID NO: 76094 - DNA, 342 bp, Glycine max
  Peptide Sequence Number=SeqID_167779
atggtagccataaccccagccaaggttcatcaacctccatttctccgagaatacgactcgaacgcaacgtgtgctggtcacagagaagccccgaggcgttccatggagcattgtagggctctgaatcgtaaggtgcaagttacaatgttaaatgaaatggatgaagttgatatctttgttcctcatcctctcacaaacgcatctttgcttattcaactttcaccggaatgtgggtgcaagccattggtctgtttgctcaagcgacctgtgctcctgagtttggacttccaagacctttcaatcagagattactcatcttgcacgttgttgggagcgccgtaa

SEQ ID NO: 76095 - DNA, 688 bp, Glycine max
  Peptide Sequence Number=SeqID_167780
gggatggtgggtttatgcgcgcattgtggatgtggaaaacttgttgtgcaccatcgcccgaccgccacctagtaccacatgtgatggagtggtacctggagatatgtcgcgggggttaggagaccttggggacgtcaggcgagctcctggcagtcaacagataaaaggagaacaagaccacaaagcaaggaggcttgtggtggctggccagctgcttgaaaacgaagtcaggaagctaagggagcctctgatcgtgatggcggcgcagctaatccgtgatcgagtagagatggagtgcctagagggagcttgggagaccctcgaaggcaacacgaggtgccgatttcggggcaccattcgattcacggctacttctttggtgcatccagatgaacctgcacggacgcttcagcgcactgtggagtggatactacccacgcctacaccatatcgtctagtggagcccgttcaagtgatcgaggtaacgtcatccgaggaagaccctgaggaggacctggaggagctacctcctgagcctgctgtggatgcccttgactttctagagggtgatgaggatccacttcttgaggtggattctcccgaggaagtcatgtcggcatctgaggcagactctacggaggatagtggcccgagggagatggcgatcagcggaggctcttcatcctag

SEQ ID NO: 76096 - DNA, 681 bp, Glycine max
  Peptide Sequence Number=SeqID_167781
atgcccacattggccttccagggtgttccaaaagaaagtgaggcactacacttcgaggtacttcacgccctcgcctttagaggactacacgtcctcaccttcagaggactagacgccaacgccttcaggggactacacgtcctcacctttagagggctacacgccctcgctttcaaacggctacatgccctcgcctttaaaggactagacatcctcgccttcagagggttacacgtcctcgccttcagaggactacacgtcctcgccttcagagggctacacgccctccccatcagagggctacacgtcctcaccttcagaggactacacgtcctcgccttcaaagggttgcccgccctcgccttcagaggactacacgtcctcgccttcagaggactacacgtcctccccatcagagaactgcacgtcctcgccatcagaggactacacatcctcgcctttagaggacttcacgtcgtcaccttcaaagggctacacaccttcgccttcgaagggctacacgccctcaccttcaaagggctacacgtccttgcctttagaggactacacgtcctcgccttcagagggctgcaagacctcacctttagaggactacacgtcctcaccttaagaggactacacgcccttgccttcagaggactagacgtcctcaccttttag

SEQ ID NO: 76097 - DNA, 234 bp, Glycine max
  Peptide Sequence Number=SeqID_167782
atgtctgaagaaattgatatgaatgttgaaaataaggaagatgctggcatgaaagtagaacatgttgattgctctgatgcctttaatacttctcggcttgcgaaaggagtggtgagtatagacctaagaagactgatttggttagaacatgcattggcagtagaaaatgtcgatgcccatttaagttgcatgcgaagccaattttgggagaagaatgatggatggggaagttaa

SEQ ID NO: 76098 - DNA, 171 bp, Glycine max
  Peptide Sequence Number=SeqID_167783
atgagggtcaccaccatacagcaacatcaatcttcggacagtaaagaggaaagtcagcgccctgtgcatagagaagagacaacaaattggggggtggaggaagaggcatgtgaaggagaaagggagaggcaagaagcaaccacaatatgggaactcgcaaagaagttgggg

SEQ ID NO: 76099 - DNA, 528 bp, Glycine max
  Peptide Sequence Number=SeqID_167784
atgaaaagagaaaaacttgcctcctatagtagtcataactcttgcaagagcctaagtgaagaactttgtgactattatgaaggaaggcataggtcacatcttagacctcactcccataggagagacaaggaaagaaagcctcaagaggctaacattaacctcccatacttccataggaaggacaatgtagaggctaacatagattgggaaataaggaaagaccaaggtcaaggcatcttaggggtgactccttctaagcccaaagatgataaggggaagacaatagaaaaacaaccccttaaggctagtatgcaagagaagactagctccatgaagtgctttaaatgtcttggaagaggacactttacttctcaatgccccaccaagaaaaccatgattatgaggggccaagacatttatagtagcgaagatgaggctagtacttcaccttcctctagtgaaagtgaagaagcaaaagggaaagaatctagtgaagaaatctacccccaagaagaagggggagtgtaa

SEQ ID NO: 76100 - DNA, 336 bp, Glycine max
  Peptide Sequence Number=SeqID_167785
atggtgcaaaagaaggacgaggaacttaggggaagtagcaatgggcccatcagtggttaccataggtggttgaaagcctacgcacaaggtctggattggctcccgaatttgagaaccactaaggagatggagggtgaagctccgaaagaagacaaagaggtacaagccctcaaaacagagcttgagaaagcccaaacagccaaagaaaagttcaagtcagcagttgttaggatccgaaaagagaacgccgaactgagagacgtcaacatagccaccaccaatgccttggagcaaagagaccaagagggcccgcgaggaagaacatggccggaataa

SEQ ID NO: 76101 - DNA, 228 bp, Glycine max
  Peptide Sequence Number=SeqID_167786
tctgaccgttgggattttgaaaataataattttggtcttccgcaaagcgagaatggcgcgctaagcgcaattccaaccaaggggaattgtgctgagcggcccaaagctgtgctaagcccaattccaactgaggggaattgtgctgagcggcccaaagctgcactaagcccaattccaaccaaggggaattgcgctgagtggcccaaaggtgcgctaagggagccctag

SEQ ID NO: 76102 - DNA, 871 bp, Glycine max
  Peptide Sequence Number=SeqID_167787
atggcatataagaaaaggaaggcttcttatacacctacccaggccagatatgacaaatctaggttcacatctcaagaagcttgggagagatatacatatattgcggtgcctaagaaactactaccggagaggaatgtggtagtttattacactgagtttgacgagttcaaggaggaactcgagagaagacactgggatgaggagctaactgattttgctgacagcaacatagacattgccatagtgaaggaattttacgcgaacctctatgaccccgaggataaatcacctaagcaagtgaaggtgagaggtcatctagtgaaatttgatgaggataccttgatcacatttctgaagacccctgtaattttggaggagggggagaatttatgtacttattccaggtttacactcctgaggcctgatcctcaggagttggctgctaagctctgcatcccaaggaggggatacgagctaaatgctgatgggcagcctttgaagatactgaggaagaacatgagcaccttagctcaaacatggagtgttttttccttctctaacctaattcctacctcccacacatcttatgtcaccttaaacagagacaaattgatttatggcatcatgatgaagatggatatgaatgtggggtacctcatctcccaccagatctctctgactacacagcatgatacatccagacttggattccttgccttgatcacagctatatgcaaggccagaggagtccaatcagattctagatccctagagagcttgagccctaccattaacttggcatatattaagaggaattgttggaatcttgatgatccaacagtgacatttagaggaccaaggaaggccaggg

SEQ ID NO: 76103 - DNA, 273 bp, Glycine max
  Peptide Sequence Number=SeqID_167788
atggtcaaataccgcgccaaatccaagacagagatgaaccgagggttagctcgcttgggcgaacaccccctgcacgaaatagtttttttcaccaagggcaagggcaaggatccacttgaaggacttggaggacctatgacaagggctagagcaaggaaagccaaggaagctcttcaacaagtgttgtccatactatttgaatacaagccgaagtttcaaggagaaaagtccaaggttgtgagttgtatcatggctcaaatggaggaggactaa

SEQ ID NO: 76104 - DNA, 312 bp, Glycine max
  Peptide Sequence Number=SeqID_167789
atgtccaacagggtcctagggtttccagctctgattacgggcatttgtcaattctacggagcgctcattgcccccaacaaggtcatcagggcccctactaaccgagctttcatcaataagtactgcgcccccaggcaggcgcagggtgaaacaccacagcagcctggggacggccggcagcgggcaatagacacaccgccgccacctccagagctcctcaactcatctacaaaggctggagcgttgcctacgacccgtggtcgaccagcaggcgaccaagtccaaagccaaaggcataagctcggaaggtag

SEQ ID NO: 76105 - DNA, 117 bp, Glycine max
  Peptide Sequence Number=SeqID_167790
atggcgagtgcgatgacatgcgggggtaccttatggttttactttcatcatccagagacattcaagtctgacaacacgcaagattcttctctgctaggcagggacaatcgagtttga

SEQ ID NO: 76106 - DNA, 245 bp, Glycine max
  Peptide Sequence Number=SeqID_167791
ttgcccccaacaaggtcatcagggcccctactaaccgagctttcatcaataagtactgcgcccccaggcaggcgcagggtgaaacaccacagcagcctggggacggccggcagcgggcaatagacacaccgccgccacctccagagctcctcaactcatctacaaaggctggagcgttgcctacgacccgtggtcgaccagcaggcgaccaagtccaaagccaaaggcataagctcggaaggtag

SEQ ID NO: 76107 - DNA, 783 bp, Glycine max
  Peptide Sequence Number=SeqID_167792
atgggctacgtgggagtacgtgagctcagttggaggtgggcaacaggggatggtgggtttatgcgcgcattgtggatgtggaaaaacttgttgtgcaccatcgcccgaccgccacctagtaccacatgtgatggggtgaaacttcctgcttttattgttgaccacagagtggtacctggagatatgtcgcgggggtcaggagaccttggggacgtcaggcgagctcctggcagtcaacagataaaaggaaaacaagaccacaaagcaaggaggcttgtggtggctggccagctgcttgaaaacgaggtcaggaagctaaggaagcctctggtaatcgattaccaagggatcgtgatggtggcgcagctaatccgtgatcgagtagagatggagtgcctagagggagcttgggagaccctcgaaggcaacacgaggtgccgatttcggggcaccattcgattcacggctacttctttggtgcatccagatgaacctgcacggacgcttcagcgcactgtggagtggatactacccacgcctacaccatatcgtctagtggagcccgttcaagtgatcgaggtaacgtcatccgaggaagaccctgaggaggacctggaggagctacctcctgagcctgctgtggatgcccttgaccttctagagggtgatgaggatccacttcttgagactctacggaggatagcggcccgagggagatggcgatcagcggaggctcttcatcctagtggacagctttttggattagttttgtatactttttga

SEQ ID NO: 76108 - DNA, 206 bp, Glycine max
  Peptide Sequence Number=SeqID_167793
atggctgatggaaaactgatagagatgaagggtaaaattaacctagggcaggcacagggtgaaacaccacagcagcctggggacggtcggcagcgggcaatagacgcaccgccgccacctccagagcccctcaactcatctacaaaggctggagcgttgcctacgacccgtggtcgaccagcaggcggccaagtccaaagccaaag

SEQ ID NO: 76109 - DNA, 288 bp, Glycine max
  Peptide Sequence Number=SeqID_167794
atggaggagttccttagccaggtggcttggctaggcgtccaaccttctcctttgggagggggtgaggccttcgcagcccaagagcctaaccttgttcctcctgagccgtttatcattgagacagatccagtcgctcaggagcctatttctctagttcctatgtctccagcacccattactaatgattcccagccatctgcaccagcatcagagccagaacagcctgttcttcaagaccctccagctgcaccggtgttggacctcaacgaccatgcagaggatgattga

SEQ ID NO: 76110 - DNA, 871 bp, Glycine max
  Peptide Sequence Number=SeqID_167795
gctaggtatgatagatcaagatttgtatcccaaaatgcttacgactgctacgtagacaatgcccttggccaaaagatccttccgaaaaggaatgtgaagctgtacattacagaatttgatgaattcaggagagaaattgagaggaggaattggcacaaggagctcactaacttctctgaagggagcattaatgtggcattagtgaaggaattctatgccaacctttatgaccttgaagataaatcaccaaagcaggtgagggtgcgagggcacctaattaaatttgatgatgacgccctcaacacctttatgaagacaccagtggtcatcgaggaaggggacaacttgctctcttactccaggttctgcaggttgaggccagatcctcaagagcttgcaacccgtctatgtatccctaggaggggatttaagctgaatgcagatgggctgcctctaaagattttgaggaagaatcttactactctggaagccgcaaatctagggctagaggattggaggcaccatctacttcagctccttctacatcagctccttctacctctcctctccctccagcaccagcaactctatttttccggatccttcttattagagctccgagccattcttttctatgctgcagagcctgcatcaggactagcttttgatcatgcagagcttgaagaatttggtccaccagtgggtgaggcctccgcagcccaagagcctcagcaggaggacattctagaggttgctgagcgtacatctcctgagctattcactttagtgtctgatccagttgttgctggtctagctgtatctcctcaacctgagccatctgcacctgtgccagacctgcctctttctaagg

SEQ ID NO: 76111 - DNA, 621 bp, Glycine max
  Peptide Sequence Number=SeqID_167796
atgggaagccgctcctgcgattgccgcatcgctattctcgtgagccaccagggttcaattctaggtgttgaggtcagcatttctagaaaatcatattctactcaactggttgtcatggaagatgagaatgggaaccaaaattccgcgtcacctcaaaacggagggtttctcatcccgaatatatttactttaactataccgaagttatactacaaggccacaagagaagctggaggggcatacaacagtggtggaaatcatgtttctaacagatttctaaacaacttctggtacttagatcaacttggaatagcatcttgctacagcactaaagtctattgcaggcagactttaattggagggaactatggccttctcaataccaccacctttgctcttaatcctgactactacagtgcagttttgtggcatcggttaatgggaaagaaggttcttgcagtctcaagtgatgttcatattaaagacttttacctacagttaggaaatcctagcacatgggaagcttccttgagaagcaaggaaggtagcttccttgggaagctagaggaagaaaacttccttgagaagctagagcgagggctactcacacccctcccatag

SEQ ID NO: 76112 - DNA, 393 bp, Glycine max
  Peptide Sequence Number=SeqID_167797
atggaccctggagaagctaccatctgtaggctttgcataataataacttgtccctggaataagctttgcagcatagtggttgtgatttgggagctctgggcatctggtcctgttgatgcagacggaggcgctggagtagatgagagaagagctggaagtggaatctgtgaaggtgctagaggaatcactaggatctctatggaggaaaagggaggaagtgtagaagaagaaggtgatggtgcctctgatggtgctgaagtggaaagggccttagtaaaaattgccatcattcatctctggaaagtagctggggtattacataaaccgaacggaattagctcatctctatcattcttgaccactttcatacctccctttttcggaacaacttga

SEQ ID NO: 76113 - DNA, 444 bp, Glycine max
  Peptide Sequence Number=SeqID_167798
atgttgcaagtcagtgaaaatcaagaacttagaactcatattgaaggcgccttggcagcgagaaaactggctgacaatgagctaacagaaagaatgaagataaccgagagcttagaagatgaaatcctggaaatgaacagtgtttttagccaaatgaatgattcatttaaaaatctgagtagtgatctacatgatgtcactaatgagagggatcaccttcagggtcaagtaatttgcctcaaaaataggctacaaaaagctgaagcacaagttgaagctaatgaagcaattactcaagaagcccagaagaggaccaaggatgccttaccagaagaccttgtcttccatattaattaccctggagcttaccaacccaccatcaccctcaatttctctaaaggtgatttgattcattacaaagtatgtacacttcttgatccttga

SEQ ID NO: 76114 - DNA, 348 bp, Glycine max
  Peptide Sequence Number=SeqID_167799
atgcagagcttacagagctcaggtctgcagcctatgatgagcatggaggagttccttagccaggtggcttggctaggagtccagccttctccttcgagaggggatgaggctttcgcagcccaagagcctaagcttgttcctcctgagccgtttatcattgagactgatccagtcgctcaggaggaaccagcagctcaggagcctatttctctagttcctatctctccagcacccattactaatgattcccagccatctgcaccagcatcggagccagagcagcctgttcttcaagaccctccagctgcacaggtgttggacctcaacgaccatgcagaggatgattga

SEQ ID NO: 76115 - DNA, 282 bp, Glycine max
  Peptide Sequence Number=SeqID_167800
atgtcttcctttctaggaattgaattactctatgggttaagcccaccaaaagagggtacatcctttgtggtacaagtagagggtacatctacttgggttgttgtaactgagaacaagagagggtacatctcttgtggatcagttcaagtggagagtacatccacttggttgttaaaagagaacaagggagggtacatcccttgtggatctttgcttgtaaaggtttttacaaggttgaaaagaaatctcaaggaccgcaggttgcttggggactggatgtag

SEQ ID NO: 76116 - DNA, 367 bp, Glycine max
  Peptide Sequence Number=SeqID_167801
atgacccaacatgggttggtggactcagatgttgatggagaactctttttgagggatggctctaatagagccaatttaaatcctttacctatgcttctccctcctcgtagggaggtgcctgatgtcttaggtggcatgagaatttttctgtttatactaggaaactggttctgtgactcagatctagataaccttactggaattgaccgggttcttatcgagaaagaccttcttgccgattcatactcggatcttgaggcttttattctagatgaaaaagagtttctcctattgaaggttatttctaccttatcggaattatcttacctgatttgttctattgttggagcgggtctggggactgacg

SEQ ID NO: 76117 - DNA, 381 bp, Glycine max
  Peptide Sequence Number=SeqID_167802
atgcaagaagaagaagaagaacaacaagaagaagaatatgatgatgaagaggaactctcactctttgtgaagaagtttcataaattcctcaaaaatagaagaatggagagaagccataacttcaacaatgggaagagatctcaagaagtttctccaacacttaaatgctataagtgtaatcaacccggtcacataaaggcaaacttcccctcaaatgagtcatggcccgagaagaatgagaagaaaagctataaagaaagaagatccaagaaggcgtatatttcttgggatgacaatgactcatccgatggttcggagaaggagatcaaccttctatccaaggactatgaaaatgatgagaacatctctcaagaagtttaa

SEQ ID NO: 76118 - DNA, 138 bp, Glycine max
  Peptide Sequence Number=SeqID_167803
atggctactaggatgcctttacagttagcagatcgctccatcaccagaccttatggagaaattgaggatgttctggttcaggtgaaggagttagatgagaaggttctaaaggagagaaccaaggttgatccaggataa

SEQ ID NO: 76119 - DNA, 372 bp, Glycine max
  Peptide Sequence Number=SeqID_167804
atggttaaagcatgtcaaaagggggggaaaagagggaggtggttgccgcccagctcacccaggcgagctgggttgcttcgaccaaaaggcactgccttctgttggaacgccctggaaggcccaagattacgcaacaatgccctttttgacttctggaatgttgcggaactttacagattgtgcaataatgctccctttcgatttctggcatgttgcggaactttacgaattgtgcaacaatgcttcttttcgacttccgggatgtcgcggaacttcacggattgcctaacgatgggtgttaagtacctcgaagtggtcaagcaaaggttgcatgccaccaaacaatggtccccagacaaaattagggtatga

SEQ ID NO: 76120 - DNA, 186 bp, Glycine max
  Peptide Sequence Number=SeqID_167805
atgttttcaggtttttttactagttcttgtggaagcaatgtcttccaagattattttgatgatgacaaagaatcaagagtcaagcaaagttccaaagaatcaagagtcaagcaagtttcaagaatcaagatcaagattaaagattcaagaataatcaagatcaagattcaagattcaagtaaataa

SEQ ID NO: 76121 - DNA, 732 bp, Glycine max
  Peptide Sequence Number=SeqID_167806
atgtttaccagtcaagaaggcaagaaagttcctcaggttactttccacacccgtcagggcgaccaatggattgatgtgaccactgatgacctgttcaaaaacaaaaccgttatcgtgttctcgctgccgggcgcatttacgccaacctgttcttcgagccatttgccgcgctacaacgaactgtccagcgtattcaagcagcacggcgtcgacggcattctgtgcgtctcggtgaacgataccttcgtgatgaacgcctggaaagccgatcagcatgcggaaaacatcaccttcgtgccggacggcaacggtgaattcaccaaaggcatgaacatgctggtcgagaaagcggatctgggctttggcccgcgttcatggcgctactcgatgctggtgcgcgacggcgtggtcgagaaaatgttcgtcgaaccgaacaagccgggcgacccgtttgaagtgtccgacgccgacaccatgctgaaatacctggcgccggaattcaaagtgcaggagtcggtctccctgttcaccaagccgggctgcccattctgcgccaaagccaagcaaatgctgcaagagcgcggcattcagtatgaagagatcgtactgggcaaagacgccaccaccgtcagcctgcgcgccgtcagcggccgcgccacggtgccgcaagtgttcatcggcggccgtcacatcggcggcagcgacgatctggaaactttcctgtcagcttaa

SEQ ID NO: 76122 - DNA, 216 bp, Glycine max
  Peptide Sequence Number=SeqID_167807
atgaagatgctcttgataccacatgatgtagctccatatggagcttgtaggaaacttaggaaacatgtttttgtgttgatcaatggagtcctttgcttcttgaagtttgatggctatagaatggagaaggagaaagatgattggagactacacttcaaggagaagatgagtctagaagaagcacaccaccatttgaagccatggataagagcttga

SEQ ID NO: 76123 - DNA, 624 bp, Glycine max
  Peptide Sequence Number=SeqID_167808
atgcacggtaacgcgtgttccttaatttctccgaaatcaagcaattctatgatttctgggtacctgcgagctgttgggagaggggttctaggagtgcctgttggggcactactgaattttttaggagctattgctgtgggggcgcctgttacatttcagtatcttcccaagactgtaaattgggctcttatgatgtctgtgttcacaacaattccagcgtcatgtgttcttggttcatcgtgggctgactggcgacgtatatttgcacaaacaaagccaaaaggatctatagagtacctgatttgtttaccagcacatggagcagttattggagcatggtttggggcttggccaatgcctcttgactgggagaggccatggcaggaatggcccatttctgtgagctatgggaccgtagctggttacctggtggcattggttgcatcattgggctttgttcttgcttgtggacctgtttgtaggcaatggataatgaattatgatgacaaagggaaaattggtgctataaaactccaggctctcgccatgacatggtccagcatggggttgaatccattatggatctattgtagacagtattaccttgcatttgtaagaggctaa

SEQ ID NO: 76124 - DNA, 144 bp, Glycine max
  Peptide Sequence Number=SeqID_167809
atggcgaaagaggtgcgagaccagccacacataaagagcgggtgtgcaatagacaatccttgtgccgctcttctcgcatcttcagtcaaatgtgtcataggcatcggccaacacaacaacgaccgagctttctttgctatggtg

SEQ ID NO: 76125 - DNA, 396 bp, Glycine max
  Peptide Sequence Number=SeqID_167810
atggagagaagtatgatagatgctgtcagtggtggagcccttagagacatgacccctgctgaagccagaaatttaattgagaagatggcttccaactcccagcaatttagtgccagaaatgatgctattgtcattagaggagtgcatgaagtagccatgaattcatcttcatcagctgagactaagaagcttgaaggtaaactagatgccttggttaagctggtaacccaactggccttgaatcagaagtctgtacctgtcgcaagactctatggtttatgctcctctgccgaccaccacacagacctttgcccttatatgcaacaatctgaagcaattgaacaacctgaagctgatgctgcaaacatctacaatagacctcctcaacctcagtag

SEQ ID NO: 76126 - DNA, 1101 bp, Glycine max
  Peptide Sequence Number=SeqID_167811
atggccccgaggaagctcgcctcaaagaggtccaggaaggacaaggcagccgaaggaactagttccgctccggagtatgacagtcaccgctttaggagcgctgtacaccagcagcgcttcgaggccatcaagggatggtcgtttctccgggagcgacgcgtccagctcagggacgacgagtatactgattttcaggaggaaatagggcgccggcggtgggcatcactggttactcccatggccaagttcgatccagaaatagtccttgagttttatgccaatgcttggccaacagaggaggtcgtgcgtgacatgagatcctgggtaaggggtcagtggatcccgtttgatgccgacgctatcggccaactcctaggatatccgttggtgttggaagagggccaggaatgtgagtatggccagaggaggaaccggtctgatgggttcgatgaggaggccatcgcccagctgctatgtataccggggcaggattttgcctggactgctacagggaggcgagtgcgaatcatgcgcaccaacatgaccaccctgacccagatatggatgacgttgctcctcatcaacatcctgcccaccaatcataattccgaccttcccatgccgaagcaccctttggacccagataagtccaacagggccctgggatttcccgcactgatcacaggactctgccagtcgttcggagtccccgttgcacctactaaaagacaggctcagggtgatgctccacaggccgcaggcgcgcccccaccacctcatcaggctggccaggctgggtcatttgacatggagcagtatttacagcatttggttcgccagcaggcggccaaccaccgggcacatgtacagacccatgattgtctgtaccagatgagcctcagcatgcagagccagggcttcgcttctttttcatgcccgactccagaccagttcaggacggaggttgcatggcccggagattggcccgaggcccaagcaggagaggcacccccagaggctcccggcgatggagaggaggcccacgaggatgaggagatggccgatttgcttgacttcttgggagggagtggagatacatga

SEQ ID NO: 76127 - DNA, 855 bp, Glycine max
  Peptide Sequence Number=SeqID_167812
atggcgcatacaaagagaagcgacctcgcgagagcaagcggacctcataaagtgcgtcgtagtccggattggagtctgcaactcgactccatgaagtcggaatcgctagtaatcgtagatcagaatgctacgggcgcttaccactttgtgattcatgactggggtgaagtcgtaacaagaggcgatgaaggacgtgctaatctgcgaaaagcgccggcgaggttaacgaggcgaaccgggggaactgaaacatctaagtaccccgaggaaaagaaatcaaccgagattcccccagtagcggcgagcgaacggggagcagcccagagtctgaatcagcttggtgatagtcccgtacacgaaaatgcacaggctgtgaactcgaagagtagggcgggacacgtgtaccgtgagggaaaggcgaaaagaaccccggcgaggggagtgaaaaagaacctgaaaccgtgtacgtacaagcagtgggagcaccttcgtggtggtatagacccgaaacccggtgatctagccatgggcaggttgaaggttggcactgtttcggctagggggccatcccggcttaccaacccgatgcaaactacgaataccgaagaatgttatcacgggagacacacggcgggtgctaacgtccgtcgtgaagagggaaacaacccagaccgccagctaaggtggcctgtgagggttgctggaggtatcagaagtgcgaatgctgacataagtaacgataaagcgggtgaaaagcccgctcgccggaagaccaagggttcctgtccaacgttaatcggggcagggggggacggagaaggctatgttagccgggcgacggttgtcccggtttaa

SEQ ID NO: 76128 - DNA, 284 bp, Glycine max
  Peptide Sequence Number=SeqID_167813
ggctcaataggacatccgagttaaaacttattgtcgtttcatttttctcagaacttccgttttcaattacgagcgtctcgatatcctacgggactccatcggacatccgagtgaaaagttattatcgtttgaatttactcagagcttcagttttcaattacgagcgtctcgatatattacgggactcaatcggacatccgatgtcaaaagtattgtcgtttgactttactcagagcttccgttttcaattacgagcgtctcgatctattacagagactcaataa

SEQ ID NO: 76129 - DNA, 321 bp, Glycine max
  Peptide Sequence Number=SeqID_167814
ggtacacatgtcccagacagtgtttcgacatcagggaaagctgctgcttcaggtgctgtatccaaggatgccttgattgctgaactcaaggacacatgcaaggtgctggaggcaaccatcaaagccaccacagagaagaaaatggagctggaacggctgatcgaaagactcacagacagtggcattgatgatggtgaagcagctgaggaagaagaagatccagctgaggaagaagaagcagctgagcaagaagaagaggcagctgaggaagaggaagatgcagcagaagagacggaatcagattctgaagccaccccatga

SEQ ID NO: 76130 - DNA, 477 bp, Glycine max
  Peptide Sequence Number=SeqID_167815
atggtgggacaaggaggagaggtgttgggcaacatcggtggaccacacatggggcataataggaatgcttacccctatgtcttaccccccaattatatgccgcccaccatgcacatgcccaacgagaacgctaatcatgtcgttcccgttacatttgagggtcagcaaccttgggagcatgctcaatgtgactttgacccatatcccacattcaccgccgagggattggcatttaatgctatgcctcaacccaataccacggaagctcctcaaccccaccctctgcaacaactgtgtttcttagtaggtgggccgcctccggcagtggaagggatagagaaacttgatctcatcgaggagagattaagggctgtcgaagggtttggtgattaccttttcgctaacatggcagaattgtgtttggtacctgatgttgtcatccccccaaagttcaaggtaccaaattttgataaataa

SEQ ID NO: 76131 - DNA, 237 bp, Glycine max
  Peptide Sequence Number=SeqID_167816
atgctaaccaagaagaaccggtacatccatagtgacaaaattgttgtggaaggcaaaactctcatagacttgggagccaatatcaatttaatgcctctctccatgtgccagcgacttggagaggtagagataatgcccacacgcatgaccctccagttagcttaccgctccatcacaaggctgatggaagcttacttgtggagcttctatggaggctggatctttgagcttcaatga

SEQ ID NO: 76132 - DNA, 372 bp, Glycine max
  Peptide Sequence Number=SeqID_167817
atggcctctagaaagagaagagctcccacttctcgacctcaggaaccctatgacacctcacggttcgtttctgaggtcgcatgggagagatacgagcagaatatccatgccagaaacatcctcctagagaggaatgttgagctgcagggcaagctgattaagttcgatgttgcaacattgaacgagtttctaaagacccccgtggttttggagccaggggagcgatattcaacatactccagattctgtcacactcacccagaccctcaggagctcgccgccagattgtgcattccagggtggggttttatgcttaatgctaagggagtcccctggaagctcctgaggaaggacctcaccacattggcttag

SEQ ID NO: 76133 - DNA, 483 bp, Glycine max
  Peptide Sequence Number=SeqID_167818
atggcattgaaagaggctattaaaaaagagttgtcacataaaggatccccagagtcactcctaattcagccggacatacaacaattaggtgcgcctgtcaacactaatggaagtaatgttgttatcaatcgtaaggatggtacactagggttggtggccatggggaaaataatggagggggattcagtcatgcacatagtggcttatgaagatgatgttgtaagggatgtagaaattattccgcacaacgaggatgcacatgtgccaaagccggctaatgtggacgcagatgatccgttgcgtggcctgataaagtacagttttgatatttatgagaagccagttgaaatcaactttgatgggagctgctttggaattgcagatgcacctacatcgatattcataacatattcagatgttagtgaaataatagcaggagacaaaactctgaacatatcagtacaacaattatggttaatgtaa

SEQ ID NO: 76134 - DNA, 272 bp, Glycine max
  Peptide Sequence Number=SeqID_167819
tccagcttggagcgaactgcctacccggaactgagtgtcagatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgagaaaaaaggctgcaccggtgcgtcagcagaatatgtgatacaggatatattccgcttcctcgctcactga

SEQ ID NO: 76135 - DNA, 366 bp, Glycine max
  Peptide Sequence Number=SeqID_167820
atggatgatgctttatttcttgcttggtcttggttaaaagctagtgagaaaggtggcaccttgggtgccttgtatctgatctcctcagtacctctgatcatgggttctccacctgcctccactcctcttcctcctttggacgcatcggcttcgccgtctattgtgaagcggacacgcaaagcctcacgtctacgatcattgtccactagaccacctggtgctgagagaccagtggtgcatgttgatcctgctaccgggaaggccgacagtcccctcaggaagaaattaagaacatatttggggattgtggtgtgtgataaggtggatgtcacctacgagaactggaaggaggtccctactgcttag

SEQ ID NO: 76136 - DNA, 162 bp, Glycine max
  Peptide Sequence Number=SeqID_167821
atggccatagcatgctcattggcatgcatcccaaacgaaccgtcagggtcttcatcgatcatgtggttagcctctttgcatgtagaggttagaataagagcccaaattaaggactttgacctagggatccaagcctttggttttgagtgcaagaaagcataa

SEQ ID NO: 76137 - DNA, 192 bp, Glycine max
  Peptide Sequence Number=SeqID_167822
atgaaatgttgatgatgttgaaaatgcactgtgatgatgttatgttgtgtatgaacatggggggtgcagtgaccttgttggatatccctgcagaatggagatggaagaatgatgattggagacgccacttcaaggagaagatgagtcaagaaaaagctcaccaccatacgaagccatggataagagctgaag

SEQ ID NO: 76138 - DNA, 351 bp, Glycine max
  Peptide Sequence Number=SeqID_167823
atggtgaaaccaagaaatattcttctaacattgaaggagcataatgttaatagttatacaacaatcaagcaaatatacaatgcaagaaacgtttatcgttcttccataagagacagtaatactgaaatgcaacaactaatgaagcttctagaagcctgggagaatttggtggattgtccttctaatcaagagtttgatgggtgccttaagaagtttgaaattgcctgctcaccatggccaatgtttgttgaggttgagtctactcattcggccttaaagagactactacagaatagccttagagagctctgtagcgttcgggaagtcatgaacaacatgatcacgctgtaa

SEQ ID NO: 76139 - DNA, 393 bp, Glycine max
  Peptide Sequence Number=SeqID_167824
gtacaaccttgtgtttttatgcgagataaatctactatcgttcccatagacttagaaatcgaagctacctgtcggcgtaataacgccgcaagaagacgaagagagcaagacatagatacttcacctcctctctctccaaatcacgttcaaatggacggagaaccagtacgaagggttacattagaagatttctgtcaaactactactcctgaattcttcacaagtatcacaccgccagaggttcaagcccttaatatttcgtaccctcattctctcattcagctgattcaggggaacctcttccatggtctcccaagtgaggatccttatacgcatctagcctcatttatagaaactcttgtgtgtttgtctccttcttccccactcttttaa

SEQ ID NO: 76140 - DNA, 315 bp, Glycine max
  Peptide Sequence Number=SeqID_167825
tacccaggtgaaaatgaagcatgttcggaggttcagagtttagaagatattgtgggtactatcattgagaacaatgcagaggatgacgacgaagatgatacggtgtctttggatcctgttacacgaaaggaagcacttatggcatcgaacactcttcacaactttatgatacaatacaaaaatacaacacctgagctattggatgcaataagaaaaaatgcagaagaagaagaagaagaagaagaagaagaagaagaagaagaagaagaagaagaagaagaagaagaagcaatcaatttaacaatgttcttttaa

SEQ ID NO: 76141 - DNA, 1353 bp, Glycine max
  Peptide Sequence Number=SeqID_167826
atggctgcactgatcttcacaagtactcagattatgactccaagtgcttatatgtcaaatccaatgttcactgcagcttcaaactacttttgcaataacctagaaggtctctctgacatcttaagactatccccaaccatagctggggtaaccttgctttctcttggaaatggtgcccctgatttttttgcaagtgttgtttctttcacaagatccaatgatggggcagttggcctcaatagcattctggggggagcattttttgtctccagtgctgttttgggggtcataagtttccttgttagagcaaatgaaattgcaattgacaaggcaagtttcattagagatgtcatctttttcctcttctctcttttcatcctgcttgtcatcatttccattggggacaggacagaatgtgagcttgtctcatcttctgaggacttgacagaatctggtatacccttgctaggctgtgttgatgatgagaaatcaaatgtatcaaataaagaggttattaaagataataatggggacaaacaaaagtgttttggttatgattcatttgactttacttacttgagcaagtttctacaagtactagagttacctcttagcttgccaagaaggcttactataccagttgttagtgaggagggttggtcaaagccatatgctgttatatcagttactttggccccagtgttgtttgcaactctttgtaacacccaaatggaaaatgtgagttcaaagagtagtcttgtttcatacttgacagctgctttaattgggattgttttggggaacatggcatgtgtgaccaccaagagcactagtccacccagaaagtgcttgtttccttggctagctgggggcttctctatgagtgtaacatggacctacatcattgctgaggaattggtttccctcttggttgcaattgggagtgtcataggggttagtccttcaatccttggactaactgtcctggcttggggtaattctctaggggatttgatagccaatggtgcaatggccaagaatggtggagctgatggggcccaaatagctgtctctggctgttatgcaggtcctatgtttaacattttgatgggcttgggcttgcctcttgttctctcagcatggtctgaatacccagactcttatgtcattcccaaggatccttctctttatgcaacacttttgttcttgatgggaggggtgctttgggcccttgtgatattgataaagaagaaaatgaagcttgataagtccttgggagttgggctcttgaccatttacctctgctttttgtttataaggatggccatagcaattggtgttattaaattctag

SEQ ID NO: 76142 - DNA, 213 bp, Glycine max
  Peptide Sequence Number=SeqID_167827
atggctccttctcgagtccagtattgcggagagttgttgctgcggtgcgggagcctcacgcgcgagggagcgtggcggggagggttaggaggggaggagtggggtgcggtgtcatacatggtgcggcatcatacatgggtttggagggaaggagtggggtgcggcgcgggagcctcatgcatgagattgaaaccacgatcgaaaatcaaatga

SEQ ID NO: 76143 - DNA, 924 bp, Glycine max
  Peptide Sequence Number=SeqID_167828
atggtctcagaaatataccctgaggttcatgagaaccctagggtcttctttagcaactctagctcaatcctcttggagcctcttgctcatggctctggtgactggtcccttcctaggggggatttcatcaagaagggcaatgtgtctaccaagaggttagggataagagaagccacaaaaaagaaggaaaaggataaggtcatttcctctcctactactgaaggttttgtttcagagatggagaagccttctaaagactattctgaaggacctcaaaatgaggaagaaacccctctaattgaagcaaagaatgagaaagttggagatcataatcaagacattcatccttctgagggtgcgaaggctgttaaagctcagaacaatgcgagttttgagccagttcaagaggatctcaataaagaagaagaagaggaggaggaagagccttttgagaaggtagaaaaggttgaagttgttgtagaaactgctcataatgtactagaggttacgggtggtgggagaacccttgttgggtatgtaaaggattccttgttcaacaccaaaaatatgcagaatctctttaactctcccatctttgacacttcagtcaaaattgcatgtggcattgatcccttacatggtgaaccctcaaccttgtccatttcattccctcatgagttagctactacaaaaccttctatggttcaggaggaggttcattttattcatatttcctctcctcaacctgttgttgaaccttctacaagctattgttctccaacattgatcaactttagagaactgatgcaatcctacctcccaagggcattggatagaagactccaagaagattgggccaaagatgcaggagaaggccctagggttatcatgagccttagggtagattttggacccatgggctaa

SEQ ID NO: 76144 - DNA, 183 bp, Glycine max
  Peptide Sequence Number=SeqID_167829
atggaggagtcctggggcattccattgagcattgtatgtatgaccttgaaacataaggattttcaagtttatgccattactgtgaacaacagtcacaatgctaataatatggataaatttgatgtccttatctcattctctcacaattacatctttgcttatttaactttcactagaatgtga

SEQ ID NO: 76145 - DNA, 693 bp, Glycine max
  Peptide Sequence Number=SeqID_167830
ggctacacgccctcaccttcagaggactacacgtcctcatcttcagagggctacatgccctctccttcagaggattacacaatcctcgccttcagaggactacaggtcctcaccttcagaggactgcacctcctcaccttcagaggactccacgtcctcacccttcagaggactacacgtcctcacctttcaagagggctacacggtctcacctttagaggactacacggtcctcgccattcaagggttgcacgccttcaccatcagaggaatgcatttcctcaccttcagagggctacgcgccctcaccttcagagggctgcacgccctcgcctttagagaggactactggtcctcgccttcagaggagtatagcactcacctcccatcagaggggcacaccctcgccttcagaggcacccaccctccctttcagaggactacacggctacggccctcgccattcagagggctgcacgccctcgccttcagaggagttcgcacgccctcacctttagagggactacatcccttgccttcagagggctaccacgcccttcccttcggagggctacacgccctcacctttaaagggctacacgccctcgcctttagaggactacacatccttgccttcagagggctacatgccctcaccttcagaggattacacgtcctgatggaagcttgctt

SEQ ID NO: 76146 - DNA, 359 bp, Glycine max
  Peptide Sequence Number=SeqID_167831
gaggtggtgatggagaacggtcttctgcggcttatactggagcgtctttcttcacccaagacccatctctctctttgcagtatccgaaagaggagactacatttgcatcgatagagaaggatctcttgactttgacaaagggctcagagtcaagaggaacatcaaaatgttgtagaaacaaggatgcgcataatcaagtagtgcctgatgcgaaattcgaatgccaaagatccagcaagaagccttctgatcatatccgcttggttggtacaaaccatccggtgggcatcagaaatgaaaaaattgaacttccactcatcatcaagtgtaccctcaaatggtacaccttcactggataa

SEQ ID NO: 76147 - DNA, 990 bp, Glycine max
  Peptide Sequence Number=SeqID_167832
atggatgcaattgccttcttcacccagtattatgactaccgcctgaggtgcttcacctttgaggatttccagctagtacccactgtggaaaagtttgaagagatcctgggatgccaactgggaggaaggaaaccatatctttcctcagggttctatccctccatggctagagttgccaaagtggttagaatctcggcacaagaattggaccaagtaaagcaaaacaaaaatggagtagtcagagtaccaaggaagtgtttggaagagaaggcaaaagccttggcaagtcaaggcaaatgggcttctttcattgatatcctggcacttttgatcttcggggttgtcctctttccaaacgtggataggttagtggacctagcagcaatgccagcaattgacactttcctcgcctttcaccacagcaaggaaagcccgatcgtcgctatcttggccaacatatacgacacattcgaccaaagatctgaaaagagcggcgcaagaattgtctgttgcacatcagccctctctgtgtggttggtttcacaccttttccgccaagaagggaggcatgtttgtccacagcaaggtcaccgctcgtgcgccaaaaaaagagaggcgaattgggaccaactcttagctagcatagaaggagcctccattaactggttccctcgctggaaggaaggaagaaccgggattctattctcatgcgagggatttccaaatgttcccttgatgggaacaagtggttgtattaactataatctcgtccttgccataagattcttcctccagaaggctgttgcttctggaggaagcaaccttgctcgcttgggcgagctgggtggcaagctcctcccctattttgctataaatagggggaggagtgaagggagaaggggttcagccttcttggcacttctcattctctcgaaattgctgaggaaaattgtttccgtgaagaaaatccaagccgaggcgcttccgtaa

SEQ ID NO: 76148 - DNA, 216 bp, Glycine max
  Peptide Sequence Number=SeqID_167833
atggaaaagagcggaggcaaacaaaataattttgggtcaatgaaagaaagggaatggaaaatcttcagaccagataaattctcggcaaggtggaaaacccagtggaccgttcggttctgccaaccacctttttcggagccccatgaatgtcattgcctagcgctgttcatgtgtcctccaccttcgagtttggagctatgtttcatgactgcctaa

SEQ ID NO: 76149 - DNA, 390 bp, Glycine max
  Peptide Sequence Number=SeqID_167834
atgcggggttaccgtatggttaccagcacctttcgtcaaccaggggcaaacgagcccgttgacgtgcagagactagcatcttcttctgcaccttttgtcgtcctgacccgtaaagttttactctcgtcgttcggaaacattcaagcccggcgatgcgcgaggttcttctctgctgggcagggacgatcgagtgcaatggcgaagggaagtgtcgggaagctgtcataccctaatttcgtccggggaccattgtttggtggcatgcaaccttcgcttgaccgctttgaggggtgtgcaaatagcaaccaagcccacttgggccttctagggggttccaacagaaggcggtgccttctggtggaagcaacccagctcgcctgggcgagctag

SEQ ID NO: 76150 - DNA, 585 bp, Glycine max
  Peptide Sequence Number=SeqID_167835
gggttgcacccacaagacacccagtggacccggagaagtccaacagggccctggggtttccagctctggttacgggcctctgtcagtcctacagggtgcccgttccccccagcaaggtcatgccaccatgacataggggtagcgcccacaagtcacccagtggacccggaggagcccaacaggaccctggggtttctagctctggttacgggcctctatcagtcctacagggcgcccgtccccccagcaagttcatgccgtcgtaacataggtaaagatcgtgcccgcaaaacacctagtggacccggagaagtccaacagggtcttggggtttccagctctgattacgggcttctgtcagttctacggagtgcctgtcaccctggcaaggtcatcaggtcccctactaataaagctttcatcaagaagtactgcgcccccaggcaagcgcagggcgaaacaccacaacagcttggggatggctggcagcgggcaacaaacgaaccaccaccacctctagagttcatctcagctcatccacaaaaaaggttagagcattgcctacgacacatggccgaccaatag

SEQ ID NO: 76151 - DNA, 765 bp, Glycine max
  Peptide Sequence Number=SeqID_167836
atggatcagtcgtggtttcacaagttctaccaatggcttaaacgatgggagcggaaggagtgtaaaccaaacagtcttcctatcttgcacaaaatgcaggagatgcggtttaagtcatatttggacgagaaagggttgtcatcccaaggaccaacacatgatgagattcattttgagtttttgcgaaacctaagtggggacccttatattctgcgcacaaacatcttcacccaaggcaaaggtaacagggagcaacagttctatctctggttcgaccccaccagaaacttccacacttattctatcatttcgaagccccagcacatcatgatgcagacctacgttttggaaaatattaaaataaagaagcacggatctacggaagatttcttgagccttccttacatttgcacattgcttaattgctccttatggacttactatggaatcataaaggctagagagtacctcgtggctactgtcaatggctttggcattgtggtggagacaatctatgttattctatttctcatatatgctccaaaagggataaggggtaggactgccattttggctgtgattttggatgtggcaatttcggcagaagcagtagctactactcaattagcattgcaaggagaagctcgtggtggtgctgttggtgttatgggagcaggcttaaacattgttatatatttctcacctctctgtcatgtacgaattcgttctggcacgaaatgctttaccacctctcaccaccattaa

SEQ ID NO: 76152 - DNA, 465 bp, Glycine max
  Peptide Sequence Number=SeqID_167837
atggatgttaaacattttgaagtggtcatacgaaggtcgcatgccgacaaacaatggtccccggacgaaattaggcttgcagcaaagttccgtaactgtggacaaacatgtgtttgtgcaaatagaattattgtgcaagaagatatatgtgagaagtttgcaaatgctttacgtgatgttgttcataatatgaaagtcggggatggttttagtgaagtttctgtttttctattgaaccaactgcctgtggatattgcctatcttgcatctctgtttttccatggtaatattcattcatatggacttcagaaaatgagtcatggtgtaactcatttcatatccatctctaaacagggtcctctaataaatgaagttgttgtaaaaaagattatagatgaggctaatatctacaaaatacaaactgcgattgagtttggtagaaacacaattgtgcagaactattga

SEQ ID NO: 76153 - DNA, 312 bp, Glycine max
  Peptide Sequence Number=SeqID_167838
gtcgactctagaggatcccccttaccgattgaagaccgaagaacgacgaagaacgaacgacgaacgacgaacgacgaagaacggttgaaaatcttcatgaaatcacccacgaaaaggaaaataggggaggagcttgccacccagctcgcccaggcgagccaggttgcttcctctagaagcaaccgccttctggaggaacaatctggaaggcccaaaattttacagaaactcaaggattgcgcaacaacacttccttttgatttccagcacattacggaatttcacggattgcgtaacaatgcttccttttga

SEQ ID NO: 76154 - DNA, 318 bp, Glycine max
  Peptide Sequence Number=SeqID_167839
atgtctcaatcaaatgaagagaccgacaaaaggaaaagaagcatagcactcaaagcctcttcctcaatacaagaagaagaagaagaagaagaagaagaagaagaagaagaagaagaagaagaagaagaatctgatgatgaagaagtcttctcactctttgtgaagaattttcataaattcgtcaaaaataaaagaatggagagaagccataacttcaacaatgggaagagatcccaagaagtttctcctacacttaaatgctataagtgtaatcaacccggtcacataaaggcaaactatccctcaaatgagtcatga

SEQ ID NO: 76155 - DNA, 1203 bp, Glycine max
  Peptide Sequence Number=SeqID_167840
atggggttggaccaagcacggtcttttaagaaaaggttctatcatgtcaaagtaaaaaatctagaagtagctagcttgcgaaagctgggacagtggatggatcaagttcaacgtcaggctttttccaagatgcttcacttttggggactttcagttagcaccgaccatagaggagttcgaagggatcttagggtgcccgataggaggaaggaagccatatacctctttactggatactatctttctatggtgagaatagcaggagtggcggaaactctggcaagccaaggagaatgggtatcatttatcaacatattagctctgctagcgtttgggacagttctatttgaaaatgtagacgggctggtggatctagcagtgatcgatgcttttcttgcttatcaccacagtaaggaaagcctggtcattactgttttagcatatgcgtatgatacgttcgacttaagatgtgagaagagtagtgcgagaattgtttgttgtacgcctgctctttgtgtatggcgcaagagtgttatgcttgtcgcaacctatccttcggcgggagggcgacgcggggctcacgggtgcgtcttctatgggaggaaaatgcgcggagtcgccaccaacgtttattcgaggaaaacgtcggaaaaatcggaaagagacactcatgtatttgaacctgtccacggtggttggccgcctgctggcaaaccaaatgctgtaaataacgctctacgcccagtgacccatctggactggcctgccaaggtggtggcagtgcgcctgcggactgatgactggcaaaggcccatgatcagagccggaaaccccagggccctgttggacttctacgggtccagagggtgcctggatggcatacaccaactggcacttaggcagagggaggtcagagttgtggtcgctaggcaagacattgctgagcagcagcgtcatccatatctgggtcaaggtagtcatgctggtgcgcatgatctgcacccacctccctgcagcggtccaggcgaaatcctgccccggtatgcacaacagctgggcgatggcttcctcatcgaaaccgtctgcctggctcctcctctgggtgacctcacactgctgaccttcctccaaaatcagcgggtcgcccaagaactaaatgagggcatctgcgtcgaagggaatcccctgacccctcacccatga

SEQ ID NO: 76156 - DNA, 141 bp, Glycine max
  Peptide Sequence Number=SeqID_167841
atgggaccagtcaccagagccatgagaaaaaggctccaagataattgggctagagctggtaaagaaggtcctagggttctcatgaacctcagggtttgtatggtaccctataaattaagggcaccctaccctataagttaa

SEQ ID NO: 76157 - DNA, 390 bp, Glycine max
  Peptide Sequence Number=SeqID_167842
atgcctgcatcttctctcttgcacccaatttcctgcatttttgccttcttctgcatcttcacgcatcaaagcatcaacgatacaaataatgtattggggagaaacatcttgccagagaggaaggtagagctctaccacaccgagtttgatgattttaagactgagttggagagctctgagggcccttcaccaaagcaagccaaggtcagaggccatctagtgaagatcaatgccgacagccacaagacattcctagagacacctgtggtgttggtagaggatcctagggagatcgaggctgccctatgcataccaagccgagggttcatcttgaacgctgagggccatcctgggaggatattgaggaagaatttgacgactttagcccag

SEQ ID NO: 76158 - DNA, 442 bp, Glycine max
  Peptide Sequence Number=SeqID_167843
atgcatagatctcccacaggcaatttagttcctctggacttggagattgaagctacgttaagaagaaggaatagagccaagaggagaagaaaattactccaagacaggacagtagcgtccattcttgaggaagaaacttatttttctgattcttcatcatccgactcaccatcatcaagggaatccgcgacttatttaccaaaagccgtttccatggctgatgagcaccagcaaagggttacccttgaggactattcaagcagttcagtgccgcaattctttaccagcattgcacgtccagaagtgcaagctcacatcataaactacacttattcttttattcatttaatacaagggaacttattccaaggattaccaaatgaggacccctatgcacatttggcaacattcattgaaatttgtaacactgtaaagattacag

SEQ ID NO: 76159 - DNA, 1044 bp, Glycine max
  Peptide Sequence Number=SeqID_167844
atggcctctagaaacacccatgtcattgaagctatcccaaccatggaaatcaccataatacacaatgacaatgagccttccattcacgtcatactattaagcgacactattgctaaggcaacaaggtgtttgcgtgagggcaacacttacctagaaggatgggaaaggaactataactcccacatcaccagagctctttatcggtacaatgctgacaaggctagtgataagaagaccattgtctataactttatgtgtgggaaggaaaaaatatgggacaacattctgaacaatagtgtgcttcacaaagctggctccaagacgattgacctccacaagtttatgcgatttcacttgacggggaacctcctgtttgaccttccacacataatatacatcaacattttgaggaacattaagggcttaggtgtctactatgtgttcaacaagatggatgaggattccaagcacatcctaatagttaatggtttagtggttgctaaacaacaaaagtttagcaagaataacctaaaggctatgaagactgatgatgatgatgatgatgaagggctggtgagagtggctctccaaaagatgaaagttgttgctcctgatgcacctactcccaagaaagcaaagaaggctcagcctatagctaagccaaaaacatttgttctcacctctgccatcccatgctggatcaatacaagggcaaccaaggccaatccaaagattggtgacaaagaatgggcaatttcctttacaagaaacaaggaagatccagccttatcctcgtcagatggtgagtccattgatggcactccaatcacacccctccgcaagtttgcacctaccccacaacagtgtccatctccttctcctttacacctggataggtttaaaagggcaactccaagggttccattgagtgatgctcaatgtttcctcttggtcttcagtcatgttcgagaagaaggtgcacgtgtggaagccaattacaagactgctgctagtgcatcctacggacatccaactcttacttga

SEQ ID NO: 76160 - DNA, 294 bp, Glycine max
  Peptide Sequence Number=SeqID_167845
atggcttgttcgagtggaacatctttaggatcattatctctgcttcagaactctagttctgaggaagatttgcaggcaatgatggaatatcatagaaagaggaagagaatgatatcaaaccgcgaatctgcacggcgatctcgcatgaggaaaaaagaggcgttggggaggggagcccaggcagagggaggcaaagtactggctggagccggtgggggcaccggaggtgaggggggagttggcggagaggcggcggaggtcgacaaccacttagacggtgaaggaatgttgtga

SEQ ID NO: 76161 - DNA, 243 bp, Glycine max
  Peptide Sequence Number=SeqID_167846
atgagcacatgggaagaactggatgacacattgttcggcgaggagacaaaaaaggaagaaaaagtcaacctctgcctgatggtagacactgcatcagaagaatcagactctgaattagatgaagaggaatcgcatgaagacagtacaagtggaggtttcaatctcttctccgtctctctgacgtttgggaattctatcggagcagtcggaggaataactgaaggaatctcagggaaccgctag

SEQ ID NO: 76162 - DNA, 540 bp, Glycine max
  Peptide Sequence Number=SeqID_167847
caaaaccaactacagaagaataattatgacctttcaagcaatagctacaatccatgttggaggaatcatccaaatctgagatggacaagtcctccacaacaacaacagtctgtccctcattttcagaatgatgctgatccaagcaagccatatgttcctcttccaatacaacaacatcagtcacaacaaagacaacaagcaactgaggctcctcctcaaccttccttagaagagttagtgaggcaaatgaccatccagaatatgcaatttcagcaagagacaagagcctccattcagagtctgacaaatcagatggggcagatggctactcagttaaaccaagctcagtcccaaaattctgacaaattgccttcacaaactgtgcaaaatctgaaaaatgtgagtgccatcaccttgaggtctggcaaccaaattcaagtgcctccaccagtagcagcacctacacctgaacctatcaagcttcattctacacctgaaaaagaggatgagatagttgcactaaagagaaatcttccttaa

SEQ ID NO: 76163 - DNA, 474 bp, Glycine max
  Peptide Sequence Number=SeqID_167848
atggcatcgagcctcccaagtattggtggtgttacaaaactacatggatgggatttgggagtgatcaccacatatgggtacaatgtataccgatccccaagttcccatctccaaaaagtagtgtttctagactatcgaaatgctagatttccatttgcgcaagaattgcactgtgtgggatcaaaggactcagtctctgacctccacgagtttgtcctcttccatctgatggacaaaatccctttcgaccttccacacacagtctacatcagcatcctgaaaaacatgaagactcttggagaagtggatgacatctactatgttgcctttgaatggacaaggactccaagtgcaagggcagtttcacttgagcatgaggataagttgcttcatgttttgagaggccacaaaaaggccattgggcagacacttgctgaccttcttggaataaatctgtccatttgcatgaattag

SEQ ID NO: 76164 - DNA, 195 bp, Glycine max
  Peptide Sequence Number=SeqID_167849
atgaggagagaagatgaagatggtgatttttcaagcttgcctggggggttaaagtttgttagtcggaaaattgtgaaacttaattcaccccctgatgagaatcctgaaactggccaaatacaggctaaaggcccaagtggagaaggacgaaggcccaagtggagaaggataaagcccccaagtggagaaggatga

SEQ ID NO: 76165 - DNA, 444 bp, Glycine max
  Peptide Sequence Number=SeqID_167850
atgactcttgctactctatttggaaagttccagaaacacaaaatggaattgttgagattaaatcaacatgaagaaaatgacaagaaaaagaagggaattgcttttaaagcctcatcttcaatccaagaagaaagtgataaggaaattgatctagatgaagatgatgatcttagcctttttaaaaacatggagaaatctgaaaagacaaattttagtgaaaagaaaatgaagaaagcgtacatcacttgggaagacaatgatatggaatcttctgaagattcagaaaatgaagagataaacctctgtctaatggctaaaagttatgaaagcgatgaagaggtaacatcttcaaataacttagccatttcttttgatgaattacaagatgcatttgctggattgcataaagtcaatcaaacttgcaaagttagtttcatcttctaa

SEQ ID NO: 76166 - DNA, 896 bp, Glycine max
  Peptide Sequence Number=SeqID_167851
atggtgaaagttggaacctcttacgtgccgatcaacgtctcatttcgccaaaagttggcccagggcttcccggtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatctcaatctcggctcactgcaacctctgtctccgaggttcaagcaatgagaacagtaaagaagctacagttcacataaagcctgttagagcccctgtccaggtgattcccaccctgtgtcctcatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 76167 - DNA, 627 bp, Glycine max
  Peptide Sequence Number=SeqID_167852
atggccaaacataacatcagtattgaaggccgctctttgattaaaatattccctatcatcaacaaactggatcctttcattctgaaacatgtggattggattatattttcaagcaaaaatggtattgaacactttttcaatttagaacctcgtttgagcaaaaagaccaaaataggtgttattggacgtggctcagaagaaattttgcgcaaatatgatcgcgttgccgatttttctggcgacagtgaggggattaacatggaggagattgcgaagaaatttgcggaactagccaatggtggcaccgtacttattccacgtgcaaaagaatccttggagaccatccaaaaagcgttgagtccggagacgaaaatcatcaatatcccagtctatgaaacggtcttagaagaaaatgtagatccatccaatgcagaggttttggtctttaccagtcctagcaatgtggaagcttattttgcggacaacctgctggaaccggggcagaaagtaatctgcatcggccgttctaccggtgcaaaatttgatgagatgaatgtgccttataccctaccttattctccagatgaaatcggtctttccgaagccgtttttggattggagtattag

SEQ ID NO: 76168 - DNA, 369 bp, Glycine max
  Peptide Sequence Number=SeqID_167853
atgtcactgcctagcgctgttcttgtgtcctccacctacgagtctggagccccgcgaagttattgcgtagcgctgttcgccaattctccattctccactttttttccgagccccatggctgtcattgcctattgctccccaagaatgtcactgcctagcgttgttcatgtttcctccacctacgagtctggtgccccgcgaagatcttcttcatcaatggattcctttgcttcttggaagatgaatggcagcggaatggagaaggaagagggagaagggacgccacttcaaggagaagatgagtctagaagaagctcaccaccatatgaggccatggataagagcttggagaaagaaggagatgaatga

SEQ ID NO: 76169 - DNA, 408 bp, Glycine max
  Peptide Sequence Number=SeqID_167854
atgcttgctagaacagatgagcctaccaaaatagaaaatttaccaagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 76170 - DNA, 495 bp, Glycine max
  Peptide Sequence Number=SeqID_167855
atgaccactcttatatggatatggatgacgttgctatttagcaacattctgcccagcgaccacaatgtcaatctccccctgcagatgtatcagttggaatcgcgcccactagacgcccagtggacccggagaagtccaacagggccctggggtttccagctctggttacgggcctctgtagtcctacagggtgctcgttccccccggcaaggtcacggatcgcgcctacaagacacccagtggacccgaagaagtcgaatagggtcttggagttgtcaagctctaattacggacctctgtcagttctatggagtgcctatcacccccagcaaggtcatcaggccccatactaatcgagctttcatcaagaagtactgcatccccaggcaggcgcagggcgaaacaccacagcagcctggggatggccggcagcgggcaacagacgcaccgccatcacctctagagttcacctcagctcatccacaaaaaggttag

SEQ ID NO: 76171 - DNA, 309 bp, Glycine max
  Peptide Sequence Number=SeqID_167856
atgaagttaggtggcaggcagagatacctaagtggttatccatataaacactctttcgctatccgtcagactcagagtccgaagtcaggtggcagtcgggggtaccgtatggttatccgtacctttcatcaaccacaagcaaacgagcccgttaacgcacagagactaacatcgtcttctgcaccttttgtcatccagggacagcaagtcaggtggcaggcggagataccttatggtcgtctgcacctttcgtcaaccaaggtgaacgagttcaacggtatcaggatgatgttggtcgtccgattctga

SEQ ID NO: 76172 - DNA, 357 bp, Glycine max
  Peptide Sequence Number=SeqID_167857
atgtatgtttataactattcaacatatgcaaagacgggacttacgttcaattactactacaacatgttgagggaggaagcagatgctgaccgagcaattaattggctcatcaagaaatcaagaaacctgccaataagtgtactagtaaaatccacatatgtaaggtgtaatgcattgttcaacgaaagagggagagaagccacaagaatgcttgcatttgaccaagtttatacaaaagtactaagcaaggtcatcgaagacgcacttaaaaaggcgaacactcacaatgttcttgagtttgatcgacgcgacacacaattcctagtccaagagacaataaatctgagagaggtttag

SEQ ID NO: 76173 - DNA, 694 bp, Glycine max
  Peptide Sequence Number=SeqID_167858
tattggaaatgaacggagaagtggtggaacgtgcggaaccacatattggatcactccagtgcggcacgaagccgctgacgccgagtcggctcctatgccgctagctatgccctgcttggtcccccggcacggtggaggacagaagggagaaggttgtgaaggaggcctcgttatccacacctccggtcagatgaatggaggaccgaccgacccgggttttcatgagcgttggcgggtcctggagtgcctgtcaagggcgctagcgcataccccgggaacgcagcagcgagggacaacccgcccatacacagccagcggggaggatggcactactggcaaagaccgtccggcgaaaacgccgcaggcgcgaagcgtggtaggccggacggtggaagagccagggggggccgggtcatttgacggaaatggaaggcttttccctattagagaaggccctctgaagtcaaggggaaacagcgctgcctacacgcgaattagcttccgaggtcgagcagtctcaatttcactacaggatttgcgaatgaatgctgggctgggccacctcgaatggcgtgagccgcatgcggggagacccgcacgtggagccaacgatccgctaagactaacgtatctacaactccatccccgagcggcagtcaaacggaggcgtgaatgcaagatgccagcggaatga

SEQ ID NO: 76174 - DNA, 501 bp, Glycine max
  Peptide Sequence Number=SeqID_167859
atggctactccacctgccttgcctcctcctcttcctcctacagtagcattagcgtctccgtctaccttgaagcggacatgcaaagccacatggctacgatccttgaccactagaccacctggggcaaagagactagtggtccatgtcgatcctgcaactgggaaggccgacggtccccacaagaagaaattaagaacatatttggggattgttgctcgtgataaggtctacatgacatatgggacctggaaggaagtccctactgctcagaaggatttgatatgggaggatattcaggcggaatttgatatccctgaagcttctgacagtaggacaaagaagaaaatacttcaaactgtcggtgagcggtggagacagtttaaatctgatttgatgaggaaatgggcacttgcagccgacaaggatagtgtggacgacactatttgtgaaaattacgacattagcaaggagaaatgggccctgttttgtcagacccgctga

SEQ ID NO: 76175 - DNA, 528 bp, Glycine max
  Peptide Sequence Number=SeqID_167860
atgacaagaaaaagaaaggaattgcacttaaagcctcatcttctatccaagaagaaaaaaaataaaggaattgcacttaaagcctcatcttctattcaagaagaaagtgacaaagaggacttgaatgaaataaaagaagatgatggtttcaatttctttgtaaacagattcaataagtttctaaggaacaaaggaaatcaaagaagaataaacttcaattcaaagaaaagaggagaagattcatcttctgttccaaagtgctatgaatgtaatcaacctgaacatctgagagttaattgccctagtttcaagaaaagaatggaaaaaactgacaggaaaaccttcaaagataagaaagcaaagaaagcttacatcacttgggaagataacgatatggattcattcaaagaatcagaaaatgaagtcgtgaatctaagtctcatgaccaaaaactataaaagcgaagaagagaacttcaagatgcattcaatgacttacataaagaatcaatcaaacttgccaaactag

SEQ ID NO: 76176 - DNA, 501 bp, Glycine max
  Peptide Sequence Number=SeqID_167861
atggcttttaatgtgagagatcctcagtcctttcacatgcatcatctgcagaatgctctttgcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccgggcggtgcttttgccgttacgcaccaccccgtcagtagctgaacaggagggacagctgatagaaacagaagccactggagcacctcaaaaacaccatcatacactaaatcagtaa

SEQ ID NO: 76177 - DNA, 378 bp, Glycine max
  Peptide Sequence Number=SeqID_167862
atgtacatcatgtatggcccaaaatatatcatgaagcatagccaacaaaacacgatatccaaggaaacaaaaccccccaccacacttattcccaaaaaaattccaaagctccaaaattccttaagggtaaggttatatcatggtttttcacttaaggcttgtagtgagcttcaaaacaaggaaagggaaacaaggctcaaaagggctatcaaaggaattaattcaaggacgcatcaacaagaatcaagccaaggctattgtgcaagcaatcaatggggcaaaacacaccaaatgattatgatgatggatggctcaaattctcacaaaggtaaaatcatcactttcaaattgagctttcaaaactatcatgacatgtag

SEQ ID NO: 76178 - DNA, 486 bp, Glycine max
  Peptide Sequence Number=SeqID_167863
atggcttctaggaaacgtaaaaagaggaaagtagagatatatcattctgagatagatgaatttaaggctgaattggagaggcataatttccttaaacgcctcaccaatttggtcaaaggaagcatagacctagctttggtgaaagaattctatgcaaatttatacagttctgaggatcatccaccaaagcagtctagagtcagaggtcatttggtgaagattgatgctgatagtctcaacacattcttagagacacctgtggtattagctgaaggggagaccttgcccgcttactctagatactgcaagttgcctacagactacagagagatagaggttgccttatgcatacctggccgagggttcatcttgaactcagagggccatcctgggaagattctcaggaaggatctgactacactagctcaggtgtggagtgtcctctcatactccaatttggccccacatcatacacttctgacttga

SEQ ID NO: 76179 - DNA, 417 bp, Glycine max
  Peptide Sequence Number=SeqID_167864
atgacaaatttccttcacaaactgtgcaatctgaaaaatgtgagtgccatcaccttgaggtctggcaagcaaattgaagtgcctccaccagtagcagcaccttcacctgaacctttcaagcttcattctacacctgaaaaagaggatgagctagctgcacaaaagagaaagcttcctgatcatataggtggaccttcttctagtagttctaacttgcagcaacctcctatccctcttccatttccacctagagtaattccgaacaaaaagatggaagaagtggataaggagatcttggagacctttaggaaagtagaggtgaacatacctctgctagataccatcaaagcaaattccaagatatgccaagtttctaaaagagctgtgcacccacaaaaggaggttcaagggcaatga

SEQ ID NO: 76180 - DNA, 468 bp, Glycine max
  Peptide Sequence Number=SeqID_167865
atgtcgaccagcatcaccatgatcgtaccgatcaaaaataccgttcccggcgtcagcaacgtcttcagcgcgccgggccatcagggcgaattgctgatggccaaaccggtcaacaaccagccggaaggcggcaaggcgaagaaaagcgaaggcgccaacggcaatgacgaaccggcaaatctcaacgaaagccgcgcctcggcgcgcatcaaggcgctgaaccggcagattcaggctctgcagcaaaagctggtggagctgaaggactccagcgccgatcccaaagagatcgagaagcagaaacagctgatcgaagcgcagatcaagatgctgcaggccgagatcgcgcgcatccagaaagaagaaatggaaaagcagcagcaggagcaaatggaaaaagccgcggcgcaagccggcgacggcgtaaaccgcccgacgccgctcaacgcggtggacgtctatatctga

SEQ ID NO: 76181 - DNA, 585 bp, Glycine max
  Peptide Sequence Number=SeqID_167866
ggcggcgtcgagccgctcctgcgtcggatcggtctggcgttcggtcagatcgaggtcgaccgacagctgcgggtagcgttccgccagcgtcggcagcagcggcagcacataggttttgccgaaggttggcaggcagctgatgcgcagcgtgccctgcggcgtttcgttcagcgcgctcagctcggcgcgaaggccggtgatgtccgtcatcagcgcggcggcgcgcgtcagcagcagctcgccggcgtcggtcagcagcaggccacgggtggagcgcacgaacagcgcggcgccgagcgcgctttccagagcgtcgatgtggcgcaccagcgaggagggcaccatgcccagccggcgcgcagcggcggaaaagctgcccaggcgggcgacgtcgagaaaaattggcagatgttctacatagcgggcgtcattcatttttgcattatatgcaaaagcgtttcttatgaatacccgcttctctgccgacggcgcggcggctactctggctgcgggttgatgacgggcttcggcgccgtcccatcccggccgcatagagagaaaacgcataaacctcgcggcgcttag

SEQ ID NO: 76182 - DNA, 387 bp, Glycine max
  Peptide Sequence Number=SeqID_167867
atgagtgatggattttgcggtactcatttgcagatcatggttaggaccagaggattaggtcgtgccttaggtcaggtcactcgcagaggtgtgggcagaggagatcatgatgattctgatgatgctccacagcgtcaacgacctactgcatccgcacggaggcagcgagtcgctatgactgcagatcacgtcgatgagccattcatcgctgacccagacgttcaggatgacccgatggaggcaccagctgctgtggaggacattcctgcggacgcaggcgcagaggcggctgaggatcagcctcagagatttccgggtggtccgagtgacccatatgtgctaacaacgtatgcggatcacgttgcttgcagcgtatggaggggagag

SEQ ID NO: 76183 - DNA, 462 bp, Glycine max
  Peptide Sequence Number=SeqID_167868
aactgttacgtgcagcaatcgcagtgcaagaaagacaacggcggcggctgtggctcgctggcgcagattttgcgtacaaaactgtgccagccagtgtcgctagaccgtttacggatcgtctttgatacggcgatcgatggcgaagggagcggaggtcgctgtggcaatcagcgcggccgcggccgggtgatcggggttaaacagcgcattatcttcgccggtgaggatgctaggcaccgtcatcagcaggggaaagccgttgtgcggatcgagaaacgccgcgccgatggcctgcgtctcctcctgctgctgatatttttcccagccggccggcagtttactgctgtcgagggcgatgatgtcggactccggtaccgccacggtaaacaccacaaagcggctttgctccagcagcgttttcccggcgtgcaccaccagttccagcgttgccagcgcttttga

SEQ ID NO: 76184 - DNA, 1040 bp, Glycine max
  Peptide Sequence Number=SeqID_167869
ggctacacgccctcgccttcagaggactccatgtcctccctttcagaggactgcatctcctcgcctttacagaacgacacgtcctcaccttcgaagggctgcatgccgtcaccttcatagggccacatgccctcacctttagagaactacaggtccacgcctttagaggactagacgtcttcgccttgaggagtaaaggcgctcaccttaagagggcgacacgccctcaccttcagaggactacacgtcctcaccttgggtactcatacccttaccttcagaggactacacgtcctcaccttcatagggctacacgccctcgccatcagagggcaacacgtcctcaccttgggtactcgtaccctcaccttcagaggactacacgggtacacgccctcgcctttagaggactacacgtcctcgccttcagagggttacacgccctcgccttcatggggctgcacatccttgccttcgtagggatacccgtcctcgcctttagaggaccacacgtcctccccttcatagggctacatgccctcactttcagtggactgtgcgtcctcaccttcagagggcttcaccccctcaccttcagaggactgcatcccctcgcctttgtaaggctacacgccctcacctttagaggactacacatcttcggcttcatatggctgcacgccctctgcttcctagggttgcacgccctcgccttcagaggacttcacgtcctccccttcagaggactacacgtcctcggcttcggaggactacatgtcctcaccttcagaggacaacacgtcctcggcttcagagaactacacgttctcaccattagaggactacacgacctcatcttcagaggactacacgtcctcgtcttaagagggtcacacgccttcgccttcgtagggctacacaccatcaccttaagaggactacacgtcctcgaattcatagggctgcacgccctctccttcagaggactactcgtcctccaattaagaaggctacatcttctcaccttcagaggactacag

SEQ ID NO: 76185 - DNA, 363 bp, Glycine max
  Peptide Sequence Number=SeqID_167870
atgcatgaaacaaaatatggaccaccacggcaaaataggggaggagcttgccacccagctcgtccaggcgagcaaggttgcttcctccagaagcaacagccttctggaggaaggatctggaaggcccaagtggctttcgaagaagttacggaaactaacggattgcgcaaaaacacatcttttcgatttctgacacgtctcgggacttcatttattgtgcaacaaaggacgccaagtatctcaaagcggctaaccaaaggttgcatgtcatcaagtaataatccccggacgaaattagggtatgacacaaaggaaacaaggcaacatgttgttcatgcaagcattaatgtttcatatctttga

SEQ ID NO: 76186 - DNA, 457 bp, Glycine max
  Peptide Sequence Number=SeqID_167871
ggcaaagaaggcctccttctgggggggccagagccatcagtgagataccactctggaagagctagaattctaaccttgtgccaggacctacgggccgagggacagtctcaggcagaagggagcttgactgcaagacccacccgtcgagcagggacgaaagtcggccttagtgatccgacggtgccgagtggaagggccgtcgctcaacggataaaaggttgggctgttcgcccattaaagcggtacgtgagctgggttcagaacgtcgtgagacagttcggtccatatccggaccgggaaggacgcacctctggtgtgccagttatcgtgcccacggtaaacgctggagcctccggtagcacagccgagacagcgatgggttctctgccccagcggggatggagcgaaagaagttttatcaagcttatcgataccgtcgacctcgagggggggcccg

SEQ ID NO: 76187 - DNA, 776 bp, Glycine max
  Peptide Sequence Number=SeqID_167872
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaattcgatcacagactcaccccgcccactccttcttctgtcctcccaccccctccttccctctgcttggcatggggatggcagagatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 76188 - DNA, 133 bp, Glycine max
  Peptide Sequence Number=SeqID_167873
atgggggtgcaaatagcacccaggcccatttgggccctccagaaggttcctccagaaggcgggatctcgcaaaagtttcaaccgttcttcgacgttcttcattcgttcttcatcgttcttcgatcttcaacgg

SEQ ID NO: 76189 - DNA, 333 bp, Glycine max
  misc_feature (298)..(298): n is a, c, g, or t
  Peptide Sequence Number=SeqID_167874
atgtccctgatgaatgctctgaagaatggcttcaaagtgctgagaatttgtctcagctggcctcaccctcatcctcctagcccctcggatagaaactgtcagatcctcgggattccaacagttcttcctaatgtaggccaagttaatgaccgagctcaggcgttcaaaagtaaggctattagagtcaggactggtgtggtcgggtcctcagaaggctctaaagtggcctcaagaaatctttccttaggagcagcaatcctcccaggatggcccttagcattcaaaatgaaccctcggnccggtatgcctaaggcagtctcaatctttctgtaa

SEQ ID NO: 76190 - DNA, 489 bp, Glycine max
  Peptide Sequence Number=SeqID_167875
atggtcattgaccaatccctcttctatgatttgacccaattatctagtgatggtgtaccatttgaaggtgcattagacgatgattggaagtttgatttttctgtacatgatgcccgccggttggtttgcaccaaccaagcggatatgaccggaaggctgcttgccggttcattggctcttgaaagccgcatccttcactatcttattgtttgtattttacttccaagatcttcaaaccttgcacaggtttatgaagaagatcttatagtcatgtgggcttttcataccggccgacaaattgattgggcaatgtgtaaggcattgcgattaaatgctcctttaccatatccacatttagtcactcttttcctccaacatttcaacatccctcttgattatgaaccttatgttccaatcaagagatctttcttgatcggtgctgctgtggttgcatcctttggttactgcaaagagcgtgatggctcttgg

SEQ ID NO: 76191 - DNA, 953 bp, Glycine max
  Peptide Sequence Number=SeqID_167876
ggttagtcactgccacaggattaagtcctttgatcgcatgtttagtagacactggcgattggggagttatatccgcttttgtggagaggtggcacaaggaaactagcagtttccatcttcctgttggagagctgaccatcacgctggatgatgaggcttacttgaagtcttcggagaggaagttagagctgagacaacacaatgtcatgaggcatacatacgcatatcgtggctacgagatatttatcaaagcagatgtgaggctggacattgaactattgcagctcgtgcctatctgctgcacttacactttccgagacttgagtcagagtggaagctatgcatggggagctaccgccctagtgcatatgtatgatcatttgaatgatgcttgtaagagcggcggccaacaacttgctgacaatacccgtccccgccctaccccattgtcatgtctacttactacaaaggcttattcaaaggcattaccagcatcgatataccggaaacgtatagatggactgatgattcctgatgtttgttggatgccatatggtgagcaccgaggagttcgggagtttgatttgatttcatgtttttccggtcagcttcgatggggtcccgttgtgaccattcctccacagactacgggttccaggttgtcatttgaagatattgaggacaggtggatgcattactctgactatcttgcagcagcgcggcatatttgtcttgtgcctggacagtatatccctaaggtcccagtggcaccagaagcagcaccttttgatgtggagcagcctagacatgtagtggatgcttgccaagcgatcgcaaaaaggttggagtgtctgctcaacctaaggatagtcactgtaggcacaaaaatacatgaggtcatggaagactgcataaagatcgctaggggtgtcacaacagatggcaatgtttat

SEQ ID NO: 76192 - DNA, 573 bp, Glycine max
  Peptide Sequence Number=SeqID_167877
atggcagagccatcaaagaagagaaagggatcatcttccaccgccaccgctgctgcccatcgccgtcacggcccatccggagcacccacagcacctattcctccttctttgtcatctccaagatcatcaacactgttttcatccgatgatcaacgtctacggatggtattattatgtcctgaggtgcatggtacttctatggtcattgatcagtcacttttcttttctttgactcatttacccagtcaaggtgcaccttttgagggcaccattgttgatgtctggaaattcgattattcgagtcatgatgctcgtcgcatggtctgcaatgatcaagctgaaatgaccggtagattgttggccgggtcattaacttttgataatcgcatcatgcattatatcattgttagaattttgcttcctcggtcttcaaatttagcacaagcctctgaggaggatttgattcttatgtgggcttttctaaccggtcgtcagatcgactgggcccatttggttcgataccgaatgcataaggcattacgggcaatgcacctcttccttatccacatttga

SEQ ID NO: 76193 - DNA, 1353 bp, Glycine max
  Peptide Sequence Number=SeqID_167878
atggttagaacacgaggtctacgtcgtgtggtaggcacaggtagaggcagagaccttagtcaggatgtggctgaggatgttcctcggcgtcgtagtcccactgcctcagcacgtaggcaacgggtgacgcagagagtcgaggatgttcctcagttggctgaggatgtgcctcatgcgtctgatgctgatgatgatgaggggttcccgggtgggccacgcgatccatctgttttgataggatttgctgatcatgtggcacacaacatatggagtgacaggaaagtagataaatttgggagaccggttgctgagatcgaaggtatgattgcggccaccggattggatccatttatcaggtgttctgtgatcaccactgatcctggactcatatccgcctttgtcgagaggtggcatagggagacgagcagcttccacctcccagtaggggaggtgacgatcactctagacgatgtttcgtcgttgttgcacattccgattattggcgcgctgcattcattcgagccgctggctacatctaacgcagtcgccctgttgacggagctacttgaggtcaccccagacgaggctacagctgagacacgtcagtactggatttacgagcactttcaatcagtccacaggtctgttgttgacgatggttatgctgaggctagcccacgtgcctgtaggtggcttatgggtaaggcccacatgaccgggattaaggaagccccttacagagcacgtattgatgccctgacagtgaccaacgtctgttggatgtcgtatgctgagcatcggggagttcggggctataacttgatctcctcgtacacggggcaagtcagatggggtccgatcatcgtctaccttagaccagagagggtggttcgacagatggggtacattcagaccgttcctccgccaccaattcgtgattcgttgacaggtactgatatagacgaccggtgggtacacttttcagaccatgtggcgcctacagggaagctctgtgtagttcctgggcaggtggccccagactacatggagtggttttttcagatttcgcacccctttgtgacgtcgacggaggacactactgagccgagacctgcgcctccccctcccactgatgatgacttcgtcgagccacctgtcaccgaggtttcagtcgcgtcagatcccctacgcattctgtggatgggaaggattgttaagcatttggagcgcgtcatcaacctcaggatggtgactgcagggactgacttatatgatatcatggatctttgcctgaggatagctagaatgacgacccagatgacaatcttaggccgcgacagagatcctgcatag

SEQ ID NO: 76194 - DNA, 288 bp, Glycine max
  Peptide Sequence Number=SeqID_167879
atggaagttggcttatatgaagcacatggaagttggcttatagggatatcaatcatattgcggttttcgccatcgccggcaacactggaccataaaaagctaaggttcacggtgcttacatcggcggtggacgcgctaacctcatcaacgatcattgctcttcgcggaagcttcctcgcagcaccaccgcaagctacctcggcaacctcctcaacgaagaagaagaagaggcacaaagaagacgcgcaagcaatgaagaagacgcaggaagaagaagcaggaaggtga

SEQ ID NO: 76195 - DNA, 162 bp, Glycine max
  Peptide Sequence Number=SeqID_167880
atgcacaatttgaatagctgcacgtcttccatggtggcattgccgaatgaaactacgagaaaatgcacaacaactgccacttgcagagacatggagaaatcaagtgaacaagcagcagcgactgagtgtcagaggagaagaagaagaagcgacttagcgtga

SEQ ID NO: 76196 - DNA, 564 bp, Glycine max
  Peptide Sequence Number=SeqID_167881
atggttccatcactttgtgctaatggttgtggcttctatggttcttctgccaccaagaacctttgttcaaagtgttacatagattatctcaaagaaaacgtcacgaaatcaaaagagtgtgaaaccaagaacttgagcgaccaagtttttgttcttgatcagtcatctgctacttcttgcaaaccatgtgcttctgaagtttctaacactgatgatgctactatggttgatgtttctcttaccgaccctgagggaataataaacaacaagagaaaaaagaggtgcaagtgctgcaacaaaaaggttgggctattagggttcgagtgtcgttgtggggatgtgttttgtggaacacatagatacccggagaagcatgcatgccacgttgatttgaaggaaattggtcgtcaagtcgacaggcaagatgtggacattgttcttggctctgctcttacaggtccccccaggaagcataacaagcaaccaaggatgaatgatctcatgctgtggaaatccacccagaatcatgtctggttgcaacttattgaaggaaaaatcagatag

SEQ ID NO: 76197 - DNA, 436 bp, Glycine max
  Peptide Sequence Number=SeqID_167882
gtggttgcgacgtggaaatcaacatatcggcaatgacgatgtaagagtttttcgtcgcaagttggatattatgaaacgtcatgagtttgtgtgggagccttacacaacaactattatatcattgttgcctcccatttgtgtagtcggaagtgtcgcgtggcgaaaaacaaagatgtttgttgacccacaaaatgcaaacacagctacattggtcgaagttgcagagacattacaatacatggtgtctcctcaagggagaaatacatggacagttgatgatctcgtgccttatgtggagaaaattacgattttattcgaagagcaagagagaatcactgagcctgtgtcacatggtcctgcatcagagcgtcaatttccagcaccagagtttcacattcttcagtcaagtgttgaaactcagggcataggcagatga

SEQ ID NO: 76198 - DNA, 687 bp, Glycine max
  Peptide Sequence Number=SeqID_167883
atggtgggtgacaggggatggtgggtttatgggcgctttgtggatgtggaaaacttgttgtgcaccatcgcccgaccgccacctagtaccacatgtgatggagtggtacctagagatatgtcgtgggggtcaggagaccttggggacgtcaggcgagctcctggcagtcaacagataaaaggaacaaagaccacaaagcaaggaggcttgtggcttaaaaagggaactgggagatggtggaggcctctgatcgtgatggtggcacaactaatccatgatcgagtggagatggagtgcctagagggagcttgggagaccctcgaaggcaacacgaggtgccgatttcggggcaccattcgattcacggctacttctttggtgcatccagatgaacctgcacagacacttcagcgcacggtggagtggatactacccacgcctacaccatatcgtctagtggagcccgtccaagtgatcaaggtaacgccatccgaggaagaccctgaggaggatctggaggagctacctcctgagcctgctgtggatgcccttgactttctagagggtgatgaggatccacttcttgaggtggattctcccgaggaagtcatgtcggcatctgaggcagactctacggaggatagtggcccgagagagatggcgactagtggaggctcttcatcatag

SEQ ID NO: 76199 - DNA, 267 bp, Glycine max
  Peptide Sequence Number=SeqID_167884
atgccacattataagggaaacaaatcaagatacatcaatcatagctgctgccccaatactgagatgcagaaatggttgactactaattgttttattcatatgatgtttgtagcaatatttgatcaagattgccactgtggtgctgctgagtgtaggcgtaagttgggtgtccgacctaccaagcctaaactttcttctgatgctacattaaaattagtggcatatcaggtggcttcatcttctcgtaaaaattctcgtaaaaaatag

SEQ ID NO: 76200 - DNA, 1545 bp, Glycine max
  Peptide Sequence Number=SeqID_167885
atgagtggtgttcctaagagatctcatgaggattctgttcatcagtcttcaaagcatccacatcaagattcaggtacatattccaagttgatgccatcagtttcaaatgaccaccatattccttatgatatgagtcaggattcccgggtggcaaagacagtccgtactgaacctcgtgatgcagatagaagatctcatcttcatacagtgtatcggatgccattatcttcaaatgattctcatgcagatcatcccattggacctgagagcaggacagaatctagggattttaaggagagtagagaaccccggtttgagaatcgtgatacgaagacagagaagaaggaattgcatggtgaagccagaagggattctcagattgcaaagagtgagaaggatgtgcgagttgatggcagaggagatgataacaaggatattagatatgaatgggatggccataatgattcgaaaggtgacattaagacagacaaggatggctatggtatggtaagcagcagcagccacttgaattggaaagaatcaaaagagtataggggtaagagattttctgatgcccctggtgggagtttggattcctggcatacatcacgtggaaatacaccaaccgaagttggaaaggacagttcaatggcagaagaaagagactatttggaaacacatgaggctgttggggaaaacaaaattgattctaaaagtgaagatagatttaaagaaagaaaaagaaaggatgtcaagcatcgggattggggggatagagaaaaggagagaagtgatcgcagaagcactacgccagttaacaataatagtggtgacaacaaagaatctgccaaggaagatagagatgtagaaaaatgggagagggagaggaaagatcttccaaaagagaaagaaagttcaaaagagaaggaaaaggatcatagcaagagggaatccttgaacggaatggagaaagatggtttgaatgatgggaaggaactttgtgaagaaaaaaatactgagctagaaaatgtgttaccagaacaaaagaaacagaaagatgttgacagctggaaaaatgttgatggagaagttagagagaggagaaaagaaagggatgctgatttagaaggagatcggcctgataagcgcagtaaaattgacaagcaatcagaagatggaagtgctcacggggaaggaactggagagaaggagagggaagtccataattataatgttcaacatcgtaaaaggatccaccgatcaaggggaagccctcaggtggccaatcgtgaggctcgttttagatctcatactcaagctccagacaatgaagagaatatggacagacatggaaataagaattctgttcgagaagaagtggagggatctgacagaatgcatgctgtcgtgaggaaaatagtggtggataggctaggatcatggcatcatgcaagaaaacgtgattatgaggggtccagatggggtgaagaagggtattgcgtagtggatcttgctcctagagttatttccaaaatatccttgtga

SEQ ID NO: 76201 - DNA, 279 bp, Glycine max
  Peptide Sequence Number=SeqID_167886
atggagggaattcattcttcatttgagggaatgcacattcccattttaaaggtttatcagaatggaggtttgcaaattggaagttctcgtgttgttgaccaaccaaagtgcttacacaattgcattggtgaagttattaggataaaacaacttggaaatgagaggtttggaattattaaacgatttgataaatattcccgaaaacactcgatcatgtttgaggatggttgtgttgaaatttatgacatgtcaaaagaggactgggaacttgtgagatag

SEQ ID NO: 76202 - DNA, 450 bp, Glycine max
  Peptide Sequence Number=SeqID_167887
atggaagaaagacgtgtttcctcaaaacccatttcaatacttgtcatctctgctcactgtgacactgcagttccatccatcaacgttgttgactccgtcaaccacaccatctatgatttctataacttccccgaacaaatgtaccagcataaatatcctgcacctggagctccacaattggcaagaagggtgaaggaactgctcataaaatctggtttcagccgtgttgatgaagatacaaagccaggacttgaccatggtgctagggttcctctctttttgatgtatccagaagctgacatccctgtttgtcagctatctgttcaatctcagcaagatggaacttaccattataactttggaaaggcattggcacctcttaaagatgaaagtgttttgattattggttctggaagtgctatcctgcacctggagctccctgggctttag

SEQ ID NO: 76203 - DNA, 645 bp, Glycine max
  Peptide Sequence Number=SeqID_167888
atggaaaccatatcgaaacgctttcagcagctcgatgtttatggtaaaatacatttgaagtcaaagctgcgagaaattgtttaccctgatatgaactccatgtatcctcctctagaaaaagtgaagaccaagggtgctccaaaaaaaccgcttgccaaacaacaaaagtcaacaaaacgcgatccgtcttattgggaaatcgtgatcattggtgaggaacatctgcataaagaactaactagctggtccgatcagtatatgaacctggttggtggcatagagaaatttgaggaattaaggcattttctacttgttgacaacttatctaaggttaccatggacaagtggatgaatattatggatatgggatacgtcattgcttcacaatacaatgtgatcgttgtttctctttcactacaacatagcatgacattttttcctcttagaagtgttgttatgagaccactgtcctttaccaccagtggcgttgctatggagtacacattgtcattctcaggcaaagcagtggctcactccgtacatagtgttgttatgagaccactgtcctttaccaccagtggcgttgctatggagtacacattgtcattctcaggcaaagcagtggctcactccgtacatagttag

SEQ ID NO: 76204 - DNA, 402 bp, Glycine max
  Peptide Sequence Number=SeqID_167889
atggtaccttggtgtttaatggtagtgtgtaccttgaggtgggcttgctatggtgttttaagatttgtgatggaaagtggggccaaaggatgcgaggtcattgttagtggaaaactgagagctcagagagccaagtccatgaaattcaaggatggatacatgatttcttctggacaacctgtcaaggattacattgactcagcagtgagacatgtgctactaagacagggtgttcttggtatcaaggttaagatcatgcttgattgggatcctaaagggaaacagggtcctaaaactccccttcctgatcttgtcacgatccacactccaaaggaggaagaagaatacaaccggcctcctgctgtgttggcaaatgatattgaggtggttcccgttgcttga

SEQ ID NO: 76205 - DNA, 1032 bp, Glycine max
  Peptide Sequence Number=SeqID_167890
atgttgatgaatctgacgtggcacgtccacatccaccagaaccatgcatatagtaatctccattctcttactcctccatccttcgtccagctagcaccacattcacctgaggcttccaaagcaatggcttcccttgcagcatccactgctgctgcttcccttggcatgtcagaaatgcttggaaaccccatcaacttcagtggtgccacaaggccagctccatctgcttctagtcctgcctccttcaagactgtggctcttttctccaaaaagaaggctacaccaacacctccaaaaaaagctgctgctgctgctcctgccaatgatgagcttgccaagtggtatggaagacaactaatagggtgtttggagatatcaggtcctgacagaaggatcttcttgcctgagggtctcttggaccgatccgaaatcccagagtacttgaccggagaagtccctggagactatggttatgacccatttggtcttagcaagaagccagaagactttgccaaatatcaggcatttgagttgattcatgccagatgggcaatgcttggtgctgctggattcatcattcctgaggccttcaacaaatatggagcaaactgtggtccagaagctgtttggttcaagactggagctctgcttcttgatgggggtacgctgaactactttgggaaacccatccccatcaatcttattgtggctgtcattgctgagattgttcttgtgggaggtgcagagtactacagaattattaatggcctgaacttcgaagacaaacttcatccaggtggtccatttgacccattggggcttgcaaatgatccagaccaagctgcactgctaaaggtgaaggaaattaagaatggcagacttgctatgtttgccatgcttggtttctacttccaagcatatgtcaccggagaaggtcctgttgagaacctagcaaaacatctcagtgacccttttggcaacaacttgctcactgtcattgccgggtctgctgagagagctccaactctctaa

SEQ ID NO: 76206 - DNA, 324 bp, Glycine max
  Peptide Sequence Number=SeqID_167891
atggaggattgggggaattttcttcaccgaatccttgaggaggattctgaggatttcgctctgattaaaacatttttcttggtgtggaggttcggcggcaagcaatggtggctcgtggcggccaccggtggtcgtgggtggtggagaaggaggttccactttttgcgcttagcacgacaattcacgcttagtacaactccctctacactaagtcttgctcagcggaccaattctcactcagcgcaattccctctcgggatccagaaagaatttgaagctgatccaacgattaacgaatccgggatcgcgatttttctgaaatag

SEQ ID NO: 76207 - DNA, 340 bp, Glycine max
  Peptide Sequence Number=SeqID_167892
atgctagttgaacgtcagacatttgatgaaagggacatgctaggtgcacccagcaacattgctgaacaatttgtgttctaccgaaagaaccttcttccggaagaacaatttgtgttctaccagaagaaccttcttccggagaaaccttcttccggaagaacaatttgtgttaccggaagaaccttctttcggaaagctttccgaaagaaggttcttccggtagaacaatttgttcatctagaagaaggttcttccggtagcttctccggaagaaggttcttccggaaaaacaaattgttctaccggaagaaccttctcccggaaaggtttccggaagaag

SEQ ID NO: 76208 - DNA, 213 bp, Glycine max
  Peptide Sequence Number=SeqID_167893
atggatgacttaactagatggaagattgcggaggaaagatcaagacctccagaaagtgaaaaatgtactgatgatggtgatacttactcttgcgttgttgtatgtgtggttcatgcctgtgatgatcatatatctaatgtacgtgaggagcatatggttaagaggtcatcccgtgtcttcgaagacttcgtagatatgcataccaagatgtga

SEQ ID NO: 76209 - DNA, 468 bp, Glycine max
  Peptide Sequence Number=SeqID_167894
atgactatgcaaaacatgcagtttcaacaagagaccagagcctccattcagagcttaactaatcagatgggacaattagctacactgttaaatcaacaacagtcccagaattttgacagattaccttctcaatctgtccagaatttcaaaaatttgagtgccattacattgaggtcaggaaagcagtgtcaaggacctcaaccagcaacatcttcctcatctgcaaatgaacctacccaacttcactctactccagaaaaagatgatgacaaaaatttaaagagtaaatctaaagagaagcagcatatccctcttccatttcctccaagagcaatttccatcaaaaaaatggaagagatagagaaggagatattggaaacatttagaaaagcagagtcaactggtgtggtaattcatttagctaatagaagtgttgcctatcctgctggtttcatagagatgtcttag

SEQ ID NO: 76210 - DNA, 289 bp, Glycine max
  Peptide Sequence Number=SeqID_167895
atgggctcaaaaatctaccctaaggttcatgagaacgctagggccttctttagtagctctagcccaaacctcttggagtcttctatccaatacccttggggggtgaaaaagaggctcaatcatgaagtgctaaaagtgacaattgagcttagctcatcagttaggctaagtgcgcatccactgctaagcacagctttagcgcgcttagcgctcagcgcacgattggcggtaagcttaaatccacttactcgcgctaagcgcgagggtggtgctaagtgcaacatcgcgg

SEQ ID NO: 76211 - DNA, 300 bp, Glycine max
  Peptide Sequence Number=SeqID_167896
atgtctccttatcaggttgtctttggcatggcatcctatgagaattccaaattctacaaggagaagactaagaagttccatgatagtttgatagctaagaaggacttcatggttggacaaaaatttttattgtataactctaggctcggactcgtgagtgttgagatcaaaagtgaatccacagataagggcttcaaggtcaatggacaccggctgaaaccattcctcacaaatccctccttagtggatgtagtggtggaggagacctccgtacttcaccctacttctcttccaccatga

SEQ ID NO: 76212 - DNA, 141 bp, Glycine max
  Peptide Sequence Number=SeqID_167897
atggatgagcgtccatgtggcccaggtatgccaccgaccaggcaccctctagacccggataagtttaacagggccctgggatttccagcattgatcacgggcctctgccagtcgttcggggttctcgtcacccctagaaag

SEQ ID NO: 76213 - DNA, 363 bp, Glycine max
  Peptide Sequence Number=SeqID_167898
atgccctcaccttcagaggactacacgttcttgccttcagagggctacacgccctcgccttcagaggactacacgtcctcaccttcagagagctgcacgccctcgccttcatatgactccacatctgcgccttcagagaactcaagggatcacacccacaagacacctagtggacccggagaagtccaacagggccctggggtttccagctttgattatgggcctctggattgcacccgcaagatacccagtggacccggagaagtccaacagggtcctggggttttcggctctgattacgggcctttgttagttctacggagtgcccgtcgcccccaacaaggtcatcaggccccctattag

SEQ ID NO: 76214 - DNA, 609 bp, Glycine max
  Peptide Sequence Number=SeqID_167899
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatcaggctggagtgcagtggcgcaatctgggctcactgcaacctccacctcctgggttcaagcaattctgtgcctcagcctcctgaggtttcaccatgttgcccaggctggtctcgaactcctgagctcagggagatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 76215 - DNA, 1178 bp, Glycine max
  Peptide Sequence Number=SeqID_167900
atgccctcttggggggagaaaaccgtatcttttctccgggtttcttccttccttgagcaagattgcagctgtggttggagattcggcaaaagagatggatctcatgaagcaaactcggaacggcgtagtgggcctgcctcggaaatacttggaaggcaaggcaagggatatggcgagccaagagaagtggggcccgtttgcggatatattagctttgttgatttttggggtgtcttctttccgaacgttgacggtttggtggacttagccgccattgatgctttcctcgcatatcaccatagcaaggagagtccggtggtggctatcttggcagatttgtttgacacctttgaccggaggtgtgagaaaaacagtgcacggattgtctgttgtttacccgctctctatgtgtgggttggtttcacacctattccaacaagacacaagacacccgtgtccgcttcaaagttatcgctcatgcgccgaaaaaggaagagtcgattgggaccaacatttggctggataggaggcaacgcaatcaattggtttcctcgttggaaggaaggcaaggagggagttcttttctcgtgtggggactaccctaatgttccattgatagggactaggggttgtattaattataatcccgcactagccataagacagctagggtaccccatgaggggagcaccaaccgaagaaagtctctcgcctttccttatgagggatctaggcgcgaaaagtctcaaggtgatacaaagagtccacaaggcgtggagaagtccgttgaagaaagacaaggagcttagaggcatccgaaatggcgtcatcggtggttatcatggatggctaagagttcacacgcgagggttagattggctctccaaattgaaagttatcaatgaggagaactttgaagctccggaggaagatgaagaagtccaagctctaaagttagagctagggaaggcgagactcgccaaggagaagttcaaatcagccgctacacacatccagaaagagtgcaccgagttacaagaggaaaacgcggccactgtaagagcccttgaacaagaaactaaaagggcccgcaaggaggaatatggccgagagaaattccgcggagcattgtggggtagcaacaatgagctcaagctccgaagagaggaaagagaccg

SEQ ID NO: 76216 - DNA, 129 bp, Glycine max
  Peptide Sequence Number=SeqID_167901
atgtcaacgatagtcctaggaggtttcaaggataactgggaagtgtattttacttatcaaagaccgctgggaaccagagagaatgaaggcaattcgcattcagtgggaaagatattatctaaaagttaa

SEQ ID NO: 76217 - DNA, 711 bp, Glycine max
  Peptide Sequence Number=SeqID_167902
atgaccaccttgacccagacgtggatgacgctgctgctcagcaatgtcctgcctagcgatcataactccaatctccctctgcctaagtgccagctggtgtatgccatcctgacacggatgagcgtccacgtggcccaggtgattgctgacgccatctatttgtttgcaggtatgccacccaccaggcaccttctagacctggataagtctaacagggccctggggtttctggcgttgattacgagcctctgccagtcatttggggttcccatcgcccccagtaaggtgattcgaccgccgatcacacgggccttcatcgagaagtattgcacgcctaggcaggcgcagcgtgatgcacatcaggctgcagacacaccgccaccacctcgacaagccgatcccactggatcactaggcatggagcgttatctacagcacttagttcaccagcaggcggccaaccaccgtgggcaggtgcagatacatgagtgtctctaccggttcagcctcaatcagcaggggcagggttctgctccttttgcatgccctactctggagcagtttggggctgaggtcgcatggcccggagactggcccgaggcccaggcaggggaggagcctgcaggatcccccggtgaggcaaaggaggcctgtatggatgaagatatgactgacttgctcgatttcttgggaggaagcagagccacgtga

SEQ ID NO: 76218 - DNA, 486 bp, Glycine max
  Peptide Sequence Number=SeqID_167903
atggaacttatgagactccatcaacatgaagagaatgataacaagaggaaaggaatatcactcaaagcctcatccttttctattcaagaagaaaagattcaatatgtttttgagaaacaaaagaaatcaaaggaaatcaaacatcaatccaaagaagaaaggagaagatcctccttagccccaaagtgctataaatgcgatcaacatgggcacttgagatttgattgtcgtgtctttaaaagaagagtggaaaaatttgacaagagaaatttcaaagaaaagaaagcatacatcacttgggaagataatgacatggattcttcaagtgattcagaaaatgaaatcataaatctgggtctcatggtcaaagactatgaaagcgaagaagaggtaatgtcttctaactatgacttatctatttcttttgatgaactacaagatacattcaatgatttgcataaagaatctgttatccaggaactttaa

SEQ ID NO: 76219 - DNA, 369 bp, Glycine max
  Peptide Sequence Number=SeqID_167904
atggtgaaagttggaacctcttacgtgccgatcaacgtctcattttcgccaaaagttggcccagggcttcccggtatcaacagggacaccaggatttatttattctgcgaacaccgccggacatcagcgctggcaagtgtagcggtcccgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaa

SEQ ID NO: 76220 - DNA, 207 bp, Glycine max
  Peptide Sequence Number=SeqID_167905
atggatggatataacagagatgggatatgtcattgcattaaggtttatttgaaagaccgttgtcctttaccgcctctcgcattgttgtggtctatgaattgtcagcctctgtcaaagcagtggccaactccatatattagtagaatgaaacagtgcaatagcttaaaggtgttgaaaagagactatgtcgacctaaatgaagactga

SEQ ID NO: 76221 - DNA, 354 bp, Glycine max
  Peptide Sequence Number=SeqID_167906
atgttggtgcgcatgatccgcactcgtctttttgcagcggcacgggtgaaatcttgccctggtatgcatagtagatgcgtgatagcctccctctctggatgtgctcgcacagttggtcgccctccaatatcagggggtgtggatatggagcacactgaaaatgagacgcgtagccctctaaaggcgagggcgtgcaaccctttgcagacggaggatgtacagtcctctgatggcgaggacataagtcctctaaaggtgataggtactagtacccaaggtcacctttatgagaaagcagagatcgactcatcgagagggtcggtcatcccaaatccacacgactggatattagat

SEQ ID NO: 76222 - DNA, 507 bp, Glycine max
  Peptide Sequence Number=SeqID_167907
atgccatatgtggaagccgcggaggtgtcattagaaacaaccttccagtcttttgaggtggtaagcattgcctccgtagattccttctctgggcaaccttgcctgtctgatacgacagtgatggtggcccaggtgatgttggggaatggttacgagcccggaatgggtttaggcaaggacaacggcgacagaaccagcctgataagtgccagaggaaaccgtgggaagtttgggttaggctataaacccacacaagtggacataaggaaaagcgttgcgggaaggaagaacagaggtcaaggctcgctgtcgcaacctacccttcggcgggagggcgacgcgggggctcacgggggcgtcttccatggaaggaaaatgcgcggagtcgccaccaacgtttattcgaggaaaacgtcagaaaaaccagaaaaggcgtgggagttgtatttacgcacggggatggtattagcaccccacgcgtccgtcacaagggacgacagcctttaa

SEQ ID NO: 76223 - DNA, 180 bp, Glycine max
  Peptide Sequence Number=SeqID_167908
atggcaccacatagagctcaagatttagtatttgttcatagcaacgatatagctggagatgattttggaccacttgatgattgtggtattcttgaaattgctagtttgtctttagatgaaccagagttagatggtgtctttttcaatgatgatgatcacctagagggtgaaaggccttag

SEQ ID NO: 76224 - DNA, 204 bp, Glycine max
  Peptide Sequence Number=SeqID_167909
atggtggaaaatcttcacgaaatcgcccacagaaacgtctcagaagcgttacggaagcgcctcggcgggaaaagagggaggtggttgccggccagctcgcccaggcgagctgggttgcttccaccagaaggcaccgccttctgttggaacatcctggaaggcccaagtgggcttgattgctatttgtacacccctgtttactaa

SEQ ID NO: 76225 - DNA, 153 bp, Glycine max
  Peptide Sequence Number=SeqID_167910
atgtcgcggaactttacggattacctaatgatgggtgttaagtacctcgaggcggttaagcgacgattgcatgccaccaaacaatggtccccggatgaaattaggaagaggagactgaaaatcgtgtttttcacactgaggacgtatttataa

SEQ ID NO: 76226 - DNA, 192 bp, Glycine max
  Peptide Sequence Number=SeqID_167911
atgagagaggaacccgcacgcacgcttcagcggactgtggagtggatactacctacacctactccatatcgactagtggagccagttcaagtgatagaggtgtcatcctctgaagaagaccctgaagaggacccagaggagttacctcctgagcctgctgtggatgctcttgacttacctgaggatgattag

SEQ ID NO: 76227 - DNA, 531 bp, Glycine max
  Peptide Sequence Number=SeqID_167912
atggggcccggtgttggcaagctcgccgctgcgcaattcacgttcaacgttggcgaagaaattgcgaatgatacccttgccggtcagcgccaactccttcatcgccataccgctgttggtgaacaagcgcccggtcatacgcatgcggtgttcaccgccgttgcgatggatcaggcggacaaactgcgggttgccgagcggcgtaaaggtgacccattggtggtgcgtcagcgcctgtggcgaatccggcacgccgtgatgcgccaggtaggccggcgaggcgcacagcacttcgcggcagcgcgccagccgcgtggaaacccgcagcgtgagacggggatgttcgtcgagaaaactttgcagcgccggcaccagatagtgagtggcgaattcggtggaggtggcgacgcgcagctcaccgaccagttcgccgcgcagtgcggcgatccgttgttggccacgttcggcggcgtggatcatcagcaggcaatcttcataaaagcacaatccggcttcggtcagactcaatga

SEQ ID NO: 76228 - DNA, 642 bp, Glycine max
  Peptide Sequence Number=SeqID_167913
atggtcgtccacagagagaggcgtgtccagctcagggaggatgagtatacggactttcaggaggagatagctcgcagaccttgggcgccgctggtgactcccatggctaagtttgaccctgagatagtcctagagttctatgctaatgcttggcccacagaggagggagtgcgagacatgcgttcgtgggtgaagggccagtggattccctttgacgtagatgccctcagccagttcctgggtgacccgttagttttggaggaaggattttgcccggaccgctgcagggaggcgggtgcggatcatgcgcaccagcatgaccactatgacccagacgtggatgacactgctgctcagcaatgtatggcacccaccaagcaccctctggacccggataagtccaaccgggccctggggtttccggctctgatcacgggcctctgtcattccttcggagttcccgtcacccccagtaaagtaatccgaccgccgatcacccgggccttcatcgagaagtactgcatgcctaggcaggcacagggtgatgtacatcaggccacaaacgcaccgccaccacctcggaaggccgatcccactggatcactaggcatggagtgtaacatcccatttttcgtaagctaa

SEQ ID NO: 76229 - DNA, 633 bp, Glycine max
  Peptide Sequence Number=SeqID_167914
atgggaagagttcatgagggatccacggttgttcataacactcctttgttgcctggccaagtaaaggtgagtgtggaggaggttacagatgcagatgctccagttcctgtacccactgatgaggtttccttagtggggcagacacttcacaccttccttgcttggccgacacatctggtcaagtctttatcacagcaggtagttgtgtctccggcaaaaccacctccaaagcccgatccagaggttgatgatccgctttatctgatgacattaaccatcccagagcttttcttgaggccttatcaggttacatgggatgccaccgtgttcggggtctttaatctagatttctcactctacataaagcacgaagacctctccgaaattgcacacgatggtcaatgtctcagcatttcagtgttacagttgtggattctgcatttcactgatacaagtatgcgagcggggaattctgatatctatggattcctcgagccacagtccattcagaggtctgggcaatcgcagtttaagtctgaaagccagacaactaccttaaggggattattaacaggtcttgatgatgctccacaggctaaatcaaaggctcctgctaggtggattgtcgtcaag

SEQ ID NO: 76230 - DNA, 150 bp, Glycine max
  Peptide Sequence Number=SeqID_167915
aggtgtcttctggagtggacctttgtcttcatcttcgcaatgaaccttgatgtttctcttccaccttcattactagagaaacaacattctacattggttatttgggagcaactacatcgattgacgaccatcgtcacagagttgatataa

SEQ ID NO: 76231 - DNA, 246 bp, Glycine max
  Peptide Sequence Number=SeqID_167916
atgcccttcggagaagctttacagcaaatgccactctactctaagtttttaaaggatatgttaacaaggaaacacaatcctttcgctaagcacaagcctcgcgctaagcgtatctttggtcatgcgctaagccgagagtctctagcgcttagcactaaacccttgcatctcaggctgatttggttcgctaagctggccaaggctgagctaagcccatttcaattcgatttgaattgggctaagtga

SEQ ID NO: 76232 - DNA, 135 bp, Glycine max
  Peptide Sequence Number=SeqID_167917
atgggagaagtgaggagaagggaagggaagggtctcatgtgttttagagaaggaaaggtttttttcttggaggaggaggagaagggaggagggctcgtgtgttttgggggggtggggggttggggtgaagaaggg

SEQ ID NO: 76233 - DNA, 186 bp, Glycine max
  Peptide Sequence Number=SeqID_167918
atggcggaccagctgaacagatcgccaaggtattgcgggctgttcggatccagcgcttcggtagccagaggcagccccatgctgaccagctccaccagcaggcgacgcgcaatcttcagacctgcttccacatcaaacgagccatccatgtgcggatcgttaatcaaccctttccagccgacagtg

SEQ ID NO: 76234 - DNA, 1905 bp, Glycine max
  Peptide Sequence Number=SeqID_167919
atggcccccagaatcctactatgcggcgacgttttaggccgcctgaatcagcttttcaagcgcgtctcatcggtcctctctttccctagggtgaacaaatctgcaggtccattcgacgccctcttgtgcgtgggtcagttcttcccggactcaccggagcagctcgaggacttcacgaaatacatcgaaggtgggtcccactttcctctcccgacgtacttcgtcggcgactacggcgtcgccgcccccaaacttctcctgcaagcttccaaggactccgccaaccaaggcttcaagatggatggcttcaaggtttgccacaacttgtactggctgaaaggcagtggcaaattctccctcttcgggttatccgtggcctatttatctggtaggaagtcttccagtgctcaacagtttggaacttacactgaagacgatgttgatgcattgcgagcaattgccgaggaacctggaattgttgatttgttcttgacatatccttcaattcatgtgcattactcacctgattcggacattcctgccggactctctgatgctgcaggcggtgattcaaccgtatcggagttagtacaagagatcaaaccacgttatcacattgcaggcactaaaggtatatactatgcccgcgaaccatattccaatgttgatgctgtgcatgtcactcgtttcatagggcttgcgtctgttggaaataaagataagcagtgctgtaacattttatttgcttctacatttcagaaatttattcatgcaatctcccccacacctgcatccaccatgtcttcaactgagattgccatgaaaaccacaaataccaccttatcaccatacacatatgaggagaaaagaacttctccaatggattcaacaaaaagatccagtgattctatctctgatcctcaatattggagatatgatgtttctcaaaagcgacaaaaacatgaagctggacacggtgataaattgtgtttcaaatttgtttcttctggttcttgtccacgaggagagaagtgcaattttcgacatgatacagatgcaagggagcagtgtatgagaggtgtttgttttgattttttgaacaagggaaaatgtgaaaggggtccagattgcaactttaagcacagcttgcaggatgagggtggtaggcttccttctaggaggcctggatctggcagcccaaatgtggagtcacatttaatcataagcattggggaaaattactacttggcactggctaaaggtccacttgttgaagaccatgtactgattataccagtcgagcatatgcctagtaccttatccatgtcttctgaatctgaaatagagctctctaggtttcagaacagtctcaagagttactgcaagagccaagagaaggaagtcatcttttttgagtgggtctccgtacgtggcactcatgccaatattcaggccattcccattccatcttccaaagcaattatggccgagaaaattttcaatttagctgcacagaagttgggatttgaatttgtgactaagaaatggggtgtttttgattttttgctacattcttatgttgttcttttatgcaactcagttgatagcatttctgaaggaaggaagtttttgaaggcgcaaattgatggggattcaagcttgttctatgctcaaatcccaggaggcacaattctgctgcatcatgttgaagagaaagagaaatttcctgcccaatttggtcgtgagatagagttaacactagtgaacatgaatcaggttctggctgggttgcttaatatggcagataatgctgattggaggaatcgcaaacatagcaaagatgaagaaatgaaaattgttgaagttttcaagagccgatttcaagaatatgatccaaactgttag

SEQ ID NO: 76235 - DNA, 1458 bp, Glycine max
  Peptide Sequence Number=SeqID_167920
gcacaatcacgaacatggtcatttctccaagcaccaaaagaaataacccttaagcttattcgtgaccccgtgaccctttcactagcctcaactgattatggccacatagttcatgacaacccttttgcaatatttgctccatcttccattagtgacatctcactcttgataaatttctcaaattctctggccatccctatcaccatagctcctagagggcaagcccactcgattcatggacaagccatgacaaatgatggggttgtggtgaacatgactgagttgaatggctttagaaatggtgatgggattatagtagtgtctgatgacacaacagctacaactattggtccatatgctgacgtgggtggtgaacaaatttggattgatgtgttgcatgcaacacttgagcgtggacttacacccctctcttggactgattacttgtacttatcggttggtggaactctctccaatgctgggataagtggccaaaccttcaggtttggtccccagatttccaatgttcatgaattggatgttgttacagggaaaggagacctagtgacatgttctgcggagaacaactcggagttattttacgccgttctgggaggtttaggccaatttggaattataaccagggcaagaatagctcttggaccagcaccaacgagggcaaaccaagaatacttaatctcagtcaatggaagaaatgagactaatgcagctgattatgtagaaggttttcttttgctaaatcagccaccacaggacctttccttttatccagaacctgatcatcctcgcataacttcccttgtaacccaatacggcatcatctacgtcatagaacttgtcaaatattatgacaatagtactcaagaacacgttgatgaggatgtgaatttttgggtcgaggaattaaagtttgttcctacgtttatgttcgaaaaagatgtgtcgtacgaagagttcctaaacagggttcatgctgacgagcttttcctaaggtcacaagggctttgggatattcctcatccctggttaaacctctttgttccagcatctcgaatctcggatttcgacgaaggtgtgttcaagggcattattctccagcaaaatatcactgcaggacttgtgataatctaccccatgaaccgaaccaagtgggatgataacatgtcagcagttacacctcatgatgatgttttctacgtcgtgtcatttcttcattcaactgggtttgataagttggaggaatttcaggctcaaaaccaacaaatattacagttctgtgcgaatgctggtattgggataaagcaatatcttccccaaaacaaaacacaggaagaatgggagaagcagtttggccccaaatggaaaactttcaaagaaagaaaagctcaatttgatcccaacagtatattgtcacctggacaggggattttcaattaa

SEQ ID NO: 76236 - DNA, 384 bp, Glycine max
  Peptide Sequence Number=SeqID_167921
atgcataaggcattacgtgcaaatgcacatcttccttatccccaacttgtcactctttatctccaagactttaacattcctctagatgatgagtcttttgttaaagttaaatgctcttttgctattggggccgctgttgttgcatcttttggatatcgaaaagacatagatggtcaacgggtgcggaaacaagatcttccaccgactcctaatgaacgcacaccctctccaccaccacaaaggaattcctcttcttccttgctgcaagatgttctaagtgagcttcagggttcgggcttttgttggggcagagatatccgtaaggttttgatgatgtcaaagaccaagattgcttcaaactttaattcaagatcaagaaactaa

SEQ ID NO: 76237 - DNA, 1509 bp, Glycine max
  Peptide Sequence Number=SeqID_167922
atggcgtcttcaccctccctaaagccgccagagctgatttttttcgctctctggtgcaatcttttggctgcacttactttgttcttctttgatggttactgcgatgtaacgaacaaccaaccaagctcttatttagggagtgtagctgaaaggctttttcaccaatatcgggctttaacatttgatgtcaatcacgaatgtgtacctggagtcgctttcaggaatcagcttccctacattgagctgcaactattggatcttctaagactgacttcgacagaaatacaaacacaattctttcaagaagcaaggattgagattgctgttttcatggggtgcaaaaacggagaaattgagcttgggttctccaacatttctcaagtaattaagaaaactatactaccttcatcatcattttgcttcatgtcattatccacgggtagccctgatcaatgttcatcatcactattactcagtagtattccgggtacttcccagtcccattttcctcaaacccttcccacacaaacacaccaacaacaaagcatccaagaaatagatttagctcctgtcattccaagttattttcccacaccagatggtgaacatgaagcaatagtaagagcacttatgagtgttatgtctccactttcttcttcttcttcaacttctcagcagcatcaaccccgccaaattttgcctaattatacttcaatagtacatccaggagccaccgctttcaatacatatagatcagatacaatgaaccctaatataacaccctacatgggatccaattttcgcaggcaaagcccacagaatagatcatttgcattctttacaaacttaaatttgatgagaatgagagaactcgttagtcaacctgcatcccgtcccattagtacccaacaccagcagcatcatatgataacagagcgaagaaggcgcgaaaaactcaatgagagttttcaggcacttagagctcttcttcctccaggaactaagaaagccaaagggacgatccttacaacagcaaaggatacaatgagatcattgatggatgaaattgaaaagattaacttgagaaatcagcagctgatggcagttttatcagcaaaagaaactacagtgtcagctactagtactgaagaaaacaaagctaaacctagcagtagctcctcaaatgaaagattgaatgttcttgtttcggccgtgttggaatcgagttcattatcagaagagcgaatggtggacgtgcaagtgacactgagaggagaaagttctcgagttgatgtattgattcggctattggaattcttagaaagggttcagaacgtaaacttggtttccatgtacgcaaacaaccatattataggagggacaaccattaaccaattaaccttcagactgaggattattgagggcaatgaatgggacgagcatgccttggaggaagcagttagaagagtggttgctgacacaatacagtggaaaccactggaccaataa

SEQ ID NO: 76238 - DNA, 552 bp, Glycine max
  Peptide Sequence Number=SeqID_167923
atgtgtagaaaatttgtaccttattataatttagcatcgggctatcagcagttcctttgtacctctgtttttggttctgattgtcctctatatgtccactcactattgtctttcagaggtccttggggtgcactttcacccgtcccagagaataatgctattgctgtcaatactcaggggggatctgtttttgccgcatctggtgattcttgtgcatattgttgggatgtggaaactggtaaagtgaaaatggtattcaaggggcacatggactatttgcattgtatagttgctcgcaactcatcaaatcaggcttatttaccatatttactagattgcaaaagtggaaagtgtacgcaagtgattgatccagcaagagatttgaaattaaagggatctgcttcatgggttggttgtgttgctttagatgcaagtgagagctggttgcaccgtggtggagtgggccctggccgcaaccggggcctccataacggcacagttcaatgtcgtggctgtagtggcagggacagcgctgctattctgttttactga

SEQ ID NO: 76239 - DNA, 1167 bp, Glycine max
  Peptide Sequence Number=SeqID_167924
atggaagaaagaagcgagcttggaaagagtgggagagaactaggactcaagaatggctttgaacttgacaacatttttcatttctacatacctaaaggtagaaggcgctctaaatctgatggaagtgactcagatgaagagaacatgtctaagaaagagttggcccttcaacaagctcttgatcagatcacttccgcatttggaaatggatccatcatgtggcttggtcgttctgtctcaccaaaaagtttacctgttgtgtctactggttcttttgctcttgatgtagcactaggacatgttgtggaaatatatggtccagaggcttctgtaaaaacaattcttgctttacatgtgattgcagaggcacagaagcaaggaggctattgtgtctttgttgatgctgagcatgcccttgataagaaacttgcagagtctattggtgtgaatacaacgaacttgcttctctcccaacctgattgtggtgaacaagcactaagtcttgtggataccttaatccgtagtggttcagttgatgtaattgttgttgatagtgtaaaaactagtgtgcttgattataacataacttctagagaggatgagaatgagataggtaatgtgggagtggaacattgttctggaaagggtgcatttcttagcatggacttaggggtggctgctcttgttcctaaaggtgagcttgatggtgaaatgggccatgctcatatggcaatgcaggctaggttgatgagccaggctcttcgaaaattgagccattgccttgtcaccttctcaattcaggttcttgtcaaggttgtgaagaacaagcttgtccctccatttaaaattgccgagtttgagcttcaatttggcaagggtataagcaaagaaacagagattatagatttgagcgtaaaaaacaaactcatctcaaaggctggtgcaatgttttactataatgaacagagtttccgtggtaaggatgccctaaagaattttctggctgagaatcaaagtgcattagaagaacttgaaatgaaactcagggagaagcttcttaatgctgagacagagaagatgtgggatgtaattaatggagatgttagagaagcaattgcaacagttgattctactgacgaagaagctgcagctatagttgaagcatga

SEQ ID NO: 76240 - DNA, 3888 bp, Glycine max
  Peptide Sequence Number=SeqID_167925
atggcaacatctagcaagtttgatccatcttctagtagcccggacaaaccattgtaccctgggcaacgtggatcccacatagctgcttcattagatagatcaggtagctttcgcgaaagcatggaaaatccaattctgtcttctcttccgaacatgttaagaagcagttctctagcaacaaatggagatgtggaaagcttcttcaattatgtgcgttttgatccaaagttgttaacactagagcataagtctaatcgtcaaatggattttaagcgacatgttaatgctgctcttggaatttcacctgatgaatctccatctagttcttcaaaaggcaagctactgccatcgcctgtaccagaagacatgaaacgggtaaaggatgctttgggtgcaaacattgtgaaggcaagggaacgtgtgaaaatgtttagtgaggctttatctgtattccatgaagttttcccagctataacttcaaagaaaagatctcgagctgaaggtttttctaatgaccgttctaatgtcatgttaagtgatcgtccagtcttggggccaagcataggcaaggttggagttcaaggtcatcctgtcacaggtggttttgaacttgagcagcaaaagtctgatgaacgtaccaaaaatgttgttccaaacaagcgcactcgaacttctatggttgatgtaaggatggatgtgcggactaattctctcgtcaggccatcagggacagttgacagagataaggaaaagctacggattgccaacaatggtgtcgttcagagtgaagaacgaaccttacctattggaggtgatggttgggaaaagtcaaaaatgaagaagaagcgttcctgtatcaaactagatgtttctccaagtacaacattgactaaacctgttaacaccttccaagaaactaaacagggaatgcaacaaagacttgctaccgattcgcgatcaaaattgactaatgattctcattctttcaggccagtagtttctaatggaactgttggagctggaaaatcagatggtatctctcaacaaactgggttgggcatacgagcttctacccctagaaacaaccaagataataattcccttgtcaatgataggaggggtcgtcctgttagttcagacaaggaaagggtgaacttcagagctgtaaacaaggcaactgcacgtgatgaatttaattcagctagccctacctcaagtgccaaaataaacactgctattcgggctccacgatcaggttctggagttgcccccaagttgtcaccagttgtccatagagcaggtgtttctaatgattgggaactgtctcactctaccacaaagccccctgctgctggtggtactaacaatcgtaaacgtgtagcatcagcacggtcatcttccccacctgttgtcccctggcagagaccacaaaagagctctcgcactgctagaagaacaaatttcatgcctattgttccaaatagtgatgaagcttcagctttggatactgcatctgatgtggctggtaatgatcttgggttaggatttgccagacgcttggctggcagttctcctcagcaaattaaacaaaaaggtgatccttcatcttcagctgccttgtctgaaagtgaagagtcaggggtagctgatgttaaaccaaaagaaaagggtaggaaagcggaagagatagatcagaaatctggacaaaatgttcaaaaggtgtctaatatggtattgccaacaagaaagaataagcttgtttctggggaagaacatggagatggtgttcggaggcaagggaggacaggacgcagtcttgctgccacaaggtcaatgattccaatgacatctgagaagcttgggaatataggaactgcaaaacagcttagaagtgcaagactaggatccgataagaatgaaagcaaggcaggtcgtccaccatccaggaaactttctgatcgcaaggcctatgcacgtcaaaagcctgctattaatgcagctgcagatttttttgttgggtcggaagatggacatgaagagctgctagctgctgtaaagggtgttatcaactctgctcatgcattctccagccccttctggaggcagatggagcctttcttcagtttgataactgaggaggatattacttactggaagcaaaaggtaaatcttgaatcaagcactctgacaccaactcccgttccttcaaatatagatggctgtgaaaccattgttaatggatatgggttgatgggctgtgaaagagatgctggatttgatgctcaatggaatgctggaattgttgcagaacagtcacaactatctaagggagatcataatgtgattcctctctgtcaaaggcttatagctgctttaatctcagaggaggagtgtagtggtggaagtgaacacttcaagtttgatgcatatgataatgaatttgagcctgatcgggaaccagaattgaatggtttggatcaccactcaggaacagattttcagtttgcttgtcattctgcttataatggtttcaggattttggacaagccagaacaggatgaaactgaaagggatatagttggtattcctccaactgggttgaattcaagctttgataaatccgtaaatggttttcttcatgataaagcaatgtctagcttcacctgttcagagttacaatatgatagcttggatataaatgataagcttctcttggagcttaaaagtattggaatttccccagcaccagtgcctgatatgttgcaaacagatgatgaaggaatatcagaggatattattaggttggaggagctttacctaggacagatttccaagaagaaaaacttgctatatggattgttcgaatctgcctcagtggataaagaacttcaagaaaaggattttgagcaacgtgctctagataaacttgttgtgatggcttatgagaaatacatggcttgttggggtcctagtccctctggtgggaaaaatacaagcaacaaaatggccaagcaagctgcattgggatttgtcaaacggacattggggcgatgccatcaatttgaagatactggcaagagctgcttcagtgatcctttattcaaggatatgttccttgctgaatcctcaaaaccttatgcctcttccctttctgtggaagcaagaacagcttccatgggttcacagcagagcccatcacagtttagtcagaatatggataatcatgatctcaattcatcagatgtgcttcctggtttaaattactcatctgagcaaacaagtgggaaggaagatctctggtcaaacagagtgaagaagagggaattgtcccttgacgatgttggcggtactccaggtatttctagtgctccaggcatcggaagttctgtaacaagcagtgcaaaaggaaagagaagtgagagagacagagacggaaaggggcacagcagggaggtactatccagaaatggaactactaaagttggtaggccagcatcatccagtgctaagggagatagaaaatctaaaacaaagcctaagcagaaagcaactcagaattctgtttctgtgaatggcctccttgggaagctaacagagcaaccaaaaccagcattgccttctgttccaaagtctaatgaaatgcctacaaatagcaatgcaaaggaaaaggatgagtttggcttgggtggattggatgaccacgagcctattgacttgtccaacctgcagctacctggaatggatgtacttggtgttggtgatgaccaaggtcaggatcttggttcgtggttgaatattgatgatgatggattacaagatcatgatgactttatgggcggccttgaaatcccaatggatgatctatcggacttgaatatgatggtttga

SEQ ID NO: 76241 - DNA, 1611 bp, Glycine max
  Peptide Sequence Number=SeqID_167926
atggaggaaatatcttctagtgttgcagtaccttttacacttggtgttggaaatttgattcaaaaggagtctgcagtgaccactcacatggagataactgggctgaagcttatggcaaatacagcagctgctgctttgatgttaaatccggcagtggagtgtttaaaggagaatcaagttggagctgctcttgtttcagaaatggttattgaatgtgagagtaattgggtcttgaatgaaggccttaaccaggcaagaaaggaagatgaattaatgttagcagtggattttcagtgtctgcatagttcaagctctcaatctgtggctaatggcaaaagtgatccttgtagggaggaagctgcgttgtggaagagtagcttttctgaaatagattcaccaatcatcattaaggtggatgatgatgttgatggtaagtctggaataagcaagctgtgtccatcaacgaagctagtggaggacacagtttgttttgctatggatattactaacgaggatcaaagtggatcagatgagtctgatcctagaccatccgctgtgcttcttgatcagttgccaggggagaataaaacatggagaacaagcaacccgaatgctttgaaattgaatagtggccctctctggggttgttcatcaatttgtggaatgagacaggagatggaagatgctatttctgttagacctcaactttttcaagtttcttcacagatgttgattaatgaccatgtgaatgagaatggaaaacagtcactagcccacttttttgctgtctacgatggacatgggggccttcaggttgccaattactgccaggaacgtcttcattcaacgttgattgaggagatagagactgcacaatcaagttcggctgaaacaaatgggagagatgattggcaggaccaatggaagaaagcattcatcaattgttttcagaaaatggatgatgaggttggaggaattggtgcaagtaacaaaggaaacaacagtggtgggtctgagtctaatattgaaactgttgctcctgagactgctggctccactgcagcggttgccattttaagccaaacccacatcatagttgcaaattgtggagattcaagaactgtcttataccgtggaaaagaagccatgccattgtcttctgaccacaaaccaaatagagaggatgagcgggctcggatagaagctgcgggaggaagagtcatacattggaaaggatatcgagttcttggtgtcttggcgatgtcaaggtccataggtgatagatacctgaaaccatggataattccagaacctgaagtcaatattgtgcgtcgagaaaaaaatgatcagtgtcttattctagcaagtgatggtttatgggatgtaatgacaaatgaagaagcatgcgaggttgcaaagaagcgaatccttctttggcacaagaagtatggtgacaacggcacaacaggacgcagtgaaggagcggatcctgcagctcagtcagctgcagagtatctaactaagcttgccatccacaggggaagccaagataacatctctgtaattgtgatagacttaaaggctcaaagaaaaattaagagaaagccataa

SEQ ID NO: 76242 - DNA, 720 bp, Glycine max
  Peptide Sequence Number=SeqID_167927
atgtctgacacagaagaccatgcagcatcagagtattccaatggtgacgaatcccctccaaagcccagacagaggttcagggacagatctaaggagatgctgtccaaacaagctgtgcagaccaagcaaatgctttccaaacaggccgttaagattgccaaacaagctgaagaacacgaaaggttcatcaacaaggtgacgcatctcgtgggggtcctcggttttggtgggttttgcttccttttaggggcaagaccccaagacattccctatgtatattgtttgttctacgtcatctttgttcctcttcgttggatatactataggttcaagaaatggcattactatctactagacttctgctattatgccaatacaatattcttagttgatcttcttttttactcatcgaacgagaagcttttcatggtttgcttttcttttgctgagcttttgcaggggccattagcatgggctttgattgtttggcgctgcagcttggttttcagttctgttgacaaaattgtcagtgttcttatccatcttttacctgccaaagttgctgttaatgaccattacaatgaagcctcttcttccttgatcatgcaacactccaacctactctttgggctgatgattattccagctgtcttactgagttatatttctaacagtgctaatctatctgatttctacagcatccttgagttgcctttctag

SEQ ID NO: 76243 - DNA, 534 bp, Glycine max
  Peptide Sequence Number=SeqID_167928
atgttgaatgaggatgaaccatcaaacatcattgcacaatcccttgggggcatttgtgctctccaaggcaacaaggggggtttgagaatacaatctgggatgttgaatgaggatgaaccatcaaacatcattgcacaatcccttgggggcatttgtgctctccaaggcaacaagtggggtgaaaaagacagcagcagtgatggtgttgatgggataattggcctttcattaacccttgacgaatggatgaggttggattgtggtgagattgatgatgatatagacaatatcggtgagcatacttccaaacttcttgctgcacatcatatcatgcaaaagattgattggctggtgtctgaggcggggaacaataatgatgagtgtgaaatagtagccaaggtggagttgaaggccaacaaagaagataaaagttctgaagaggaggaggaggctattcctcagttcagaattacagaagtacatgttgcaggtctgaagactgaacctcacaaaaagaaggtttggggcacttga

SEQ ID NO: 76244 - DNA, 1098 bp, Glycine max
  Peptide Sequence Number=SeqID_167929
atgcttacgtgcatagctcgtccaaagaaacctgatgagtcggatccaaacaacgcgacaagcgccgctaaatcgcaagccgtcaaatctctcacttctcagggatatggcgctgaaggcttcgggagcgtacaagcattgcgcaccgtgcacggggccagcgacgcaggggcgatttcggagcaacaccaccgagtcggacgcggattcggaccggttccggtggtcgtaccggagaacggggagttcgagctcgacgacgacaaggacgtgggggaaggagatggaggcgcggctgaaggggatttcgagcggggaggggacgccgaactccgccagcgggaggcgggcggagccggtggtgctgtggagcctggcgttttgattacgttcgtttcgttgccacgtggcgggaacgatctgaagcgcatacggttcagtcgagagatgttcaataaatggcaagctcaaaggtggtgggcagagaactacgacaaagttatggaactttacaatgttcaaaggtttaaccgccaagcatttcctcttccaacgccaccaagatctgaagatgagagctcaaagcttgaatcagctgaagaaagccccgtaacacctccactgaacagggaacggttacctcgtaatatgtaccgtccaacaggaatgggaatgggatactcatcctcagattcctttgatcatcagtcaatgcaatctcggcatttctatgactcaaatggtatgaactcaacaccgaaagtgtccaccattagtgcggccaaaacggagatatcatcaatggatgcttctatcagaagtagctcatcgagagaggctgatcgctccggtgatttttcaatcagcaatgctagtgatttggagactgaatgggttgaacaggatgaacctggggtttacattacgatcagagcattgccaggtggtgcaagagagctcaaacgagtcagtcaatggaatttatttcttggtgttctcatgtgttacacagccgagaaaaatttggggagatgcatgctagattatggtgggaagagaaccgtgccagaatacatgaacaatacttgtgagttgtga

SEQ ID NO: 76245 - DNA, 312 bp, Glycine max
  Peptide Sequence Number=SeqID_167930
atgaaggttgaaggcataggtagcgtgaggatgaagttccatgatggtgctattcgaactttctcaaatgtgagggagatgacatcacaagggtacaagtatgttggttcaaagtggggatgcaaggtgtacaaagggagacacttgatattacaaagacataaaaataaaggtaacctttgttatttggatgaacaagtcttgaagagaaaccacaatagaaaaatgaagaagaaaatgaagttttccaatgttgtagaagtgttgggagatactttggttggacggagagttagttcactttcaaattga

SEQ ID NO: 76246 - DNA, 84 bp, Glycine max
  Peptide Sequence Number=SeqID_167931
atggtgatgcaagggagtgtgggagaaaagagattagggtttatggagttatcaaacctttttccgtattgtagcgaccgctag

SEQ ID NO: 76247 - DNA, 573 bp, Glycine max
  Peptide Sequence Number=SeqID_167932
atgcccatcagatgtattctgcattggcaaccgaaccaaggaagcgttgtgaacagccaagtcctgaatgagatctcgcagtgcgtcgaaagccttaacggcgtcaaagaaggaagatgcaaagcctccctcactttctacagacccaatttacgagaccaatcggtgaccatcgattttcctcgcgattttctggggatatcgatgctggagcagccgaacaaatactacttaatcattcgcggccagaagattgttctcgaggccgattcttctatcttgcttatcatggagaaactccagtcctacaagtccaaagtcgcccttcatttcgagggagtgctgtataagttgggtgactttcagatcagggtgattaaagttgttcccagtcaagcggagagtctcagaggaattatgattgagataaaaataaactgcatgaaaacattaaaaagaatgggggagtggggcattgtgacttttctcgcatcccagtcacgaaactgtgatgtctgttgcagctgcgataacagtttttgcgggagcctcactgcaatggagtcacaatag

SEQ ID NO: 76248 - DNA, 1149 bp, Glycine max
  Peptide Sequence Number=SeqID_167933
atgaatggaaggaacgttaacacaaacaggttccctttcactccttcccagtggcaagagcttgaacaccaagctctcatctacaaatacatggcttcaggtatctccatcccccctgaccttctcttcaccatcaaaagaacaacccacttggactcctcaagactattgcctcaccaccctcaacactttggatggaactatttgccaatggggttggggaggaaaatagacccggagccagggaggtgtagaagaacagatggaaagaaatggaggtgctcaaaggaggcgtatccagattcaaagtactgtgagaggcacatgcacagagggaaaaatcgttcaagaaagcctgtggaagttttgaaaacaacaccaacgacagcagcagtggcaacaaacacagatgcctcaaccccaacaacaatcttatcaatcaccaaaaacagtcctgcacatgcactctccccaaccactcattctctctctcatgacacttaccatcatcatcatcatcaccctcaccctcagcaacattcctcccactccttcctctatcatcattcttcgaggccctcttccggtgctgctttgtcatttcaagacaacagtgcccccttgtttctcgacactgcttcttgctctcagaataacaacaacactgactgcaggtatgtgtatggactgaaggaggaggtggacgagcatgccttcttcacagaaccttctggaactatgagaagcttctctgcttcctcaatggaagattcatggcaactcacaccactgactataagctcctcttcctcttcgaaacagaggaactgctctggtttatccaatgacaacaacgagtactcctacttgcaacttcagagcctcaatggcaacaactcaaaacagccacaacaagatcaaggttgctacatatcaggcagtgatgtcaagtgcgaaacattcatgaaacttgggaaagaagaacctcagaaaaccgttcatcgcttcttcgatgaatggccccctaaaagcagaggatcgtggcttgatttggatgataaatcatccaccacccagctttcaatttccattccaacttctactcatgattttgcaactttcaattcaacaacccaacgagatggttga

SEQ ID NO: 76249 - DNA, 1038 bp, Glycine max
  Peptide Sequence Number=SeqID_167934
atgtcccttctgaagtcaccaagggaccccaaagaagccaaagttttggtgaggctggagtgtggggcattgatggcaatgtgcatgctgcagtgtgtggtgctgatgctgagttgtgcagtgcatagttgctgggtgaaggattatgaggaactggaagcagagaaagcggcctccgcgaggaagaggagtagaagaattgcggaggtgcaagaggagtccatggctaatgcaaccaagatggcagaaatcaaagctaaggagttggatgagaaaatgaaaagcaatgcagatatttgcatcattgttttttttatttgttctccttttgttggtgttggttgtttggggtcactgtgggtgtggccattgaatttgaatgtcgtgagccattcaaggaccatcgatactgatttcttgaccaagaagaagaagcaagtttcggtgcaacttccgagtttgacatcacctgtctccactgtgaggttctgcgatctcaattttggccgcttgcaaccttcggatgacgaattggatcctcacaatagatttgagtttggcaatttcgttgcacgacaagccctgcttcacgaagagtattggacagcagcgtggctaagggcagaagagtgggcaagtcgaacacataaactgtatgacacggaatttgatgcgataaaaaagcggtgcaaggagcaacaagacggtcagagtagcacatgcatcatcacggtgaggaagcaggacaagaatgtaaaacgttcaataataagcagtgttgtaggaacccttgatttgaatatccgatatttgcggctaggggagacctttcctggggaaccggtggatgctcctcgtttttgtaaaatcgaacgaacaccatcaagcagatatggttatattgcaaacttgtgtgttgccaaatcagttcgtcgcaagggtattgccagcaacatgttgtattttgctgtggagtctgcaaaatctagtggtaatatgaacattaatgtgagagtaacatttacaactaatgtctga

SEQ ID NO: 76250 - DNA, 120 bp, Glycine max
  Peptide Sequence Number=SeqID_167935
atgaagccgcaaaggcgtgatcccaaaagaccaagaagcaatgttggtggtggcggcagcggtaaaaagggtacatatgatggtgtattgatcgaccttgatccactggtttcaatgtga

SEQ ID NO: 76251 - DNA, 1086 bp, Glycine max
  Peptide Sequence Number=SeqID_167936
atgcctccattgccttcatatgggtatgggagggagcatcctgggcctcgatatggcagtttgattcatggtcaacatcttaaagatgttgtgataacagggcataacggtaccataaatggacagggacaaacatggtggaaaaaatatcgccagaagcgtctcaaccacactagggggccacttgttcagatcatgttttctagtgacattgtgatcaccaatataactttgcgtgactctcctttctggacacttcatccatatgactgcaaaaacattacaataaaaggtgttactatattggctcctgtgtttggagctccaaatactgatggcatagatcctggcgacttgtgtgaggtgtcagatttttgggaagtgcttcaagcctgtggcctgagagactcttgtgaggatatgttgatagaggactgttacataagtgtgggagatgatgcaattgcaataaaaagtggctgggatcagtatggaattgcttatggaaggccttccatgaatataatgatccgaaaccttgttgttcgctctatggtcagtgctggcatctcaataggcagtgagatgtctggcggggtatccaacgtcatggtggagaatattcttatatgggattctaggcgtggtgtgaggatcaagaccgcccgtggacgaggagcatatgtgcgccaaataacttatcggaatataacatttgagaatgttcgagttggaatagttatgaagacagattacaatgaacaccctgatgatgggtatgatcctatggcactcccaattctcagagacataagctttaccacggtccatggccaaggagttcgtgtgccagtacgcatacacggtagtgaggagattcctgtgagaaatgtgacttttcaagacatgtcagttggtctaacctacaagaaaaagcatatctttcagtgtgcatttgttcaaggccgtgtaataggtaccatctatcctgctccctgtgagaaccttgatcggtacaatgagcaaggacagttggttaagcattctgcgtcccagaatgtaacagatatagattatgatatttga

SEQ ID NO: 76252 - DNA, 1122 bp, Glycine max
  Peptide Sequence Number=SeqID_167937
atggggactccctcgcagatacaagaacaatccaggtgttggccattgccaaccatcactcgtagaggtgagatacttcggcatggaaggcctaattgggtcaccaaagtgggctgcacgaagttgtgggtgctgccgtcgtcgacgagcaacaccacacggtggttggccataatccccaccatacgtaaagccttaagtgccagatggcctgaaaatgaattaaggcttctttgggcctggaacgggtcgggttcatttgacgggtcaggtggtgggtcagttgggtctattttagggtctgaggtgaagcataacccacgctctcggcgtgaggttatctcctccggcgtgagatgtttcattatcggcggaggggtcgcggaggggctaggagcaaggggggtagaggttgacgaggttcagaggttgcagggagaacacgaaaggggttgggtggctaggggggtgcgtgaggccgtgggggattgcggttgtcggcaatcttctcctcctgaagcttggccagaccggcggcttggacgagggcttgagatgaagcagctcagcagaaagggagatggcgggccgattatccggttcgcaaggtcctcaaattcagaaaggaacccaggccatgaggtgaactgggcattgcttgacatccattggaaccaagcaagtgcccttccctccatgagggggttctggttgcgtagaggaaaacgaggaagggcggtgaagaagttcatcaagtttaaggttcatggtctgcatggtgtcggtgaggcgagtgaggatggtttccaggttgctcgaagatgtctcgtggggactcgtcatagtatcaagggaaacgagagcaccaatgttatgaacttggctgatttagaggaatattacgtcactaattctgttatggctgcttcccctcagatacgcagcatcagcaggaggattgtggaagatcgcttgctgttatgtctatactgccctccattgaagcttctctgttcatatcacaatgccccagctgactggttagctaagcatggtgcttctaacgcagacaccttttctcttttggctgattcctctggaccttccattgctagaccctag

SEQ ID NO: 76253 - DNA, 2073 bp, Glycine max
  Peptide Sequence Number=SeqID_167938
atgcagacgccaattgcatgctgggacaactgggtcggagaggcgctcgagaccctttactctctcagacccatttgcctccgcaatagccagcctcgagaattcggggcggacgatggtgcgttccaagtgttcgacgaaatgcagcagcgggaccgatcttctgtcgaagtggaaattgctgaaaccacgtttagtagatggatgcatgacaccccagttctgagcagaagcgaattcgaatgcacaggaggaggcggaggagggagtggaaactacttattagggaatcgggatgaccaaactaataaaaacacagggttaaggatgaaggtaggctttaatggattaaggggtaaagaaatttcgcttatttccattgttctcatgtctgtaactatcattttatggtcatgggagaaaatgcctggtcttagtgcctttcttcctcctcaaacaccaccactgcaactgccttcagatcatttagctagtcgtcgttcagaccaggtgctagaaccagatccacatttgggtgaagatggctcgccgttggcaaaggcaaagactgccaatgaagcagaagaactacgtctcaagggagcatcatggacggtccctgcacaaagctcttctggaaagaacatgggtgaagagggctcatcattagcaacggagaagatcttcaatgaaacagaagaactaaatctcgagggagcatcgcgaacagttcctgcacaaagctcttttggaaagaacatgagtgaaagtaataccaaaacaacttcatataccgaacaaattctttcaagtgtgccagatgatgaagcaaaacacaagagaatcttggaaggtgagaaaaatcatgacgtacagactttttccagcccaacatcatctggggctaaaagaaatgaagctgagggggaaaaaagtttgagacaagaagaaaataagcatagaaatgattttgtgactaaatctcctcaaataatctctttaactggtggaaaagacaacaattggaataatgctacagaaaataaagtctgtaactacgcaaaaggaaaatgggtcccagacaacaaccggcctttgtattcaggttttggttgcaaacagtggctatcagggatgtgggcttgccgcttgatgcaacgtactgattttgaatatgagaagcttcggtggcaacccaaggattgtcaaatggaagaatttgaaggttctaaattcttgagaaggatgcaaaacaaaactctggcttttgttggagactcgttgggccggcagcagttccagtctttaatgtgcatgatcactggtggtaaggataagcttgaggttgaagatgtggggagggagtatggattggttatagctgagggctctgcccgccctagtgggtgggcattccgcttctcaagcactaatactaccatcctgtactactggtcggcaagcctctgtgatgttgaacctattgatgtaaacaacccaaacacggattatgcaatgcatcttgatcggccaccagcattcttgcgccaatatatccacaagttcaatgtcctggttctcaacacaggtcaccactggaatcggggaaagctcacagctaatagatgggtaatgcatgtcggtggtgtgccaaatactgataagaagatagcagtgatttggggtgccaagaatcttacaattcacagcgttgtaagttgggcgaattcacagcttccaaaatatccaggtttgaaggtattctatcgttccatctctcctaggcattttgttggtggggactggaacacaggaggcagttgtgacaataccaaacccatgtccgttggaaaggaaatattgggagaggagtctattgatgaaggtgctgcaagtgcggtaaagggaacaggggttaagctcttagacataacagctctttctcagcttagggatgagggtcatatatcacggttcagtcttacagcgaagcctggggtgcaggattgcttacactggtgtttgcctggtgttcctgatacatggaatgaaatactatttgctcaaatatag

SEQ ID NO: 76254 - DNA, 324 bp, Glycine max
  Peptide Sequence Number=SeqID_167939
atgatacgacaggttgttgaacgacgcgacaatcatgaacaccgtgtccgtggcgaggagcctctcgaagacgagtctgccaacaatttgtccctacggtccgaaaagggacatgacgaaggcattcgggatcaccgccagagaaccatggtggaggaaggttgcagatttggagaggatatcgaagcggccatggaaagtgacggtggcgacagtggcaccgacgggtgtgaaagaaggttaatgaagagtgacgttggtgatggttccgaaactggttataacacacaggtcaatgttctttctgcggctgaagcaagctag

SEQ ID NO: 76255 - DNA, 4287 bp, Glycine max
  Peptide Sequence Number=SeqID_167940
atggaaggcattgaaatggaggaagccgcattcggcatagacgaatccaatgatgatttgtgcagttcgatcctctctcgcttcgccaactccaccgacgaaacccaccaccacctctgcgccgtcgtcggcgccatgtctcaggagctcaaagacaacaaccaaccctccactcccttcgcctacttctgcgccgcacgcgtctctctcgataaattcacctccgaacccaatcccccaagccacgtcatcgacgcccttctcaccattctctctctcgccctccccagagtgcccctcgtgcttctgaagaagcagaatttgcagggagagccattctcggagctcctttcgcgagttctcctttctccttcggcgtcggagagtgcgatcgtttccggattgaagtgcctctcgcgtctgttgatcaccagggaaagtgtagactggtctgacgtgtcccctttgttctatgtcttgttagggttccttactgattcgcgacctaagggagtaacaagcctacttgaaaggtttattctgcttgttggtggagcaaatgcaaatgctggtgaaggagctaaggaagctcagcagattctgtatattcttgatgccttgaaagaatgtcttccttttttgtcacgtaaatctaagaccagcattcttaattacttcaaatacctcttggatctgcatcaacccttagtcacaaggcgcataacagatggtttgagttttctctgtcattatccaacatcagaagttcatcctgaagcactacttgagttgttaaactcattggctcgttctatcgaatcgaataagatgtctggagacagattgacatttactgcccgcttgcttgatgctggaatgaataaagtttattctcttaaccggcaaatatgtgttgttaagcttccgattgtctttaatgctctcaaagacatcttggcatctgaacatgaagaggctatatacgcagccactgatgcattcaaaaacatgataaattcttgtattgatgaaagtttgattaaacagggagtggatcaaatcagtttgagtgaaaacaaagaatcaaggaagtcagcgccaaccatcattgaaaaaatttgtgcaactattgagagcttacttgattatcattatactgctctctgggacagagtatttcaaattgtttcagccatgtttcataaattaggaaatcattctccttattttatgagaggaatactcaaaaacatggaagatgtgcagaagcttcctgatgaagattttccatttaggaaacagctgcatgaatgctttggatcagctcttgttgcaatgggacctgaaactctgttgtctcttatacctctaaatttggaagctgaagattcatctgatgcaaatgtctggctttttccaattctaaaacattatattgttggcgcacctctaaattattttacagaagaaattctgactatgattaagcatgcaaaagagaaggctcaaaagcttgagaagcaaggattgatggtgtcatcaaggaatgcagatgcacttgcctactctttgtggtctctgctgccttctttttgcaactatccttcagatactactaaaagtttcatgaatctggagaaacatttacgtcgtaagctgaaagaagaacctgatattcgtggaataatatgcactagtttgcaacttcttattcagcaaaacaatattgtggattcaaaagacaagggttatattggtgaagatatggccaaagaacaagttccagttcattattcacagcaggttgcaagagacaatttatatgtgctgaagtcatctgcaaagcactggttagaagatctttcagaagtattccttaaatctacaaaagacgatgggggttgtttgcagcgtacgattggcgatgttgcttctatagcagataaagcagatgtacgcaaattattccaggagaaaatgttgaagctttataaatgcactcgaaaggccagcaaagcaggcagttccaaaagttctcattttatgcaaattgatgatgcatcaaacaatttgtccctaacaattttaagggcacagcttcttgatttggcagtttcactgttgcctggtttagatgctgaagatattgctctattgtttgaagcaataaagccagcattgcaggatgctgaaggtgtcatgcagaagaaggcatacaaagtactttcgatcattctgaggagctcctccaatggttttgtttcatcaaagtttgaggagttgcgtcaaactatggttgaaattcttccgtgtcatttttctgccaaacgtcatagacttgattgcctttacttcttaatagttcatgtctcaaagtccaaggataatatggagcactggcgagacattttccttactgaaattatacttgctcttaaagaggctaataaaaaaaccaggaacagggcttatgatattctcgtcgaaattgcccgtgcatttgcggatgaagagagtggtgggaacagagaaagcttgaataatttttttcagatggttgctggacactttactggggaaactccacatatgataagtgcagcagccaaagggttagcccgtttggcttatgagttctctgatcttgttttaacttccttcaaattgctccctggcacacttactctcctgaggagtgataacaaagagataatcaaggccaatcttggttttttgaaggtattagtagccaaatcacaagcagaagggttgcaaatgcacttgaaaagcatggtggagggtttgttgaagtggcaagacaactcaagaaatcattttaaggctaaggttaaacttcttttgggaatgcttgtcacgaagtgtgggctcgaggctgttaaagccgtcatgcctgaagaacacatgaaacttctttccaacatacgcaagatcaaggagcggaaagagaggaatcgaagtgctaaatcggaagaagctagatctcatttttcaaaagcaactacatccaggcaaagcatgtggaatcatacaaagattttttcggattttgatggggatagtggcaatagcgatgcagaatacatgatttctagagggagtaaggcttccttgcatcccaaatcagcagcatcttcatttaggtccaatatcagactgaagaagaatttgcctgagcacttgtcggaccaatcagatgatgagccacttgatttgcttgatcgacagaaaacaaggtcagcgcttaaaatgtctgagcatctcaaaagaaagtcaaggttagatgatgaggtggagctagattcagaaggacgcctgattatccatgaggaagtggaatggaggaaggaaaaacatgcagatgaagattttgattctaggagtgagcgtgatagtcacatatctgcaaagtctggaactaaagcccagaagaagagaaaaacatcagattcaggttgggcttacacagggaaggaatatgctagcaaaaaggcaggtggagatgtgaagaggaaggacaaacttgaaccgtatgcatattggccacttgatcggaaaatgatgagtcggcgaccacaacagcgggctgctgcaagaaaaggtatggctagtgttgtaaagatgaccaaaaaacttgaaggaaaaagtgcctctggcattggaccgttggaagggaaagccttggttcgcttggatgatattgatgctcttgccactgcaagtgattatgtaacagtatcaggaggatgggatatgccaaggttggtaagagaattaccttcacatatttgtgatgttccgcctgcggttagtagagatgacgatgtccctgtgtggaaacactctacggatggggtgttcaaggtagcttctgattacaaacagaataatagggatcctttatttcttgctatttggaagtcagctatgatcttcgtcaggaatctactattcgagattgtgtcttttgcccataaggtgtgggatacttgtggaggagttcttagagatcacctgggtaatgtggttcttgcctgtgcttacaacctaggagtctgttctatatcccatgcagagctctgggcgattttgatagggttgaagattaattgggcgagggggtttaccaatctcagggaatgggtgctttcgactgctgcaagcaaggagtttaccagtaatgatgctgtttattctggggagcatatttttagagaggcaaatcaagttgctgataccttggcaagatatgggattgtctattcttga

SEQ ID NO: 76256 - DNA, 678 bp, Glycine max
  Peptide Sequence Number=SeqID_167941
atgaacggtgtttctcctctagaggcccaagccttcaactacctgagcttcggtttcctcaccctcctcaacaatttctggacatggctcgccttcactttctggaggacccgagcccccacctccgagttgctgccaccacccgatgacccggttcgcgacgagtcggatcctgttgccgtgaccgggccaagtccaactgtggttgacgttgacggtgcgaggaaggggaaatttaccttgtattacgaggatgagtctgagagggaatgcgagagccaccaggagacgacggcgctaacggagagagacggaagaggcctgaagtggtgggagagttgggaagagttgttgaaaataagacgaggagaagaccagaacggatggtacacgtgccaggatttaacggtgcttaacggcagcgttgttaggttatgggatggtggcttcggctttggtacctcaccacagaacccagggacactacaagatgtgttcttgtatggtttggttgaaacgcataggtttggttgccggaagcgtgaagggaccttggtcaccggaggaggacgcgctgttgagccgattggtggcgcagttcggggcaaggaactggggcatgatcgcgcagggagtgccaggacgctccagcaagtcgtgccggctccggtggtgtaa

SEQ ID NO: 76257 - DNA, 780 bp, Glycine max
  Peptide Sequence Number=SeqID_167942
atggaagatgctggaggttccaaattgcatggaattaagcagattgtgagattgaaggaaatgtttcagaagtggcaaactgtaactctgggctcaaaagattccaacaatcattctgatgtgactcatcatcatggggtcttatcaccaatgattaacaaaaggctaactgatattgtgtattgtgactctgatgaggatggctgctacagccctcaaccaccacatgatgttcccaaagggtacttagccgtctatgttggtcctcagcttcggaggtttatcattcccacaagctaccttagccactctttgttcaaggcgttgctggaaaaggctgcagaggaatttgggtttgatcagagtggtggactcaccattccatgtgaaattgagacctttaaatacctcttgaattgcatagagaaccatgatgacagctccacggagttgctgcaaaagttcagtatcaaatcaaaaggtggtcatggaaagcttttaaggttaattcaaaaccctgtgaccgatcactcacctatcaactcctgcaaagtaggtctttcttttagctcacaaaagacagttcaattaagggactatgttagtgatgctaattgtaatgagaaccttgtattcgtggttggtgcaatggctcatggaaaaattgatgctgactacattgatgatcttatatcagagtatgagggtagagtttataattcgacattagtaggaaagtcacaggattttggacctgtaatgcaaaatatgatcacatga

SEQ ID NO: 76258 - DNA, 2103 bp, Glycine max
  Peptide Sequence Number=SeqID_167943
gttcgcctccgcaccaatggctgcaatggctggccttcaccgccgtccatgtcgctcaatttgcagcgtgttcccaagtttcgcaagggaaactgcaagaaagcggttgagggtaatgttgttgatggagatggaatagggagtggtggtggtgatggtgaggggaggagggtggggatgctagtgccgaagggtagggagggagtggtggtggtggtggtggtgctcgaaggtcgtgttgaagggggcaacgatggtttgggagtggtggctttccagggttttgaaagccaattcgaggtgcaaggctttgcattcgtagcccgtcacggagaggagaaggagagagaaagagagaatggtggaagccatttcttgctcaaaatcaataactctctgccactgccttcacccgctcccttcgagaatctcttccacagcttaataacgcacttcccttccgtgaattcactcaatttgattactcccgctctcggcttcgcttccggcgtcgctctctcctcctcctcctcctcctcctcgcgctccaataactattcctccgtctccgacatcggcgagtggctcctgttcgcgagtccgacgccgtttaaccgcttcgtgctactgcggtgcccttcgatatcgttggaggggggagaggacccgagtgcgaggctggttagggaggagaggcactacgtgagaggagggaggattcaggttcggagggggagggagagggagagggaattggaggagctcggttatcagagggtgtgtgtgagtgctgctgatggaggcgttgtttctttggattggcctgataacttgcacttggaagaggagcgtggattggacactactctcttgctcgttcccggcacgccgcaggggagcatgaacgccaatgtgaggttgtttgtggtggaagctctcaatagggggttcttccctgttgtcatgaaccccagaggatgcgctgcttcgcctctcaccactccccggggaactgctactcttccttttcatcttccattctcaaccaaccaaccaaaggattatctacttctctgccttcttcctttctcttctttctccaatcctgctgctgacagcgatgatatctgcacagctataacgtatatcaacaatgcaagaccatggacaaccttgatgggtgttggctggggatatggtgcaaatatgctgacaaaataccttgcagaggttggggaaagaacgccattgacagctgtcacatgtatagacaatcctttcgatttagatgaagctacaaggtcctctccttatcacattgttactgatcagaaactcactgatggactgatagatattctacaaaccaataaggcactattccaaggcaaaaccaaaggttttgatgtggaaaaagccctgatggcaaagtctgtacgtgattttgaagaagcaatatctatgactatcttgcttggatcaccgctacctcactccctatccgattcttctcctcaggatattctatcggcttattctccgacaatagatattcggagtatcccctatgagtggatattagttacaaaggaactagtcttaggacacttgaagaggcagaataacaagcagaagcaggcaaaaggctcaaagccaggctttaggaaagattcactacgtatcactatgaatattcagtatggagaccttgggaaggcatcacttatgctagaaggcttcattgccctccttactagcagcccagatctgttttgtgctcggcttgatgccatctcagatgtccattcaaggataggttttagtcctggttcaaggtgtgaagagagaggctgtcccaaaaggacagggcccttgccgcaacacagcgctaaaactttcgactcaccggcggctggcttcgtcttcactttcaagctggaacagaacatcgggtacaacttgaccttacccgcttccgatttggttggttttcagtctaccgtgtacggttgcttgctctgggtgcagctatcacgcttaggctggttggaagcattcctcgtcgatgaagccggcattgccctttccgccgctaacctgtga

SEQ ID NO: 76259 - DNA, 3102 bp, Glycine max
  Peptide Sequence Number=SeqID_167944
atgacgggaacacctgtggcggtggctgcggcaacgccgaggtctaagatacagaggaatgcttcaggtacgccgggtggccccaaagttcgggaggagaaaattcgagtcacggttcggatgaggccgctcaatacaaaggagcaagctatgtacgatctaattgcttgggattgtttggatgaacacactattgtgttcaagaatccaaaccaagagaggcctacaacaccatacaccttcgataaagtttttgcacctacgtgctcaactcataaggtttatgaagaaggggctaaagatgttgctttatcagcactttctggaatcaatgcaacaatatttgcgtatgggcagactagcagtggtaagacattcacgatgagaggcgtcactgaaagtgctattaaagacatctacgactacattaagaatacaccagaaagggattttattctgagaatctctgctctggaaatctataatgagactgtcatagaccttctgaaacgtgaatctggtcctcttcggctcttggatgatcctgagaaagggactattgtggaaaagctgaatgaagaagtagctgaagatcgtcaacatcttaggcgcttaattggcatctgcgaagctcaaaggcaagtgggagaaactgctttaaatgataaaagctcaagatcacatcaaataatcaggctgactgtagaaagcagccttcgtgaaagttcaggtcacgtaaagtcttacatagcaagtttgaattttgtggatcttgctggaagtgaacgcatctctcaaacaaatacatgtggagcaagaatgaaggaaggcagccacatcaaccgaagtttgttgacacttgcatcagtcatcaggaagctaaggttcaaatctttgaaacagtcgctctacttacagggggataagactgcttacatctatcctttcaatatctcactaggaagaagcctcatgcaccaggctactctttttgttcaaactgaaaatggcggaaaatgtggtcacataccatatagagactcaaaattgacacgaatattgcagtcttcattaggagggaatgctcgaacagcgattatctgtaccataagtccttccttaagtcatgtggagcaaacaagaaatacactagcatttgctaccagtgcaaaggaagtcattaatactgcccgagttaatatggtcgtttcaaataagacactagttagacagttgcaaaaggaagttgcgaggcttgaaggggagttacgaagccctgacctttctgtgaattcatgtctaaggtcattgctagctgaaaaggagttgaaaattcagcagatggagagggatatggaagatctgaggcgacagagagaccttgcacaaactcaacttgatctggaaagaagagtgaataaagttccaaagggatcaaacgattgtgggccctctagtcaaatagtcagatgtctttcttttcctgaagagaacaaatcagctaatggtaaacgtacgccagagcgacgagaggcagtgggcaggcaggcaatgctgaagaatttattggcttctcctgatccatccatactggttggtgaaatccgaaagcttgaggatcggcagctccagctctgtgaggatgcaaatcgagctcttgaagttctgcaccaggattttgcaactcacaaacttgggaatcaagaaactgctgaaaccatgtcgaaagtactatctgaaataaaagacttagtagctgccagctctactccagaagaaattgtggcagcagataaggccgacctaatggaaaagatcacacagttgaaaaatcaagggaacaccattgcatctttagaaaggaagctggagaatgttcaaaaatctatagacaagcttgtgtctgcttttaatgcagaggagactccagaaaacaagacgacccctctgagaaggaagaaaattcttcctttcacattaagcaacagtcccaacatgcagcatataatacgtgctccttgctcgcctctctcctcttcgcgtaaagcaatggaacatgacattgagaacagggcaccggaaaacaacattggcatctctggcagtgattcttttgctaagtttcataaagatactccacgaaaggatgataaaagttgtgattctattttatcacgggcaggaagcccagctacaaggaaatcaaaatcagtgaatgtgatgaagattcaaaagatgttcaagaatgctgcggaggagaacattcggagcttcagagtttatgttaccgagttaaaagagctagtggcaaaactgcattaccagaagcagctactggtttgccaggttttggaactggaagcaaacaagtcattaaatgaagaaaaggatacacctgatcggtctcccttgccatggcatatactatttgatcagcagagaaagcaaattatcatgttatggcatttatgccacatatctcttgtgcaccggacacagttttttcttctgttaggaggagacccttctgatcagatatatatggaagttgaacttagaagattgactcggttagaacagcacctggcagagcttgggaatgctagtcctgcacttctaggtgatgagcctgcaggctctgtttcagcaaggtatgctcgtgtctttgaaagacatgtgtcttttttgacaattcctgctagtcctgcacttctaggtgtctttgataattccttaaatcaagtgtctttgataaagctcgtgtatttgaaaaacagcattagagctctgaagcaagaaagggaacatcttgctaggaaggtgaacactaaacttacagcagaggagagggaactgctttatgcaaaatgggaagttcctccagttggaaaacaaaggagactgcaatttgtaaataaattgtggaccgacccttataacatgcaacatgtgcaagaaagtgctgaaattgtagcaaagctcattgatttcagtgtatctgatgaaaacagcaaggatatgattgaattaaacttttcaagcccttttaataagaaaacatgggcgggctggaactttatatcaaatcttctaaatttgtaa

SEQ ID NO: 76260 - DNA, 213 bp, Glycine max
  Peptide Sequence Number=SeqID_167945
atgaagatggttaatcatgaggctcttcgaaaatctgtttctccgcattggacgtccatgcatgctgcaaagggcgatgtaaagttggtggtggcaaacattcaagagttggaacttgttctgtgtaatattggaggagtaaagcttaatggaatagttttcttggagaccagtcattatgttcaaagcttggttttgccttatccaatttga

SEQ ID NO: 76261 - DNA, 7134 bp, Glycine max
  Peptide Sequence Number=SeqID_167946
atggcatcctctgatggtagagttacgtattcttcattatctaagctagaaaaggagaatacccattttggctacgatgatataaatcatcatgttgaatctgtgtggtctgagcttatgcctggtaccccgtgtggccaattagtcccaacgttgtctaacaaagagacattgtatcagtttccctctgaggatgatgacttgtttgatggaggttatgaatcaggtgatgatgctcgtggtattgtaccctctaacaggccgcctgaggtgaacttgaagaatgtgctttctgggatctttgctattttgtctggacggaccaaggctccgagtgttactgcaaaccagcagctcccaagttcaaatgtgtcattttttgactctggaaagaatggggatgttttccttgactcttcggtgtacacgccaagtgctccgccactttgtctgccaaatggaattgattatagttcttacaaagaggtcttggaagctgaaccccctgagtggctccctgatagttctactactgtttgtatgcaatgtagtgctccttttactgcgattacccgtggtagacatcattgcaggttttgtggggggattttctgtcgaacatgtacaaaggggcggtgtttaatgcctgttgggttcagggaaagaaatccccaaagggtttgtgatgcctgctatgatcggcttgatcctttacagggcgttctgatcaacaccataagcaatgccgtacagggggctaagcatgatgtcacggactggacttgtgctagaggatggattaatcttcctattggtttatctatggagcatgagatttataaagcatctaatacattaagaaactactgtcaggtggccaaatccaatcctgagaagtccattcctttaactgttcttaaaagtgccaagggcctagcaattttaacagttgctaaagctggtgcactagtctcttacaaactgggtactggcttggttgttgctcgaagatcagacggatcatggtctgcaccgtcagcaatattctccctgggtttaggatggggtgctcagattggtggtgaacttatggattttatagttgttcttcgtgatatgaaagctgtgaagacattctgcagccgtatgcatttttctctgggtgctggttgtagtgctgcagcagggcctgttgggagagtgcttgaggcagatattcgtgctggtgacagaggctctggcatgtgttacacttacagttgcagtaaaggggatgaccagaaactaggaaggttgagcaaagtgttagagtattgttgcttggatttcagctctcaggggtggtgctatgataggtacttgggtattatggagtgcctaagtctcacatctagtagtatgggatgtatagctaacgacatggaatgttgccaaactgtaggtgcatttgtgggagtgtctttggaaggaaatatagttgcaaccaggatggatgccaatttgtgcttttatggtgatccttacctcaccacatctgacattctactgggaatggtggacagaccaaaggctgctcaacccttggcttgggtggaatcacagtccatgggcaccccggacaagaaaatatctgactttgttgatgtagttaggtcttggatccctcgaagggcggaaccactaaatgtgtcgagggacttctggatgccggatcagagttgtagggtatgctatgagtgtgattcacagttcacaatattcaaccgcaggcatcactgtcgaatctgtggtcgagttttctgtgcaaaatgcactgccaattctgttcctgttccatcggatgaggcaaatactggccgcgaagattgggagaggataagggtctgtaactattgttttaaacaatgggagcaagtaacaacagttgataataatggcagtgcagatccttcggctaccccttgtctcagcccttcaccatctacaacaagcttggtcagcactaagtccagttgcacctgtcatagtagcagcagcactgctggttcagttccttatacaactgggccttatcagcgtgtgccgtatagtccccatcaatcttcgcaaatgaatcagataacagatgatcaagaaaatttaaattctgggaggagtacaaatccctcagaggctgtagggaatgtgccttctaaccaatttggccattgcttcagcagtcatttatgtcctcacatttctgatgctgatgaaagcatccccatcaagagtgatgatgaggatgatgattatggtgtttatcattctgatacagaatcaaggcattattcccatgcccatgactacgacgatccagttaacattcatggtgttgaccatgtctatgggccacatcaaatgcatcctgatgaagataacattcaggaaaaaaacttgagttgcctaacccaggcacagaatcttgatccagaaggtgtaggtggaattcaagtacctgggaaagaagacgatgagcatgatcatgctgatggatgtgaaacttctccttatcatgaggagagcaattatgcggagcctgtggattttgagagtaatggactactgtggatacctcctgagccagaagatgaagaggatgatagagaagctgttctttatgatgatgacgaagatgaaggtactactggaggtggggaatggggatatctacgatcctccactagttttggctctggagaatgtcgtagcagagataaaacaagtgaagatcataggaaggccatgaagactgtagtggaaaggcattttagagccctggtagctcagctattacaagtggaaaacctaaatacttgtgatgaagatggaaaagagagttggttggatataattactgctttgtcttgggaagctgctacacttctgaagccagatacgagcagaggtggaggtatggatcctggtgggtatgtaaaggctggtgaatggcaaagtgcgctatctgctccatatgattgtcgttctgggagaagtctttataacatggtggttaaaggagttgtatgtaaaaagaatgtggctcatcggcgaatgacagcaaaaattgataaaccacgttttctaatacttggaggtgctttggagtatcagcgtgtttctaaccagttgtcaagtgttgatactttgttacagcaggagatggaccatttgaaaatggcagtagcaaggattgatgctcatcaccccaatgttcttttggtggagaagtcagtatctcgttatgctcaagaataccttcttgctaaagacatatcgcttgttctgaatattaagaagccacttctagagcgtattgcccgttgtactggtgcacagattgtcccttcaattgatcatctgacctcacagaagctgggctattgcgaaacattccacgtagacaaattttttgaggagcatggtagtgctgggcaaggtgggaaaaaatcaacaaagactttgatgttctttgagggttgcccgaaacctttaggttgcactggtgccaatggggatgagttgaagaaggtgaaacatgtgatccaatatggaatctttgcagcctatcatctggcactggagacatcttttctggctgatgaaggtgcttcacctctagagtttcccttgaaatctcccataactgttgcattacctgataaaccatctagtattgtgagatccatttccactatccctggattttctgttctcactgctagagagtctcagggagcaaaagcttttaaagaagaaccacaatctaatgacatctacaagacagaaagaagcccatctagctgctgtgagtccactgaaagatcattggtgggtgactcaatccatatgcatgaagtgtctggaggtattacccaatcagctcaggatatgccatcttccaactgcaatagtttcctttcaaatacttcttctaaggaggatgataagaaatgtcccatggaattttttcaatacagactagatgagagaagggaaactatgttgaacaatgatcttatttcagattcttttggtacttttgagtcttcacagcaagatggaaatagccacctcagagctgcagcattgtctgcttatcaaggagctaaccctgagccaccttatataaaacatgatactaataattataataacaataataatcatgatgacatgatacattcaaaagaagattttcctccctcaacttctgaccatcagagtattttggtctttttatcaacacgtgtgtggaaaggaactgtttgtgaaaggtcccatcttgtaagaattaaatactatggaagttctgataagcctttgggacggtttttgagagatcaactacttgatccgagttacacttgctgctcatgtgagttgccatcagaagctcatgttcattgttatactcatcagcaaggcagcctgacaatttccgttaagaaatcggagtttgctttaccaggggaacgagaaggtaaaatttggatgtggcacaggtgcctgaaatgtcctcgcatacatggttttcctcgtgctacacgaagagtagttatgtctgatgctgcctggggcttatcctttgggaaatttttggagctgagtttttcaaatcatgcagcagcaagcagggttgcaagttgtggtcattctctccacagagattgtttaagattctatggttttgggaagatggttgcctgctttcgttatgcttcaattcaccttcattctgtttatcttcccccacccaaactggaattcaactatgatagtcaggactggctacaaaaagaagcaaatgagctgcataacaaggctgaaatactgtttagtgaagtgtgcaatgtgctgcatcaaatttcagagaaggtttcaggtcctgtgttgcaggagggtggaaatagggtgtcagattttaggaatctagttgctgaacttaaagggatgctgctgtatgagaaagaagaatttgaggactcattacaaagattgctgcataaagagggcaaagttggtcagcctgtgattgatattctagagctcaataagttgtgcaggcatatccatatccattcttatgtttgggaccagcgcttgatatatgcatccaatctaagtaaaattattcttcaagaaaacttgaagagcttaaatcatagagagaagttgcttggttctagggaaaaggttatcgaagcagatgttgccactaggccagcaagaggccatagcagttgtgattcctttcttttgggaacaaaacctgatggaaacctaaatttagaaaacactagccaccttagccaccctgtggtcaaaagtgaggacaagggcaaagacacaaatcatgataaggttgatctttctctttctggtggtgccaatatcaatgataaatctgattctgtggagtttggaggggctgtacggagggctttgtccgagggggaatctccttttgtggctaatttatctgatacccttgatgctgcatggacaggtgaaggtcatccgacaaatttatcactcaaagaaaatggttgtctacctcctgatgcagcagctgtggctgttcattcacctgtggcaaatatagttacatcaaaatcaaattctgatatttatagtgctaatataggtgggattgaggcaggatgcactaattactctaaattgctttccaaaggacttgatactaaatggaaaggaataccttttgcaaatgtctttggttcattcaacaaaacttcttccttcaatactgagaagcttgttgagtacaacccagttcacattttatcatttcgagagctggagcgccagacaggtgctagattgcttcttccagccagcactaatgataccatagtgcctgtctacgatgatgaacccactagtgttatagcgtatgtgcttgtgtcaatggattatcatatgcagatgttagaatatgatagacctaaagagagtggagacagttcaatttcattgccactctttgattcaacaagtctactttctctcaactcttttgatgagacaattactaatacctacagaagtcttggctcttttgatgagaatgtgttacccacttctgggtctcggagtttgccggctggggatccattctcatacacaaaggatttgcatgcaagggtttcttttactgatgatggctcccttggaaaagtgaaatatactgtaacttgctactatgcaaaaagatttgaggctttaagaagaacttgttgcccttctgagttagattttgtgcggtcccttagtcgttgtaagaagtggggagctcagggaggaaagagcaatgttttctttgcaaaaaccctggacgatagatttatcatcaaacaggttacaaaaacagagcttgagtcgtttactaagtttgcaccagcttattttaagtatttatctgagtcaatcagtacaggaagtccaacttgtcttgcgaagatcttggggatttatcaggtaacatcaaagcacctcaaaggagggaaggaaacaaagatggatgttttggttatggaaaatcttctttacaggcgtaacattagacggctttatgatctcaaaggttcttctcgttcacggtacaatccagatacaagtgggagcaataaagtgctgctggatcagaatctcattgaagctatgccaacctctccaatatttgttgggaacaaggcaaaacggttgctcgagagggctgtgtggaatgatactgccttccttgcatcaatatatgtgatggactactcattgctggttggcgtggatgaggaaaagcatgagttggttttaggtatcattgattttatgaggcagtatacatgggacaaacaccttgaaacttgggtgaagacctcaggcatccttggtggacccaagaacacttctccaactgtgatatcaccacagcagtacaagaaacggtttaggaaagccatgagcttatattttcttatggtgccagatcaatggtcccctccagagttacaccccactgctgttgatttgtgtcccttaagcaatggaggtgcacctcctgttaccagagattgttga

SEQ ID NO: 76262 - DNA, 1832 bp, Glycine max
  Peptide Sequence Number=SeqID_167947
atgggaagcagaggtccacctcaatcccatccaaattccgctgccatttccaagggttacaacttcgcttccacttgggaacagaatgctcctttgacagagcaacaacaatccgcgatcgtttcgctttctcacgcagtatctgagcgaccgttgcctcgcaagttggctcaagaaaatgcgtcggtgcaagacaatgccttatctgttaaaacgaaggatagttcttttgatgactctggtgctattgagactgttatggtcaataccaatcagttctacaaatggtttacggatcttgaatctgccatgaaatcagagacagaagagaagtatcaacattacgtgaacactctaactgaccgcatacagacatgtgatgaaattctccaacaggttgatgacaccctagacttgttcaacgagctacagttgcagcatcaagcagtagctacaaagactaaaacgctccatgatgcatgtgataggctgctacaagagaaacaaagactaattgattttgcagaagcacttcgtagtaaactcaattactttgatgaactggagaattctcgagcattgggcatgatgcgttctcatgtacttgctgttcttaaaggtgcctcttctcaggtccaggaagcaatccgtggaagtgggggtggcaaagcatctatctctgagggagtagaggcatccgtgatatatgttcggttcaaggcagcagcaagtgagcttaagccactacttgaagaaattgaaagcaggtcttcaaggaaagaatatggtcaaattctggcagaatgccacagactatactgtgagcaacgcctcactttgataagaggtatagttcagcggcgaatatctgagtttgccaagaaagagtctttgccttcgttgactagatcaggctgtgcatatctcatacagaagaagcattcatatatccagatagtgtttgacaagcatagtaggaggagtgaatcactagctggtcttcgtcctacatttgagagaattttagcagatgttcatgagcggttaacatttcgtgctcggactcatatacgggatgagatagcaaattacattccaactaatgaagacttggactaccctgaaaagctaaagaaatctgctgaaagtacttctgagatcaatccttttcaagttggtaccagagcaggttccgaccgtcgtccgccgccgccgtacgccgttgtctccggcggatttttccggcgagaccagggttcggatcgcctcgaaaagcgcgatccacccctggaacttgcaccgccatcggaagctccacgcgcggcttcttcctcgcgtgttttccggtgcgtgcagctcacgcgccgccgtgccggcgtcggaagctgccccttccggtctcggcagcttcgtcgtcgcctcctgggtgcgtttcaggcctcacctccttcttccggcaagctgtttggtcagctcttgtgtgttttcctctcttgtgtgttagggtttgctttgtggttccttggtcaaggacaccatgaccacttggagaaaacctcagattctgtttcagatgataaaagatctgaatgggagaagcttgattatcaactgtgtgccgtgttaaggcaatcagttgagccggatatcttggaaatccttcgatcatttaaatcatgtcgttccttttggaagaaagcccaagaaatctttgccaatgatatccaaagtttgtttgatgcaaccatgaaagttacaggcctcaagcaaaccagtcatgacatgatcgctcatgtgggtaaggctcgagctgccgtggaagaactgagaaa

SEQ ID NO: 76263 - DNA, 2451 bp, Glycine max
  Peptide Sequence Number=SeqID_167948
atgggactccaacattttactacgtgcgttttgttagctctttgcattctaagccaaggtttggcaaagggtgctcatggctttgcttgcaactggggaacgcgtttaacacatccccttccacctcaaataaccgtgaaactcatgaaggacaatggattcaagcaagtgaagctctttgaggctgatcccgcagcactcaaggctttaggaaattctggcattcaggtcatggttggcataccaaatgacctcttagcaacccttgcttccaatgtcgatgctgccattgcatgggtcaaccaaaacgtgtcctcttacatatccaaaaatggggttgatataaggtatgttgctgtggggaatgaggcttttctcaaaacatataatggccggtttgttaattcaacctttccagccatccaaaacatccaagcagcccttataaaagcaggattaggcaggcaagtgaaggtgacaacccctctaaatgctgatgtctaccaaagtgacagtagtcttccatcaggtggaaacttcaggcctgacattcatgaccaaatgatctccataataaagttcctaagccaaaatggtgggcctctaaccttcaacatctacccattcctcagccttgatgctgatccccacttcccaaaagagtttgccttctttgatggctcagctgctcccgttgttgatggctccataacctacaccaatgtgtttgatgcaaactatgacaccctcatctcagcccttgagaagaatggttttggccaaatgcctgtcatcattggagaggttggatggccaacagatggaacagccaatgccaacatcaagaatgctcgaaggttcaaccaaggcctaattgaccgcattgtgaaaagacaaggaagccccaaaagaccttccccaccagatatctacttgtttggatttatagatgaggatgccaagagcattgagcctggcccttttgagaggcattggggtgtcttcaactttgatggatccattaaataccctttgaatttgggtggtggaaagcaactagttggtgcaaaaggggtgaggtatttgccaaagcaatggtgtgtgatgtcaactcaagcaaatgttgaccctaatgctttagctgagagcatgagcaaagcatgcacatatgctgattgcacaagcctctctccagggtcatcttgcagtggattagacacaagaggcaatgcttcatatgcattcaacatgtactatcaggccatgaatcagcaaaaaggtgcatgcaatttcaatggtctctctgtcatcactaacataaacccttcaccacctcaaagctcttgtcaatttaagatcatgatcgatctggggaagcatgaaaagaagtccacctcttcttctgttgcaccagagaggaaactacactcaatggtcatgctggtgtcaagcttcatttttactgtcatcaaggccttttctcagtacccttctctttctttttctgatcgtggtagctacctgtctttcccatttctccgtaatcttgtttatgctaatgtttttggggttagcagaagcattggttttggtactagaggttgtagctttgacactagtggtagctgcagtggtaatagtgataggatctttgtgagggcaaagacaaggtcccgtggctttgcatcgaatcgccgccagccgatgttggctgatttggagcaaaggaattctgttaggagtgatgagagtgatgctactttggttaaggttgataatggatctataaatggaagtcctgctaagcctccttgtttcagtgatcatcgattatcccagaaacttgtggttgctgttgatgttgatgaggctctcaacaagttcattgcagatcgatattcatcaaattattcagtttctgagtatcacgtgtatgagttctgcaaggtattatttgtctgctttggtaattctctgagttctgcatcagctgatatccgtgttcacgagttttttaagacaccatatttcaagtcagggatccatcctcttccaggtgctcagatggctcttcagaagttatcaagattttgtagcctatcagttgtaacatcacggcagaatgcaatcaaggaccgcacaattgagtggatagagaagaattatccaggactgtttcgtgagattcacttcggtaaccactttgctcttgatggtgtgtcaagaccaaagtcagaaatttgtaggtctttaaaagccaaggttcttattgatgataacccacgatatgccatagagtgtgctgatgttggaattagagtcttactttttgattatgaaaactcatatccttggtgcaagaacgagtctgttgatcagcatcctctggtgaccaaagttaagaactgggaagaagtggaacaacaattagtgtctctgatagcttcttag

SEQ ID NO: 76264 - DNA, 2442 bp, Glycine max
  Peptide Sequence Number=SeqID_167949
atggcgacggctaacaacgcgtcatgcccagcgttcatgaaggcaacgtcgaatggggcgttccaacatgagaaccccctcgattatgcgcttcctctgttaatcctccagatttgtttggtcgttgtttttactagagttattgcattcctctgcagacccctcagacaaccccgagtcattgctgagatcattggaggaatactacttgggccatctgcaattggacgaaatgagaagtttctgagcacggttttcccaaagaaaagcataacggttcttgacacactaggcaacgttggtcttttgtttttcttgtttctagttggtcttgagcttgacatgcgtgctattcgccgtactggtcacaaggccttagccattgccctttgtgggatcactgtgccttttgttcttggcattggcacttcttttgctcttagagccaccgtgtccaaaggtgctgagccagtttcatttcttgtcttcatgggtgttgcactctcaatcactgcctttcctgtcctcgctaggatcctagctgagcttaaactcctcaccactgatgttggtcgcatagcaatgtcagctgcagctgtgaatgatgttgcagcttggattcttcttgctcttgccatagccatttctggttctaacggatcaccctttgttcctctttgggtcttgctctctggtgttgcttttgttatctttgctgtctttgccattaggccattgcttgtagctatggctaaccgttcccctgagggtgagccagtgaaggaggtgtacatatgcatcacattgacactggttttggcttgtagttttgtcactgatactattggaatccatgccctctttggggcttttgtgattggtaccattatgcccaaagagggttcattttctgtagtgatgattgagaagatagaagacctggtgtctggccttttcctgccactgttttttgtgtctagtggcttgaagactaatgtggcaactattagtggaggactttcttgggcaatgttggtgcttgttatattcaatgcttgctttggcaagattgttggcacaatagttgtgtcgttaacgtgcaaggtgccttctcaagaagccgtggcacttggatttctcatgaacacaaagggcttggtagaactcatagttctcaacattgggaaggaccgtaaggtgttgaatgaccaagcatttgccatttgtgttctcatggcattgtttaccaccttcatcaccaccccaatagtgatggctgtatataaaccagctcgcagaggagcaccctacaagcacagaacaattcagcgcagagatcctgacactgagctccgaatgctagcttgcttccacaccacccgcaacattcccacgttaatcaatctcatagagtcttcccgcggaattcgaaagagaggaaagctttgcatctatgccatgcacttgatggaactctcagagcgatcttcagcaatcacaatggttcacaaggcacgcaagaatggcatgcccttctggaacaagaaaccggatgacaaagatcaaatgatcattgcttttcaggcttatgagaaactaagaagtgtcaatgtgcgccccatgacagccatctctgctctcaatagcatccatgaggatatttgtactagtgctcaccaaaaacgtgcagccatgattatcctcccattccacaaacaccaacgtgtggatggatcaatggagtcactaggacattcactccatgtgatgaatcagcttgtgctaagccatgctccttgctcagtgggaattttggttgatcgaggtcttggagggacaagccaagtccaagctagtgatgtgtcttataaggttgttgtacccttctttggaggacgtgatgatcgtgaagcactttgttatggtatgagaatggctgagcacccggggattttgctcaatgtggttaagtttgtgcccccacctggggcatcattggcctttggtgctaaattggttgggatgtcatcgaacaaggacaagaaagcaatggaagtggttggtggcagttattatgatgataaacaacaagatgatcaattgtggagtgagtttttaagtgcatgcaacaacaaccaagagtcaatgaagtatgagcaaaaactggtggcaagcaaaggtgatattgaggcagcattgaaggaaatgaataggagcaatctaatattggttggtagaatgccatcagtaggacctttggttagcagaagtgattgtccagaacttggacctgttggaagctacatggcttcttcagatttctccactgttacatcagttatggtaattcagcaatataatccttcaactgacattcatccactagtgatggaggaatttgattacccagataagctagagccaaacgcaccaaggagttaa

SEQ ID NO: 76265 - DNA, 567 bp, Glycine max
  Peptide Sequence Number=SeqID_167950
atgaagctgctgaggatgtttttgtttgtggggttggtgattgtgaaatgggtggaaggctttgaggatgctaatgtgacagaccttgacatgcaatatgtcagtggaagaggtttctacagacctttgatggttggttttactcttattaatggcgctgctgctaaaggagctgtttgcctggatggatctttaccggggtaccatttccaccgtggatatggttcaggatcaaacagttggctcatacaattggagtgtttatctaaaactcttgtctatttagcactctttatttgggttgatggtgaatgtggtcgaactaatactgaagtcatcgttgctccacagggagcagggttatatttcagagggcaacgcatttggcaagctgctatggaagatttaatgtcaaaagggatgcgctatgccaaacaggctcttctatctggatgttctgctggaggtttagctactattatacattgtgatgaatttcgggaattgtttactagaaccacaagagtaaaatgcttaagtgatgctggattattccttgattcgtaa

SEQ ID NO: 76266 - DNA, 417 bp, Glycine max
  Peptide Sequence Number=SeqID_167951
atgggaggtttagctaagaagataactcatcatctggtgaccctggtgctggtaatagtattgtgcaccactattgttgaaggcaccaaacatgtaagcatcaagaacagactaggatctgggaggaacatgaccttgcattgccagtccaaagataatgatctgggcaaacaaaacatagcatacggggacgaatttggatgggacttctctgacaatgttgctggaaccacactgtttttctgtgatttgggatgggaaaatgttgaggagttccattttgatgcgtattcctttgccagggacagggtacgatgtggtgatgctggatgttcatggctagtatcgattgaaggcatttatggcttaaatggacaaacggggtactgggaattcatgtaccaatggccaaattga

SEQ ID NO: 76267 - DNA, 612 bp, Glycine max
  Peptide Sequence Number=SeqID_167952
atgaaaactccgatttcgggtttctacagaaaccccgtgaagttcagaatgccaactgcggagaacttggttcccattcgattggacatcgaaatcgaggggcagagatacaaggacgcgttcacttggaacccttctgatcccgattccgaggttgtcgtctttgcaaaaaggactgttaaagacttgaagctccctcccgcctttgtaacacaaattgctcaatcaattcaatcacagctttcggagtttcggtcctatgaaggccaggatatgtatgctggggagaagattgttccgatcaaggacttgaacaactttgagagtgaccctgaagagtttgccagaatcttctgcaaggacacgggcattgaagatcctgaggttggaccagctattgcctttgctatcagagagcagctttatgagattgcaattcaaagtgtggtttcagcaagagaaagcagaatgagcaagaagggtcgtcgaggggctgaatatactccagtcagtaaaggaggtgcagcagcagtggacttggtcaagttgtttggtccgaaatctagtgtagttcgcttgtggaattcgctaattcataagcctcaggactag

SEQ ID NO: 76268 - DNA, 582 bp, Glycine max
  Peptide Sequence Number=SeqID_167953
atggaatgccccatcctgttccggagcaaaagggaagtcgtggaaactaaggatggaactgtctcagtagctgctgcgtttgctggtcaccaggaagccgtgcaggatagagaccacaaatttttaagcaaagctgttgaagaagcatataaaggggtagattgtaaagatggaggcccttttggtgccgttatagttcataatgatgaaatagttgctagttgtcacaatatggttctgtgtaacacagacccaactgctcatgctgaggtgacagcaataagagaggcttgcaagaagcttaagcagatagaacttgctgattgtgaaatatatgcttcttgtgaaccttgccccatgtgctttggtgcaatccacctttctcgaattaagaggttggtttatggagcgaaggccgaggcagcaattgctattgggtttgatgatttcattgccgatgcattgcgaggtactggattctatcagaaagcaacattggaaattaagagagctgatggtaatgaggccatcattgctgaagaggtttttgagaaaacaaaggaaaaattccaaatgtattag

SEQ ID NO: 76269 - DNA, 288 bp, Glycine max
  Peptide Sequence Number=SeqID_167954
atggacaaaatctggtttcgtggcgaagtgttgagcttcatgtgcgacgagggtcatcatgacaccgacaactgcgatctcacacgacaacatcctgtgttcacggtggctgccggagtcatgaggagtggcgttgtcagcgagaacccagattttgttattggttttgagggttggtctgatctgggtttgagatttggttttttgatttgcgtggtgaatgctcatgatgggtgtggtttgaagaagaggatgaataaaaacaacataaagatactggctttttga

SEQ ID NO: 76270 - DNA, 984 bp, Glycine max
  Peptide Sequence Number=SeqID_167955
atggagatctccggcagcgttctccgccagctcagctacgtctccggctatgggacccccacgcgttcccgtggcgtggcttctcgtgttgggctgagaatggggacgggttctggtttctgtgacgaggggcatctgcagtattaccaggacaccaaaaagattctgacccctaagaagttgaaattgctcaagggtttctccaaattagggcttgcatcggatcccgagaaacttgccatgttccatgatcttcaacaaaacctcacctcggatgctggagaggtgttactgagagagttagaagcagcaagagcaaaggagaaggaaatgaagaaaaaaagaaagcaagagataaaggccaaactcaaagcctccaagatgaattgtgaatcttcttcatcttcatcgtctgaatcaagtgacagtgatggtgattgtgatcaagtggttgacatgaactgcttcagagctggtgctggtgttgttgtccctgcacctgtggaggaatccccactgcccaagacccccattgttgaggatacaaatgcaaaggcgcatcgtgatgccatggcattgtgttctaagaatgatatctctgttagcagtgttagagattgtattaagagcgagagtgctgttgttaccgctgctcctcaaaagaggattgaggtctgcatgggtaccaagtgcaaaagatcaggggctgctgcactgatgcaagagtttgagagagtggtgggtgtcgaaggtggtgctgttgtttcatgcaagtgcatgggcaagtgcaaaactgctcctaatgttaaagttcagaattctgtcgatcatagccttgctcgaggactcgatgattctgttaacattcctgctaaccctctctgcattggagttggcttgggggatgtggatgccattgtggctagatttttgggagagagtcacacagatataggtatgataggtgcagctacagctacttga

SEQ ID NO: 76271 - DNA, 154 bp, Glycine max
  Peptide Sequence Number=SeqID_167956
atgataggaagactagtcagggtcatgctgttttgcgagaatgctccaatcatgtgggatcgacacaaatttaaagaagcattcaaaccaagtgtatttacccccaaggcctacactccgaagagtccgtcagggcctctccctcctgattcag

SEQ ID NO: 76272 - DNA, 2256 bp, Glycine max
  Peptide Sequence Number=SeqID_167957
ggactagacacaatggttggtgagcatggggctcagctttctgggggtcaaaagcaaagagttgcaatagcaagagcaattctgaaagacccaagaatcctacttctggatgaagctacaagtgcccttgatgctgaatctgagaaaattgtacaggaggcattgaacagaataatgataaaccgaacaactgtcattgtagcccaccgcttaagtactataaggaatgctgatagcattgctgttatgcatcaaggaaaaatagttgaaagaggttcacatgctgagcttacaagggatcctattggagcctatagtcagctcattagactgcaagaagttaaaaggtcaggacaaaatgttgcaaatgaaacagacaagctagaaggtactgcacattttggaagacagtcaagtcaaagatctttcttacaggctataagtcaaagatcatcagaagttggaagcagtggtcgtaactcattctcagaatcacatgcggttggcttcttggaacctgcaggtggagtgcctcaaacatctccaacagtttcttcaccaccggaagtgccactctatcgcctggcatatttaaacaaacctgagactccagtcttactggcagggagtatagctgcaataataaatggggtgttattacccattgttgcaatctttatgtccaaaatgattagtattttctatgagccagctgatgagcttcgtaaagattcaaaactttgggcattattatttgttgtgcttggcgtggtatcatttatcatgcctccttgtagattctacctttttggcgttgctggtgctgaacattcaagtggagcaattggagcaaggctttcttctgatgtagctgctgttcgagctttggttggggatgcacttggtttgttggttcaaaatattgctacagcagtaggtggcttggtaattgcttttgaagcaagctggcagcttgctcttataatgcttgctttggcacctttattagtactaaatggatacgtgcaattcaagttcttgaagggattcagcgcaaattcaaagaaactgtatgaggaagcaagtcaagtggcaaatgatgctgtagggagtataagaacagttgcttctttctgttctgaaaagaaggtgatgaaattataccaggaaaaatgtgaaggaccaattaggacaggcataaggcgaggaataataagtggaattagttatggggtatcattcttcatgctgtatgcagtttatgcatgcagtttctatgctggagctcgacttatagaggatggaaaatcaacattctcagatgttttccgcgtcttttttgctctcagcatgacagctatgggaatttcgcaatctggctctttggtccctgattcaagtaattcaaaaagtgctgccgcttctgtatttgctattcttgaccagaagtcacaaattgacccaagtgatgactctggattgacattggaagaagtcaagggagagattgaatttaaccatgtcagtttcaagtatcctaccagacctgatgttcaaatattcagagatcttagtttgaccattcatagtggcaagacagttgcactggttggagaaagtggaagtggaaaatcaacagtgatttcactattacaaaggttttatgacctagattcagagcctgtgctgtttaatgacaccatccgagccaatattgcatatggaaagggcggtgatgcaacagaggcagaaattatagctgcagcagaactggcaaatgctcacaacttcacttgtagtttgcagaagggttatgacacaatagtaggggagagagggattcaactatctggagggcagaagcagcgggtggcaattgcacgagctatagtgaagaatccaaaaatattactactagatgaagccacaagtgctcttgatgccgagtctgaaaaagtggttcaggatgcactagaccgtgttatggtggaccgaaccacaatagtagtggctcataggttatcaactataaagggtgcagatttaattgcagtagttaaaaacggggtcatagcagagaagggaaagcacgaagcattactcaacaaaggagcgccacacctcgcgcttagcgcgttcagatcgtgcgctgggcgcgccatgcacgctgggcctgtgcttctgttggatcgggcgctgggcgctgggcgcctagctgggcttagcgcgcgtaacggttttcaccttcgtgcttaa

SEQ ID NO: 76273 - DNA, 795 bp, Glycine max
  Peptide Sequence Number=SeqID_167958
gagtctccccctactgtacaatgcaccgtggagaaagctttaactcaggcaacaaagcttcaaaggaaggatctctgtttggttggtgcaagcaggaccgatgcaggagtccatgcttggggtcaggttgctcatttttttacaccttttaactatgacaacttggaacaacttcatgcagctttgaacggtcttcttcctactgatatccgaattagagagatcagccctgcatcagctgaattccatgctcgattttctgccaaaagtaagatttaccattacaagatatacaatgatgccatcatggatccattccaacggcactttgcttaccatagtgtgtataaactcaatagcgctgttatgagagaagctgcaacatattttgttggcaagcatgatttctctgcctttgccaatgcatcccacaatgatcgggtaccagatccagtgaagcatgtattccgattcgatttgaaagaaatgggagctcttttgcaactagaagttgaaggctcaggttttttatataggcaagtccgaaacatggtggctttgttgcttcagattggtagggaagctatccctcctgacattgtaccacatattctggcgagtcgagatcgcaaagagcttgcaaaatactccttgcctgcccctccacatggtctttgtcttgtttctatcaactataatgaaagtcacctattgcctccgccggagtccccccctgcaaacagttttggtagacatcagaccataaggaaatgcaaggttccattctttttgtaa

SEQ ID NO: 76274 - DNA, 171 bp, Glycine max
  Peptide Sequence Number=SeqID_167959
atggttccacatgaagatactcttgattcatgtccttcacactcagttgttcctagaacagatccttcttcatcatcatcttctcatgatccagattcaggttggcccattgtctttagaaaaggaatgtttgtgaggcacttgctcaccctagatggtgacaagccatga

SEQ ID NO: 76275 - DNA, 336 bp, Glycine max
  Peptide Sequence Number=SeqID_167960
atggaggatatcaacaagcatattggtgataatctgaggtacagcacatttgttgaagtgaatgtgcagcagaaagagactgctaatatggagcagaaggaggttgcttcagaatactttgtaacgcaggttcatttatctttctctggggcaatcttgtttttctattatgcaacaggtagagagcagcaagtgggtaagttcagggagagtagctcttcaagaaaggataaatatcccactgagataattccaaagagaattgtattggatattgacaaggcaaaaatacaatgcatcactggaacaatgatcattttcacattttgttggtaa

SEQ ID NO: 76276 - DNA, 159 bp, Glycine max
  Peptide Sequence Number=SeqID_167961
atggggaagacacatgaaattcctcaccacaatctagccgacttcgagccttgcctcagatatgccactgaagggcaagcatttggtggtaaaatccctcctattatggaaggaaagggaaaagttggatcatctagaggaaaggctcaaggccattga

SEQ ID NO: 76277 - DNA, 333 bp, Glycine max
  Peptide Sequence Number=SeqID_167962
atgtcgacgcagaggttgctcagagtggcaacgtccacgtgtttccaactattcggtccaacgttggaagggagcgaggaggaggggctagggacggcgatttcgaggcttctgcacccgaatgcgcgattcagaggcaaaagggttggccaaatgggtttttgttttggtttggaaatggaagggaaaaaggagggtccatggagatggtggattctcgctctggctgggactgagagaggcattcagccacgtttcagtgcagattggagaacaacaacaaagaaactaaagatattagatatggccagaaaccaaaactgccttttctag

SEQ ID NO: 76278 - DNA, 519 bp, Glycine max
  Peptide Sequence Number=SeqID_167963
atggaattcggctaccaagaagattcctccaaaagctcgagcgacgaaatcgatcgatcgtccgaacagaatgatgagacgggcattggcagatcctacgagtgtgtgttttgcaagagaggcttcaccactgcacaggctttggggggacacatgaacatacacagaaaagatagagccaataacaaggccaaacccaattttcctccttcgagttcaagcaaggttgttgatgagagtaataactacgcaaatccaagctatcttacaagagggaattactattcttctactcttcctgatcatagggaggtagatgttaattacagttactaccatcaattgtattttccctcacacgcatgtggtgccaaatcaccttcacatagagatgagttgcaagttggaagcagaaagaagcaagatttctatagcatggaggcttcttcaaggaaaggttgcaagatcgtgtttctggtaagggaaggtactcaagatatatatacgttttcaatctag

SEQ ID NO: 76279 - DNA, 354 bp, Glycine max
  Peptide Sequence Number=SeqID_167964
atgggtacaaagcttccaatagagaatgaagaagatgaaacacaccccagaaactgggttctgttcaagcacaatatctccaattccaaacaacgaataaccaatccagtcgttgaaaatgaagaaccagatgtcctgaacctactgacaaaatttcaggtggatcccaatgataaagaaggtaaaggtaatggaatgttgacaacaaggatagatgctggaatagagtctagtgtattggaggcaagagaagggaatgacaaagttaagagaggaggtgggaagtctgtttatgagatagacacttatgaggaaggcatggtcccaaaatttgaaagggagagaggcttgtga

SEQ ID NO: 76280 - DNA, 456 bp, Glycine max
  Peptide Sequence Number=SeqID_167965
atggctttgcccaaagaggctacccctccaccaagttttggtgtttgttgcttgttggaagcttgcatctcatctctgccatcaatatgcacggagcagctcaaggtgttggtggtttccattggtattaatgtttggcaaatgttggtcactttttgtgaagtcccgttcgtcggtgaaggtgaagggaccattgcatttcgtcacaattccctccattgtttgctagtcaccagaccattcccattgaaggcactgcaaaagacacactcaaaggatgacatggtgtcgatgtttgagtgtcacaataatgtgcgtggcggtagcaagtggttggttgatggcatggtggagggtttggtgtggtgtggaggtggtgttaggtggttgcggtggtggtatagggtggatgtagggtgtggtggtcatggaggtttgggagagagaggcaactag

SEQ ID NO: 76281 - DNA, 1044 bp, Glycine max
  Peptide Sequence Number=SeqID_167966
atggaagtggtgggttttgacaaagagggtgcaggctatgacagagccaaggaagtgaaggagtttgaagataccaaagcaggagtgaaaggactcgtagattttggtattctcaagcttcccagattcctcatccatccaccagaatctcttccatcatcaccaacatcttccaacaacacaacttcaaccttgcaggttcctgtgatagatttcgcaggatatgatgatgatgatgatgaaagttgttgtcgcaggttaaagatagtgagagagattcgcgaggcatcagaaaagtgggggttctttcagatggtgaatcatggtgttccagttagtgtcatggatgagatgctaagggtcataagagagttccatgagcaatcaaaggaggtgaagaaagagtggtattctcgtgaccctaaggtgagagtaaggtatttctgcaatggagatctccttgtggcaaaagtagcaaactggagggacaccataatgtttcattttcaagagggtcctctcggccctgaggcatatccactagtatgcagggaagccgtgattcaatacatggagcacatgttcaaactgagggagatattgtcccaattactttcagaggcattggggctcaagagggactatcttaaaaacagagaatgcatgaaaggtgaaacagtggtgtgccactattacccaccttgtccagagccagatttgacacttggtgccactaagcattcagacccatcatgcctaacaattcttcttcaagataccatgggtggtctccaagttttccatgaaaatcaatgggttcacattaagcccatgcctggagcattagtggccaacattggtgacttcatgcagcttatcagtaatgacaagctcaagagtgttgagcatcgagtactggttggacgagttgggcctagggtatcagctgcatgccatgtacatgcttgttgtattgtactcatcaatggtaacaatcccatgtgggtagtaacaattcttggaacataccaacatgacaagtaa

SEQ ID NO: 76282 - DNA, 240 bp, Glycine max
  Peptide Sequence Number=SeqID_167967
atgggttcgaatccggaaacagcctcgttgcatatgcaaggtcacagtttgacactctcctgtgataaagaagaaaagaacagtagcttgcccttcaactccaagcaagcgcccatagaccattatagaaattacagtagtttccttcctcgtccttactctctactatgctcgtcctcactatttgaaggtcaaaactttattgaggaatcaatatcaagtaacaacatatgccaataa

SEQ ID NO: 76283 - DNA, 405 bp, Glycine max
  Peptide Sequence Number=SeqID_167968
atgcctgatcctctgtttttcattgctgctaaatcctttagatgtcagaaaaaggtctttaatgaatttaatgcccgaaagccagataaattcaacatattcaagggagtcacaagaaactacctctttatggggatagtaggaataactgttgtgcttcagattgtcatcgttgaatatcttgggaagttcactaaaacagccaagcttaattggaagcagtggctcatttctgttattatagcatttatcagagtacttgtcatgtgctcgcatgctaactgtaattcttctcctgctccccattctctcagctggcctcttgctgtggttggaaaactgatacgagtaccaaaggctgaactcagtaacttgttccgaaaatatcttcgtagaggaaattaa

SEQ ID NO: 76284 - DNA, 972 bp, Glycine max
  Peptide Sequence Number=SeqID_167969
atggcaacctataagcacagatatttctctgggcatactagaaacccagatggaagtgttcaatttatagcgggcaagaccaaagttggtgatgctattgatggagtaattaagatattcactgtcgcggtcaccattgtggtgattgcagtgcctgaagggctgcctttagcagttaccttaacgctttctgcctgtgagacaatggggtcagccacaaccatttgcagtgataagactggaacattgactatgaatcagatgactgtggttgaggcttggattggtggtgggaagaagattgttcctccttatgaggaatcaaagttctctcatatgctctgctctttgctgattgaaggtgttgcacagaacactaatggaagtgtatatatcgctgagggtggtaatgatgttgaggtttctggatcaccaacagaaaaggcaattttagagtggggaattaagcttgggatgaattttgacactgccagatcagactcatcaattattcatgtattcccattcaattcagacaaaaagcgaggaggagttgcaacacgggtgtctgactctgaaatccatatacattggaaaggtgctgctgagatagtcctagcttgctgtacacggtattttgatgcaaatgatcagttggtggagatggatgaagctaagatgtcaacttttaaaaaagctattgaagatatggctgctgatagtctacgttgtgttgcgattgcatatagatcatatgaaatgaagaatgttccaactagtgaagaagaactttctcactggtcattgccagaggataatcttgttttattggctattattggcctaaaggatccttgccgacctggtgtcaaagatgcagtgaagctttgccaaaaggctggggttgaggtattaatacatgcttttgatgttgaaattcattttgttccattatgcgacttaggtcattga

SEQ ID NO: 76285 - DNA, 642 bp, Glycine max
  Peptide Sequence Number=SeqID_167970
atggaagacaataatgaagaatgcatcactgggttatgtttgggaattggaatgggagggcatgttccaaagaagaataagcagaaagagaacaaggctgtggcttgcctagacctagcgtttgagctttgtccaaaaggagaagaagccattaacgtgaatcttcatcatcatcatcatgagaaggtagaaagaatcagcttggagagaatccacgagtaccccaatgaaaagagcactgattctgataacagcaacaacaacaacagatgcagaaagaaactgcggctttccaaggagcaatcatccatgcttgagaacagcttcaaacagcatagcactcttaatccggtccagaaacaagcactagctgatcaattgaatttaaagactagacaagttgaagtttggtttcagaacagaagagcaaggaccaaactgaagcagacagaagtggaccacgagttgttgaaaaaacactgtcaaaatctaagtgatgagaacaaaagattgaagaaggaattgcaggaactacgtgcacttaaggttggaccgtcgccactatgcattcaactatccaaaacggcgactctgacaactatgtgttcttcctgcgatcgagaattaaaactagtaaattaa

SEQ ID NO: 76286 - DNA, 480 bp, Glycine max
  Peptide Sequence Number=SeqID_167971
atggatgcaaatttggaaggcaagtatccaaccaacttagctttacaattagctcaactcgctctcaaatgcatccaagcagaccccaaagtcaggccatcaatgaaagaagttcttgaaacattggaacagattgaagcagccaatgagaaaccagctgataacataaaatgggttacttgttcccgggtagttcaacaacatggctggccagaggtagctagcaaagagcttcctcggatgttgttgttagggtggaaggtttggcgcgaagcagaaagacagaagcaagatcgtgtgggacttgaaagaaggcttgagaatgagaaggaaaagttgtccttgtggttctggacactcgtggtttctttggaggtggtggacaaaccaacaacgtttgaggttttgatgatgtgggtgtgtggcactcttgcagcagctcctccttctctacctccgcgcgttggctgcagcttctaa

SEQ ID NO: 76287 - DNA, 1176 bp, Glycine max
  Peptide Sequence Number=SeqID_167972
atggcttattcattcattgcaaatatgaggttaggcacatctgagctgaacccacccgcattcttttcatgccggcggcatttccccggaataccaacactccaacttcacccacccgcaagaccaacgtcgccgcgccggtgccgcgattgggtaacctatgcaagccgtcaaaaaccgccgattccaatttctagtaacatcgacgagagggccttatgttttgatatcttgtggagatggctttctagacttatctccttttacttgctatctctcaatctcgctgctgcagcctctgattacccagctccctctacttatccctgtgaggacattagccattactattcttctgtgaagcattttagattcagaggtgaagcactcaaaagacaattgaatagcatcgttgccccacatcattccttgtcctacagagaggtgtgggatgccctcaaggttcttgatgctgctgatattgataatccagaagcttcatctgaaatagttgaaatatactccttgagagttgtcccaaaacggttggcaggaaaaccgcagggatggaatagggaacatctatggcctcgttcttatgggctgactaaaggtccatctttgactgatttacacaatattcgccctgctgatgtaaatgtcaattcatcaagggggaacaagtactatggtgaatgcattactagctcaagcaaatgtttgaggcccgctaacaaggaagctgctttggacactgaaacagacaaggagaggtgggcaccacctatgcagttcagagatttctttgagaggcaaagtctggagaagttcttgaaggttagaggggatgtagcaagggcattaatgtacatggcagtctgttatgggttccaacaaccaaggggaattccaggccttcgcctctcagatgccccaaatgttgaaaagagggagatgggactcctttccactttattaaaatggaatgaagttgatccaccttcaagggatgaaaaactgagaaatgaaaggatatgcaaattttatcagcacaatcggaatccatttgtcgaccatccggagtatgccaaccttatatggaagcaacctgtttttcataacaatagccacactaataatgcctcacacaaagaaaaggagttaggaatgtcttaa

SEQ ID NO: 76288 - DNA, 1053 bp, Glycine max
  Peptide Sequence Number=SeqID_167973
atgcatgagacacccagaggacttatacatctgctgctaacttgttcactctggattatgcagcagaaagtgaatgccaaatgtttccaggctgaagaaatcacaattgctaaaggctacttgagcataattgaatctttggcttctgtgctaccacctggtttggttcagttgggaagaaaagtcacaagaattgaatggcagcccgatagacacgaggcgatgaatttggaaaatggaagaacatgctctaggcctgtgatgctacatttctgtgatggctctattatgtctgcggatcatgtcattgtcacagtttcacttggagtgttgaaggcttctattcgtgatgatgattcaggtatgttgatgtttaatccccctttaccctctttcaaggccgaggctatttcaaggcttggttttggtgttgttaataagttgtttatacaattgagtgagcctccacatgagagaaaagacgaacatgaacactccaaagggttccccttcttgcaaatggtttttcactcacctcaatctgagttgaggcacaagaaaataccctggtggatgaggaggacagctaccctttgtcccatttacaacaattctagtgtcctcctatcttggtttgctggggaagaagctttggcactagagtcactcaaagaagaagagatcattgaagggatttcagacacaatttcatgcttcctatcacattcacttgagttttgcaacgggaatgtgaattctgagaagtactctcacgaatacaaggtgaaattcagtaaagtgttgaagagccagtggggaacagatccattgtttttaggctcatacagtcatgtggcagttggatcaagtggtgatgatttagatacaatggcagagccattgccaaaatgccacatttctgcttcacccccacttcaaatcttgtttgcaggggaagcaacccacagaacccattattctacaactcatggagcttacttcagtggccttagggaagccaataggcttcttcaacactattcactgtgttaa

SEQ ID NO: 76289 - DNA, 2202 bp, Glycine max
  Peptide Sequence Number=SeqID_167974
atggatgaggatgttcttgctgtgccacatctatatgaggatcatcttgctaatatggttgatgaaggagatgtttctggtgttcaaagcctttcatccagtgcacaaagtactccagaaaaaaatggccattcagatgatgcttcaagaagttcagaacttcttcaggagttcctaaaatctggtcctaagaaggaaattttacgaacttgctttgataaggacaaaaagaacatttcttcaaaaagcaggatggctgaaaccaagtcaaccagtaagattgccaagaaacaggactcaaaaaaagtttctggtatcagcaatcagccttctaggaagcaacatcgcaaaggagaaaacccggtgcggttcgtaccaactcctgacccacctagtgattttggacattcaaactcttggatctgtaagaattctgcctgccgagctgttctctctaaagatgacacattttgtagaaggtgctcttgctgtatttgccacctttttgatgataacaaggatcctagtctttggttggtatgcacatgtgaatcttctcaaggggactcttgtgggttgtcttgccatattgagtgtgctcttcaacatgaaaaagtaggagttgttgatcatggacaactgatgcaactagatggtggttattgttgtgcatcctgcggtaaagttactgggatacttggatgttggaagaagcagctaaatatagcaaaagatgcccggcgtgtagatgtactatgctacagaatatatttgagctacaggcttttggatggtacttcaagatttaaagaattgcatgaaatggtaaaagaggcaaaggctaaactggaaactgaagttggtccagttaatggggtttctgccaagatggcccgtgggattgtcagcagactccctattgccagtgacgtacaaaaactctgctctcttgctattgagaaagctgatgaatggttggccactgttcccaatgtacatccagaatccagagagggttctcttcctgctgcatgcaaggttgtgtttgaagaggtaacagcttcctcagtcaaaatcattttaattgaaatgtcaaatgcatcttctggggacattaagggatacaagctctggtattacaagagtagggaggagtcgcacactaaagatcccgtttctgtgtttcccaaagctcagagaaggattttgatacccaacctccagccttgcacagaatatacatttcgggttgtatcttttacagatatgggtgacctgggtcattctgaggccaagtgtttcaccaagagcattgagatattggaaaagaattcatcgtcatcagttgccatgaataaaaaaaaggagaaccttcaaactgaatgcaattcttctggctccaaaatggagcccaatcccacaatggaagactctggatttaaggttcgagaccttgggaaaattttgcatctttcttgggctcaagaacaaggctgctctgaggaattttgctgcgctgacaagagaaaatgctgtgggcaaagtgaaacaatcaagcctaccaatccacaagagctgttgccttcagtttctcgcgaccttgatctaaatgttgtttcggtgcctgatttaaatgaagagcttacacctccattcgagtcttctagggatgaagataatggttgcactttgcagcaggctgttgaggcagatgatgatgctgcttcgcatgatttagaaaaaaatttagcaagatcacacggtagtggtggttcccaaacttggaaccatggacctactggtgaagttccagcagttgactctcgtggagatgcatgtaggaagagggtagcaagcacaaatgaagagacacatgattgtgacagcactttgataaatgattctcctttacgtgcatctgatggtccattctccttagatgagaactttgagtattgcgtgaaagtaattcgctggctagaatgccagggtcatatcaagcaggaatttaggttgaaattgctgacatggtttagtttgaggtcgacagaacaagaacgtcgggtggtaaatactttcattcaagctctgattgatgatccaagtagtttggcagggcaactagttgactcattttctgatattatatccaacaagaggccaagaaatgggttctccaataaggctgtgtcatcaagttaa

SEQ ID NO: 76290 - DNA, 330 bp, Glycine max
  Peptide Sequence Number=SeqID_167975
atggatagaagaggagaaggggataatgaacatagaaagaagattctcctattagagatactcagacttatgatgtattcattaaagagttttgagtctccggggtggtttgtatggattggtatctcgactttcgcgctaaacgtgtttttggacttccttgtgagccttcttcgcactaagtctgagctttcccgtttagtgagggtgcgcgctaagcctggattgcgcgctaagcggactatccaattcttccaatttttcttcaaggttttttcttccaatttttctccaaagcacttgaaatcttcttcttttaacttctgctaa

SEQ ID NO: 76291 - DNA, 1470 bp, Glycine max
  Peptide Sequence Number=SeqID_167976
atggaagatgatcaatctactcagatcaaaggtgttgttataatctcccttccaccaccagataacccttctttgggcaaaaccatcactgcttttgctttctctaataacccttctcctccccctcaactttttattcaaccccatcaacaccaaagtcaacaaacacaccccaatgctcaacataacactgatcctccacttcagtcctacccatctaatcctcagcttagtttttcattcagaagactcttccacagcaccccagtgaagcttttctcattctttggtactcttctctttgctctcttctctatggttctgtttcttcaaccaccactgtggacctacgtggccgcaagaatgatgaaggatttgaagctccaactggggaagcttgttcaaaaagagaagtttttgacgcaaagagatgttggtgatggttctggggttgtggccgttgactcttcatccgtttttccagtcagtggaaatgtttatccagatgggttgtatttcactattttacgtgttggaaatcctccaaaaagttattttcttgatgtggacacagggagtgatttaacttggatgcagtgtgatgctccatgcagaagctgtgggaagggagcacatgttcaatacaagccaacaagatccaatgtagtatcatctgtggactctctctgtttggatgttcagaaaaatcagaagaatggacatcatgatgaaagtttgctacagtgcgactatgaaattcaatatgcagatcatagttcttccttgggggttcttgttagagatgagcttcatcttgtaactactaatggatccaaaaccaagctaaatgttgtttttgggtgtggatatgatcaagaaggcttaattttgaacacattggctaaaacagacggaatcatgggattgagtagggcaaaagtcagcctaccctaccagttagctagtaaagggcttattaagaatgtggttggtcattgccttagcaatgatggagctggcggtggatacatgttcttaggtgatgattttgtgccatattggggtatgaattgggtacccatggcctatacccttactacggatttataccaaactgagattcttggaatcaattatggaaatcgtcaactcaaatttgatggccaaagcaaagtaggaaaagtgttttttgatagtggcagttcttatacatatttcccaaaagaggcatacttggatcttgttgcttctcttaatgaagtttctgggttaggacttgttcaagatgattcagatactactttacccatttgctggcaagcaaatttccaaatcagatctatcaaagatgtcaaggattacttcaagaccttaactcttcggttcggaagcaagtggtggattttgtccacattgtttcagatacctccagagggttacttgatcattagtgtaatcctctctttctaa

SEQ ID NO: 76292 - DNA, 2013 bp, Glycine max
  Peptide Sequence Number=SeqID_167977
atggcgatggtggaccagcctctgtatccgattgccgttttgatcgacgagttgaagaacgaggacattcagctgcgcctgaactcgatccggaggctctccacgatcgcgcgcgcgctcggcgaggaccgcacgcggaaggagctgattccgttcctcagcgagaacaacgacgatgacgacgaagtgcttctcgcaatggccgaggaattaggcgtcttcattccctacgtcggaggcgtcgaccacgccaacgtgcttcttcctcccttggagactctctgcaccgttgaggaaacctgcgtcagagacaaatcggtggagtcgctgtgcagaattggagcacagatgagggagcaagacttggttgagcacttcattcctttagttaaggtagtgcatgttcctagttgcattgcgttttcattcgttgtgctaaggaggctggctgctggtgagtggttcacggcacgggtttcgtcgtgcggtttgttccatattgcttaccccagtgcaccagagtcggtgaagactgaactgagagccatatatggtcagctgtgtcaagatgatatgcccatggttaggagatccgctgccacaaacctgggaaagtttgccgcaactgttgaagctcctcacttgaaatctgacatcatgtctgtgtttgaggatctcacacaggatgctgtgaatgatattcctcaagttgtggcattgtcagtatattggactgactacgtgagaaatgaatacagtttgagtttgtcatatcaagattctgttcggctacttgctgttgagggttgtgcagctctgggaaaattgttggaacctcaagattgtgtggcacatattcttcctgtcatagtcaatttttctcaggataagtcatggcgtgttcgttacatggttgctaatcaactatatgagctatgtgaagctgttggtcctgaccccaccaggtcagaattggtccctgcatatgttcgtctgctgcgtgataatgaggctgaagtacgtattgctgctgctgggaaagtaactaagttttcccgcattttaaatcctgaccttgccattcagcatattctaccatgtgtgaaggagttatcaacagattcatctcaacatgttcgctctgcactggcttctgttataatgggtatggcaccggtgttagggaaggatgctacaattgagcaacttctgcctattttcctttctcttttgaaagacgagtttcctgatgtcaggctaaatattatcagcaagcttgatcaagtgaaccaggttattggtattgatttgttatctcagtctctgttgccagccatagtagaattagctgaggatcggcactggagagttcgacttgcaatcatagaatacatacccttattggcaagccagttgggtgttggtttttttgatgataagcttggagctctttgcatgcaatggctaaaggacaaggtatactcaatccgtgatgcagccgctaataacatcaaacgcttggcagaagaatttggaccggattgggcaatgcagcacattattccccagccttgggttattgggatttgggatgacgagtttgagtgtttcttggattgtggattatggttattggcttattaccgtttggtggcaaggattttgtttctgagtgatgaagtgaaggttttggacatggttactgatccacattatctgtatcggatgacaatcttacaagcaatttctctactagctcctgttctgggctcggagattacttcttcaaaactgctccctctggtcattaatgcatcaaaggatagggtacccaatatcaaattcaatgtagctaaagtgttgcagtctctcatcccaattgttgatcagtctgttgttgagagtaccatccgtccctgtctggttgagctcagtgaggatccagatgttgatgttaggtttttcgcctcacaagcactacaatctagtgatcaagtcaagatgtctagctag

SEQ ID NO: 76293 - DNA, 93 bp, Glycine max
  Peptide Sequence Number=SeqID_167978
atgaagaaaagcaggatgctgatgactaaggaacatcatcctaaaagttttatattcgaagagctgtttgtacagccattttgccaaatgtaa

SEQ ID NO: 76294 - DNA, 483 bp, Glycine max
  Peptide Sequence Number=SeqID_167979
atgtttgcacattcgattaaaggctgccgtcccttgggacgggcgtgtggggtgctaataccttccccgtgcgtaaatacaactcccgaacctttcaacttaaaagttcgtagatcgcgtcttttccggtttttccgacgttttcctcaaataaacgttggtggcgactccgcgcgtattcctttcgtggaacacgcatcccgcgagtcacgcgtcgccctccctccgaaggatctaagtaatgatatctatccaaatccacagccaaaatcacacctcttcctaacgatgacgccactatttgccaaacactcctctccttcaacaacaacgggaagctcaccctcgacttcttcaactaggtccaagagttcctccctactttcatcactccaccaacaccttcaacctcatgctcgacatcatcgacaagtacttcgagttcaacctctcgtgggacctcattcgctgcgtgaatgttaa

SEQ ID NO: 76295 - DNA, 510 bp, Glycine max
  Peptide Sequence Number=SeqID_167980
atgggtgaccaagaggagatacaggaacagatgaaagccgacatgtcagctttgaaagagcaaatggcttccatgatggatgccatgctagaaatgagacaactaatggagaataacgtggccatcgttgccactgttagtttggctgtcgaagcagacccaactctcccagctaccgcacaccatcctctgccaaatgtgtcgaacgacgttcatgaggatcgtagagagcatgcccaaggagacatcgattcctactcctcggtccccgtcgaggggctggcacccaacacactaccccagcccaacctcacgggagaacctcgaaatctcccagcacagccaatattcttgtccacagaagggccacccccggcagtggaagaaaaaaggaaactcgatctcatcgaagaaagattgagagctgttgaaggctttggcgactatccgtttgtggacatggcagatctttgcttagtatcggacgtcctcatccccccaaaattcaag

SEQ ID NO: 76296 - DNA, 306 bp, Glycine max
  Peptide Sequence Number=SeqID_167981
atggaccattttaagtgcttgaaagaatcaatgacaatgcttacaaagttgagctacccagtgaatggagaatccaatttgaggacaaatccttctcaagagggagagaatgatgaggacatgaccaagagcaagggcaaggatccacttgaaggacttggaggacctatgacaagggctagagcaaggaaagccaaggaagctcttcaacaagtgctgttcatactatttgaatacaagcccaagtttcaaggagaaaagtccaaggttgtgagttgtatcatggcccaaatggaggaggactaa

SEQ ID NO: 76297 - DNA, 180 bp, Glycine max
  Peptide Sequence Number=SeqID_167982
atggcaataactcaagctacaaggctccaaatgaggcccaagtggagaaggacgaaggcccaagtggagaaggacaaagcccccgagtggagaaggatgaaggcccaagtggagaaggatgaaggcccagaggcagagacactatcaagactattaattgttgctgaaggcccaaactaa

SEQ ID NO: 76298 - DNA, 519 bp, Glycine max
  Peptide Sequence Number=SeqID_167983
atggtgcttttcatgtcattaatgcatatctcccgagcttctgcatctttcaatgagctcaagcagctccacaaggagcttggatcatctcactctcataagaagcacaaaaggcacagaacagagaatgatcttcctgaggttaaaaattctgccaaaggaaaggttttgatgcaagcaatgtatggagttaaggtggagactgtatttatttgcagggtgtttactgcagcattctttggctcgtcaaagaagttatcagacttgaatgtggcagacatacattcatgggctctagattttagaaggttgcagaatcttgtaaatgaggaaattagagtaagattttctggtggtaaatttactgtattgaatgagttggaagcggttgatgcgtctatgaagatattatatcctacttgtcgcaacctacccttcggcgggagggcgacgcgtgactcgcgggatgcgtgttccacgaaaggaatacgcgcggagtcgccaccaacgtttatttga

SEQ ID NO: 76299 - DNA, 429 bp, Glycine max
  Peptide Sequence Number=SeqID_167984
atgattgcttacatcccaaatccaagggttgatccttctcaatatcgtgatttagtacattattggtgttctgagaaagggcaggaaataagcaacactaacaaaaggaatcgctcaaaatatgaggacttgcattgcatgggaaccaagaatcttccaagacgaattcatgagatggatgaactaaaaaagaaaatgattgaagcagagagttcacaaaatttacaaagcactcaagattctactaattggacaaatgatatatattcaaaagtcaaagaacctgaaaaaagaggacatgcgtgttgtcttggcaagctttcacatcaagcaagttcatctcaaatctcttatgcaaacaatagaattcaaaaattggagaatttgcttgaaaaccttgttgttgtccttaaagtgcaatttgcataa

SEQ ID NO: 76300 - DNA, 264 bp, Glycine max
  Peptide Sequence Number=SeqID_167985
atggagacttttttgcagtctcggccggaagatgatgacctctccaggaaagggtgtcttcgcttgccaccagacccacaggtcatgatagcaaaaggtggggtggtcgacaaaagcgaggtttttgctcctactgtcgcaacacacccttcggcgggagggcgacgcgagggctcaggagtgcgtcttccaagggtggaaaatgtgcggagtcgccaccaacatttattcgagaggtgtatttacgcacggggaaggtattag

SEQ ID NO: 76301 - DNA, 396 bp, Glycine max
  Peptide Sequence Number=SeqID_167986
atggaacttcaacgtctcaacaaaaatgaagagaccgacaaaaggaaaaaaatcatatcactcaaagcctcctcctcaatgcaagaagaagaagaagaagaagaagaatctgatgatgaagaagacttctcactctttgtgaagaagtttcagaaattcatcaaaaatagaataatcaagaacacttcaagattcaagaggaaagttgaagaacacttcaagactcaagaggaaaagttgaagaactcttcaagatttaagaggaaagttgaattcaagcatcaagattcatggatcaagcttcaagaaccaagattaagattcaagactcaagattcaagaatcaagagaagacttaaacaacataagtatgaaatggtttttttcaaaaactga

SEQ ID NO: 76302 - DNA, 199 bp, Glycine max
  Peptide Sequence Number=SeqID_167987
gggaaaagagggaggtggttgccgcccagctcgcccaggcgagctgggttgcttccatcagaagacaccgccttctgttggaacgccctggaagattgcgcgacaatactccctttcgactcccggcatgtcgcggaacttcacggattacctaacaatgggtgttaagtacctcgaagcggtcaagcaaaggttgtag

SEQ ID NO: 76303 - DNA, 367 bp, Glycine max
  Peptide Sequence Number=SeqID_167988
atgggatcaagtcaaacgcatttgcttaaaaagaggttctatcaagtcaaggtcaagagcctagggatggtagaagtctccacagaggtcattgcctccctcgcccagtattatgatcagccattgaggtgcttcacctatggggacttccagctatcacccatggtagaagaatttgaagagatcctaggatgtcctctagggggaaggagaccatacctcttctcagggttctatccctcattagctagaatttctaagatagtccaaatctcggtgcaggaattagaccacagaaagcaagtcgaaaatagggtggttggaataccgagaaaatatttggaggcaaaagctagaatcttggcag

SEQ ID NO: 76304 - DNA, 243 bp, Glycine max
  Peptide Sequence Number=SeqID_167989
atggctcgctcagcaggccatttctcgctcagcgcaattccctctcggtttgcaattgcacttggcgcgcccttcgcgcttagcgacacatcaaaagttgttattttcaaaatcacaagggtcaggctgtggagaaatgtcttaggaagcttcagaaaacattttaagacgatccaacggttaacgaatccaggatcacgattttgccggaataggtttagaaatctcataatttcaacttag

SEQ ID NO: 76305 - DNA, 156 bp, Glycine max
  Peptide Sequence Number=SeqID_167990
atggtcattcccaagttcaaggtgccggactttggcaagtacaaggggactactcgctccaagaaccatctaaagatgacaactgtcacctggtctactaacttaggaaccttcttgagtccattcttggaaggacctaatggttgccttcattag

SEQ ID NO: 76306 - DNA, 812 bp, Glycine max
  Peptide Sequence Number=SeqID_167991
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatcgtcgcgtcaaggcttcacaggcctcactaaacacttttgtagactgccgggggttgggggtttatacaaagaaatataggatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 76307 - DNA, 1017 bp, Glycine max
  Peptide Sequence Number=SeqID_167992
atgtcgctggtcaatcgtgaccagctgctggcttttaccatgggacctgccgccttctactttggcgcggcagtcatcctgaccattatggccgaaacgccgactacaccgactagcgctaatctgcgtaataaacgcaagatttcgccgttctggcttttgcccattatcgccctgctgattgccggctggctgttatggaccaattatcaggagcgcggcaccaccatcaccatcaacttccagacagcggacggcatcgtgccgggccgcacgccgattcgctatcagggcgtggaagtgggcaccgtgcagggcattgtgctgagcgatgactaccgcagcattcagatcaaagccagcatcaagagcgacatgcgcgatgcgctacgggagaacactcagttctggctggtgacgccaaaagcctcgctggcgggcgtctccgggctggatgcactggtgggcggtaactacatcggcatgatgcccggcgacggcaaagagcgcgatcactttaccgcgctggatacccagccgaaataccgggtaaacaccggcgaactgctgattcacctgcacgcgcccgatctcggctcgctcaacaccggttcgctggtctattaccgtaaaattccggtcggccgcgtctatgactacagcatcaacggtaataccgatggcgtgaccatcgatgtgctgattgagcggcgctttaccaacctggtgaaaaaacagagccgcttctggaatgtctcgggcgttgacgccgatgtcagcctgagcggcgccaaagtgaagctggagagcctggccgcgctgccagcgcggcgtgctgatttcgctcgatctgcccaacggcgacaacctgaaagccgacagcacgccgctgatgtatcaggggctggaagtgggcaccctgaccaaactgacgctgctgccgggcggcaaagtgtccggcgagctgacgatcgatccctccgtcaccggcctgatgcgcagcggcacgcggattga

SEQ ID NO: 76308 - DNA, 187 bp, Glycine max
  Peptide Sequence Number=SeqID_167993
atgtgaaaaaggaaggtacaacaagcaaaaaggggcaaaaataaagaaaaaaagaagaaaatcagaagcagcccaagtccagcaaggcgctaagcgcaggacacgcgctgagcgcgacgtgacgctgagcgcgaggctttgcgctcagggagactacgaaggcccaagcccaagtttgcacctataa

SEQ ID NO: 76309 - DNA, 249 bp, Glycine max
  Peptide Sequence Number=SeqID_167994
atgtgggtgtgtcacaacctacccttcggcgggagggcgatgcgaggctcacgggtgtgtcttccaagaaaggaaaatgcgcagagtcaccaccaacgtttattcgaggaaaacgtcgaaaaaaccggaaaggtgtggtttatgaactttaagcgtgaaaggttcgggagttgtttttatgcacgaggaagggtgtttccttcgctcctacgtatcctcaattgcaatgaggaaatcagacctacgtag

SEQ ID NO: 76310 - DNA, 809 bp, Glycine max
  Peptide Sequence Number=SeqID_167995
ttggaactcttacgtgccgatcaacgtctcatttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggcgaattggagctccaccgcggtggcggccgctctagaactagtggatcccccgggctgcaggaattcgattccctcacggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 76311 - DNA, 237 bp, Glycine max
  Peptide Sequence Number=SeqID_167996
atgaagtggggtgacatacagggttaccttatggttacccacaccgttcatcaaccatgggcaaacgagccaaatgatgcccagagactaacatcatcttctccaccttttgtcgtcctgacctgtgaagtcagctcacatgcggggttaccttatggggaaaacgagcccgttgacgcgcgaagactaacatcgtctactgcaccttttgtcgtcctgacccgtgaagtcaggtga

SEQ ID NO: 76312 - DNA, 1050 bp, Glycine max
  Peptide Sequence Number=SeqID_167997
atgcacgaagcccgccaggcggtggtcgacgagagcaagttggaagaggagatcggcgatctgctgttcgccacggtgaacctgtcgcgccatttaggccacaaggcggagaacgcgctgcaggcggcgaaccgcaagttcgagcgccgcttccgccaggtagaagcgatcgtaaaacaacgcgggctgagcttggaagacgccacgctggagcagatggaagaggcctggcaacagggtttatgcggcgccggcggagtaaaccctgatgaacacgggagggcggccgagatgatggacagcaaaacgatcgtttgtaggtcaggagaggttcgggtatactgtttcccgtcctggttcagcatgacaacgaattatatttttgtgaccggcggggtcgtttcctctctgggcaaaggcattgccgcagcctccctcgcagccatccttgaagcacgtggtctgaatgtgaccatcatgaaactcgatccgtatatcaacgtcgatccgggtaccatgagccctacgcagcacggtgaagtgttcgtcaccgatgacggggccgagaccgatctggatttaggtcactacgagcgcttcatccgtaccaaaatgtcgcgccgcaacaactttactaccggccgtatctactcagaagtgctgcgcaaagagcgtcgcggcgactatctgggcgcgaccattcaggttatcccacacatcaccaacgccatcaaagagcgcatcattgaaggtggcgaaggtcatgacgtcgtgctggtggaaatcggcggaaccgtgggcgatatcgaatccctgccgttcctggaagcgattcgccagatggcggtcgatgttggccgtgaacacaccatgtatatgcacctgacgctggtgccttacatggcggcggcgggtgaagtgaaaaccaagccaactcagcactcggtcaaagaactgctgtcgattggtattcagcctgacgtgctgatttgccgttcagaccgcgcggtgcccgctaacgagcgcgcgaagatcgccctgttctgtaac

SEQ ID NO: 76313 - DNA, 231 bp, Glycine max
  Peptide Sequence Number=SeqID_167998
atgcctactttgctagggaagtcgacggtgttgataagatacactaatatgttaaactttgctggttgtgatggcaaagctgtcgcaacctacccttcggcgggagggcgacgcgagactcgcgggatgcgtgttccacgaaaggaatacgcgcggagtcgccaccaacgtttattcgaggaaaacgtcggaaaaaccggaaaagacgcgatctacgaacttttaagttga

SEQ ID NO: 76314 - DNA, 661 bp, Glycine max
  Peptide Sequence Number=SeqID_167999
atgtctgccaaacatccagtgatcgcagtcacgggctccagcggcgcgggcaccaccaccaccagcctcgcgtttcgcaaaattttctcgcaactgaacctgcatgccgcggaggtcgaaggggatagcttccatcgctatactcgcccggaaatggacatggcgatccgcaaagcgcgcgatcagggcaaacacatcagctacttcggcccggaagccaacgacttcagcctgcttgaacgcacctttttagagtacggcgaattcggcaagggccagtcgcgaaaatatctccatacctatgatgaagcggttccctggaatcaggttcccggcacctttaccccgtggcagccgctgcctgaaccgaccgacgtgctgttttatgaggggctgcacggcggcgtggtgacgccgcagcatgacgtggcgaaacatgtcgacctgctggtcggcgtggtgccgatcgtcaacctcgaatggattcagaagctcattcgcgataccagcgaacgaggccattcgcgcgaagcggtgatggactcagtggtgcgttcgatggaggactacatcaatttcatcaccccccagttctcacgtacccatatcaacttccagcgcgtgccgacggtggatacctcgaatccgtttgccgccaaag

SEQ ID NO: 76315 - DNA, 345 bp, Glycine max
  Peptide Sequence Number=SeqID_168000
atggcatcaagaaagagggttagaaccgacgacatcccttcatcatccatcccacctcctcacttgcgagagttggctcagaacaggacaatcgtgcctctggagtattttcttgagaaagtagtctggtctgaagctcaacttccattggtgagacccaatgaggttgctcctccagagcccgcaccggcacaggttgaactaatgtcagctgagccacaaactccagtgctgaagaaacagctgacccccctgcttccccagttggaggaattgctgatctttttgattcgtcatctggagaagttgttgctctcactgatttcccagtttagacattgttga

SEQ ID NO: 76316 - DNA, 468 bp, Glycine max
  Peptide Sequence Number=SeqID_168001
atgttgaataaagaaccagggctatggtgtaacacctcgatcgaatcacaacaaaatgagaaggatctagaggctgtgcacgtacgggactatacaactaaggatgacttaaaggaattaattggtactaccaataccaacaagatgcatctacctttcagtaacccatcacttaagaacttcatagttaagcgtgcttggcttggagtagtttcattgatcctggaagcaggtagagctgattgtcgagatcttagaaagagctacctatggaggggtagtaaatctagtgataacgaagagcatgatgatattgagattgaatttgatgactcagatattgacttgacgtcttctatattcaatagctttattgaattgatagaagaacacataatgggaatggaatttgcaagtgaagatgatggaagcttgcttgtggggcttctatggaggctgaatctttga

SEQ ID NO: 76317 - DNA, 589 bp, Glycine max
  Peptide Sequence Number=SeqID_168002
atgaccctcttagttctgcctgtattaggggtactagttgctagttgtaacagactatgtgagattgttggtaaattgcttgacaattttaattttgtcatgaatgaaattttgaagttgactaaagttttgcagcaacaaagacacatgcatagcagtgatagtcatgctgaagatgatgtaggtgatccggatgtggtcaagacaaagtttgatgatagccaaagagctgacaatggaataactgataacaaaagagctgataaaggaagatgcgacaatggagcaactgataaaggaagacctgacaacgaaagatttgataaaggaaaacttgacaacaaaagagctgaattacgatgcctgggagatgtagagaaaggttatacccaacctcaaaatgaggctactttgtcaccaaatgagaaggagactttgttgaagttgaagaagaaggatcaacaagcacttgctttcattcatcaaggtgttgataaggtaaaaaaggtgtgcctacaaactctacgtagagagtttgaatcattgcatatgaagaaatccaaatctatctcggattttggaaataaag

SEQ ID NO: 76318 - DNA, 355 bp, Glycine max
  Peptide Sequence Number=SeqID_168003
atgactaggggcaatccaggtgatttacaaccctttgatcttgaaatagatagaacctttcatagattagttaggcatagtgtgcatcctggtcattctatgcattttgagcattttgagcattctgagtattctattgttggtgattctgaatattctgattttgagcattcaattactaatttttatactgagaacatggctcaatctccacctcgtgagaggactcttagggagatggctgcacctgatttcacttatgaaagcttgtgcattcaatatcctgatgagggtgttccatatgttctcaggactggactaatacatttgttgcctaagtttcattatcttgcag

SEQ ID NO: 76319 - DNA, 909 bp, Glycine max
  Peptide Sequence Number=SeqID_168004
atggtaaccaatgaatattcacttgaaaatattctgagtgaggctgctatgcaagacagaactgttatcttgacaacattaaatgaagcatgggctgcaccaaattcaatcattgatctattccttgagagctttagaattggagatcatacacgcaggctcttgaatcatttagttataattgctttagaccagaaagcatttatacgctgtcaggcaatacacacctattgctatttgcttgtcagtgaagccactgattttcatgaagaggcatactttatgactcctagttacttgaagatgatgtggagacggattgatttcctacgctctgttctagagatggggtacaattttgtgttcacagatgctgatatcatgtggtttagagacccatttcctcggtttcacagggacgcagatttccagatagcatgtgatcatttcacaggcagctttgatgatgtacagaacagacccaatggagggttcaactttgtaaagtccaataataggtcaattgagttttacaaattctggtattcttcacgggaaacctatcccggataccatgatcaggatgtcctcaattttatcaaggtcgaccctttcattactgatctaggactgaggatgaaattcttggatacagctaattttggtgggctttgtgaaccaagtagagatttaaataaagtttgcacgatgcatgcaaattgttgctatggtatggatagcaaacttcatgatcttagaatcatgcttcaagattggaaatattatttgaccttatctccaagtttgaagagattgtcaattatttcctggagggttcctcagaattgcagcctcgattctcttaagcatgatcatggttctccagaaaagagtgttcaagagggttga

SEQ ID NO: 76320 - DNA, 1566 bp, Glycine max
  Peptide Sequence Number=SeqID_168005
atgagaggaggtatttgtagcatacagcttcagcctcttacacttgaagctacaactgttgtcaagcaagctgtgaatcttgcaacaagaagaggccatgcgcaagtgacacctcttcatgttgcaagtgccatgcttgcaacttccacaggccttcttcgtaaggcttgtcttcagtgtcactctcatcctcttcagttcaaggctcttgagctttgtttcaacgttgaactcgaccctttaccagcttccacttcaagccctcttctagctcctcaatattccaccccttcactctccaatgccttggttgcagccttcaaacgtgctcaggctcaccaacgtcgtggttctattgagaaccagcagcaacatattcttgccttgaagatcaaggtggagcagctcgtgatttcaatccttgatgaccctagtgttagtaaggtcatgagagaagctggtttctctagcacccttgtgaaaacaagggttgaacaagctgtttcaatggaagtttattcaaaaaaggcttcttctgataggagccatgccaaagaaaatatcaccaagccccatcatgttgttcttggtggtagtaataatgtgtctccatcatctggaccttttggtcaagttactgctggctccttcacgaagcctaatttagaccatgttaacaatgatgatgtaactagtgtgctaagtgagttggtgaggagaaaaaacacagttattgtaggggagggtgtggccaatgctgagggagtagctaaggaggtgatggagaggtttgaggtagggaatgttcatagggacttaaggtatgtgcaatttgtgagccttcctctcatgtgcttcagaaacattagcaaggaggaggttgaacataagcttatggagattagaaacctagtgaagagttgtgtgggaaaaggggttgttctttacttgggtgatctaaaatgtggggagtctagtagactgtggcttatggggattgcaacttttaaggcatacatgaagtgtaaaatgtgtcacccatccctagaagctatttgggagcttcaccccttcacaattcctgttggcagcctcagcctaagtttaaattttcatagtgattttcaagctcaagagagaagcaagctgtttttcaaggatgtggcttttgaagatagaacaggagtcagaaaccatctaacttgctgcagggattgcttgataaattttgaaaaagaagctcaaagcataactaactgtataaggaagaaattttgccctgctagtagcttgccaacatggcttcaaaattgtaaggaagagagaagtgacataatggaagatcagccacgagattgtgctcttggatctgacattaaaatcaacatggttacttcaaaaaaatcttgtcccaaatatgttagcttgccagaatctgtatcagtggcagtgacagacaagctttatgcatctagttttgccaacacgattggcgaggacaagatcttcctcactgttgcagaggctgttgcatattgttctccaaagttggttgaggacccttga

SEQ ID NO: 76321 - DNA, 171 bp, Glycine max
  Peptide Sequence Number=SeqID_168006
atgagtacaaaggaatatggatatatttggtgtcaccaactcttggagctgcggctggtacttgggcctataatttcatcaggaattaatgaaccattgggcttaatccggattttggttgtggacttgaagagagcaaataaagcagcgcttaccctagttaatttctaa

SEQ ID NO: 76322 - DNA, 756 bp, Glycine max
  Peptide Sequence Number=SeqID_168007
atgagtcttcattcttcatctagtgttaatggtgagggttctactcctaaggaccccttgtataagatattagatgagttgagatcccttaagttgtggaaagaaaaacaagagagaaaagaaaaaggtaaaaaaagagtggaagaaataagtcaagatgaaagagagaaaataagagaggaagaaagaagaaaaataatgaaagaaatgaaaagagaaaaacatgcctcctatagtagtcatgactcttgcaagagtttaagtgaagaacttagcgactattatagagggcgtcatagttcacatactaaacatcactcccaaagaagagaaaaggatagaaggcctcacgaggttaacattagcctcccatatttccacgaaaaagataatgttgaggcctacttagattgggaaatgaaggttgaaaaacactttgcttgtcatcatattagcgaagagagaaaagttccattggctacccttagctttcaagggggagatttcaaagctcatttggagcacaaaatttcgtgctcttctctccccctcccttcattcatctccttcttcctccaagctcttatccatggcctcctatggtgtggcgtctcctctctctcttccttctccattccgctgccattcatcttccaagaagcaaaggaatccattgatgaagaagatcctaggcctacaagctccaatggagcttgcatcagaaactcagtaaaccaagacaggggcggggggtga

SEQ ID NO: 76323 - DNA, 645 bp, Glycine max
  Peptide Sequence Number=SeqID_168008
atggcttatgcagatgatgtgataagggattcacatattagtcaaaagaaaccagttgaacctgtgaaaaggtcaaataatgttactgcagatgatcccttgggtgacttgattaagaacatgtttatggatgagtggagctcaagttcgggtcatggttcggtgtatggattccttgagcctcagtccatacacaatgcaaaggatagatgtgttgaatgtcaacattacattgaaacatgggtgaaggaatcccaacaagaggtttacctaggagcttacttgaacaggctcattggcagctggttgttctgtgtcctaggaatgatgttattgtctggttttgttcattatataaatacttttatcgtcatatatacattgatgtttttttttctaactagtgcaatgaagacattaaagaccattgtggatggtaaaaatcatggtacttctaaggggattgaagtaaagagtcatgttcaaagcataggctatgagtgtggctattatgtcatgcattggatgtggaacatatggtttggtgatgacacgctgttagacatcgagaccataacaataattcacaagaaatggacaacatattttgcaaaagttaaaaacatccgatgtagaaacgtttag

SEQ ID NO: 76324 - DNA, 423 bp, Glycine max
  Peptide Sequence Number=SeqID_168009
atgaaagattgcaaaaatacaagtgctgaggatgtctccttcatctctaggatctcacaatcactcacaaactcatctcaagctctcaaactggctcctgcttcaagctttggtggccttgttcgtgctcgtgtgcttagcgcacctatggaccacttagcgcacctcatcttcttctggattcttcctcgcgctaagcctaggagtgttgcacttagcggatgctcgctaagccagcagattggcttagcgagaagcgccctcgccttcgtcactgatggcgaggtctttatggcgcaggaggcgctactaaaggtcttcgatcggattcttgatgtcgttgttgagaccactggcactgctcccttcgatgaaatcatagaggtcagttccgacggtggcgatgagaggggggagcagtag

SEQ ID NO: 76325 - DNA, 744 bp, Glycine max
  Peptide Sequence Number=SeqID_168010
atgaaaaaagactatgacattgcccttgttggggcctttagaagggaaaaggacaaagacatggaattacaggcactaagagatgaaattcaagcgtccatgaagctgatcacacttgatgctggtgatataatgagagaccaaggggccttggaagaagaacctttagtcaacagacctgatgaatttccaatggtcaataaggtttcaaacttgctgggcatggatgatagggacgttgtatcgcattcccaatgtgagaagaaggatgtagatattcggaagatgggcctggtaaagacaagcccagttaaaaaagagagcaactccacttctgccttaaaagtttatagcagaagaaaaacatgtcatatagcaaaatccatggcccatttaaatcttggcccaattttaaatgaaattggaacagaaggggatacaagggtgatggtagcaggtaattccttcgaatataataaggaaggggttgacctttgtgactctcaatctggtcctttgacccctaagcaggatcaccaaccccatagtcctattcccccaagtagctttaataatgatttcaatggagtggaaggtgatcagcattgggagatagctcgtcaattgggtatatcttttgatgaaaattttaaaaacaggggtaaggagtttttggatgaggctagtacaagtcattcagctgcagcaacaacagagatgggaaacaacacaattgctccatga

SEQ ID NO: 76326 - DNA, 75 bp, Glycine max
  Peptide Sequence Number=SeqID_168011
atggccttaggagacaaaagtagagttaggaggtatgctgaggtggtagcagaacaggctgacaaagcaccttag

SEQ ID NO: 76327 - DNA, 192 bp, Glycine max
  Peptide Sequence Number=SeqID_168012
atggaagcttgcttgaaaaacttctatggagcggaagataaaagagaagagatgagaggttcattagagaataagccatggaaggaaaagtttcaccaccaagagattgtcttggataagaagcttagagaggaagctttaatggaggaagagaatgagagagagagtgacgtggaaattgaaggagaatag

SEQ ID NO: 76328 - DNA, 372 bp, Glycine max
  Peptide Sequence Number=SeqID_168013
atggtgaaagttggaacctccttacgtgccgatcaacgtctcattttcgccaaaaagttggcccagggcttccccggtatcaacagggacaccaggatttatttattctgcgaacaccgccggacatcagcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaa

SEQ ID NO: 76329 - DNA, 435 bp, Glycine max
  Peptide Sequence Number=SeqID_168014
atggtgaaagttggaacctcttacgtgccgatcaacgtctcatttcgccaaaagttggcccagggcttcccgtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatacaggcacaagatcccggaagatcatctcttcttactcacaacgcattggtgatggaagcttgcttgtggggcttctatggaggctggatctttgagcttcaatga

SEQ ID NO: 76330 - DNA, 797 bp, Glycine max
  Peptide Sequence Number=SeqID_168015
atggatttcttctccaatgtgaattttgaatgcattcaggcatttcaaaattcaaatcttattccttttatgtctttaaaattgcctgtttactctgaattagttaaagccttttattctaaccttgaaattcaagaaagcactttgatttctgaggtttttgggataaaaatggtcattgaccaatccctattctatgacttgacccaattatctagtgaaggtgtaccatttgaaggtgcattgaatgatgattggaaatttgatttctctgtgcatgatgcccgccggttggtttgcaccaaccaagcggatatgaccgaaaggctgcttgccggttcattggcctttgaaagccgcatccttcagtatctcattgtgtgtattttacttccaagatctttaaaccttgcacaggtttctgaagaagatcttattgtcatgtgggcttttcatatcggtcgacaaattgattgggcacacttagtccgatatcacatgcataaggcattgcaattaaatgattctttgccatatccacatctagtcactcttttccttcaacactttaacattcctcttgattctgaaccttatgttccaatcaagagatccttcttgatcggtgctgctgtggttgcatcttttggttactgcaaagagcgtgatggctcttgggtaaaaaagggtgctcaacccattgatgatgaaggacacttaccagttggagaggattcctctctccttcagagaattttggacaggtttgatggtcttcaaacctatgttggtgaaag

SEQ ID NO: 76331 - DNA, 351 bp, Glycine max
  Peptide Sequence Number=SeqID_168016
atgcggtcatgggtaaggggccagtggattccttttgatgcagacgccctcatccagttcctgggtgacccgctagtgttagaggagggccaggagtgcgagtttagtcagagaaggaatcgggccaatggatttgatgaggaggtcatcgcccagctgttatgcataccaggtcaggattttgcccgaaccgctgccgggaggcgggtgcggatcatgcgcaccagcatgaccaccttgactcagatgtggatgacgttgctgcttagcaacatcctgcccagcgatcataactccgacctccctctgccaaagtgtcagctggtatgccacctaccaggcaccctctag

SEQ ID NO: 76332 - DNA, 108 bp, Glycine max
  Peptide Sequence Number=SeqID_168017
atggactactcaggaaaacgcctacacatgggtacagtgaaccggagggaagatcaagctaaagacaccggaggaggcaatggaactcatagaaaacatggcggctag

SEQ ID NO: 76333 - DNA, 204 bp, Glycine max
  Peptide Sequence Number=SeqID_168018
atggcaatgagtgcgccgacgaaacgtggactggccagcagcccgggatcgaccatgggatgtgaccgtgcccgctcaacgatgacgaaggcggcggccatgatgatggccaggcccagcccgctcagcgccggcgccgatgaccatccttttgccagtccttcgaccaggaagaacaccatgccgaagatggcaacgctgaag

SEQ ID NO: 76334 - DNA, 213 bp, Glycine max
  Peptide Sequence Number=SeqID_168019
atgactcaagactactctctaaatataccagtggctgctgccagtggtgctttgcatgtctttccgggtggactcaagacgatagtaccggataagcgcagcgtcggactgaacggggggttcgtgcatacagtccagcttggagcgaactgcctacccggaactgagtgtcaggcgtggaatgagacaaacgcggccataacagcggaatga

SEQ ID NO: 76335 - DNA, 794 bp, Glycine max
  Peptide Sequence Number=SeqID_168020
catgttcgcattttagtgaaagaacgccgagattattttagtctcgcacctttgtcatccagagacagcaagtccaatgacatgcagagataccatatggttattcgcaccttttgtcagctagaggcaagcgagcccgttgacacacagagactaacgtcgtcatctgcacctttgtcatctagagacggcaagtccgatgacatgcggagataccttatggttatccgcaccttttgtcagctagaggcaagtgagcccgttgacatgcagagactaacatcgtcatctgcacctttgttatccagagacggcaagtctgatgacatgcggagataccttatggttatctataccttttgtcagctagaggcaagcgagcccgttgacatgaggagactaacatcgtcatttgcacctttcctggagatgtcagcgtctttcggccaagactgcgaaaaagtctcatttgctatccgtcacactcaagggtctgcgtcttccggccgagacagcgaaaaagtctcgtttgctatccgtcagactcaagggtccgcgtcttccggccgagactacgaaaaagtctcgtttgctatccgtcagactcaagggtctgggtccggtagcatgcagagataccttagggttatccacacctttcgtcagctagaggcaagcgagcccgttgacacgcaaagaccaatgtggtcatctgcacccttcccggagatgtcagtgtcttccggccgagactacgaaaaagtctcatttctgccgtcagactcaagtgtccg

SEQ ID NO: 76336 - DNA, 234 bp, Glycine max
  Peptide Sequence Number=SeqID_168021
atgcacgcgaagcgatgcactgttaaaagggtccagaagttagaagctgagcttaacaagcttgaatctgaagctgaacacaggcaactgacttcccaagaaaatatgaaaaggaagaagctacaacaagatctttggtcagtagcccaagctcacgagtctttaatgaggcagaaggcgagatcgcgttggattaaggagggggccagatatctcgatattttcacctggtga

SEQ ID NO: 76337 - DNA, 1353 bp, Glycine max
  Peptide Sequence Number=SeqID_168022
atgccgattgtcagagtcggtgcgcgcttgctgtataactatctggttaaaggcggcgttcaggtttttgagtaccgccgccgcccgctccacggcaaagtggcattgatggacgatcactgggcgacagtagggtccagtaatctcgatccgctcagtttgtcactgaatctcgaagcaaatgtcatcatccacgatcgtcattttaaccagacgctgcgcgataatctgaacggcattattgccgcagattgtcagcaggtggatgaaaccatgctgcccaaacgcacctggtggaacctgaccaaaagcgtgctggcgttccactttttacgccacttcccggcgctggttggctggcttccggcacacacgccacgtctggcgcaggttgatccgcccgcacaaccgacaatggaaacgcaggatcggaagatcctcacctggctgttttttatcgcggtgattgtgttgctggtggtctacgccaaaaaagtggactgggaagaggtctggaaggtcatccgcgactacaatcgcgttgcgctgcttagtgcggtcgggctggtggtcgtcagctatctgatttacggctgctatgacctgctcgcccgcttttactgcggtcacaaactggcgaagcgccaggtgatgctggtgtcgtttatctgctacgccttcaacctgacgctcagtacctgggtcggcggcattggtatgcgctatcgtttgtactctcgtctggggttgcccggtagcactattacgcggattttctcgctcagtattaccaccaactggctgggctacattttactggcagggattatctttaccgcaggcgtggtggagttgccggatcactggtatgtcgatcaaactacgctgcgtattctcggcattggcttactgatgattatcgcggtttatttgtggttttgcgctttcgcgaagcaccgccatatgaccatcaaagggcaaaagctggtgctgccttcatggaaattcgccctcgctcagatgctgatttccagcgttaactggatggtaatgggggcgattatctggctgttacttggtcaaagcgtgaactatttctttgtactgggcgtgttactggttagtagtattgctggcgtcatcgtgcatattccggcggggatcggtgtgctggaagcggtgtttatcgcactactggctggggagcatacctccaaaggtacaattatcgccgccctactcgcttaccgtgtgctgtattactttatcccactgctgctggcgctgatctgttacctgttgctggaaagccaggcgaagaagctacgggcgaaaaatgaagcggcgatgtga

SEQ ID NO: 76338 - DNA, 216 bp, Glycine max
  Peptide Sequence Number=SeqID_168023
atggtgaagcataaacaacgctactggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 76339 - DNA, 210 bp, Glycine max
  Peptide Sequence Number=SeqID_168024
atggttggagcattctcacaaaacatcgtgaccctgactggtctccctttaatcttacttaagggtgtcacactgatggaagcttgcttgtggggcttctatggaggctggatctttgagcttcaatggggtcctttaatggtgattttccaccatggagatgcagcggaagacaaaggaaaggaggtgagaggaggcgccatccattaa

SEQ ID NO: 76340 - DNA, 195 bp, Glycine max
  Peptide Sequence Number=SeqID_168025
atgtaccctctcttgttctcagttacaacaacccaagtagatgtaccctctacttgtaccacaaaggatggaaagggaagaatcaaaagaattctcagacagtatccttttgaattctttgaaaagggagaagggagacacaaaagaattcaggcgaggggagaagagaaacacaaaaagaattcaggcgattag

SEQ ID NO: 76341 - DNA, 207 bp, Glycine max
  Peptide Sequence Number=SeqID_168026
atgagtgtggatgagtattacaaagagatggaaatttccttgattagggatcaaattgagaagtctcaagaggccaccatggcaagagttgcaccactatgcctctttggaggatctcattcatcaagctatcaaggtgggacacaagtaaagaggaaacaaacatacaagaaggagagaggatctttgaccaaatctcatgaaaag

SEQ ID NO: 76342 - DNA, 711 bp, Glycine max
  Peptide Sequence Number=SeqID_168027
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaacggtcatcatagaaacgttaatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 76343 - DNA, 231 bp, Glycine max
  Peptide Sequence Number=SeqID_168028
atgaagcctctccgaaattgcacacggtggatcaatgtctcagcatatcagtgttacagttgtggaaattcttccattcagaggtctggcaatcacagtttgagtatgaaagttaataatgagttggatgtaaagttcaacaacaacgatgtctatcttggagcctacctaaatggttccatacagcatggaccaggcagattaaaagcatcctgcccaaggaacacctag

SEQ ID NO: 76344 - DNA, 396 bp, Glycine max
  Peptide Sequence Number=SeqID_168029
gtcgcacctaccaaggtgattcagccgcccatcacccgggcttttattgagaagtactgcacccagagacaggctcagggtgatgctccacaggccgcaggcgcgccaccaccacctcatcaggctggcccggctgggtcgtttgacatggagcagtatttacggcatgtggttcgccaagaggcggccaaccacagggcccatagtcagggcttcgcttctttttcatgccctactccagaccagttcagggcggaggtcgcatggcccggggattggcctaaggcccagacaggagaggcacccccagaggcccccgacgatggagaggaggcccacgaggacgaggagatggccgatttgcttgacttcttgggagggagtggagctacatga

SEQ ID NO: 76345 - DNA, 519 bp, Glycine max
  Peptide Sequence Number=SeqID_168030
atggctactccacctgcctcgcctcatcctcctcctcctcctgcaggcgcatcaatgtctcagtataccttgaagcggacacgcaaagcaacacggctaagatcgttggccactaggccacctggggcagagagactagtggtcaacgttgatcctgctaacggcaaggccaacggtccccacaagaagaaattaagaatatatttggggattgtcgctcgtgataaggtcgacgtgacatacgagacttggaaggaagtccctgttgctcagaaggatttgatacgggaggatattcaggccgaatttgaaatccttgaagcttctgacagtaggaaaaagaagaaaatttttgagactgtcagcgagtggtggaggcagtttaaatctgacttgaccaagaaatgggcacttgcagccgacaaggacggtgtggacgacactatctgtgaaaaatacgacattagcaaggagaaatgggcccagttttgtcagacccgcagagacccctcatgggag

SEQ ID NO: 76346 - DNA, 336 bp, Glycine max
  Peptide Sequence Number=SeqID_168031
atgaaatacgaatgcccccgactgtccctgttaatcattactccgatcccgaaggccaacacaataggatcagaatcctgtgcaccggaggcacgacccggccagtttaaggacaggagcgcatcgccggcagaagggacgagccgaccggtgcacaccggaggcggaccgatcgacccaacccaagctggaattaccgcggctgctggcaccagacttgccctccaatggatcctcgttaagggatttagattgtactcattccaattaccagactcaatgagcccgggtattgttatttattgtcactacctccccgtgtcaggatttgggtaa

SEQ ID NO: 76347 - DNA, 171 bp, Glycine max
  Peptide Sequence Number=SeqID_168032
atgtgggccatcattgaccaatacaaagagaagctaagtctagcggcaacccatgaacaaaggctagaggacgaatatgcaaaggttcgctttcaccttgaacgagagtcaatagcttctgagattgctagccaaagcaaaggcgatggtggatgtatactcggcccctga

SEQ ID NO: 76348 - DNA, 327 bp, Glycine max
  Peptide Sequence Number=SeqID_168033
atgtccttcatccagatgcagtcccagatgcaatcacagggactcgcactgcctcctaagactgaggttggtccttctgttgctcatgtcagcataaaggaaagttgtgttgatccctcgagtcctccccgactggttgctcttggaagagtttatgaggggtcgacgaccatccacaacattcctttgggaaatgatcaagtgaaggtcgatgttgaggaaggagtcgagggactggggaaacctgcagatatgccagatcctgacatggatcccctatacctgatgacattgaccatcctgtatcttttcctcatgccgttgtag

SEQ ID NO: 76349 - DNA, 390 bp, Glycine max
  Peptide Sequence Number=SeqID_168034
atggaggagaagaaaaataaacgattggatgaagcagcccaatccgagagcactgacacagttgttaatcctccatctcccattagacaacacgtgaagtggaagatggcccgcatgaaaagattaggtcaaataacatctgaggcaacaaaagaaattacagataggattagaagctttgtcacccatggacgtcaggatgtactgattgctgccattgggcgaccagagcaccctagtcgtgtccgtgctgctagagccagtgtcacaatcaaatattactttggaccgacttcaagggccctccgcacctcttcgtccatgggtcctaaagacttagagcacctgacacaaaagattaaagaccagctgaagaagtcgatcacataa

SEQ ID NO: 76350 - DNA, 306 bp, Glycine max
  Peptide Sequence Number=SeqID_168035
atggatcctccaaggctgaaggtattggtccagtggaaaggcctacacccagatgatgctacgtgggaatcttgggatgaactcaaagcagagtatcaccttgaggacaaggtgcttttcgaagcacaggggaatgttatgaatgaagctccacaatcaccattaacagaaacacaaacagagcagttattaacagagaagaaccagaggcagaggagaagggttgaagcattgtttgaactgataaaggggcttatcaaggattctgatgggatccctaatgatgaggtcattttagtaccatga

SEQ ID NO: 76351 - DNA, 135 bp, Glycine max
  Peptide Sequence Number=SeqID_168036
atgtgctcttattcacaaagcggtgcgcttagtgggattagcccttgctcagcgaacatgcacaactcatccttcttccagattcttcctcgcgctcagccaaaggagtgttgcgctcagcggatggctcactaa

SEQ ID NO: 76352 - DNA, 662 bp, Glycine max
  Peptide Sequence Number=SeqID_168037
atggctggtgttgcaggtagttatgatggtgcaccagttttggctcttaaactatcatcagcacttttgttttctgcagccacggggatgctacttgctaccaacaaaatccaaccctcacaacttgctgaggaacaaagaaacactgcaagactgtttaagcagcttcagacacagatccaaacagaaatcgccattggaaatccaagtgaaggagatgtgagggatgcaatagagaaggttttggctctagacaaggcttatccactccccttgttgggtggtgcaatgctcgaaaagtttccagcaaagtttgaagcagctagatggtggccggaaagtagattatcaagcaacgacgaagacaagataatggagattaagaacaacaataataatggatggaatgtggagttggaagaggaaatgagggaggttattgaagtgttgaagagaaaagacatggaagactatgagaggttagggaatattgcactgaagaaaaacaagggttttgctgtttcagcacctttgctcacaggaattgttgcactagggtctgtgttttcaggagatggattagttcctgcccttgctggggcgttggccacggtggttaatgcttttgagcatggagggcaagttggcatggtgtttgaaat

SEQ ID NO: 76353 - DNA, 216 bp, Glycine max
  Peptide Sequence Number=SeqID_168038
atggcagtattgtactatgatacaatgcaaagcaaggaaccattcggtgttttgatcaggaaggcaaaagattccaagaaaggagagcaaaagggtcttttccttggtttcctggaccctagctcacccaggctagcctcttgcttgcctgagccaccgaatgatttcaaggtgaagaaaccagctctctgggcgagcttattgcttcatgactag

SEQ ID NO: 76354 - DNA, 759 bp, Glycine max
  Peptide Sequence Number=SeqID_168039
atgtcagcttgtggcaagattactatgtcacacattggacatggacctattggtggatatggtgccagcatcaacatgcctaacccatcaacacaattccctccaatgccacagtttgttttgaaccaaagcttttatgaaacaagttacaataccattacagctcttgacaatttgggaaccagtgattttcccaaagctggcgtctcttcaacagcttcaggatggccttcctttaatgacatcaaagcacctcctctcacttattctctatctgcagaagagaaagcaattgtggcagtgttgcaattgcagcacaaagtattagaagcttgccagaagttcttagtcggggatgctggttctgacggtgacgaagatgatgaggatgaagacaaattggtagacgattatgattctaaagaatgtgaggagtacaagttctttgaaaaagtgtttgcagaagatggtgacttgaggagatattatgagagcaatcaaaaggaaggggattttcattgtttggtttgtggaggtataaggaagaaagtatggaagaggtttaagaattgtaagacactaattcatcactccactgccatactaaggacaaaaaggaagagagctcacagggcctgtgcacaagtcatctgcaaagttgttggttgggacattgatcaattgccagctattgtattaaaggatttggattcctccttgacaggttcaaggaagcttttggtgagcaatcctaattga

SEQ ID NO: 76355 - DNA, 432 bp, Glycine max
  Peptide Sequence Number=SeqID_168040
atggcagcacagttaatccatgatcgcgtggtgatggagtgcctagagggagtttgggagaccctcgaaggcaatgagaggtgccgattccatggcacaattcgactcactactacttcattagtacatccggaggaacccgcacgcacacttcagcagcctgtggagtggatactacctacacctactccatatcgactagtggagccagttcaagtgatagaggtgtcatcctctgaagaggatcctgaagaggacccagaggagttacctcctgaacctgttgtggacgcccttgactttccagaggatgatgaggacccactccctgatgtggattctccagaggatatcatgtcagtatttgaggaagactctacagaggagagtggccctcgagggacaacgaatagtgaagactcttcatcatag

SEQ ID NO: 76356 - DNA, 270 bp, Glycine max
  Peptide Sequence Number=SeqID_168041
atgccttactttggagtcattgaagaaatcttagaggttaattatgtaaaatttcgagtctgtgttttcaactataagtgggtacatagcaatatcggtgtgcaaaccgatgatttcggatttactttgatccttgtgatgaaagatggtcagtgtttgctagttccgacaagtgtaccggatcgcacaagtagtataaaacggtgtataaactatctgtgcaaaaagaaagaaaatcacgcaagagaaatgatgtgtaaaaacaagtag

SEQ ID NO: 76357 - DNA, 513 bp, Glycine max
  Peptide Sequence Number=SeqID_168042
gcacatggctacaccacccagctcccccccgcccatcgtcctcctgagtcagcagtaccttcaccgtctacgtcgaaaaagacaagaaaagcaacacgactcagatcgttggctactagaccagctggggtggagagaccgttagttcatgttgatcctgtcactgggaaagttaatagtccccacaaaaagaaattaagaatgtatttggcgattgtcgcccacgataaggtcatgataataggaaaaaagtccatagctcaaaacgatttgatctgggagggagagcgctggaggaagtttaagtcagatttgacctccaaatgggctctagcacatggcaaggagggtgaggatgacaaagatgttcaaaagaaggcgcaggccattcagaaacaaaacattgcccctcacgtattgtctcgtgggggttatgattttctagaaaaaaaagttgatggaggagaagcaaaagaaacgattggaggaagtagcccaattcgggagcactaa

SEQ ID NO: 76358 - DNA, 132 bp, Glycine max
  Peptide Sequence Number=SeqID_168043
atggctggggtactcttccttttgaaacagcaaaatagtttagatattacgagcgatggcattggctatgtttgtggaggtgatggtggtggtgatcactttcatgctgctgctgctggtgtagtggagtag

SEQ ID NO: 76359 - DNA, 570 bp, Glycine max
  Peptide Sequence Number=SeqID_168044
atggtgtttttacgacagtcattctacgaagcccatcgtcccttgacctccgcacacaaagtccctctcaatctccctcacacgctcctcactaagcttcttcttgagaagcgagtacaagcgaatatcgcgcagatgagtttgttggagaaggacgatgtcgtcggaggcgacgaagaaggcaaggacgtgggtgatgaagtggcatgcatcgtcgctgagggtggtgttggacaaatggcctcagttatcttaagaagagggactggagcaatgaggcttgggagggatgtcctagttctaacacagagaactaattccagatcactagcttttctttcagaatcattgaatgaaggcaaagattctgaagctttggctaaatacaatttgaaagctattaaggaattttcaccctttaataagtatcttattggtgaaaaggcagccttggatgaatggggatcaaagtattgtttagaatggcatgatggattgaaaggtgggagttcttttcaccaaggtgacattttaatcagcaacaaaaggattcgttctcgtccaggctag

SEQ ID NO: 76360 - DNA, 204 bp, Glycine max
  Peptide Sequence Number=SeqID_168045
atgcggaaaggtgagccagaaaaccgcgttacccgtggtattgcacgttactcacgactgcgccacatcgaaatcgaatggccgttgctcgctctttctgtgttctgtttcgtctacaattccgtcagtggtttttggtctctgccttccactctgcgcctttggattccctacacgtcgccgcgtaactttgaccgtggataa

SEQ ID NO: 76361 - DNA, 321 bp, Glycine max
  Peptide Sequence Number=SeqID_168046
atgtggactcttcaacttactcaggaaatgctggatcatcctgaacccctgaaactcccccattgtacagaagttcctcttagagcttgcggcaaccacatgacagtcttaaggcggcatggccccccactgcaatggaaagttgaaacgctgaatcctgctattggtggaaaaggtgttgtccaaccatggtataattttcttgaaaaaatggattttgatgatggagatgaaatctctatttattataggtattatgaaaaaatttgggatatcataattaggaggcaggaggattgggaagatgatgacaacgactag

SEQ ID NO: 76362 - DNA, 87 bp, Glycine max
  Peptide Sequence Number=SeqID_168047
atgaccgtcattacattgagttcgactttagctgccaatggtggagtaaatgtacttagaggagatgaaagagcatcaactaaatga

SEQ ID NO: 76363 - DNA, 396 bp, Glycine max
  Peptide Sequence Number=SeqID_168048
atgtcatctctgggattgacaattttacaagtcccaaaagcaatttacaggtgctcattgtttcatatgagacatttcaaacgcattcgtcaaagtttagctctacttactcatggaaaaagttgcatgctagttgctggggatgtttacaaacctgctgctattgaccagcttgctattttgggaaaacatgtggatgtgcctgtctatacagcaggtactgatgttaaaccttcagaaattgccaaacaaggtttagaagaggcaaaaaagaagaaaattgatgttgttattgttgatactactgaagtgttgctagttgtggatgcaatgacaaggcaagaagttgttggatcgagtggcctcagaataattaagaagggggggttgaattaa

SEQ ID NO: 76364 - DNA, 531 bp, Glycine max
  Peptide Sequence Number=SeqID_168049
atgacagataaagaaatcagcttcagagacagcaccaaagtctcaaagcctgcagaccccaaagacacagttgctagtagccagaaaatgccacatgcctttgtcatgatgaggctcatactcgtcgtagtaggaagaaaactttcacgaaaccctaatacatactctagtgtgttaggacttctttggtctctaatctctttcaaatggaatatggaaatgcctagtcttatcaaagcatccgtcaaaatcatctcagatgcgggccttgggatggctatgtttagcttagggcttttcatggcccttcagcctcgtatcatagcctgcggtaccaaaagagcagtcatgggcatggtcattcgcttcatgtgtgggcctcttgtaatgtctgcctcttcaatttccattggattaagacaagagagactacacactgccattgtacaggctgctcttccacaggggattgtgccatttgtgtttgcaagggaatatggactgcatcctgatattttgagcacagggtaa

SEQ ID NO: 76365 - DNA, 1011 bp, Glycine max
  Peptide Sequence Number=SeqID_168050
atgttcaacggaaaaaacatactttccaaaccacgaatcaagggaggatttgtacaaggtgatgtgcgcgatggtgccactatacttcgcaatgctggtggcctacggctcagtcaagtggtgcaagatgttcaccccggaccaatgctccggcatcaaccgcttcgtggcggtgttcgcagttccggtgctctccttccacttcatctccatgaacaacccttatcagatggacgccaggttcatcgtggcggacacgctctcgaagctcgttgtgcttctatttctgtccctctgggcaattttcttccccggaggctctttggactggctcatcactctcttctcgctcgccaccttgcccaacacacttgtcatgggtatcccgctgctccaagccatgtacggcgacttcacgcaatcgcttatggtgcaactcgtcgtgctccagtgcatcatatggtacactctactcctcttcttgttcgagtacagagcggcgacggttctgatccaacggcagttcccggggccaacggcggcgtccatagcgaagttcgaggtcgacggcgatgtgatatcgctcgacggccacgacatgccgctgcggacggagtcggagaccgacgaccagggccggatccgagtgcggatccgccgctcggtctcatcggtgccggagacgaactcctctatcggcggcaacactgccgttgtcacgccgcggccgtccaacctctcgaacgcggacatattctcgatcaacacgccgcttcacctgcacgacggcggcggggactttgccgccggcgccagtccccacctctccggctacgcctcgtccgacgcgtactcgctgcagcccacgccgagggcgtcgaacttcaacgagatggaggccagcacgccggtgtgggggaggtcgccggtctccgccgggagagggtgccaacagtcatcgccggtggccagagtggtgtgggggtcgccggggaaatgcctgggagttga

SEQ ID NO: 76366 - DNA, 260 bp, Glycine max
  Peptide Sequence Number=SeqID_168051
gggaggtggttgccgcccagctcgcccaggcgagctcagctcgcccaggcgagccaggttgcttcctccagaagcaacagccttctggaggaatattctggagggcccaagccacgcataagggttgggatcttggctctgttgatgtagggtgtactgataaaagctctcattcatccgtacctgacccctatggttggccacttactgaggtggactctagaggtggcggtgatgtgtctgtagctgcttactactag

SEQ ID NO: 76367 - DNA, 276 bp, Glycine max
  Peptide Sequence Number=SeqID_168052
atggttcagcccactaatccaagatcaattccaagattctccacaaagtgtgactatatgatgtggcaatggggtgtaataattggacccaaccttggcccatgggctcagaaatctaccctaaggttcatgagaaccctagggccttcttcagcagctctagccaaatcctcttggagcctcttgctcatggatctagtgactggttccttcctagggaggattgcatcaataccagcaagctatggtggcgttattccacgacatgatgcataa

SEQ ID NO: 76368 - DNA, 643 bp, Glycine max
  Peptide Sequence Number=SeqID_168053
ggcgcggcggtcgctgcaaaacccagggcgcgagcccgggcggagcggtcgtcggtgcagatcttggtgggacgggggaagcccgtctgatagcgctctgtgcgcgtactccgaaagggaatcggcctgcccaccctggaaacggctcagccggaggtagggtccagcggctggaagagcaccgcacgtcgcgtggtgtccggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcgggcctcttccccgggcgtcgaacagtcaactcagaactgtgctctgaatgtcaaagtgaagaaattcaaccaagcgcggattcccactgtccctgtctactatccagcgaaaccacagccaagggaacgggcttggcggaatcagcggggaaagaagaccctgctaccgttcgtcggctctctctcgttttgcctgcctggtgctaactatgtgtgtgcccgggcggacggacgaccaagccccctccttccccttgtgcctgc

SEQ ID NO: 76369 - DNA, 655 bp, Glycine max
  Peptide Sequence Number=SeqID_168054
atgtcatgtcagcatctgaggcagactctacggaggagagcggccctggagggacagcgactagtggagactcttcatcatagcagacggctccttagactagagttcatcgaccgcaaggaaagcccggttgtcgctatactagccgatctatatgacaccttcgaccgaagatgtgagaagagaagtacaaggattgttttctgtactctgaccttctatgtatggttggtttcgtacctttttcgccaagaggtgaggcatgcttgcccgctagaaagccatcgttcatgcacagagaaaagaggggcaaattgggaccaactcttagcaagcaaagaaggagcatctgtcaactggttcccttgttggaaagaaggaagaaccggggttcttatttcgtgcgtaggatttccgaatgttcccttgatggggacaaggggttgcatcagttacaatcccgatctcgctataagacaacttggctaccctatgagaggggcaccactagaggaagagctcgagcctattattgcacgaggtttcaataagaccaacgtggaggcgcttcaaaaggtccataaggcgtgggagatggtgcaaaagaaggacaaagaactcaaaggcagtaacaacgggcccatcggtggctatc

SEQ ID NO: 76370 - DNA, 354 bp, Glycine max
  Peptide Sequence Number=SeqID_168055
atggttcacgcatgtcatcgggcccaccacctttggatgacaaaaggcgcagaagacgatgttagtctctgcgtgccattggacacgactgtgtctgaatggcgaaaaggtgtgccgaatgaccataatttgtctctgcatgcccgccacctctggatgacaaaaggcgtagaagacgacgttagtctctgcgcgccatcggacatgactgtgtctgaatggcgaaaaggtgtgtggaatgaccataatttgtctccgcatgtcatcgggtccagccgcctctggatgacaaaaggcgcagaagacgactttagtctctgcgtgccatggacactgaatgtgtctgaatggtga

SEQ ID NO: 76371 - DNA, 225 bp, Glycine max
  Peptide Sequence Number=SeqID_168056
atgtcttcgaatcggacttcctcatcgaagagattgtattttggtacgacctcgtggatctggttatcttgttcattgagtaacttattggttgaattcattgaagaagaggatgaagatgagtttgatctaaaagaaatgcgagagaaagaacgtaaaagatccatgaattcagttaacatatgcccctacggacattattcctacttccccatcgagctttga

SEQ ID NO: 76372 - DNA, 264 bp, Glycine max
  Peptide Sequence Number=SeqID_168057
atgaccgcgacacaacaatcagattcgccgcgacatccacctgtgacgcatgatgcctcatttgtggagccacatatccctcaggtcctagagccagcagcagcaccaacacatgcccgttttgatgtggaccagcctagacatgcagtggatgcttgccatgcaattgttgaaaggttggagcgtctgctcaaccttaggatagtcacggcaggcacagagacacacgaggtcatggaagaatgcatcaggattgccaggtga

SEQ ID NO: 76373 - DNA, 225 bp, Glycine max
  Peptide Sequence Number=SeqID_168058
ccatttatccacgacttcagtcataacattgttgatgtcaaagctgatggaaactgtggatatcggttggttgccgatttattaggtatgggtgaagactcatggtcgttggtccgcacccatctgcttaaagaacttgggaaattctcagatgagtatatgaagctctttggtggcaaggagagatttgaggaattaaggatgtcactacttgttgatgggtga

SEQ ID NO: 76374 - DNA, 643 bp, Glycine max
  Peptide Sequence Number=SeqID_168059
tgtatgatggtgtttttgaggtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatctcgactagtggatttcactcttggacacctaagtaccatttgggatttggttaccttggagggatgcatggatacagtgtatatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 76375 - DNA, 500 bp, Glycine max
  Peptide Sequence Number=SeqID_168060
gtttagattggctcgccaagttaaaagtcgtcagcgaagagagttttgaagcaccggaagagcacgaagaagtccaagctctcaaaagcgagttaggaaaggcgaaatttgccaaggagaagttcaagttggccgcaacacacattcggaaggagtgtgccgggttacgggaggagaatgcaattaccgcaagagcccttgaacaagagaccaagagggctcgcaaggaagagtatggccggaacaaatttcgtggagctctatggggtagcaatagtgaactcaagttgcgaagggaagaaagagaccagtcgcgagcacatagcatggcaaccatgtggatggatcggtttgctcttaccttgaacgggagtcaagaacttccccgcttgttagccaaggccaaggcgatggcagacacctactccagcccccgaagagattcatgggcttctcggctattgtcagcatatgatagacttaatggcccacataattag

SEQ ID NO: 76376 - DNA, 282 bp, Glycine max
  Peptide Sequence Number=SeqID_168061
atgcatgccttgttagggtcattcaacagtggaaactggtctgactctaaagtccttgatagtgcagggctaagttgttgtgctttcacgaggaattgggatagtttatacacatgttcatattcacacttacctttacacaccagacacctatttgctgaaatagcttaccaaataacacaagatccccgaatgttcgatactcggttcttaccattttatattacttgtgcgatccggtgcacttgtcggaatccgaacactttggcatgcattcgataa

SEQ ID NO: 76377 - DNA, 369 bp, Glycine max
  Peptide Sequence Number=SeqID_168062
atgaccactcttacgtggatgacgttgctatttagcaacattctgcccagcgaccactatgccaatctccccctgcagatgtatcagttgggatcacgcccacaagacacccagtggacccgaagaagtccaacagggtcttggagttgtcaagctctaattacgggtctctgtcagttctacggagtgcctgtcaccttcagcaagggcatcaggccccctactaatcgagctttcatcaagaagtattgcgtccccaggcaggcgcagggcgaaacaccacagcagcccggggatggccgacaacgggcaacagacgcaccgtcatcacctctagagttcacctcagttcatccacaaaaaggttag

SEQ ID NO: 76378 - DNA, 345 bp, Glycine max
  Peptide Sequence Number=SeqID_168063
atgctccacatcgatcctacgaccgggaaggttgacggcccccacaagaagaaattaagaacatatttggggattgtcactcatgataaggtcgacgtgacatacaagaattggaagcaagtccctactgctcagaaggatttgatatgggaggatattcaggttgaatctgatatccctgaagcatctgacgttaggacaaagaagaaaatacttcaggctgtggggagagtcgacaaggacagtgtcgatgacactgtatgcgaaaaatatgacattagcaaggagaaatgggcccaattttgtcacagccgcagagacccctcgtgggaggggatcctctag

SEQ ID NO: 76379 - DNA, 375 bp, Glycine max
  Peptide Sequence Number=SeqID_168064
atgtctcgggcttcatcctcctcagtttttgttttaccagggaacactcgggatttagagcaaagatgtcttggtagtccttttagcagggctgtcaattcttcacggatgggtgtggtcatacccgtgcctatctttacttcttttttccactgccagttcctaagtccactagttccgtctttcttgatgaggccccatctcttggtcctcatgggcgactatcctctccaactctgggggaagtcccacatcctcgtcctcttcatcctccgtctgattcgtttcttgcttgaaatcgatggtcgggtcccaggtattagtacctttgagggactcatcgtcggatctggcgtttcaaacgtaaagaaataa

SEQ ID NO: 76380 - DNA, 252 bp, Glycine max
  Peptide Sequence Number=SeqID_168065
atgtggtactggagcagtggtatatggtgctggccaaacttgatcacaagttcagatatgaatggcagtggaatggagaaggaagagagagaaaggatacgccacttcaaggagaagataagtctagaagaagatcaccaccataggaggccatggataagagctcagaggaagaaggagatgaatgaagggagaggaagagaagagcacaaaattttgtgctctaaaagagctctgaaatctgaagtttaa

SEQ ID NO: 76381 - DNA, 603 bp, Glycine max
  Peptide Sequence Number=SeqID_168066
atggagatcagtatgattgatgttgccagtggtggagcccttggagacatgacccctgctgaagccagaaatttaattgagaagatggcttccaactcccaacagtttagtgccagaaatgatgctattgtcattagaggagtgcatgaagtagccacgaattcatcttcattagctgaaactaagaagcttgagggtaaactagatgccttggttaacctggtaacccagctggccttgaatcagaaatctgtacttgttgcaagactctgtggtttatgctcctctgccgaccaccatacagacctttgcccttctgtgcagcaatctggagcaattgaacagcctgaagcttatgctacaaacatctacaatagacctcctcaacctcaacagcaaaatcaaccacagcagaacaattatgacctctcctgcaacagatacaaccccgaatggaggaatcaccctaatctcagatggtctagccctcagccacaacaacagcaacctgctccttccttccaaaatgctgctggtcgaaatagaccatacgttcctccaccagtgcaacaacaacagcaacaacagcatcaacagagatag

SEQ ID NO: 76382 - DNA, 117 bp, Glycine max
  Peptide Sequence Number=SeqID_168067
atggttaatgcggtggaggagtgtgaacctcagaggccgaagcaaatgaaagatatggggtgtttccctcgctcctacgtattccttaattgtggtaaggaaatcagacctacgtag

SEQ ID NO: 76383 - DNA, 540 bp, Glycine max
  Peptide Sequence Number=SeqID_168068
atggcgcctaccaggcaccctctggacccagataagtccaacagggccctgggatttccagctttgatcacaggactctgccagtcgttcagagtccccgtcgcacctagtaaggtgattcggccactcatcacccgggcttttattgataagtattgcacacagagacaggcccagggtgatgcaccacaagccgcaggcgcgccaccaccacctcatcaggctgacccagctgggtcatttgacacagagcggtatttacggcactcgatgcgccagcacgcggccaaccacaggggactggggcaggtccatgagtgtctctaccagctaagcctcaacatgcagagccaaggcttcactccttttccgtgtcctactccagaccagttcaaggcagaggtcgcatggcccggggattggcccgaggcccaagcaagggaggcacccgtagaggctcccgatgatggagaggaggccggcatggatgaagagatgtcagatttgctcggcttcttgggagggagtggagccacatga

SEQ ID NO: 76384 - DNA, 300 bp, Glycine max
  Peptide Sequence Number=SeqID_168069
atgagacctgatgaggttattcctcctaagccaattgtgccaattatacatgagacttttgaagcaggtgagtcacagttgaggcaggaggctgctactcctgagaggacaccacagaccccagaagtacatgagagacaagcagatcctcctacacctatcatggagatgccaaaagaccctaccatgccagtcctaagactgtcatccactcctctagctaccctagttttacatctgacagatgaagaggatatgcaggacacacagggcatacaggaccagtcacaggagttctaa

SEQ ID NO: 76385 - DNA, 727 bp, Glycine max
  Peptide Sequence Number=SeqID_168070
tcttgagtgcgttggagcatttaatgcttgcattaaatgtatgtccttgttgggttacaagtgtgaggtgaagtcccacatcgggtctccttatgtggtggctcgtggtccacaggtgtacccctcgaatctccccaacaattggtatcagagccgatggttcgaccaggttctgactcaaacgagtatgcaagtaccacaggtggccagaatggtggccatggctatactcgtgaatgataaaagacctccgctagagggggaggctaccatgtggaagagactcacacttgagggggagatgtgttgggttacaagtgtgaggcttccttatatggtggctcatggtctacaggcaaggcaagtaccgcaggtggccatgactatactcgtggatgataaagacttccagtcgagggggagactaccatgtggaagagactcacacttgagggggagatatgttgggttacaatgtggtgttaggtctccttatgtggtggctcgtggttcacagttggttgcgcatgtagacgatgtgacagagcaatggggtggctgccaaatagtggttgagaatgtgacactgttcatcacaaatattgcatgctcaaagcgaaaaaggactagagacacatggggtcacatgtcaactccgatggaggcacaatatatggcattggatagatcagtgatgggtgatccaaaccatgggtttcccagttag

SEQ ID NO: 76386 - DNA, 1065 bp, Glycine max
  Peptide Sequence Number=SeqID_168071
atggaagaagcactccgtcgtctcaacggaatgggccccactcaagaccccgacacaaccctctccgaccaccaccccaagaaaagcgccaccaccaagcgcgggctgcgcgataccgccagctccggcggcaccatgcgctatcgcggcgtccgacgccgcccctggggccgctacgctgccgagatccgcgacccgcagtcgaaggaacggcgttggcttggcaccttcgacacggcggaggaggccgccttcgcatacgactgcgccgcccgcgccatgcgcggcgccaaggcccgcaccaacttcgtataccccgacgccgccgaccctcaccaccaccacctcttccaaccctacaacatcaaccccaaacactgccatgtcaccaggttcgtcccgaaccaaaatttaaacgctgacttctccgcaaattcccacaacaacaacaataacaacgtttcttcttctcttaacatggttctctttcgtgactttctcaactcttcttctcaccactttcataataataataataagtcttctagttgttatgtaaactcttcatcttcttctgctgctgcaaataactgtctccaaggttgttgctttaccaaccctaatcttggaatggaagttgctgaagctattgatgaagaatctgactttttcccaatagagtcttctgattctgggttgttggaggagattgtccacaagttcttgccaaaatcgaagcccaagaaagaaactttgtctgttcctgagtcacttcctcctcaacagaaatttgaactcaagaatgtttctgctgcaaggggttgtgctgatactaggactagggttccgaaggttgaagcttttggtgccccttatgattcgtctaccatgcagcaccaatttgaagccattcatcatggcttcaacaccatgcagggcgtgtctgtggagagaaacaaccagtttttgatgaaccatgttgctgcaggatgctccaacctggaagattttcttcagtatccagagatttttaattcccttgtagcaaggatgcaaaatgcttag

SEQ ID NO: 76387 - DNA, 2835 bp, Glycine max
  Peptide Sequence Number=SeqID_168072
atgaagaccttggaggaagccaacgtgcttgtgacgtcagactactccacatgtctcaatagtggcttagtgggtttgttagagttgcatttctttctttcagggatctcaggtggagctatgagattatcttcactaaaggatcacaccagaactttcaaaaatgctatcttggattccacaagtctaagtaatattaccatattcacagctcctaaaccctttaagggctctattaggaccagacaaacactagctattcggtcatggttggctctgtctccatatgttacagttgttttgttcagtcaagatccttctgtttcctcttttgcagatgcttttgattccagggttttagttgacactaacattgatttcaccttccttggtactccttttttccattccatggttgcaaaatcacgctcatacacatcagagatatctgtcatcattgattctgaaaccgttatcctttctggattcatctccactctaaaccatgtgtatcaacttgaccatgattggcttcttgttgcttcggctcaaaatgtttcttcctttccattccatttggatgagtctgggaaacattggcagacggataataggaaacggatgaatgtccaggagctgcagaaaatacttcagcacaattggcaggggaaacattgttgttattcaagaatgctcatggtgtggaacaacaaggatgcgcctctacatagtggagttcttcctccattcttgtacggtaagggtacacacaacaattggctgattcatgaggccatgtcatctgagttcagatttgtgtttgatgctagtttgaccatcacaagtttccatctgaatgaagaggatgatttcagtcctacacatgggaattctagtgctgtagatattgaaaatagaagttgggagtacattggcaattcccacataggggcaaactatggctcattcttctatagtgaagctaatttcactagccttgtcaaacttttgaagtgtaataaacaatacattatggttgataccaagaaaaacattgtttatcctattggacaccaaggtgcaatgaacttgatgaaggaaaaggttattccatcttggttaaaggaaaatacagtgtattgcatcgatcgtctgaactcacatacaaaatcattagattgctctgtgaaggatcagacgaaaattccatcaatactggagcttccattctccttagaatcacttctttctatcacttcagacaaaactaaaacagttatacttactgttgctggatatagctacaaggatatgctcatgagttgggtttgcagattacgaaaactttccattgaaaattttgttgtgtgtgcccttgataaggaaacttctcaattctccatcttgcagggaattcccgttttcacagatccaatagctccaagtaacatcagttttgatgactgccactttggcacaaagtgcttccaaagggtgacaaaggtgaagtcaagaattgttctgaagattctcaaactaggttacaatgttcttctgagtgatgttgatgtatactggttcaaaaacccagttcccttgcttcactctttgggccccgcagttcttgctgcacagtctgatgaataccaaaatcaaggaccaataaacctacctagacgcttaaactccggcttctattacgctcgttccgattctcaaacaattgcagccatagagaaagttgtaagacatgcagaaacttcaggcttatcagagcagccaagcttctacgacacgttatgtgggaatggaggatccaaccgtgttggtgacgacaaatgtgtggaacctgaaacaaacctaacggtacatttcttagacagagacctttttgcaaacggtgcttaccaagacctgtggcgggaaaaaaacgtcaaagaagcatgtttgaagaagggtagttacatcatccacaacaactggatcagtgggaggctcaagaaacttgagcgccaagtcttgtctggtttatgggagtacgatcccagcacaagaatgtgtctaaggtgttcgcaatcttctaaaagagatggtgaaacagaaacattcagagtgcataacaactttgaggtgcaggctatgctgaagcgtgtggttcactccttagacctggtagagcaaaaagagaaggattccagaaggaagaaccgtctgagaggaagagaggctccgccaacgaaggactttgttcgcggccccgatgtgttcaaatttcctcatcaatcagtgttttggcatgaagatgttccggtgccaggccacaagtacatcttgatctcgtttcgagatgtcgataagctgaaaagtaagctcttggaggaagagaggagcaaagaggctaatggagtggtgctggaaacaaagaccaggtctcctagtggacacaaggacaaagtgaaagtgtcaaatggtgtagcaggccatgaggcactggagacaatgatcacaagtggaaatggaaaaatgaaagagccaaatggagttgcaggccaagagataagtgtgtcgttgtctcccaaagacaaagtgaagagtgtagagatggtggatacagacatggaaggttctctaggtgagggaggtgtagaggaatcttttttctctgcaaaggacttctatgcccctaaggagaagtccacaagcacaagaccttcaagaagaaaaggactaaaagggaagaagccttttgtggcacctcttccaaaggcaaaaaaactatataggagtttgggatggcaacccagcctcccaactgtgaaggaaccctctccatga

SEQ ID NO: 76388 - DNA, 843 bp, Glycine max
  Peptide Sequence Number=SeqID_168073
atgccaaagcaaatacagttatacgccgtcaatgtaagggaaaacaagaagggaggagaaggtggtggttttaccggagaagggagcggagcgagggagggcgaggacgcgggtgtggccgccaaagtaacggagcttgctgtcgggaaaacgggggaggattttgccgccgtagctgcagaggaatttgaggttgttgccatgggagggagaggggcccaccattgggttttcgttggatttagcgggaacgaatgggattgggggataatgattttcatgtacccatctcttattcctgaagccacgggagctactggcgatataggctgttggcgagagagctgcttacgtggacatgccgtcattgctgttggcgagacaactgacgtggcctgcataccaccattctcattggcgagtctggtgacgtggagagagtctcgcccttcccattggcaagacatgcacagcgggttgcagagcaggaggcctggtttttctgagcatatatcgtcattactaatggcaaaagctgggctatctaaagagaatgaaagcaaggcttgtaaattcttgattgaacacgctgctgtgtgctttcttttatcaaaattactacaaattttcaaggcaaaagctgtctatttaaaggaatccccgacaccagtctcgtcatttccagtggcaagaaccactgctagcctgcaacctatatcgccagaagcattggcgactctctccacgttactagactcgccagcagcaatggcaggaaagccacgtcaatcggtctcgccaacaacaatggcgacatgtccacataagcagctccctcgctag

SEQ ID NO: 76389 - DNA, 2874 bp, Glycine max
  Peptide Sequence Number=SeqID_168074
atggcatcttggaatttctgtatctccatttttaatgcagtggattgggctgctaaggccagagcttgggctgatgctaatgctgcaagggaaagtcagcatccacaatcacatttttcacctgctggaagaatgcaagagcaaagccattatcatgatcagtatcaactatctgttgactcacattatactgatgttcaaaaccaaacccatccatcagcaagctatcaacaattttcctacttggatgcatctgtgcagcggatttcaggacattcccaggagcctgcatctgccagtttggaggcatcatataatcaagatgggcattcatgcagtgctagaaatgggaccggcataggagattcgactgtttcatttgaacaagggaacttgccaacaaatccatcagttcatcagcaggaggtaccttctagttatagttctgttgcagggtatttagccgaacagctaatgtgggatgaaaaactaagtcagtgttgggtgggtgtgaccgcaatcttgtgggcaaaggggtctgtgaagatggcttctgaaaaatgctcactgtcacacgctacccaaatgggtggacactacagactacaggccagcgatgagggtggttggggaaaaatagagtttctattgaaaagttctagtaaagaggctgctgagcagattcaacaatcatactcggcctttcctttgtcaagttcctcatctcaagaacaccatgtgcaaccatcaatgcatgcaccaccttttgcgtctggctgccactcagttgactctgctatcagtcttgctgatcaaccattagattttgcacctaggtttaatcgtgatagtgacttgcaaatgcaatcaacttatagtcatcatgattccagctcttcaatgaataactgggtttctccagtggcacctggtgttggttatccaccaataccaccaattctttcttctgggcaacagcatgacccttctatcaccactcctggtcatgtggcaccaccatttggaaggtttcctggacctggcctcccttcaaccatacaaccaactggtgcaccctttactcttagcacaggaaccacaattcatcctactgtggctttctctgctgatgtgtatggggtatctggtattcctgatcgtcctaagaaggcttcagtccctaactggctgaaagatgaaataaagaaaaaagtcatccctgctcctgcagggaatctgaaggaggaaacatttgtaaatgatggcattgacaaatcatatgcgagaggtgatgaggcagatagtaaaagcattgattcgtctagatcagctgaggatgaagaagacgaagaggatcaagttgaagcagctagaactgcagcaatcaacctagaaataaaaagagttctgactgaagttcttttgaaggttactgatgaattgtttgatgaaattgcaaccaaagttcttgctgaagatgattttactgctgaaggttataacaatgtgttttctgtagtgggtcacaaggttgccacctcaaaccataaggcatcagcatctcctccctcagctacagttcctaaggcatctgcaaaagtttttgttccaatcaaagagaaggtagaaaatgttgatgccagtgaaaaatctaattccagctctcctggagatgttttaggtcttggaaattatggttctgatgctgatgatggagacaatgaaattgagagttccagtgtgccaactcctgcaaaagatgctgcctataagtcagggattaagaaacctttgtcagatacacatgatctatctgttaatggcatttcacaacttgatgagcatgctataagtgaaactaatttggtgaataatcaggtcaaaactatctctttaccatccagaagtagcaatggtgctgctactgatcagttgcatgatgacaaggtgaccaaggaatccaatcattcacattcttccaaggtggtgtctgaagatctgagggataatgggcttaatttcattgaaagaaaccatgatagatttaatggttttagttctaaagatacttcagggataccacgatctgaactgcctggaaagaacattagtgtggaaaaagcaatggatgatcattcaggtagggaaagcagaaaaaaatcagaaaaaaatgatcgacctgacaggagtacttctgagaaagactttgtaaaggaggtacacagtagtaagactaagatagatgaaaaaggtaatgagaatcaaagaagaaaggatgaaaggaatcagaaaagggacaaaacagattatggcagtgaagcaaaagaaagagtgaaacagcacagtttaaggcacggggagaaggcaaaggaatcagactcaaggaaaagatcctctcatgttgatgtcaaggatgataaaaaggaagcagaaaaatcccatagaggtagtgccactgacgatactagccggaaaagggagcatgcaaaggataagggggaacataaatcaaggcaaaaagatgcaagtaataatgacaggcatagaagaaggcgttcatcttcagtaagcagtagaggtagaaccaagaaggattgtattaatcatgctggtgattcaagtggaagctgcattcaagaaagcgtgacttatcaccgtctccagtcagatctaaaagaagacaacttttgcggtctcctcatagcaagcgttctcagcgcaggcattctccctatacttctcttgattcttccaggggaaggaggtcaagatccagatcacctgttcggcggcagagatgaatggatggggacagagatggttgactttgcatctacggtgttcattcaagagaacataaatttggaggcgtag

SEQ ID NO: 76390 - DNA, 126 bp, Glycine max
  Peptide Sequence Number=SeqID_168075
atgatgcgtgtgatctcggttgacaatcatgaattttggtttatgggcttcttgaactatgatggtgctgtggagtccctgcaagatgcccttcaatctggcagacaaatacaatcagaagcatag

SEQ ID NO: 76391 - DNA, 807 bp, Glycine max
  Peptide Sequence Number=SeqID_168076
atggtgggcctctccttcaccaccctgggccagcgcaacctcaaatttcaacagggatctcttccacctcaacctcggcgtggctcccgccgttggctcgatccagttgcatttcatcgtcctggagcttttctacacgaacgacttcaccatcgcggtggacagggcgtcgacggcgctgggtctgttactggtggcgctggaactcttcgaggagtgtgtgcgctagaagagaagaaagtggtgaaattaatccccttccttagcgagaaagagtcgaaggagcttgtggctagggtttggccttcgagagaggactcatgcgatgcgatgctgcaaggattgatttcctcggcgatgaacagttacgacaacattacatttgtgaaggctttcatagggaagattctttgggatctgtcattgagggagacagcgaagagagtgttggagaaggtgtttaggatgagcttgaagacggtgaaggagttgttggaggattatttgagtccagtgttcagaggggatctgaacgagacgggggctgttcagaggctgaatctgcataaggcttcaacaaatgggaagcatcttctatggctggtggagaggatgattgagcttagggttgttgatgtcgcagttagagaatggagtgagcaagttgtcttcactgctgatttgcaaagggcgtttcgtgatgatgcatggaggaacattgtgcctggccttcctgctgttattctcaggtgtacatttaggctcaccaatgttgtctctgccagcaccatacttgcttctagatag

SEQ ID NO: 76392 - DNA, 597 bp, Glycine max
  Peptide Sequence Number=SeqID_168077
atggctctcaacctccttaggatccagatacctgatgaattacaagaacaagctaaacagggagcttttgtcccacatggtcgtcaagacatcctaaacactgccattggtcgtccagagcatcctggacgtgttcctgtcggtggacatggtgtgaccataaccagctactttggacatgcttcctgtgggtcccacagttcttcgcctgcgatcaccgccgaaagattggttgaaatcatacaaactataaagcaagaggtgaagaaagaggtagaagacgagaacaaagatcgtatggacaagatgaaaatggagttggatgcgatcaagagtgaattatcccaaattcatacgcaacagtcagctcccccaagaccgtctaaccctgacgtatttgttgcacgtgttagcacgaaagagagttgtgctgaagctgctaataatgttgttggtaatgagcggtctacatttgatacatgtagtatgggcttctacattgtttgtggtgacagtacacagctggtggcagggggaaaggtctttggagtaggtggcatcatacacactgttgcttatggagatgatgtagtaagg

SEQ ID NO: 76393 - DNA, 642 bp, Glycine max
  Peptide Sequence Number=SeqID_168078
atggctgaaaccaatactagtatcaaaagctctaggcaattgaggtatgtttatagttttgctgataaggtgaaaagttttcctggtttggcaaggagggcaacatggaaggttggcaaagaggatccaagaagagtggtccatgctttgaaagttggcatggctttgacactagtttctttgctgtatctgatggagccattgttcaaagggatagggaaaaatgctatgtgggctgtcatgactgtggttgtggtgatggagttcactgtcgaagtggtaaggagaaagaacaactcaccagtgacgacgacgctgggttatactccggcgaaaggcggcgacggagctgaggctacggttccacggcggcggcgggggaggttctttgaacctttaaaagaattcaggaaggaggaggtgacccttcaagttgatggctccaatgaccatataattgtgaaaggcgaaaggcaaacaaatgaacagaaacatgttcactttgagttggcctttccattcccaccagattcagatgtggataacatatctggaaactttaacagggaaatccttcacatgcatgtccccaagcaagcctccaacacacttgtaaatagaaatgaaccttataataaatga

SEQ ID NO: 76394 - DNA, 508 bp, Glycine max
  Peptide Sequence Number=SeqID_168079
gaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctggtacccgcgaggtgcacgctaagcgcgtgcatcgttttcgtggtctgggaagcgccagctgagcgcgctcttccctccttcgttccatgtttggctgttcgcgctaagcctctacgtaggcttagcgtgatgctacctgcaaatcattacatgaacaatccagatcccaaatcttacctattagtgtggaaactgcgtgaaaaggttacgagaaaattgggagccccctggaggcaactgagaggttgggcagtttcgaaaactgcccaggaatttatgacttgcgtgcttagcgcccatgtggccgctaagcgcaccaagggaagcgtcccttggttgcccctcagatttaaaatttaa

SEQ ID NO: 76395 - DNA, 183 bp, Glycine max
  Peptide Sequence Number=SeqID_168080
atgagaagggggggggggggtgaaagaaaggctgaccctcttatttataggtgcaaaattgggctttgggccttcgtagtctcactgagcgtgaaacctcgcgctcagtgccactgcgcgcttagcgtgtgtcctgcgcttagcgcctcaccttcttgcgcgctgggcatgccttgcgcttag

SEQ ID NO: 76396 - DNA, 300 bp, Glycine max
  Peptide Sequence Number=SeqID_168081
atggtagccataacccctgctaggtttcctcaatctccattttttcgaggatacgactcgaacgcaacgtgtgcttgtcatggagaagccccggggcattccattgagcattgtagggccctgaagcataaggtgcaaggtctaattgatgcgggctggctgaattttgaggagaatcacgtgattttcaagtgcaagccattggtctgtttgctcaagcaacctgtgctcctgagtttggacttccaagaccgttcaatcagagattactcgtcttgcacgttggtgggggtaccgtaa

SEQ ID NO: 76397 - DNA, 408 bp, Glycine max
  Peptide Sequence Number=SeqID_168082
atgagtgtagagcaattcattaagaaggtgccctggcctggagctcgaccttcttttgtgggggataatgaaagttttacagcccaggcacctcaaccacatgaactagagctagaaaacgatcactcatctaaagccatcatccctagagctgttgattttttgaaaagaagatttgaaacgagatccaatgaggctgctcatcctgagccaatgccagtatcagctgatgcactatttcctggggtggatccatctttagctcagcatgcaacagacttttccactcctgtcttagagatacctgagggccagaccataccagtcctaactctggacacttctcctccagctattttagtattacatctgacagatgaggaggatgttcagacacaggacacctag

SEQ ID NO: 76398 - DNA, 309 bp, Glycine max
  Peptide Sequence Number=SeqID_168083
atggtcataacttttcacacggaggtcctgtcataccctaatttcgtccggggacctttgctcgatgacgtgcgaccattctttggtcctcgtgagacttatcaaggtaatccttgtggcgtctacccagacttatcttccttcactggaagtggcgtctacccagacttatcttccttaaccggaagtggcgtctacccagacttatcttccttcactggaagtggcgtctaccatgacttatcttccttcactggaagtggcgtcatccaaaccttcgtagcctgtatcaaacgatccgccccgtaa

SEQ ID NO: 76399 - DNA, 591 bp, Glycine max
  Peptide Sequence Number=SeqID_168084
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatgtttgcattcaactcacagagctgaacattcccgttcatagagcagagttcaaccatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 76400 - DNA, 381 bp, Glycine max
  Peptide Sequence Number=SeqID_168085
atgttggtgcacatgatccacactcgtctctttgcagtggcacgggtgaaaccttgccccggtatgcacagtagctgcgtgatagcttccctttctggttgtgctcgcacagttggcgccctccaatatcatggggtggcccaagaactgataaaaggaaactactggccccttaaccgggagtgcaagtctcgaatgtggaaccctctgaaagtgaggacgcgtagtcctctaaaggtgagggcgtgcaacccactgaaggtgaggacatgcagtcctctaaaggtgaggacatgcagtcctctgaaggcgaggacgtgtagccctctgaaggtgagggcgtgtagccctacgaaggcgaggacgtgcagtcctctgaag

SEQ ID NO: 76401 - DNA, 333 bp, Glycine max
  Peptide Sequence Number=SeqID_168086
cggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacacggtgaccgctacacttgccagcgctgatgtccggcggtgcttttgccgttacgcaccacccccgtcagtagctgaacaggagggacagctgatagaaacagaagccactggagcacctcaaaaacaccatcatacactaaatca

SEQ ID NO: 76402 - DNA, 543 bp, Glycine max
  Peptide Sequence Number=SeqID_168087
atgaccaccctagctcagacatggagtgttctttccttctctaacctgattcctacctcctatacttctgatgtcactcttgatagggccaaactcatctatggcattattatgaagatggataagaatgtggggtacctcatctcccaccagatttccctcacagctcagcatgacacatccagacttagattctcgaccttaattacagctttatgtaaggctaggggagttcagtctgactctagatccttggagagtctgagtcctaccattaatttggattatattaagaagaactattggaatcttgatgatccaatagtaactttcagtggacccaggaaggccagagggaagagatctgaggccctttccaccctttccacttcatcaccttcttcttctacccttcctccctcttcatccactcagattccagtgattcctccaacaccttcacagattccactaccagctcctctttctacaggtccaacagattttattttcactcctcagatgcttcactccatgctctag

SEQ ID NO: 76403 - DNA, 711 bp, Glycine max
  Peptide Sequence Number=SeqID_168088
atggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcagtggctgctgccagtggtgcttttgcatgtctttccgggttggactcaagacgatagttaccggataaggcgcagcggtcggactgaacggggggttcgtgcatacagtccagcttggagcgaactgcctacccggaactga

SEQ ID NO: 76404 - DNA, 267 bp, Glycine max
  Peptide Sequence Number=SeqID_168089
atgaggtcctttaatggtgattttccaccatggagatgcagcggaagacaaaggagaataggcaaaaaccctatactgctagaatggccaaaatacaaggcccaaaagaaggaaaaacctattctaatatttacaaagaagagtggattcaaccttgacccatgggctcaaaaatctaccctaaggttcatgagaaccctagggccttctttagtagctgtagcccaagcctcttggagtcttctatccaatacccttggggggtag

SEQ ID NO: 76405 - DNA, 632 bp, Glycine max
  Peptide Sequence Number=SeqID_168090
atgggaacaaatcaaaccagaaaaagattctatcaagtcaagattaagggcctagatgtcaccagccttaaggagttggggcggttgatgggacctctccaaatgcaagccttccgcaaggcgtacagaaagattttagatttaaccatagcggagatattcacggaagccgttgtatccctcacccaatactatgaccagcctttgagatgcttcatgtttggagacttccaattagtaccgactgttgaagaatttgaggagaatctaggatgtcctcttgggggaagaaaaccgtatcttttctccgggtttcttccctccttgagcaagattgcagtagtggtcaggggttcggcaagagagttggatcatgtaaagcaaactcgaaacggcatagtgggcctaccacggaagtacttggaaggcaaggcaagggatatggcgaatcaagaggagtgggtctcgtttgtggacgtgttagcgttgctaatctttggggttgtcctctttccaaacgtggacggtttggtggacctagccgcgattgatgctttccttgcatatcaccatagcaaagagagctcggtggtagctatcttggcggacttatttgatacatttgaccgaag

SEQ ID NO: 76406 - DNA, 772 bp, Glycine max
  Peptide Sequence Number=SeqID_168091
ggctacacgccgtcgctttcaagggctacacgccttcgctttcagggggctgcacgccctcgccatcagaggactacacgtcctcgccttcagagggctgcacgccctcgccttcggaggactacacgtcctctccttcagaggactatatgtcttcgccattagagggctgcacaccctcaccttcagaggactacatgtcctcgccttcagaaagctacacgccctcgctttcagagggctacatgccctcaccttgaaagggctacacgtcctcacatttagagggttgcatgccctcgccttcaaaggactacacgtcctcgccttcacaagactacatgtccttgccattagaagacaacacatcctcgccttcataggactgcacgtcctcgtcttcagaggactacgcgcccttgcctttagaggattacgtgtcctcgccttaagtgggctgcacgccttggccttgagagggctaggactgcatgtccacgactttagagggctacacgccctcgccttcgaagcactacatgccctcgccttcagaggactactcatcctcacctttagaggactacaggtcctcgccaatagagggctacacaccctcgctttcagagggctacacgtcctcgccttcagaggacttgcacgccctcgccttcagaagactacacgtcctcgccttcagaggactgcacgtcctcaccttcataggactacatgtccttgccttcagaggatagcacgtcctcatctttag

SEQ ID NO: 76407 - DNA, 1272 bp, Glycine max
  Peptide Sequence Number=SeqID_168092
atggcccaggcgctggtgccgctgctggcggcacagggctgtaccctcacctgcgtatttcacgacgtcaaaagctggcgcgacgacatcgatctgagtgacgccgacatcatcatgggcgaccgtctgattggtgatgcgccgcagtttaccctggtgaactggctggaaaatgatgcggcctggcaaccgctgcgtccggcggtactgcaggcaccgctgcacgctatcgcccgtcaggccagtccggcactgcgcagcgccgcgattcatcagctgtttcagcagctaatgcgcgacggccatctgctgccgctgtttaactatcgctaccaggtgtttgctccgccaggcgtcgaaggtattcagcttaacagcatgggctggttcgatttcacccgcgcctggatcccgccgcctgccgcaggcggtgctgttcagcccgcgccggagccagcgctgcagcagtatgatgaagtgcactgcgtgacctttgattatggtcagcgccatcgcgaagagatcagcgtcgccgcagagctggcgcaccagctgggcgcgcgggcgcacaaagtgctggacgtaacgctgcttaatgaactggcggtcagcagcctgacgcgcgataacattccggtgccggcctacaatccacaggccagcggcctgcccagcacctttgtcccggggcgtggaagccgaagcggtgattaccggcgtatgcgaaaccgattttccggctacccggattgccgtgacgagttcgtcaaagcgctgaataacgccgttactctcggcatggcgcgtgacgtgcgttttgaaacgccgctgatgtggctgaataaagcagaaacctgggcgctggcggactactggcagcagctgccgctggtccgttcagagacgctgacctgctacaacggcgttaaaggcgacggctgtggccaatgcggccagcgtgatggcggcgatgaaacagaaaagcggcctgcgctgattgcggccgcgctgcgggctggcgtgctgtcagggcatgccagctcaggaagtcgcgacctcgctctcaatgtgcagcacgtcgcccagcaccgccggacgacgatagttaatgttgatattcaccaccacaaacgccagctgctgctccagcagccagtgaaaggcatcggcatcttccagccactgccagcgcgcctcttccagaaattccaggctgagaatgacaactggttggacctgttgagcatagcacagcctgatgggccgctttag

SEQ ID NO: 76408 - DNA, 90 bp, Glycine max
  Peptide Sequence Number=SeqID_168093
atggcctttgtggataactgggtggtgggtaaggagaagggaaacacttgggctgccagatccctccagctttggaagcgtattctttga

SEQ ID NO: 76409 - DNA, 183 bp, Glycine max
  Peptide Sequence Number=SeqID_168094
atgatgggagatgtatccaagtttacaaccatttcccccaaaagtggacatgttacatacgacgacaacaatatcagtaaaatctcaaaagagacaaaggatcaagctgaatgttttgatgatgccaaaggatcacataagaaattaaagatattcaagatggatgatcaagacagtctctag

SEQ ID NO: 76410 - DNA, 75 bp, Glycine max
  Peptide Sequence Number=SeqID_168095
atgggtgccaagtacctcaaagcagtcaagaaaaggttgcatgccatcaagcaatggtcctcggacgaaattagg

SEQ ID NO: 76411 - DNA, 603 bp, Glycine max
  Peptide Sequence Number=SeqID_168096
atggatggcaaagccttctcatggcaaagacattacatacaacaacctagctgcaaggacaaatcgtgggaacaaattttacacgatgtggcatatcgatttgatgacagtgtatttgatgatcctgtagcggagttatcgaaattgaaacaagaaggagatttaggtgaatatttggaagcatttgattctccgttggctcgtgtagggtccatcatgagtctacaacagaattatcatacggagtcaacgtcgtcaccaacaattgccgattctaagggtaacacatcaacttctatttctaggaaggaagttagtgacaggattgctaaaggattgtgtaggctctgtggagataagtgggataaaaatcatacgacaaaatgtaaagtttggggcaagctaaatgctattttctttgctcaagaagagatagatgttgagatgatgcagaaaaatgatcgtgaagacgaacaagcaataatagatacaagtatagatatgattcaagatgtagatgtccacatctcccttaatgctttacaaggcatagcaggtggcagtatgttcaaactcggcaagtgcaccagattgcgcaagtag

SEQ ID NO: 76412 - DNA, 144 bp, Glycine max
  Peptide Sequence Number=SeqID_168097
atgacgaagaacgaacgaagaacgatgaagaatggagaaaagagggaggtggttgctgcccagctcgcccaggcgagttgggttgcttccaccagaaggcaccgccttctgttggaaccccctagaagactcaagtgggcctag

SEQ ID NO: 76413 - DNA, 600 bp, Glycine max
  Peptide Sequence Number=SeqID_168098
ctggtgtacgccatcctgacacggatgagcattcacgtggctcagttgatcgctaatgccatctatccatttgcaggtatggcgcctacccggcaccctttggacccgaataagtccaacagggccctgggatttcccgcgctgaacacaggactctgccagtcgttcggagtccccgttgcacctagcaaggtgattcggctacccctcacccgggcttttattgagaaatactgcacacagagacaggtccagggtgatgcaccacaggccgcggacgtgccgccacctcatcaggctggcccagatgggccatttgattcggagcagtatttacgacatgtggttcgccagcaggcggccaaccatcggctgcacgtgcagactcatgactgtctttaccagctgagccttagcctgcagagccagggttttacttcttttccatgccctactctggatcagttcagggcagaggtcgcttggcccggagattggccggaggcaccaacagaggctcccgacgaggcagatgaggcccgcgaggacgaggagatgaccgatttccttgatttcttgggagggagcagagccacatga

SEQ ID NO: 76414 - DNA, 339 bp, Glycine max
  Peptide Sequence Number=SeqID_168099
atgcccccgcccccccccccccaaatccaattcgccctgtgtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 76415 - DNA, 618 bp, Glycine max
  Peptide Sequence Number=SeqID_168100
atgggagcttctgagcatcctctaaatatgcatatccaaggtgctcaggtagtggtttcagctccaaggaagatggctgaatggtggaaggcagaggaagtgatggtggcccgggtgatgttggggaatggttacgagcccaaaatgggtttaggcaaggacaatggcggcagaaccatcctgaaaagcaccagaggaaaccgtgggaagtttggcggaggtcaaggctcgcgattaggacaagaagtcgaagggggcccgccctgccacatcagtaggagctttataagcgcgggtctaggacacaaagaccaagtcattgaaatatgcgaagaagattctccaagtgggttagatttggtacgaccatgccctcctagtttccgactaggaaattggcaagtggaggagcgcccggacatttacgcgacaagcataatatccgacgacgagtccctcgaaggtactattacctgggacccgaccatcgatttcgagcaagaaatggatcaaatggaggatgaagagaacgaagatgtgggacttcccccggagttggagaagatagtcgcccatgaggaccaagaaatggggcctcatcaagaagagacggaacta

SEQ ID NO: 76416 - DNA, 836 bp, Glycine max
  Peptide Sequence Number=SeqID_168101
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatcagaactcaagaagccacacaccatatgcatgtgaatgctatagtacaccagtatacagcacagtattggtacgcacctttccaaacagattcgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 76417 - DNA, 1197 bp, Glycine max
  Peptide Sequence Number=SeqID_168102
atggggaccatcaatgccggttatagctacagcaaagattatcagcagtcttcgttgggcgtggcgggcggcatcgtcgcacactccggcggcgtgacgctgacccaaccgctgcagaatacgtttgtgctggtggaagcgaaagacgccaagggcgttcgtatcgaaaaccaaccgggtgtcgccatcgaccgcttcggttacgcggtgatgacctctgcatcgccataccgccataaccgcgtggcgctgcgcaccgaagatattggcaacggcctggatatcccgatggcggcgagagacgtggtgccgacttacggcgcaattacccgcgtgaagtttgaaacgcacacgggccaaagcctgggatcgcctgctggtgaaatggggcaacgacgcgggcgaaagctgctcactggtggtgccggaattgaaagcggcgaccgaacagctgatgggttatcaggaactttcgctgacctgcggaaaaccgtaaaaggaaaggatatgtcttctttattaaagcataagaatctcgggttggcggctgggctgctggtcacgctgggtacgttttcgcagagcagctatgcgctgtcatgtaagcagaacggcagcattcgccaggacatcgtgctggataaagccatcaaggtatcgaccgccaataccgcgccgggcgcattgctgtggcgttcgcagacctttacctcgactttccaatgtacggatgactggaacaacccgaaaggggaaaatgcctacctgtactgggatcctcagtcccggatgagtcagatccataactcgatcgaagtgggtgtcacttatcaggggattgatgtcaaaccaacgaaaggtgcacgtcaggatgtggggccaggaacggaatgccgccgttcaggcagccgttgtctgtctccggccagatcgctgacggtaaccgtgtcttacgctatctatattaaagcaaccggcaaggcgcctccggctggcggcaagattaacgacaacaactcgtactcggtatttcaggttgatggcgtcggcggcttgaacggcacgccgaacagcaactttaacgcctatatttccgggctgggcaacattcagtttatttcctgcaacccgaaaatcaccgtggtggccaacaacggttcgacggttaattttggcactatcccgcgtcagaatgcg

SEQ ID NO: 76418 - DNA, 525 bp, Glycine max
  Peptide Sequence Number=SeqID_168103
atggtagtacgagccttcgacagtagtcggcgggaggtgatggaggaaattgacatccccattcagataggcccccacacatgcaatgtggttttccaagtgatggacataaatcccgcctacagctgccttttgggggaggccatggattcacgcgctaggagtggtcccttcaatgctttaccagaaattgaaattcccggttggtggactcttggtgatagtgtcaggcgaagaggatatgttggtaagctgcccctcctccgcaccatatgtagaggcagcggacgaatcattggaaacagctttccaatccttcgaggtggtaagttgtgcctctgtggaaacaagtccattgctattgtcgcaacgtgcccttcgcgggcgaggctcacgggtgcgctttccaaaggaggaaagatgtgcggagtcgccaccaacgtttatttgtgggaaacgtcagaaaaaccgaaggaaaccggtcaaaatgaaaattctaagttcgggagttgtatttacgcttga

SEQ ID NO: 76419 - DNA, 585 bp, Glycine max
  Peptide Sequence Number=SeqID_168104
atggggtggttgggataccaaggaagcgcttggaagagaaagcaaaagctttggcggatcaaaaagaacgggctagtggatcttgcagcgatcaatacttttcttgcttatcaccacaacaaggaaagcccggtcgttgttgttttggccgatgcctatgacaaatttgactggagatgtaagaagagcaacacgagaattatctgttgcacacccgctctttatgtatggatggtctcccacatttttcatcatgaaagtagactcgtctgtcccttacaaggtcgtcacatgtgtgctgagaaagggaaaacaaattgggaagaactcttggaaggtatggtagaggtgtccattaattggttcccccgatggaaggaaggaggggctggagttttgtgctcatgtgaagggttcccaaatgtccccttgatgggaacaaggggttgcatcaattataatcctatgctggccataagacaactaggctaccctgtgagaagggcgccatcagaagagattatcgtgcttctcatcgcacggggtttcagtgaaagcaatgcaaaaatgcttcaaagagtctga

SEQ ID NO: 76420 - DNA, 198 bp, Glycine max
  Peptide Sequence Number=SeqID_168105
atggaaggaggtcaagaggttctgaagcgcaagctttgcactaagcgtatctttggtcatgcgctaagccaagagtctcaagcgtttagcgcccaacccttgcatctaaggttgatttggtccgctaagctggccaaggctgagctaagccaacttcaattcgatctgaatttggctaagcaacagcttgatcgctaa

SEQ ID NO: 76421 - DNA, 792 bp, Glycine max
  Peptide Sequence Number=SeqID_168106
gcacccctctctttcaagaggattcgcggcatgtcaagccctggcgggatacttaacgcgttagctacagcattgcacgggtcgatacgcacagcgcctagtatccatcgtttacggctaggactactggggtatctaatcccattcgctcccctagctttcgtctctcagtgtcagtgtcggcccagcagagtgctttcgccgttggtgttctttccgatctctacgcatttcaccgctccaccggaaattccctctgcccctaccgtactccagcttgacgctttacgcccaatcattccggataacgcttgcatcctctgtcttaccgcggctgctggcacagagttagccgatgcttattccccggataccgtcattgcttcttctccggggaaaagaatcccagtgtggctgatcatcctctcggacccagctactgatcatcgccttggtaagctattgcctcaccaactagctaatcagacgcgagcccctcctcgggcggattcctccttttgctcctcagcctacggggtattagcagccgtttccagctgttgttcccctcccaagggtaggatcgaactctccatgagattcctagttgcattacttatagcttccttgttcgtagacaaagctgattcggaattctcttccattccaaggcataacttgtatccaggcgcttcatattcgactggagttcgctcccagaaatatagcccccccacccctcgtgctcgaactgataacttccaccacgtcaaggtgacactctaccgctga

SEQ ID NO: 76422 - DNA, 447 bp, Glycine max
  Peptide Sequence Number=SeqID_168107
atgggaggatacgtaggagcaagagcctcgcttttgtcgaccataccgccttttgttgccatgactcaagagctggtagcccgcggagacaccttacggttatccgcacctcgtcattcagtcaccccaagtgtgattgacgagcagaggccaatatggtcatctgcgccctttccggagatgtcagcattttccgatggagacttttcaagtctcacaaattatctagaacaacgtagaggcggcgggcccgatgatacgcggagataccttacggttatccgcacccttttatcatccagaggcggcgggcccgatgatacgcggagataccttacggttatccgcacccttttgtcatccagaggcggcgggcccgatgacaagcagagacaaaatttggtcattctgcacccttgtatcatccagaggcggcgggcccgatga

SEQ ID NO: 76423 - DNA, 1116 bp, Glycine max
  Peptide Sequence Number=SeqID_168108
atgaaagtagacccgtctgtcccctacaaggtcactgcttgtgtgtcgagaaagggaaggcaaactgggagcaactcttggctagaaggaagagccggggttttgtcctcatgtgaaggattctcaaacgtccctttgatgggaacaaggggttgtatcaattataatcccatccttgccataagacaacttggctaccccatgagaggagcgtcgtcggaggaaagcatcacacctttcatcgcaaggggtttcagtgaccccaatgcgaggatatttcaaggagttcgcaaggcgtggtgtgcagtgcaaaggaaagataaagagatcaagggaagtagcaatgggatcatcgacggctatcataagtggctgaatgctcggacgcaagggttggattggctcctaaagctaaaggttttaagagaggaagaggccgaaacccctgaggagagtgaggaggtgcaagccctaaaggcagaacttgaaagggcacaagcagtcaaagaaaagttcaagacaatgaccatcaaggttcggaaagagtgcgacgaactgagagacattaatgtggccaccgccgaagcattggaacgggaaacaaagagggcccaaaaggaagaatgcggtcgaaacaagttccgaggggctttgttgggtagctacagtgagcttaagcttcgaagagccgagagagaccagtcgagagttgagggcatgatattggaagataagttaaaggcttgtcaaaggtcaaagagaagtttgtccgaccaattgagaaaaatggaagaaaacatgtgggtcatcgttgaccaatacaaggagaagctaagcctagcgggaacccatgaaccaaagctagaagacgagtatgcaaaggtatcggtcctgcaagcagaaagggaagcaaaggaaagggcgatcgattcattacacagagaagcaatgatgtggatggacaagttcgcctttactttaaatgggagtcaagatcttccaagactgctagctaaagccaaggcgatggcggatgtgtactcggcccccgaggaagttcacgggctcctcgattattgtcagcacatgatcgatctgatggctgttagtcgatga

SEQ ID NO: 76424 - DNA, 66 bp, Glycine max
  Peptide Sequence Number=SeqID_168109
atgcgtcctccaccatcaagcgcggagcctccgagaaaggagatggagagacggaagtcgtcatag

SEQ ID NO: 76425 - DNA, 234 bp, Glycine max
  Peptide Sequence Number=SeqID_168110
atgggatttactttattagaccttcaaaagttggcttacaaggacgagcctttcatcatggcaaaacaagtgagacaggtgttttacatcgaagatccgtgtaactcaagaagatcagttgttctacttggaagaccaactgtcatggcaacacccccaaggtcccttctgcattcagatgctccttcggaggttaaatgtcaaaagcttggatcagccaaggctaacaattaa

SEQ ID NO: 76426 - DNA, 936 bp, Glycine max
  Peptide Sequence Number=SeqID_168111
atgaattcagaaatatctggtggcaactggaaattgctatctgagaataagcatgtgaagtacctttatatcccttataccgactctgttgtggttgtgcgatgcaatcctgtttcaaagtggaaaggtcctcccaagttcaaaccacaatataccaaagatgaagccatacagcatgtgcgtgacctttaccaggagtccctcaagaaatatggagccgaaggatctaagggtaaatcagcagaagatggtgaacaaaatatagatgagctttctttcacagaattaagagataagctaattgccctagatcctctcgataaaaagcacatcatcaacatcaataaagctgaggccgagttctggcgaaagtcagaaggatatagggttggatggagtgatgaaatattgggctttgattgcggaggtcaacagtgggtatcagagacatgtttccctgctgggaaactagctaatccaagcatgaaagaccttgaatacattgaagagctgaagcaacttatagagaaagaagagatacctgcacctgctccaattgagcagcgctggacagctagcagtaggagttccttgagtcctgcttcaagtccgtctgaggatgatatattttcttgggtaggtataatcatgtaccttcctaccatggatgctcggcagaggaaagatataacagaagaattctttcattataggcatttgactcaggcaaaattatgggattgttactccgcatatgaacactgggctaagattgaggttccaaaggacaagaaggagcttgcagctctccaagaaaggctaagaaagcggtttcctgtggatgcatacaataaagcaagaaaggaattggaccccaataggatcctttcgaataacatgttggaaaagctcttcccacaatcagacaccatataa

SEQ ID NO: 76427 - DNA, 423 bp, Glycine max
  Peptide Sequence Number=SeqID_168112
atggagatggatactcagaatgtaattttggcccctaacaaactcttaactcagcaaatagaggccttaacagacaagtcaacttcctcaacaatttcaacaagaatgaagccatacctcaacagaacttccaaggaaactacaaaggctacagaggtggctcaggataatggtgagaaaaagaataaagatggagttgaaaaagaaaaagagaaaaatgatggattggtgactagtgaaacagtggaagagaaagtagtaagtgaagaagagaagcaaaaatcaaacaaacaagccactaataaaggtaaagttgtagtaaatcgtccaccaattgagtattttccttatctgcatgctccgtcaaagaaagacaaggaaaggcagtacaagcgtttcttagaaattttcaaacgactgtag

SEQ ID NO: 76428 - DNA, 1473 bp, Glycine max
  Peptide Sequence Number=SeqID_168113
atggcttcggaagtagccccatcttccggggatttgttgaaatgttgcaactgtggatgcggttgctccttggtagctcattcttcggggacatggatgcgatccgttaaacggaagcttgatgagttcaaaatggacggccaattacccattcctgcgattgcgcggattgaagttgagaatgaatgtgtggccttacgcgagatggtcagcatgcagcagagaaccattcaggatttgaatgctgagttggaggaggagagaaattcttcatccacagcggccaacgaggccatgtcgatgatattgaggctgcagagggagaaggcggaggttcaaatggaggctcgccaattcaagcgttttgcggaggagaagatgacgcatgatcaggaggagcttctatctttggaagatttgctctataagagagaacagataattcagtcacttacctgtgaagttcaggcttacaaacacaggttgatgagctttggccttactgaggacgaggctgagggtgatcaatatgaacttccaacctatgaatatcctcctttgaagtgtaatgtgatgcatgatggtatggatgccggtaatgatgacactgatatagagaaatatgcctttggtgaaactccaagtgaccgtttgaggaacttggaaaataggatttctcaaatggagaaaactcctacttacagccggatggatggggattttacaggaaaaaatattctagagaaagtgattgttggtcagtctccaagacggattaagcattctaggagattttccagtgactcagcatctttgagtgggataggaaaagaaataggtcccgagtctatgatggactctcccaagctcaatagtaactataggagagattatttctcagagtcagaggatccttccaatttcaagaaggtacacaatgcatcagatggtgacgatatgagcgacagaatttatacaattgactctgttcattgtggggcaccatataatggtttcacagattccaaagctggtggttttgaagattatgcaaccactcctagggagtcagggaatcatgctactgattttgaggatccctacataaagaagctttatatgaggcttcaggcccttgaggctgatagggaatcaatgaggcaggcaatcatttcaatgcgcacggataaagcacaggtggtgttactgaaggaaatagctcaacatctgtgcaaagagatgtcaccaaaaagaaaaatggcaaggaaactgtatttttctggcaactctaactcttcgtttgtttcaatttttaagtggatctcatcaattgttttctggagaaagagagctcatcaaagcaagtacatgtttgggctaccgcctgagagtgttggcttgctgatgctcctagacaagggaatgcatgcaaggccgtggagatgcgtttcgagtacacaagtgggggattaa

SEQ ID NO: 76429 - DNA, 381 bp, Glycine max
  Peptide Sequence Number=SeqID_168114
atggctcaccaacaatcattcttgaagtcatggagtcacaagacttatggagttggcaagcatatttttgagttacaggcgacacttatgaagactatcccaaggccacaaggtcataaaacaaaattgtttgctcaacatcaagaagcaataagaaaggatgtggatcacacatttggagtgcttcaatcttggttcatgattgtacatggccttgcatatggttggagcatactgttaatcgcgtctgctaagtgcaacactcatgggctaagcacgaggaagactctggaagaagatgagctgtacaaaccagggcttgaagtaggagccgatttgagagcttgggatgagtttgtgagtgattgtgagatcctagag

SEQ ID NO: 76430 - DNA, 345 bp, Glycine max
  Peptide Sequence Number=SeqID_168115
atggtagtaagcttcaaggacgaggactacccttggttcgctaacatggaaaactttaaggccacagaacaaccaccagaaggtataaaattccacaagagaaaaaggttcttcggagaagccaccaaggagaacaaactagcatattttcacattgccacaactcaccatatggaggcaacttcaacggagaaagaacaactgcaaagatctttcaagccagattctattagcctaaattcttcaaagatgctcataaccatgcacgatcatgcgacaactgttaacgaactgacaacatatctagacgacatgaaatgccattacagaacatgcacgagatag

SEQ ID NO: 76431 - DNA, 411 bp, Glycine max
  Peptide Sequence Number=SeqID_168116
atggatgaaagactccttgcatacaccattgcttggatctttctggcaagaggaggcaatcatgcaacactcatgataggcgatctaattgccattcaaaccatgaaggacaaagtcatggagcactatggaatggacttcatggatgagaagttcaaaattctgactgcaccagagctagagattatggctcaagttcctaaagttgaagagaaacctctttcaccattcgagatcacactgttgcggaagattgatcagatctataattggcaactccaacaaaatgagactcaaaatgagcacttgaacaacattagtaagatgttgaacatcattaaggcaagcctgaggaagcatcacattggtgatgacattttgtacttgttgtgtttgtttatgatgctttga

SEQ ID NO: 76432 - DNA, 252 bp, Glycine max
  Peptide Sequence Number=SeqID_168117
atgaatcttgaagaacggtcgagaatcttcgccaaaataggggagaagcttgctgcccaactcgcccaggcgagcaaggttgcttcttccagaagcaacaaccttctggaggaatcttctggagggcccaagtgggcctgctttcgaagaagttacggaaactcacggattgcgcaaaaacacctcttttcgacttccgccacattacggaatttcacggatcgcgcaagcctgcttccttttgatttctga

SEQ ID NO: 76433 - DNA, 513 bp, Glycine max
  Peptide Sequence Number=SeqID_168118
atggcgtccttttccggtcacaggcacggccttatgcgtgttttttccacacgccaaacagacatgcttagacgtgcactgtcagcacgtgtagtctctgttcaggcagcatttttcacgccaacgacgccccctcctagcgacccaatccctggagtttgggggcaatcagagttgcagtgcttgcaccccctttgtaatctagacttccgccttatcgttctttgttgttgcaggctttgtgtgctcgtccaaggcacacagtttctatacaaattcaatatgccttcccaacgccctttcgtcgatgcctacctacaactatcgatgcctgtctttgatgacccagatgccgcaaccgcaccaccatctgctgccacacgtgcccctatgcacatgcatctcacgctttcaatgcgtgctcttttcacaggtgaaccgtacccgtcaaaactgtgggcctccattgactggtgtcgagccatcatttattcagcacgaccacacggctag

SEQ ID NO: 76434 - DNA, 279 bp, Glycine max
  Peptide Sequence Number=SeqID_168119
atgtcagttctggaattgtacatagaaaaggatgtggctggtggttcaatgtttccttctgcaaattcgcttacatcatgtggaaattatttatctaatgatgagacacaaccgccaacaaatatgagcaatttacatgttgacgaagatgatgatgataatgattatcttgtgtctaacacatacgttgaagagtctaactcaaccgcatttatcttcagattaaaattcaagacaatacttcaagattacaagttacaacatcaagatgatcactag

SEQ ID NO: 76435 - DNA, 165 bp, Glycine max
  Peptide Sequence Number=SeqID_168120
atggagatgcagcggaagataaaggagaagaggaggaaaagtgatgcaatcctccctaggaaaggaccagttaccaaagccatgagcaagaggctccaagaggattgggttagaactgttgaagaaggcccgagagttctcatgaaccttagggtagatttttga

SEQ ID NO: 76436 - DNA, 294 bp, Glycine max
  Peptide Sequence Number=SeqID_168121
atggcggcttcaaagacagtgcagaaccgaaataggaagtcattaataaccaacgtagaatgcgctttctgcactaattgcctgaatgcatttatcttatatgatctggtgaaagcttgtaagaagtatagcaatatgggagattgtttttggttgattgataaggacttagtgatgcaatcctaccccgcaagggcattggctagaagactccaagtagattgggctagagatccaaggaaaggccctagggttctcatgagccttagggtagatttcgagcccatgggctaa

SEQ ID NO: 76437 - DNA, 114 bp, Glycine max
  Peptide Sequence Number=SeqID_168122
atgaaggttttcatgatgccaaagtattacctaaagatggttgtcatcatcaaaaagggggagaatgtgaatgaatatcatgcaagttttgatgatgccaaaaaggttacttga

SEQ ID NO: 76438 - DNA, 501 bp, Glycine max
  Peptide Sequence Number=SeqID_168123
atgtgggatcgacacaggcttaaaggaacactcaaatcgagtgtatttacccccaaggcctacactccaaagagtctgtcaaggcctctccctcctgatttaggattttcaagcgtcagagagaaggagaagggattgaagccttcacttcactgtctgtgtgcgatgagtatttctcctgttgcaaaaagtagtttaaaaatcccaatgatggagaagtgtagaaatgaatttcaaacccggtgttccaatttcacaatgatccaatggtgtgagcttatgacacttcaacgccctaccaaccccagtccatggagtgactctcaggaatacatgatcacctacaacaaattcaaggtcctttattctcctatcatggtagctcttctgcctactttgggctgctctcattctctcttggttcaacttgaccttttcagtggtctgctaaaccacctcaggtctaaaggcaatgctctcactgggatctacccaacataa

SEQ ID NO: 76439 - DNA, 228 bp, Glycine max
  Peptide Sequence Number=SeqID_168124
atgataaggttcagtggacttctcacaacgtcgcgggcagcgaaccgctcacgtcgccgcaatccgaacacttcaccggaccattcaatcggtaggagcgacgggcgattacccggacctgtcggccaaggctatagactcgttgaatacatcagtgtagcgcgcgtgcggcccagaacatctaagggcatcacagacctgttattgcctcaaacttccgtggcctaa

SEQ ID NO: 76440 - DNA, 1050 bp, Glycine max
  Peptide Sequence Number=SeqID_168125
atggaagtggcaaaagaatgggtagcggcgaaaaaaatctcctggggcagcgtcatcggtggtgtgatcaccgtattggctgtttcactgttgctgtcgacgttgggcaccagtttgggattttccatcgtggatccgacatcagacgatccgatcaacggagccggtaccaccgtagtgatttggtccgctgtttcaatcatcattagcttggctgccggcgcttttattgccggacgtttggctgctaatgacggccttattcatggcttcctggtatgggctacgtcactgattgtggcggcggtgttgggtggaatgctggtcgggtctgcagtgaaggccaccggtaatgcgctgggtgctatcgcttcgacctctggcagtttgctttccggcgccggttccgcgattggcaaaggtgcaaccgggttggcagacgtgggcggtaaggtgtttgacaagttgggtatcgacaccacgttggaacctgaacagctgcatggtgatgtggttacggcgctcaaaaaaagtggtattccgtcattgcagcctgaattcatgcagcaacagttgaatgcggccaagactgatttggcagacgcagtaaaagccctggcacttcagcctgacaatagcgatgcgattattaagcaactggtcgacaagcttaaaaaacatggtgaggccatctcgcaagatgtggatcaagacacactgaaaaaagctctggttgaaaataccaatatgacgccgcaggaagtggaccagacggtgaagaatttggtcgacgccaaaaataaaactgcgcagctggttaatcagcgcttggatgaagccgaagcaaaaatcaatcaggcaaaacaggagtatgctgagctgaaacagaaggcgcgcgaacaggctgccgcggctgcggacgaattgtctcgggctgccctgtggtcattctttgcgttgttgattggcgcagtggtcagtgcattggcaggcttgtggggcgttaacaccaatgcccgacgtgtaaccgtatcatctccccaggcgtaa

SEQ ID NO: 76441 - DNA, 402 bp, Glycine max
  Peptide Sequence Number=SeqID_168126
atgccacctaccaggcaccctctagacccagataagtctaacagggccctggggtttccagcgttgatcacgggcctcttccagtcattcggggttcctgtcacacctagtaagcggtatttacagcacttggttcgccagcaggcggccaaccacagggggcaggtgcagacctataagtgtctctaccagctcagcctcagtctacagagccagggtttcgctccttttgtgtgccctactccagatcagttcagggcagaggtcgcatggcccggagattggcctgaggcccagacaagggaggcgcccgcagaggctcccggcgacacggaggaggcatgcatggatgagaagatgacagatttactcgatttcttgggagggagcggagccacatga

SEQ ID NO: 76442 - DNA, 465 bp, Glycine max
  Peptide Sequence Number=SeqID_168127
atgggttctatgaattccatgatggagaaactcttcaaacaagttcagttgtttcggagccaaatcaaattcagaagaagaagaagaggtgggcagcgaggcagagccaaagctgaacagctctttgaattggagaatacgccacaagctcaatggggaaagctttggttattgtcaatggaagggaaagcatttgtttggcaaaggcattacacgactcataacaacaataagatgaaatcttggcagcagattcttcaggatgtggctttaagatttgacatggggaattatgatgatcccgtatcagaattatctaaactacgccaagaagctagggtagatgttactaaagaaatggctatcagctttttcttgggaggattacatgcttcattagaaaaatcagtttgtattcataaccctagttctctacaagatgcaatgcgattagctagattgtaa

SEQ ID NO: 76443 - DNA, 678 bp, Glycine max
  Peptide Sequence Number=SeqID_168128
atgacaagcagagaccaagttggtcattctgcaacccttgtatcatccaagaagacggcgggcccgatgatacgcggagataccttacggttatccgcatccttttgtcatccagaggcggcgggcccgatgacaagcagagaccaaagtttggtcattctgcacccttgtatcatccagaggcggcgggccccgatgatacgcggaagatcccttacggttatccgcatccctttttgtcatccagaggcggcgggcccgatgacaagcagagaccaagtttggtcattctgcacccttgtatcatccagaggcggcgggcccgatgatacgcggagataccttacggttatccgcacccttttgtcatccagaggcggcgggcccgatgacaagcagagaccaaaggcggcgggcccgatgatacgcggagataccttacggttatccgcacccttttgtcatccagaggcggcgggcccgatgacaagcagagaccaagtttggtcattctgcacccttgtatcatccagaggcggcgggcccgatgatacgcggagataccttacggttatccgcacccttttgtcatccagaggcggcgggcccgatgacaagcagagaccaagtttggtcattctgcacccttgtatcatccagaggcggcgggcccgatga

SEQ ID NO: 76444 - DNA, 255 bp, Glycine max
  Peptide Sequence Number=SeqID_168129
atggcgtacttctcctgtttgaacccggggtttgaaacccaaacttatcctcaggaggatagatggggcgattcaggtttgaaaaaggatcttagagtgtctagggttgtgccaggagggtctcttaatgccttcctttttcttctcatcggagttatttcacaaagacttgccatggtaaagaagaagggggaacaagcacacttggagagcgcagtacaacggatagttgtatgctgcgttcgggaaggatga

SEQ ID NO: 76445 - DNA, 178 bp, Glycine max
  Peptide Sequence Number=SeqID_168130
aggcggtttgcgtattggggcgctagcggagtgtatactggcttactatgttggcactgatgagggtgtcagtgaagtgcttcatgtggcaggagaaaaaaggctgcaccgcggaaatgttttacttaacggggctgaagatttcctggaagatgccaggaagatttttaacagggaa

SEQ ID NO: 76446 - DNA, 129 bp, Glycine max
  Peptide Sequence Number=SeqID_168131
atgaagtcaggtgacatgcggggttaccttatggttacccataccttttgtcaaccaggggcaaacgagcccgttgacgcaaggagagaaacatcgtgttctgcaccttttgtcgtcctgactcatgca

SEQ ID NO: 76447 - DNA, 195 bp, Glycine max
  Peptide Sequence Number=SeqID_168132
atgcagctattgctcttcctgcagcgtgtcttcccgcatatagcccggccgccgccgcagacaccaccaggaataaccggcgttgaacagcaccaccaaagcggtgacggcgaagaccgcgcgaaaaccgtagccggcggagaccgcggcgccgagcagcgggccgctgacgttgccgacgtcgcggaacgactg

SEQ ID NO: 76448 - DNA, 1365 bp, Glycine max
  Peptide Sequence Number=SeqID_168133
atgttaatcgacccttcaagcaaatatcgaccgttcccgccggtggcgttgccggaccgccaatggcctgcgcgtacgctgcggcaggcgccgcgctggtgctccagcgatctgcgcgacggcaaccaggcgctggcggaaccgatggataacgcgcgcaagcgcgagttctatcaattgctgttgcagtgtggttttaaagaaattgaagtggctttcccttcggcgtcgcaaacggatttcgattttgtgcgcacgctgattgacgagcagctgatcccggacgacgtcacgattcaggtgctgacgcagtcgcgcgacgatctgatcgaccgcaccttcgaggcgctgcagggggcgccacgggctatcgtgcatctgtacaacgccacggcgccgatgtttcgcgacatcgtgttccgccaggataaggccgccaccgtggcgctggcggtgaacggcgcgcggcgcattcgccggcagtgcgaggcacagcccgataccgcctggtgcttcgagtattcgccggaaaccttctgttttactgaattggagttcgcgctggagatctgcgaagcggtggcggcggtgtggcaaccggggccgcagcggccgatgatcatcaatctgccggcgacggtggaagtgagcacgcccaacgtgtatgccgatcagattgaatggttttgtcgccacttcagccgccgcgccgatgtaacgatcagcgtgcatccgcataacgatcgcggcaccggcgtggcctgcgcggagctggcgctgttggccggcgccgatcgggtcgaaggctgcctgttcggcaacggagagcgcaccggcaacgtcgatctggttacgctggcgttgaatctctatacccagggcgtggcaccgggcctggacttcagccgcctgaagcaggtggtggaggtggtggagctgtgcaatcagctgccggtgcaccctcgccatccttatgccggcgagttggtgtttaccgccttctccggttcgcatcaggatgcgattaaaaaaggcttcgccgcccagcgccaggatggctggtggcaggtgccttacctgccgctcgatcccgccgatgtcggctgcagctatgaggcggtgatccgggtcaacagccagtccggcaaaagcggagccgcctggctgttggaacaaaatcacgggctggcgttgccgcgcgcgcgcgaccgacggcagcggcaaggaaatgagcggcgcgcagctgtggcgcttattccgcgacacctatgggctggtggagcaaccgcgcttgcagctgctgagctaccagacggaaagccacggcgtagaggcctacagcttcaatgcgcgggttgcctgtga

SEQ ID NO: 76449 - DNA, 178 bp, Glycine max
  Peptide Sequence Number=SeqID_168134
atgggattgaggcttcagtcctcactttgtgctttaaaccgtgagcagaatcgtcttaggcaatggtcaaatgtcgggccggatccaaaggcggagaccaatcaaggatcaagatcgatagatcgtcgtcccatgcccagctctggacaagcggaaagcaccgctgggaagcagccta

SEQ ID NO: 76450 - DNA, 357 bp, Glycine max
  Peptide Sequence Number=SeqID_168135
atgactacaggatcatcggtctactctacctcaattcaccatttcgaactttatacagaaggtttttccgtaccagctccttctacctataccgctgttgaagcacctaaaggagaatttggtgtctttctggtcagtaatggaagcaatcgtccctaccgtcgtaaaataagagcacctggctctgcccattcacaaggactcgattctatgtccaaacatcacatgccagcagatgtggtcaccatcatagatcggtcgagtgtctccgttggagatgggattgcacgtgtttatggattgaacgagattcaagctggggaaatggttgaatttgccagcggtgtgaaaggatag

SEQ ID NO: 76451 - DNA, 246 bp, Glycine max
  Peptide Sequence Number=SeqID_168136
atgatcctgtcatcatggcagaacaagcgaaatagccaaatggctatactgctcagctctccttcgcctcctcctcctattggtgcagcatcgcattcgtcgtctatgttgaagcagactagaaaggcctcacgcctaagatcattggcaactagaccaattggggaaaagagacccttggtccatatggatcttgctactgacaaagcggacagtccccacatcaagaagttaagaacatattag

SEQ ID NO: 76452 - DNA, 243 bp, Glycine max
  Peptide Sequence Number=SeqID_168137
atgagtcatcattcatcttgtgttaatggtgagggtactagtcataaggatcctctacctagaatcttggatgagttgagttccctcaagttatgtgtcacaacgttccctttgcgggcgagcgaaggcgaggctcacgggtgcgctttccaaaggaggaaagatgcgcggagtcgccaccaacgtttatttgtggaaaacgtcagaaaaaccgaaggaaaccggtcaaaatggaaattctaa

SEQ ID NO: 76453 - DNA, 465 bp, Glycine max
  Peptide Sequence Number=SeqID_168138
aaaactgacttgactccttcatgcatgctccactcggctcggggggatatagctcagttggtagagctccgctcttgcaattgggtcgttgcgattacggaggaccgaaacatgccactgaaagactctactgagacaaagacgggctgtcaagaacgtagaggagaggatcaagctggcccttgcgaacagcttgatgcactatctcccttcaaccctttgagcgaaatgtggcaaaaggaaaaaagaatcccatggaccgaccccatcgtctccacccccgtaggaactacgagatcaccccaagggccccttcggcatccagggggtcgcggaccgaccatagaaccctgttcaaaaaagcggaacgcattagctatcccgctctcaggggggcgggggaagctctccgttcccggttctcctgtagctggatcctccggaaccacaagaatccttagttag

SEQ ID NO: 76454 - DNA, 180 bp, Glycine max
  Peptide Sequence Number=SeqID_168139
atggcatctgacccctacgatttgctatcggctggtcagtcaaatgacacatgtatgtgtgcatctagagctcgatcctatgcaagtgggctgagatggactccaaggatggtggctgatgtggaggtgtggtggtgcatctgtcgttggctgaatgttgctggatcctgctttggtgtg

SEQ ID NO: 76455 - DNA, 120 bp, Glycine max
  Peptide Sequence Number=SeqID_168140
atgccaccatggaagacgtgcagctattcgaactgcaagaataaggaggaacccaggaaggaagtgcctgatatggtagtggctgatattgtaattgttgttttgctgaagaatttgtag

SEQ ID NO: 76456 - DNA, 591 bp, Glycine max
  Peptide Sequence Number=SeqID_168141
atggtaggatcgtccattaactggttcccccgatggaaagaaggaggggcaggagtgttatgctcgtgtgaaggattcccaaacatccccttgatgggaatgaggggttgtattaattataatctcatgctggtcataagacaactaggctaccctatgagaggtgtaccatcggagaagatacttcaaagaatccgtagagcatggaatacagtggaaaggaaagataaggagcttaggggaagtagcaatggcgccatcggcggctatcacaagtggttgaagtctaggacgcaagggataacttggctcccaaagctaaaaggcctaagtgggaaagaagctgaagtccttgaggaaagtgaagaagtgcaagctttgaaagtggagctcgaaaaaatgagagtggtcaaggaggcgctaaatatggtagtcactagggtctggaaaaagtgtgatgtgctgagagatgtcaacatgactatggtcgaagccttagagcggaaaaaccaaaagggctcgaaaggaagaatggagcaggaacaagctctgaggggctttatggggcagcagcaacgagctcaagcttag

SEQ ID NO: 76457 - DNA, 102 bp, Glycine max
  Peptide Sequence Number=SeqID_168142
atggattattttaacgaccctataccattggagcttgagagattaaaagcattgcggatccagtgggcacagttttatctccgagttagagatcaggcctag

SEQ ID NO: 76458 - DNA, 336 bp, Glycine max
  Peptide Sequence Number=SeqID_168143
atgaagctcaaatttgggaaacttttgaagcatatcccttggaagaaagttatcgcaaccaactggcgagacatctctgtgaagataatacttcagaatactgatgatggtcaaatccaaacagagatttatgttctagaacttgagtttcaaaaggttgaagatttggttgatgaccattccgcattagaacaagactgggaagactacaatgctcaattgatggaagaattgttacacaaaaagaaatatcgttatcaccacccagtgtacgaaagtctcaccagatcagaggcacaacattataacttgtcattatccaccagatcagactag

SEQ ID NO: 76459 - DNA, 168 bp, Glycine max
  Peptide Sequence Number=SeqID_168144
tgtgttagcagctcaatagtgagtgactcttctttcttgggagaccccactgttcctttctccgagggcaaggatggaaattctcatcctaggtcaaggtttatgctcagggataaggggaatgtcccacattatttccatgacatgcatgtaacaatgatgatttag

SEQ ID NO: 76460 - DNA, 213 bp, Glycine max
  Peptide Sequence Number=SeqID_168145
atggcggtggtgggaacaacaggtagctacggtgggcacgacggaggtcagggaacggcgattgatattacttgtcatgggttggacctgaatcaggaaggtgaggcccaaacggattcttcggagtctaggccttggggtaaagatactcggtttgagtgctcctttaagcccatgttgatcccatgtggttggggcattctcacaaaatag

SEQ ID NO: 76461 - DNA, 141 bp, Glycine max
  Peptide Sequence Number=SeqID_168146
atggaggtggtttctgcccagagacttcttgaggtggtactagtaccaaaagttcaagtctattgcctcaatgaagatttgcattcgggttttccagtagtggtaaccctctccattaaaaatatgaggcctatttattga

SEQ ID NO: 76462 - DNA, 894 bp, Glycine max
  Peptide Sequence Number=SeqID_168147
atgaagagtctgtatatcgaggatcttaaaaaactggaattcccgacgcaacacaaacatgagttactggaaacactgtcaatagaaagcagttgtgattcactcacatctcttccattggttacctttccaaatctcagagatgtcacaatcggaaagtgtgaaaatatggaatatcttttggtttcaggggcagagtcatttaagagtctgtgttctttgagtatttaccaatgccccaactttgtatcattcgggagagaaggattgcctgaagagatgagtactcttctcccaaagttagaagatctttacatatccaactgcccagaaattgagtcctttccaaaacggggtatgccacctaacctgagaacagtttggattgtgaattgtgagaaactactgagcggcctagcatggccatccatgggcatgcttactcatctcaatgttgggggtcgatgtgatggcatcaagtccttccctaaagagggtttgctgcctccctcccttacgtctctgtatctatttaagttttcaaatctggagatgttggactgcacagggcttctccatctcacatccctgcaagaattaaccatgaggggatgtcctttgctggagaatatggctggagaaaggcttcctgactctctaataaaattaaccatatgggaatgtcctttgctggaaaaacgatgccgcatgaagcaccctcaaatttggcctaaaatttcccacatccctggcattaagagaatcaacaaatcatcaaaggcaacgtggaaattgaccttgtatatatgtttagaagaagtaacgatacagatatggttgattggcccggagaaactgtacctatccatgaatctaagttcaaatttgaactag

SEQ ID NO: 76463 - DNA, 597 bp, Glycine max
  Peptide Sequence Number=SeqID_168148
atgacctcccgcaacctcgatgaggcccttattcgtcttgacaataccatgcactctatgaccctcaacatggacaagcttctcaaccgccttgctcttgtgccttcctccaccacacccaaccccacaccagtccctcaccactccacctttgttcctgtacaaatccggtatgccccatcaccgtatgaggaccctaattatcggcttgtcggcccccttcctgttgccttgcttcatctcgggtttgacgctggagatccgctgcgcagtccaggcccatcagcctatgactgtggaccaggtcgccggcctcgcgaagatccaggagcagaagttgttagaccttcgtcttcctccaccgcggtcgcgaccccaccgccagcccctttggttccccctcgtatcacgcctttgccccctttgctgccttccccaccacaggctccaaccatcaagcgtctcaccccggaggagttagcctcacgccatgagcacgggctgtgcttcacatgcgatgagaagttccatagaggccatcaatgtgcctctagggttcatctcttaatcgcagaggatgaggaacctgcagactag

SEQ ID NO: 76464 - DNA, 558 bp, Glycine max
  Peptide Sequence Number=SeqID_168149
atggaatatcttttggtttcaggggcagagtcatttaagagtctgtgttctttgagaatttaccaatgccccaacttcgtatcattctggagagaaggattgcctgcgcccaacttgattaatttcagtgtttggggctctgacaagttgaagtcgttacctgatgagatgagtagtcttctcccaaagttagaatgtctcggcatatccaactgcccagaaattgagtcctttccaaaacgggatatgccacctaacctgagaacagtttggattgagaattgtgagaaactactgagcggcctagcatggccatccatgggcatgcttactcatctcaatgattggggtcgatgtgatggcatcaagtccttccctaaggagggtttgctgcctccctcccttacgactctgtatctatttgacttgtcaaatctggagatgttggactgcacggggcttctccatctcacatccctgcaacaattagaaattaagaaattaagagatgtccaaagctggagaatatggctggagaaagtcttcctgtctctctaa

SEQ ID NO: 76465 - DNA, 921 bp, Glycine max
  Peptide Sequence Number=SeqID_168150
atggcactactaatagaagcaaccgtgggagcaacagtgggagctgtgttcagcagagttgctgagaactatagaacagcaaaacaacgagttgcagcttccgatggaggaactccaatcgtttatcagaaagatggaggaggggacacaacttgttttcgagtgttcaaaaatccggtggctacactttgtgacttgggcttgttacaaggacaaactggaccggttttccgacgagctcgtgaaactatttgccatcgacatgcaagctcagatggcaagagatcagaggagacattgcttaaggttaggagaatacttagggttgttgagaaaacgtgcttcgacccttgggaggcaattgaaaacacgctgttaatgtttttgacgtggatttctgtctttgctgtgaagctaataagtgcaatttctgccttgagatggatttttccgacgctaataagggtagcttttacgttttcttctactaaacgggagcagtttccgactctacttgctctctgccaggagtctcacagttttttggggagagtgactgaaatcgttagtgtgtcctggctaaaaatcctgggcaggatcaaaactgggatgttgtccccagatacattgtacgaggcttaccttgtgtttaaagaaagcagtgatggtgcctacgggttcaagaacatgccctttgaggtgaccattggggttatcggagaggttacagattcaagaattatgaacttggtagtaggaagctcagagtcaaatatccgaaggagagtgacgatggtggatcaaccttcttggccaatggatttcgggatactcaggatcatgtggactggattgtgtaccaatctcaaggctgtgaactccttgccatcttttatggtctctgtcatgtctgcaatctag

SEQ ID NO: 76466 - DNA, 1523 bp, Glycine max
  Peptide Sequence Number=SeqID_168151
atggatcgtcaacggacagcgcttaaagatctaatatggaggacaactagagaagttgacgaccgtcatgcacttaaaagatcctttaaagaagccctatgtctagctaaagacattaaactaagcgctggttgggaggcaacccaacatatttatttaaggtgcaaacagcaaacagggggtacgaaaagcaaaggcccaacaggtgaagacagcaaaaggaggggtaccaatagcaaattaaagtgggctacacgaagccacgcgcttagcgcgcgactacgcgctaagcacccaggtctcattgcgctaagccttgctcaaggcttagcgaatgctgacggactggaggccataaggacgagcccatggcctcccgtaaacgctgagcagtgcccacacctggggaagcgtccaactatgactcttcccacttcacttcagagatcacttggcacaggtaccaagacaacattcagctttggaacatccttccggaaaggaatgttgagcttggacccgggatgttcgatgagttcctccaggaacttaggcgacgcagatgggaatagggtgcgaggacaggtcgttcgctttaacgctgacacgattaacgaattcctcgacaccccagtcatccaagaggatggtgaggagtacccagcctacaccagatatcccagcactcatcccgatcctgacaccatcgccgccacaatatgtactccaggggggcatttcattctaaacgtcgatggtctcccctggaagctgttgaggaaggacatgacgacacttgctcagacatggagtgtcctctcttattatgatcttgcacccacttctcacacatctgatgttaatcttgacagggcacgcttgatctacgacttagtgagatggatggatatggacgtgggcaactttatatctcagcagatcagtcagattgcccagtccagtacctcgcggcttgggttcccggcgttgttcacaacgttgtgtgacattcagggggtggtttctgataccctaatctttgagtcactcagccctacgatcaaccttgcatacgtgaagaagaatttttggaactccgccgatccatccattacatttccaggggcccgccggactcgcaccagagcaccagcatccacatctgaggcaccccctacttctcaaccttcctccttgcgaccacagcctccacttccatcaactgccgcaccttcagacatgcagggacaaatgctcaggtacttgtaccagggacagcagatcatcattcaggacctgcatcgcttgttcctccacttgcagatggattcgtcgctcacgactccggaggcctatcgtcagcaggtcgcctggccaggagaccagccctccactgacaggggggaagggccttctagagccgccgctacggaggatcctgcagttgatgaggacctcatggttgacttagctggcactgattggggcccatgggcagatttgggaggcggcgcaggacacta

SEQ ID NO: 76467 - DNA, 744 bp, Glycine max
  Peptide Sequence Number=SeqID_168152
atgttggagtccatgatcgaggcaatcactaacatccaaccaacttgtctccgagatgtcacaatcggaaagtgtgaaaatatggaatatcttttggtttcaggggcagagtcatttaagagtctgtgttcttttagaatttaccaatgccccaactttgtatcattctggagagaaggattgcctgcgcccaacttgattaatttcagtgtttcgggctctgacaagttgaagtcgttgcctgaagagatgagtactcttctcccaaagttagaatgtctctacatatccaactgcccagaaattgagtcctttccaaaacggggtatgccacctaacctgacaacagtttcgattgtcaattgtgagaaactactgagcggcctagcatggccatccatgggcatgcttactaatctcactgtttggggtcgatgtgatggcatcaagtccttccctaaagagggtttgctgcctccctcccttacgtctctgtatatagatgacttgtcaaatctggagatgttggactgcacggggcttcctgtctctttattaaaattaaccatagagagatgtcctttgctggagaatatggtgggagaaaggcttcctgactctctaataagattaaccataaggggatgtcctatgctggaaaaacaatgccgcatgaagcaccctcaaatttggcctaaagtttcccacatccctggcattaaggttgacgatagatggatttag

SEQ ID NO: 76468 - DNA, 507 bp, Glycine max
  Peptide Sequence Number=SeqID_168153
atggcctcccgcaacctcgacgaagcccttgtccgtcttgacaataccatgcactctatgaccctcaacatggacaagcttctcaaccgccttgctcctgtgccttcctccaccacgcccaaccccacactagtccctcgccactccacctctgttcctgcacaaatccgatatgccccatcaccgtatgaggatcctgtcggtgccttgttcaaactcactcacacgggttcagtgctaacatacctgaaggagttcgaagacttggctaatagaattatcggcttgccgacccccttcctgttgccttgcttcatctcgggtttgacatcggagatgcgccgcacagtccaggctccgaccgtcaggcatctcaccccggaggagttagcctcgcgccatgagcacgggctgtgcttcacatgcgatgagaagttccatagaggccatcgatgtgcctctagggttcatctcttaatcgcagaggatgaggaacctatagactag

SEQ ID NO: 76469 - DNA, 276 bp, Glycine max
  Peptide Sequence Number=SeqID_168154
atgaactatcgcatagctaatctatttgttcggggtcttgaagttaaagcttggaggacaaaacaaagtagtgtacaagtacttggtgctatggcataccgtgctcctcagcatttgtctcggtgtctccctaagattgttcccaaattggctgagtatttgaaggttttgactgatacacatcctaaagtccagtcagctgggcaaatggcccttcaacacgtagggaatgtgatagagtccagaaatatctggtcttatccctactctacttaa

SEQ ID NO: 76470 - DNA, 60 bp, Glycine max
  Peptide Sequence Number=SeqID_168155
atgatcagagtagaaagacaaaggcaaggaattggttgctatgaactggattggttcttc

SEQ ID NO: 76471 - DNA, 474 bp, Glycine max
  Peptide Sequence Number=SeqID_168156
atgattgctcacatcccagatccaagggttgatccttctcaatatcgtgatttagtacattattggtgttctgagaaaggacagaaaataagcaacatcaacaaaaggagctgctcaaaatatgaggacttgcattgcatgggaaccaataatcttccaagacggattcatgagatgactacaaaggctaagggagtgcaaccttctagggcagaaatttatattgacactcgaactcgaaaagatggaagcattgttactgaaaaggctgctattgtaattgatgaactaaaaaagaaaatggttgaagcagagagagttcgcaaaatttacaaagcacccaagattctactgattggacaaatgatatatattcaaaagtcaaaggacctgaaaaaagaggacgtgtgcgttgtcttggcaagcttccacatcaagcaagttcatctcaaagctcttatacaaacaatataa

SEQ ID NO: 76472 - DNA, 450 bp, Glycine max
  Peptide Sequence Number=SeqID_168157
atgggaaagcgcagaaagttgaatatcattcagaatgatggtcaatcacaagcaaaagagcaatcaattgaaagctctactgaagtgaaccaaaataacaactctatacttgaagaaaatgcacaatttgaaggagaacaacacatacaagaagatagtcatgttcagtctcatacttctcttgaaagtgcaagtgaaagttcaactaaagataaaaagagaaccagaggttatacacatatgctagatgtgtgggacttgccagatggagaattcatacttgttgaagtagatcattggggcaatcctatgggttgggaagggaaaactctactgaatgcaattgggagcttggtaaggagacaccaatgtgctcctatcaattttgttagctggaaagacatacctaaggactatattactgacatggttgaattaattcaggtctga

SEQ ID NO: 76473 - DNA, 294 bp, Glycine max
  Peptide Sequence Number=SeqID_168158
atggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgagcgctctcctgttcctgcctttcggtttaccggatgtcattccgctgtatggccgcgtttgtctcattccacgcctgaacactcagttccgg

SEQ ID NO: 76474 - DNA, 909 bp, Glycine max
  Peptide Sequence Number=SeqID_168159
atggcactactaatagaagcaactgtgggagctgtgttcaacgagtcgctgagaactgttttggaatttaaaaacaaaacggtttgcttcaaatcatctttggtgcacctccaatccactctagtagctatatctccggtgatcaaggagatagaacagcaaaacaacgagttgaagcttccaaaggaggaacttcaatcgtttatcagaaagatggaggaggggacacagcttgttttcgagtgttcaaaaatccggtggctacactttgtgactagggcttgttacaaggacaaactggaccagttttccgacgagctcgtgaaactatttgccatcgacatgcaagctcagatggcaagagatcggaaggagaccttgcttaaagttaggagaatacttagggttgttgagaaaacgtgcttcgaccctggggaggcaattgacaacacagtgttaaggtttttgacgtggatttctgtctttgctgtgaagctaataagggtactcggagggttcaagaacatgcccgttggggtgtccattggggttatcggagaggttacagattcaagaattgtgaacttggtagtaggaacatggcggaagctcggagtccagtatccaaaggagagtgacgatggtggatggagggaagaagggaaatatgctaagctaatactgggaatgagtttctctgctttattcatgagtggacttgttcttttatacatgtcctcgaggtgtttaggacgtgagacttcccttcgtggtcatgccatcggaacgcaaccttcttggccaatggatttcgggatgctcaggatcatgtggactggattgggtaccaatctcaaggctgtgaactccttgccatcttttatggtctctgtcatgtctgcaatctag

SEQ ID NO: 76475 - DNA, 199 bp, Glycine max
  Peptide Sequence Number=SeqID_168160
tgtgatcgtcaactctcctactggaaggtggaaggtgttggtctccctgtgccacctctccacaaatgtggatataagtccaggatcgccagttacaactaaacacccgatcaatggacttaatcctgtggtgggaaccaacccttcaatctcaggcactggcgtcccaattaatgctgttgaggatatacttttgtaa

SEQ ID NO: 76476 - DNA, 1260 bp, Glycine max
  Peptide Sequence Number=SeqID_168161
atgccgagaggaatgagtaaattaaatcatttacaacatctggatttctttgctgtgggcaagcacgaagagaatggaatcaaagaattgggaggactttcaaatctttgtggtgaacttgaaattaggaagttggagaatgtttcccaaagtgaagaagcgttggaggcaaggatgatggataaaaaacacattaatagtttacagttggaatggtctagatttaacaacaacaggaccaacttccaacttgaaatagatgtgctttgcaagttacagcctcactttaacattgaatcgttgcaaataataggctatgaaggaaccagatttccagattggatgggaaattcttcctactgcaatatgattagtctaaaattgcgtgattgtgacaactgtagtatgcttccttcacttggacaactaccttctctcaaggtccttgaaatttcagtattgaataggctgaagactattgatgcaggtttctacaagaatgaagaatgtcattctgggacgtcctttccctcccttgaatctctggccttttatggcatgccttgctgggaggtgtggagttccttcgattcagaagcttttcctgtgcttaaaagtctttacatacgtgactgccctaagctagagggaaatttgccgaatcaccttcctgttctgaaaaaacttgcgattaagtattgcgagctgcttgtctcttctctcccaacggctcccgccattcaaagtttggaaataagtgaaagcaataaagtagcactgcatgcgttacctctattggtagagactatagaagtagaaggaagcccaatggtggagtccatgatggaggccatcactaacatccaaccaacttgtctccggtctttaacattaagggattgctcgtcagccgtgtcatttccaggtggtcgtttacctgaatcactgaagagtctgcatatcaaggatcttaaaaaactggaattcccgacgcaacacaaacatgagttactggaaacactgtcaatacatagcagttgtgattcactcacatctcttccattggttacctttccaaatctcagacatctcataatcgaaaagtgtgaaaatatggaatctcttttggtttcaggggctgagtcatttaagagtctgtgttctttgagtatttacgaatgccccaactttgtatcattctggagagaaggattgcctgcgcccaacttgattaatttcagtgtttcgggctctgtatag

SEQ ID NO: 76477 - DNA, 303 bp, Glycine max
  Peptide Sequence Number=SeqID_168162
atgaagttggtagatagactgccaaagttagctaacgattgtaatgaaaagtggaaccacatgcatctgataaagcaccaagatggattactccacagtacatgtggtacccctgcctatgttgctccggaagtgataaacagaaggggttatgatggagccaaagctgatatatggtcatgtggggtgatcttgtatgttctattggcaggggagagttcaaatttcctaactggtttgcaccagatgtacgcagattgctgtcgaaaatcatggaaagctcttggttcaaaagggggctag

SEQ ID NO: 76478 - DNA, 96 bp, Glycine max
  Peptide Sequence Number=SeqID_168163
atgcttgcaaaggctgtagcaactgaagctggagcaaatttcattaacatttcaatgtccagcattacttcaaagaggagtgggaatgcgagatag

SEQ ID NO: 76479 - DNA, 315 bp, Glycine max
  Peptide Sequence Number=SeqID_168164
atgggggagggatgttgtacgcagccttacccttgcatatgcaaagaggctgtttccggattcgaacccatgaccaacaggtcaccaaggcacaactttaccgctgcaccagggctcgccctcaacttgcaccatggaggaaagagtgggacttttgtttctgattttgtcatgcaagagaggagtgacaggttcatattagcttttaaccatcaatggaaaactggtaaaaagaaaaggctggcactaacaaccagttatttgtccataggaaaggaagcttgggcccaattgaaggatgttgtggaaaattag

SEQ ID NO: 76480 - DNA, 315 bp, Glycine max
  Peptide Sequence Number=SeqID_168165
atggggcagggagtgataaggaagcgtgataacatagcagacaaagggatgtattcaaaagaaatagatgcgaatcaagacatagcaactataggggtgtctacagcaaagaagggtgtaaatcaagcagaaaaggaggtgcaagcagcagtcaataccaaaagaaagatctcaaagcctgcttaccttaaggactacaactgttggaatttgaatcagtgggaacttgcagcaagcaagcaacagaagcaggggatgcaattagaaaacaagatcaagagagcaattacaaggcccacttacctcaaggattag

SEQ ID NO: 76481 - DNA, 1671 bp, Glycine max
  Peptide Sequence Number=SeqID_168166
gtcgactctagaggatcccccatggagaatgtttcccaaagtgatgaagcgttggaggcaaggatgatggataaaaaacacattaatagtttactgttggaatggtctggatgtaacaacaacagtaccaacttccaacttgaaatagatgtgctttgcaagttacagcctcactttaacattgaatcgttgcaaataaaaggctataaaggaaccaaatttccagattggatgggaaattcttcctactgcaatatgacacgtctaaccttaagtgattgtgacaactgtagtatgcttccttcacttgaacagctaccttctctcaagttccttgtaatttcaagattgaataggctgaagactatcgatgcaggtttttacaagaatgaagattgtcgttcttggaggccctttccctcccttgaatctctgttcatttatgacatgccttgttgggagttgtggagttcctttgattcagaagcttttcctttgcttaaaagtcttagaatacttggctgccccaaactagagggaagtttgccgaatcaccttcctgctctggaaacactttatattagtgattgcgagctgcttgtctcttctctcccaacggctcccgccattcaaagtttggagataagtaaaagcaataaagtagcattgcatgcgttacctctcttggtagagactatagaagtagaaggaagcccaatggtggagtctatgatagaggccatcactaacatccaaccaacttgtctccggtctttaacattaagggattgctcgtcagccgtgtcatttccaggtggtcgtttacctgaatcactgaagactctgcgtatctgggatcttaaaaaactggaattcccgacgcaacacaaacatgagttactggaaacactgacaatagaaagcagttgtgattcactcacatctcttccattgattacctttccaaatctcagagatcttgcaatcagaaactgtgaaaatatggaatatcttttggtttcaggggcagagtcatttaagagtctgtgttctttgagaatttatcaatgccccaactttgtatcattctggagagaaggattgcctgcgcccaacttgattactttcaaagtttggggctctgacaagttgaagtcgttgcctgatgagatgagtactcttctcccaaagttagaacatctttacatatccaactgcccagaaattgagtcgtttccagaagggggtatgccacctaacctgagaacagtttggattgtcaattgtgagaaactactgagcggcctagcatggccatccatgggcatgcttacccatctcagtgttgggggtcgatgtgatggcatcaagtccttccctaaggagggtttgctgcctccctcccttacgtctctgtatctatatgacttgtcaaatctggagttgttggactgcacggggcttctcgatctcacatccctgcaaatattacacatagacaattgtcctttgctggagaatatggctggagaaaggcttcctgtctctctaataaaattaaccataatgggatgtcctttgctggaaaaacgatgccgcatgaagcaccctcaaatttggcctaaaatttgccacatccctggcattaaggttgacgatagatggatttag

SEQ ID NO: 76482 - DNA, 570 bp, Glycine max
  Peptide Sequence Number=SeqID_168167
atgagtgtggccattaagattactgacaaggagaagattctgaaagttgggatgattgatcagattaagcgcgaaatttcagcgatgaggctaaccaggcatccacatgtggttgagctttacgaggtaatggccagcaaaaccaaaatttactttgttatggagtatgtaaaaggtggtgagctcttcaataagcaattgatcagcgctgttgactactgccatagcagaggtgtgtgccatcgtgatctgaaaccagaaaatcttctactggatgaaaatgggaatataaatggattactccacactacatgtggtgcccctgcctatgctgctccggaagtgataaacagaaggagttatgatcttgtatgttctattggcaggggagagttcaaatttcctaactggattgcaccagataacttttggaatttgaatcagtgggaacttgggaagactggaaaagccaaaaacggccccacaagtgatagcgtagcaaaggaacctgttgcagaaacagaggatgagaatgcagcaagcaagcaacagaagcaagggtgcaattag

SEQ ID NO: 76483 - DNA, 403 bp, Glycine max
  Peptide Sequence Number=SeqID_168168
atggcaagagaccagaaggagatcttgcttaaggttaggagaatacttagcgctgttaataaatttcccttccacacagttgatgcatctaaccctgaagaaaatacaattctatgtcctcgtaggtgtcgtggatgcaaacaacgttggggtgctcagagaggtggtgcatacgtcatcgggcgtcccgtggcgttgtgcgtgcagaagaaggtgggctttggtggtaaggccgcagtggtgccggtggtggagtttgacattgtgttcgagagagagacagagtcagtggtctcacacatcactgctgctattaaagattggattgagggtgttgtgattcccgtggatggaaaggagggccctgcagatgtttgtgtgattgaactgggaggcactgtgg

SEQ ID NO: 76484 - DNA, 1392 bp, Glycine max
  Peptide Sequence Number=SeqID_168169
cacgaagagaatggaatcaaagaattgggaggactttcaaatcttcgtggtgatcttgaacttaggaacatggagaatgtttcccaaagtgatgaagcgttggaggcaaggatgatggataaaaaacacattaatagtttacagttggtatggtctggatgtaacaacaacagtaccaacttccaacttgaaatagatgtgctttgcaagttacagcctcactttaacattgaatcgttgtatataaaaggctataaaggaaccagatttccagattggatgggaaattcttcctactgcaatatgacaagtctaaccttacttgattgtgacaactgtagtatgcttccttcactaggacaactaccttctctcaagaaccttagaattgcacgattgaataggctgaagactattgatgcagaagcttttcctgtgcttaacagtcttgaaatacgtgactgccccaaactagagggaagtttgccgaatcaccttcctgctctgaaaagacttacaattagaaattgtgagctgcttgtctcttctctcccaacggctcccgccattcaaagtttggagatacttaaaagcaataaagtagcactgcatgcgttacctctcttggtagagactatagaagtagaaggaagcccaatggtggagtccgtgatggaggccatcactaacatccaaccaacatgtctccggtctttaacattaaaggattgcttgtcagccgtgtcatttccgggggcagagtcatttgagagtctgtgttctttgcacattcatcgatgccccaactttgtatcattctggagagaaggattgcctgcgcccaactttattaatttgaccatatcagagttgaagtcgttgcctgaagagatgagtagtcttctcccaaagttagaatgtctcgaaatattcaactgcccagaaattgagtcctttccaaaacggggtatgccacctgacctgagaacagtatcgatttacaattgtgagaaactactgagcggcctagcatggccatccatgggcatgcttactcatctcagtgtttggggtcgatgtgatggcatcaagtccttccctaaggagggtttgctgcctccctcccttacgactctgtatctatttgacatgtcaaatctggagatgttggactgcacggggcttctccatctcacatccctgcaacaattacaaatttttggatgtccaaagctggagaatatggctggagaaagtcttcctttctctctaataaaattaaccatggtggaatgtcctttgctggaaaaacgatgccgcatgaagcaccctcaaatttggcctaaaatttcccacatccctagcatttggttttacggtagattgatttag

SEQ ID NO: 76485 - DNA, 636 bp, Glycine max
  Peptide Sequence Number=SeqID_168170
atgggtataggcgtcatcatcttgatgtgtctaagagatattaggcataacaaattcgaatattctttaataggaacagtagaaacaagcctagaacaaggaccagtctatttcaactgttacccaaacaaaatagtgagtctgatggatagaaacatccttaactctttattcctaaatatctactttcatggcatcgacatgaaagagggttcaattctggcaactgtaatttacagaatccagtataaggtcatgaacacttgtgcatcaagagtccttctgaaaccccaaaaaggagagacaactttgtttatcactgatatgacaaagactaatgtttctctccccagaattataaaatgggatgaagtaactcttcctgaaaaatgggtcatggataaggctacgccttcagtccccagacctgcccctaccatagaacaaattaaacaagataattgtggattatctagatctgagtcacataaccagttttctagcataaacctcaaagaattagatacgatctctagtatacctagaaccatgtacaatcaagaaccagaagatgaccaaaagtcaattcaatctctaacatattcttctatccatgaaccttatgatgttatctga

SEQ ID NO: 76486 - DNA, 192 bp, Glycine max
  Peptide Sequence Number=SeqID_168171
atggcgatgcaagactcacgggtgcgtcttccaaggaaggaaaaattgtggagtctccaccagcgtttatttgaggaaaacgttagaaaaaccaaaagtgggtctacaaattttaagaacaaaggttcgggagttgtttacatgcggggaaggttcgacaagagtggggctcttgctcctacgtatccttaa

SEQ ID NO: 76487 - DNA, 644 bp, Glycine max
  Peptide Sequence Number=SeqID_168172
atggttaaatcgatgaaaaagcgaaaggtctcttccaccaccaccgccgctgctagccatcaacgccacagaccatctaaagcacccacaacaccagttcctccttccttaatcatattagaccctaagtacctagacatagctttctttgatgatgagacatttgactgctatcaattgcctcattatcctgaactagttagagtattttacaataacttaagaattcaggataatacactttactcagaggtgcatggtattcctcttgtcattgatcaatctttgtttttctcattgactaaattacccagtcaaggtgttccttttgagggcactgttgtcgatgactggaagttcgattattcgagtcatgatgctcgtcgtatggtctgtaatgaccaggctgatatgaccggtagatttcttgtcgggtcattaacctttgatttccgcatcatgcactacatcattgttagaattttgttaccccgttcgtctaatcttgctcaagcctctgaggaggacttgattttgatgtgcgcttttcttatcgatcgtcagattgactgggcccgggcccacttggttaagtaccgtatgcataaggcattatggaccaatgcacctcttctatatcctca

SEQ ID NO: 76488 - DNA, 761 bp, Glycine max
  Peptide Sequence Number=SeqID_168173
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttctgctttctggtctcttcctgcacgcaagacccaccttcatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 76489 - DNA, 885 bp, Glycine max
  Peptide Sequence Number=SeqID_168174
atggcagagccatcgaagaagagaaagggatcatcctccaccgccgctgctgcccatcgccaccacagaccatctgaagcatccacagcacctattcatccatctttatcatccacattgttttcttccgatgatcagcgtctacgtcaaggtgcaccttttgagggcaccattgttgatgactggaaatttgattattctagtcatgatgctcgccgtatggtctgcaatgaccaggctgaaatgaccggtagattgctgaccggatcattaacttttgataatcgcatcatgcattatatcattgttagaattttgcttccccggtcttcaaatttagcacaagcctctgaggaggatttgattctgatgtgggcttttctcaccggtcgtcagatcgactgggcccatttggttcggtaccgaatgcataaggcattacgaaccaatgcacctctaccttacccacagttgataactttgtttctgcgtcattttcaaattccgcttgatgatgagccatttgttcaagtcaagcgttcctttgcaattggtgctggtgttgtgacttcctttggttaccgtaaggatcagaatggtcaatggctgaagaaagacgcactccctcctcaagatgagcgtactccttcacctcctcctcagcgtgaagattcagcactcctgaatgaagtccttaccgaattacgaggtcttcgttcttatgttggtgaacgtttcgactcattggatacacgctttgccgtcatggatattcgcctcacacaagttgaagatgtctcctttatccgtacttgctttgatccaccaccaccgcctccatcatcctctagattaattgttattattatgactaagtcttattag

SEQ ID NO: 76490 - DNA, 327 bp, Glycine max
  Peptide Sequence Number=SeqID_168175
atgtttgaaacccatcgtcgtggaatacataaagttctgggatgtttcagagagaaatcagccaaaaacatgaaaacgagagtgtatttagcaaagtgggtgtgtgtaaatagactattacatccaaatttcatctgggcaccattgttaatcacttcggaaggcttaacacccatcgccatggaatccgtcaagctccgtgaggtttcagaaagaaaacatccaaaaaacaaaaaaacaggtggaagcaacctagctcgcctaggtgagctaggcgacaaccacctaccccattttgttgaaaaatggcatccagggcttccgtaa

SEQ ID NO: 76491 - DNA, 564 bp, Glycine max
  Peptide Sequence Number=SeqID_168176
ccaacaagcccgttgacacgcggagatttacgtcatcttccgcgcagacaatttctgtcatactgaccttggagtcacgtgacatgcggagatacccgagtgaggcggcggacccaatgacatgcgggaaccatttggtccaacacctttttgctatctataagactcaaagcatgatagcgagcagagacaaacgtcgtcttctacgccttttgtcatccagaggcggcgggcccaatgacatgcgggaaccatttggtggcgggcccgatgacatgcagttatccgcacgctcgatgagtgataaacgcgcagagacagattctgcgccctttatcattcaggagcagcgagtcgactggaacagcaagttgggtggtaaacacgcagagacggattctgcgccctttatcattcaagagcagcaaactgagtggataaacgcgcatagacgaattctgcgccctttatcattcaggaacatcaagaacaacaagttgggtggtaaacgcgcagagacgaattctgtgcccttttattcattcaggaacagcaagttgggtg

SEQ ID NO: 76492 - DNA, 81 bp, Glycine max
  Peptide Sequence Number=SeqID_168177
atggagaaaaatgaagaaacaacaatggagagagaaggggaagataaaggagaagaggtgagaggaggtgtcatccactaa

SEQ ID NO: 76493 - DNA, 525 bp, Glycine max
  Peptide Sequence Number=SeqID_168178
atgtgtagaaactgccggaaatcgtcgtggtattcactccagagcgatgaaaacgtttcagtttgctcatggaaacggtgtaacaagggtgaacactatcccatatcaccagctcaccgtctttcattgccatacgaaattccggatgagcattcatcaggcgggcaagaatctgaacggtctggttataggtacattgagcaactgactgaaatgcctcaaaatgttctttacgatgccattgggatatatcaacggtgttggaacctcttacgtgccgatcaacgtctcattttcgccaaaagttggcccagggcttcccggtatcaacagggacaccaggatttatttattctgcgaagtgatcttccgtcacaggtgctccagtggcttctgtttctatcagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 76494 - DNA, 462 bp, Glycine max
  Peptide Sequence Number=SeqID_168179
atgcacgaacagtgcttggcaatcaattcgtggggcttcggactcgatagtggaggatgcatgaatggtaatcaattcatggggctccgaataagatttgatggtggaggatgcacgaacagcgcttggcaatcaattcgtggggctccggactcgatggcaatcaattcgtggggctctaaactcgatggtggaggatgcatgaacaacgaccaattcatgggactccgaataagattagatggtggaggatgcacgaacaccacttggcaatcaattcgtggggctccgaactggatgcgcttggcaatcaattcgtggggctccggacacgatggtggaggatgcatgaatgacaatcaattcatggggctccgaataagatttgatgatggaggttcaacgaacagcgctagggaatcaattcgtggggcttcggacacgatggtggaggatacatga

SEQ ID NO: 76495 - DNA, 342 bp, Glycine max
  Peptide Sequence Number=SeqID_168180
atgtcgctaagcgatagtgtttattttgtgaagatggcctctaggaagcgtaaaagcattggggcaaggccaactgctcagtatgataccagacggttccattcacttgattcttggaaccggtatacagataacgttttgggaagaagcattttaccaaagaaaatggttaagatataccacacagagtttcatgacttcaagacagagttggagagtgatgcaatcctccctaggaaaggaccagttaccagagccatgagcaagaggctccaagaggattgggctagggttaataaagaaggccttagggttctcatgaaccttagggtagatttttga

SEQ ID NO: 76496 - DNA, 429 bp, Glycine max
  Peptide Sequence Number=SeqID_168181
atgcatgccaaagctagagtgatgagtgaaatagaggaggtgcaagagcagatgaaggccgacatggaggccatgaaagagaaaatgaccacaatgatggaagccatgatgagtatgagaaaaatgatggaggccagtacgactacagtcactgctgcaagtaccactactgaggttgacccggctcacccatctagcctcaatcaagtaaatagtccagtctcagatatggtaggccagggaggcataacattgggatgtacgggtggcccctattttgtacaggtccagagcaagcatctcttcccaccatatggcttgcctcccaactctacaccacccaacgttgtacacgctcccgatgagaatgtcaacaactccgcacctatacccattaagggccgacaaccccaatctggccatgcatag

SEQ ID NO: 76497 - DNA, 210 bp, Glycine max
  Peptide Sequence Number=SeqID_168182
atgactcttccttgtaaattgactttccaaacatttgtcttcgtaggaaatggctccgaaaaagctttccacgaagaggttgtcgcaacctacccttcggcgggagggcgacgcgtggctcgcgggtgcgtgttccaagaatggaatacgcgcggagtcgccaccaacgtttatttgaggaaaacgttggaaaaaccggaaaagacgtga

SEQ ID NO: 76498 - DNA, 229 bp, Glycine max
  Peptide Sequence Number=SeqID_168183
gaaaaatattgaacattttgaaaatcttgcaaaggttcaagccaagaatgatcaagaaaatattagtgataaattgtctggggttgatcaggggactagttataattcaaacaatttggttaatcaggaagtgatagaaactgtggttgtaattgagtatattcagaccaagtatgtgtcaatgaagataatacgaaattgggagcaaaagttgatgaatcgggggtga

SEQ ID NO: 76499 - DNA, 435 bp, Glycine max
  Peptide Sequence Number=SeqID_168184
atggttaacaaggagtgtaaggaggtaagtgtctcctccaagagaaaaacttcccctcttagacaacctcctcattttctcgtttgcaaaaagacacttgttagcactgccacatctcttgggcttgaggttattcctcaagtaaagaagttgttggatgagggtttggttcgtaagagcttaaatccttgtgctttgttggtgcccaaaataggtgtcgtggaaaggagcccagagtatgaagaacctcgagatttgaggtcaaatcctttccaaggcagaggggatgatgcaatcctaccccccaagggacagactgttgttgttgtggaggacttgcccatcttagatttggatgatttctccaacctggattgtatctgttgcttgaaagatcataattattctactgttgttgattttgctgctgagggg

SEQ ID NO: 76500 - DNA, 243 bp, Glycine max
  Peptide Sequence Number=SeqID_168185
atgggacagcttagtgatcaaggggttcccaaggaccctaaaagaataaagatcattcctgattggcccactccaccaagtgtcaaggtaaggagcccagagtatgaagaacctcaggatttgaggtcaaatcctttccaaggtggaggggatgatgcaattcctaccccccaagggtattggatagaagactccaacagtgcttgggctagagctactaaagaagccctagggttctcatga

SEQ ID NO: 76501 - DNA, 165 bp, Glycine max
  Peptide Sequence Number=SeqID_168186
atgcttgaagctgaagagagcgagatgttaaaaatcaagggttgcggggatttgaagaatgcagagagattgagaatttatagtggggaggttgggaaagtggccttggtgtttggggataattacaaactagtcactgctactgtctccgcttcttgtagcaaa

SEQ ID NO: 76502 - DNA, 1561 bp, Glycine max
  Peptide Sequence Number=SeqID_168187
attaagttgggagaacctggctggaaagagaggtattatgagggaaaattttctgccaaaactcctgaggaacttgaagctatacgtaaagatgttgtcttgaaatacactgaaggcctatgttgggtgatgcactattattatgaaggtcctctcagactaattcttgatattataacagcaactggttcagatgaagtacagaaattatctttattggaaattcttccctctgacccagcaccagggttttatccttatcactatgccccctttgcgtctgatctcaaaggccttggtgaactcgatattagctttaagctgggtaccccattcaaaccatttgaccagcttctaggggtctttcctgctgcaagctctcatgcacttcctgagccgtataggagacttatgacggatccaaactcaccaatcattgatttttatccaattgactttgaagtggacatgaatggcaaacgctttgcttggcagggtattgctaagttgccatttattgatgaagtgcgtcttcttgcagaagttcaaaagattgaaaacttgttaacagatggtgattttagagtagcaaagaagcaattgtttgagaagttgataatgacttttttctccaaaagacgcacaatagctgctgctgctgcaatagaacttcactatagttttcagatgcatgaaattgtcaatggtggaatgaatggttacatatccttatgtggtggagaaccttgccctcctatttttaggtctcctattgcaagcatggaagatatcatggacaatcatattgttgaaattggggatctaaaacctgaacctgttttgtggcatgaagattcaggcaggagacaccattctgaaaatgggaggaaaaaccctccaggatctatttctggtcgggagcttggggatgcagcacacagactcattgtcaattccttacaggcaaaggttgatactaatggataccgccatccgcataatggacctcctatatcttatcctgcacccatgggtcattatcgacaaccagtgccttcgtatggttatgaatccagcccaggatatgttgcaatgccgccacctatttcagctccctcactccaaggcagaccacagtttgcaccttacaatgctgcccctactgctcagcagtatggttgcaatcaaccatacccgccaccaccagtggtgtacaatcatcctcgtcagcaatcaaattcttacgaaagaaatgactatcagcacgccagatcaaatcattatgaaagaaatcaccatcaaggtagtgggggtagttcaaggcatggatatcaatcatcaggaaataatcacaatgccaggtttaataattcacatggttcatatggtagtcaccatcatgaagttagtcaccacaaccaaaacttccaaccttctagagctcatcagaattggactccaccaaacaacccgagtgggcacagggattatggtcatcattcatccaatcaatattctttattagatagaagaggaaacaggaatccaatgcccccacctg

SEQ ID NO: 76503 - DNA, 642 bp, Glycine max
  Peptide Sequence Number=SeqID_168188
atggaaattgaacagcaagccatgaaaatgatgaagtcgtctaggttcagacgaatctgtgtgttctgtgacaccagccatggcaagaaccccagctaccaacacgctgcaatccaactcgccaaacaacttgtggagaggaacatcgacttggtttatggaggagggagtattgggttgatgggtttaatctcacaagttgtgtttgatggtggacgccacgtgttaggggtcattccaactactcttatgccaatagagataacgggggagagtgtaggagaagtgagggcagtgtcgggtatgcaccaacgcaaggcagaaatggcgagagaagccgatgcatttattgcactgccaggtggatatggcaccctggaagaactacttgaagtgatcacctgggctcaactaggaatccacgataaacccgtggggttgttgaacgttgatggctactacaactcgttgctgtcattcatggacaatgctgtagaccaaggtttcattacacccgctgcccgtcacattattgtctctgcccaaactgcccaagacctcatttccaagcttgaggaatatgtcccgaagcactgtggcgtggcaccaaagcaaagttgggagatgaaccaacagttataa

SEQ ID NO: 76504 - DNA, 195 bp, Glycine max
  Peptide Sequence Number=SeqID_168189
atgggagcaacaatgccttcaaaaggatggcagatactggtgtttaagaaacttcccaatggttatgttgaagaagttaaaaatctcatatgggataccataaatatatattccttattcaaaaccggccaaggtttctacggttgtcaatgtgctgaagaaattacatatttgatagaggcaaggcaactgtga

SEQ ID NO: 76505 - DNA, 246 bp, Glycine max
  Peptide Sequence Number=SeqID_168190
atgaaggtggccaatgtgaaagcaacatgccaagatgacaacctttcgaacgagaagtacgcaaaggagatcttgaacctcgtgtcccacttgcacggctacatccatgcgtgtgtctccatttctccacagtgtccaagcgtttggggaaagatgtgtgattggactatgaaagaaaaatttatgcgtctgttgcctgtggatgaaaggtttggtgaagagataatttctggttgtcacacatga

SEQ ID NO: 76506 - DNA, 1881 bp, Glycine max
  Peptide Sequence Number=SeqID_168191
atggaaacggtggtctctcgcgctgtcctcgttctctgcactccgcacccaaccacaactcaccctttcactaaacctaacaaactcctccgttcctccctcagccgcggcgccgcttccttatccgccaccagcaaatgggcggagcgcctcattgccgatttccaattcctcggcgacgccgccgcctccacttccacctccactctcagcccctcctccgtccctccccgcctcgatcctcctgagcgctacgtgtcgatccctctcgacctgtaccgcattctcggcgccgaaccgcacttcctcggcgacggcattcgcagggcctacgaggccaagttctcgaagcctcctcagtacgccttcagcaacgacgctttaatcagccgccgccaaatcctccaagcagcctgcgaaaccctagctgatcctacttccagaagagagtacaatcaaagccttgtcgacgacgaagaagccgccattctcactcaaatccctttcgacaaagttcctggagcgttgtgtgtgttgcaggaagctggagagacggagcttgtgcttgagattgggcagggtttgcttagggagaggttgccgaagacgtttaagcaggatgttgtgttggctatggcactcgcatttgttgacgtgtcaagggatgctatggccttgtctccaccggatttcattgcggcctgtgagatgctcgagagggcgttgaagcttttgcaggaagaaggggcaaccagcctagctccagatttacaagcacaaatagatgagacgctagaagagataaccccacgttgtgttttggaacttttagccttgcctcttgatgacgaacatcgagcgcggagggaggaaggtcttcttggtgtccgtaacattttgtgggcggttggtggagggggtgcagcagcaattgccgggggtttcacccgtgaagacttcatgaatgaggcattcttacacatgacagcggctgaacaggttgaactttttgtagccacaccaagtactattccagctgaaagttttgaagcatatggagttgcacttgcactggttgcacaagcttttgtgggtaaaaagccgcatcttattcaagatgctgataacttgttccaacaacttcaacagactaagattacaactgtgaggaatgctccctcggtttatattcccaaggagaagagagagattgattttgctttagaaaggggtctctgtgcactgcttgttggggagctggatcaatgtcggtcatggttgggactagatactgacagctctccttatagaaacccatctattatagaatttattatggaaaatgcaaagggggatgaggacagtgatcttcccggactctgtaaattgttggagacttggctgatggaggttgtttttcctaggtttagagataccaaagaaacaagattcaagcttggagattactatgatgacccaacagtgctgagatatctagagaggctggagggtggtagcaattcacccttagctgctgctgcagccatagcaaaaattggagctgaggctactgctgtcattagccaggtccaggctagtgtaataaatgcattgaaaaaggcatttcctgttggttctgaagatcaaattgtgaaacatcaagtaaatggtgtgaacgaggattttggcttttctgaaagtgagaatcctctgatattgtcagatcaggattctccagtcaatgctgaggtttctggaataaaaaatactatggagacaagaaaaggtgaatttattactgaagaaattaaacatgcaagtgtgcagatcatgtgtgctggtgttgtaattggactggaatggctcacccattcttcgtaa

SEQ ID NO: 76507 - DNA, 1011 bp, Glycine max
  Peptide Sequence Number=SeqID_168192
atggatggctcacttatcatagtagtgcctcctttaccatttgaccatatttatccatctcaatcacttcccactttttatgaagcattggctacaccttcctttattctctcctctcaaacctttcacttcaagcttcaagttttcaagctacccacccactgctcatactcacacccaatgaagatccagtgcgacgtgtgcaacaaacacgaggcctccgtcttctgcacagccgacgaagccgccctctgcgacggctgcgaccaccgtgtccaccatgccaacaaactcgcctccaaacaccaacgcttctctcttctccgcccttctcataaacaacaccctctctgcgatatttgccaggagagaagagccttcacgttctgtcagcaagacagagcgattctctgcaaagagtgtgacgtgtcaattcactctgccaacgaacacacccttaagcacgataggttccttctcactggtgttaaactcgcagcttctgccatgcttcgttcatcacaaactacctctgattcaaactcaaccccttctcttcttaacgtttcacatcaaactactccacttccatcttccaccaccaccaccaccaccaacaacaacaacaacaaggttgctgttgaaggaactggttcaacgagtgctagcagcatatcagagtatttgatagagactcttcctgggtggcaagttgaggactttctcgattcatattttgttccctttggtttctgtaagaatgatgaagtgttgccacggttggatgctgacgtggaggggcatatgggttcgttttcaaccgagaacatggggatctgggttcctcaagcgccaccacctcttgtgtgttcttcacaaatggatcgggtgatagttcaaagtgagaccaacatcaaaggtagcagcatatcgaggttgaaggatgatactttcactgttccacagattagtcctccctccaattccaagagagccagatttctatggtag

SEQ ID NO: 76508 - DNA, 324 bp, Glycine max
  Peptide Sequence Number=SeqID_168193
atgggttttcttagtgcctcttccaggattataccatatatatatataggactagactatggcttcatgtcaaaatttcgtatgttttcagactttgatgtattatgttcgtggtcctgtcctttcaaaaacaaaggaagagaaaaacaaaaagaagcatacgtccatgttactttcagttctagttcagttgaaaatgtggaagggaagatatttccgaaaaagaatccgtctgctgaatgtgtttgcttgaattgggagaaaggtgctgatccccttaaaatggagtgcagcagcaaaggtgaacttgcactggcacattga

SEQ ID NO: 76509 - DNA, 1509 bp, Glycine max
  Peptide Sequence Number=SeqID_168194
atgcttcaaagcggtgccaaggaaaataatccgttgtgctattgcggcgcctcagcgccaaccttccaccactggatcagttcagttttctttttcttcagaggggtgaggactgcaatgaccatgactgagaagatattggccagagcttctgagaaggcacagctgacccctggggataatgtttgggtcaatgttgatattttgatgacacatgatgtgtgtggccctggttctattgggattttcaagagggagtttggcgaggatgccaaggtttgggaccgtgaaaagcttgtaataatacctgaccactatattttcacaagtgatgaacgtgccaatcgcaatgtagacatattaagagatttctgccatgagcagaatatcaagtacttttatgatattaaggatcttagtaattttaaggtaaatccagactataagggtgtttgccatgttgctcttgctcaggaaggtcattgtaggccaggagaggttctcttaggtactgattctcacacttgtactgctggagcatttggtcaatttgctacagggattggtaatactgatgccggctttgtgctgggaactgggaaacttctgctcaaggtgcccccaactttgagatttgtaatggatggagaaatgcccgattatttgctttctaaggatttgattctgcaaattattggtgaaataactgtggctggggcaacatataaatcgatggagtttgttggtacaaccgttgaaagtttaactatggaagaacggatgacattgtgcaacatggttgttgaagctggtggaaagaatggtgttgttcctgctgacagcactacatttaaatatcttgagggcaagacatctctgccatatgaacctgtttatagtgacgatcaagcaagatttctcgcagagtatagatttgatgtctcaaaattggagccagtggtggccaagcctcattctccggataatcgtgctttggcaagagagtgcaaggatgtgaaaattgacagagtatacataggatcttgtacaggtggcaaaacagaggatttcatggctgcagcaaaagtttttctggcatcaggtaaacaggtcaaagttcctacatttcttgtgcctgcaacacaaaaggtttggatggacttgtactccctccctgtccctggatctggtggtaagacatgctcacagatatttgaagaagttgggtgtgacacaccagctagtcctagttgtggtgcttgtttgggtggcccaaaagatacttacgcacgcatgaatgaacctaaggcaagttccttgcttctgccccaacatcttggcggcggtgatggtggtcttgtcacggtccacattggtgcagacggtgaaggatcgactcacacaccaccgtcaaactcgaaccagcagccacccaccaccgtcaaaaccctagcagagcaaaattggggttttctagtttcagagacaataatactgtttttgggttaa

SEQ ID NO: 76510 - DNA, 1065 bp, Glycine max
  Peptide Sequence Number=SeqID_168195
aggaatacacatcctcgccttcacaccttcagaggactacacgtcctcaccttcagagggctgcacaccctcgccttcgtagggctacacgccctcaccttcagaggactacacgtcctcacctttagagggctacacgccctcaccttcagagagctacaggccctcaccttcagaggactacatgtcctcccctttagaggactacacgtccttgcctttagagggctacataccctcgccttcagagggctacataccctcgccttcagaggactacacgtcctcgccttcagagggctacacgccctcacctttagaggactacacgccctcagctttagagggctacacgccctcacctttagaggactatacgccctcgccttcagaggactacacgtccttgccttcatagggctacacgccctcgccttcagtggactacccgtcctcaccttcaaagggctacacgccctcgccttcagaggactacacgtcctcgcaatcagagggctacacgccctcgtctttagagggctgcacgccctcgccttcatagggctactcgtatttgccttcaaagggctgcacgtcctcgctttcagagggctccacatctgcgccttcagagaactcaagggatcgcgcccaccagacacccaatggacccaaagaagaccaacaaggccctggggtttccagctctggttatgggcctctgctagtcctatagggtgcccttccccccaagcaaggtcatgccatcgtgacatagggatcgcgcccgcaagacacccagtggacccggagaagtccaacagggtcctgggatttccagctccgattacgagcctccgtcagttctatggagtgcccatcgcccccagcagggtcattaggcccctattaatagggctttcatcaagaagtactgcgcccctaggtaggcgcagggcgaggcatcatagtagcgggcaacagacgcaacgccaccacctacagagtacacctcaactcatccacgaaaaggctagagcgttcaaaatattgtctctatggtaa

SEQ ID NO: 76511 - DNA, 650 bp, Glycine max
  Peptide Sequence Number=SeqID_168196
atggagttcttctcaaatgagaattttgaatgcttccaagcatttgaaaattccaatcttattccattcatgtctctgaaattacctgtctattctgagttagtcaaagctttttattcaaatttagaaattcatgaaggtgttctaatgtctgaaatctatgggatgaagatggtcattgaccaatccctattttatgatttaacaaaattgtctagtgaaggtgtgccttttgagggtgcactaattgatgaatggaaattcgatttctctgtgtatgatgcccgccgatcttcaaaccttgcccaggtttctgaagaagacctcattgtcatgtgggcctttcataaaggtctacaaattgattgggcacatcttgttagatatcgcatgcataaggcattgcgattgaatgccccactgccttatcctcatcttgttacccttttccttcaacacttcaacatccctcttgattctgaaccttatgttccaatcaagagatcatttcttataggtgcttcagtcatagcatcctttggttatataaaggagcatgatggctcttgggtgaagaagggtgctagaaatattggtgaagaaggacatgaaggagaagattcatctcttctttcgaagattatggaaag

SEQ ID NO: 76512 - DNA, 297 bp, Glycine max
  Peptide Sequence Number=SeqID_168197
tttgttactagtcatgacatgtttcaaatgcaaggagagcaaacaaggtgtccctacaagaaatgcaaatgtaaagttttcaagtttgtggatgatgtgatgagggatctttatgaggaagggttcatgccaaattattattggtggacaaaccacggtgaagagttaccacaatttcctccaatactgttgcaaggttcatactacgaaagtggtgggcaaaggaaaaaattgaatccttatgagcaaatgatcatggatcatgctggaccatcaattggtcaatacatagaataa

SEQ ID NO: 76513 - DNA, 1836 bp, Glycine max
  Peptide Sequence Number=SeqID_168198
gccacgaccttgttcaagttttacttgcaagagctggctgcactcaaacgtgaactggccgtttcaacccgtgttgtcggtgtcagtgaggccgttctgcacatgaccaaaacctcgcgagatcaatcgcaacatcgccttgatgagccttaccgcctggccttgaatggcgtatatgaccggctgcttgccacagctaatcaattgcttccagagggaggctgggtactggagcaagggatcgtggctgatgcgtatgaaaatgcagaagccttgctggtgccgctggaaacgattgccgcttctttgcgccagcatcaaggcgaagcgctgatctatccgcgtctgggcaagctaatcaaagccgtccatagttttggttttcacctggccacggtggatatccgccaatcgtcggatgtgcatgaggccgtgatcaccgaattgttgcataaggccggtcatgattttgattacgccagttttaacgaagatgaaaaaataggcgtattgcttgaggagctcaagcagccgcgcctgctattttccccattccagcaatattccgagctcgtgcataaggaaattggcgtgctggtcgcggtacgcgaaacgcgggagcgctttggcgaacatgctgtgcgccaatatattatttcgcacaccgaaacgttatccgacctgctggaagtggctttgctgcaacgcgaggcaggcttgttacgcggtgtgtggggatcggccaatatacaggtggatttgaatattgtgcccttgtttgagaccatcgctgacttgcgcgatgcccccatgatcatgggcaaatggctgagcctgctcggcatccgtcatattatccgccatcaggggaacgagcaggaaatcatgctgggttactcagatagcaacaaggatggcggtttcctgacctcaaactgggagttgtataaagcagaaatttcgctggtggagttgtttaaccaggcaaatgtcaggttgcgcttgtttcatggccgcggcggcaccgtcggccggggtggcggaccgacttaccaggccatcatggcccaaccaaaaggcacggtcgatggccagatccgcctgactgagcaaggtgaaatcatctctacacgctacgctgacccggtggtaggccgccagcatctggaaaccttgattgcggcgacattggatgccacattgttcccggcagaccagctggaatcctccaaacggcgcgccttcgaaagcgtgatggaggctttgtcgaccaccgctatgaccagttaccgcagcctggtgtatgaaacaccagggttcgccgagtattttttcaataccactccaatagacgaaattgctggcctcaatttgggcagccgcccggctgcgcgtaagtctacccggcgcattgaagacttgcgcgcgattccgtgggggttctcctgggggcaatgccgcctgctattgcctggctggtatgggttaggcagtgccatccagcattttttgcaacaagatcctgcgctcaaagagtcccgtttggccatgctgctcgagatgcaggcacattggccgctgtttaatacgttgatcaacaatgtggatatggtgctggctaaaactgacctgattgtggcgcggcattatgcacacttactggaagaccgtgagctgcgtgaagagattttcagccgtatcgcgcatgagcataaattgacgacagatgcggtcaacctgctactggggaccactcagcggttggccagccagcctgtgattgcaaaatctatccgtgaccgtttgccttaccttgatccattaaatcatttgcag

SEQ ID NO: 76514 - DNA, 213 bp, Glycine max
  Peptide Sequence Number=SeqID_168199
atggataagagcttgaaggtaggagaagatgagtggagggataaggagagaaggagcacggaattttgtgcctcaaatgagactcaagtcaagaatcaagattcaggcaagtttgaagaatcaaagagtcattcaatcaagaatcaagattcaagtgaagattcaagagaagactcaagattagaaagaatttcaagaaaaacatcaagataa

SEQ ID NO: 76515 - DNA, 692 bp, Glycine max
  Peptide Sequence Number=SeqID_168200
ccatcccgaacttcgaagctctggaggaagttgaagaagtccaagctctcaaattagagctaaggaaggcgagactcggcaaggagaagttcaaatcagccgctacacacatccggaaagagtgcaccgagttacaagaggaaaacgcggccactgcaagagcccttgaacaagaaactaaaagggcccgcaaggaggaatatggccaagagaaattccgaggagcattatggggtagcaacagtgagctcaagctccgaagagaggaaagagaccggtcacgggtgcatggcatgatcttaaaagaagagttagctgcgtgcgcaagatccaagaggagtttggctcaacacttggaagccacggagcaaagcatgctagctatcatagggcaatacaaggaagagttaaaccagtctgtggcccatgaacaaaagctagtggaggattttgcacaagtgtacgccgaaaaagaagcaagagggagggtgattgatgcattgcatcaagaagcgactatgtggatggataggttcgccttgaccttgaatggaagtcaagacctcccgcatctattagccaaagcaaaagccatggccgatgtgtgtacggcccccgaggagattcatgggctaatcaattactgtcaacacatgatagatttgatggcccacataattagaaaccgttag

SEQ ID NO: 76516 - DNA, 289 bp, Glycine max
  Peptide Sequence Number=SeqID_168201
cctccctatagtcaatgcagactctccaactgttctgcacccgagtaggaatcagctcctccttctcatttctgatcactgtgaggccagtcttcttcggcgactacctaaggcccacgggatcacccatttggcatcacacataagggataaatgtccagtcgggtgcttggatgatgggggtggtagtcaacgctcttttgaggcatacatcaagaatcagagtctctctggttgcatttggtcattagctccatcctcctttgatgcatacatgtggatgggctaa

SEQ ID NO: 76517 - DNA, 615 bp, Glycine max
  Peptide Sequence Number=SeqID_168202
atggatatctctgaagatactaacatccctgtaatattgggaaggctattcatgttgacagcaagctgcatagttgatatggggaagaggaagctagagctaggttttcaagatcagaaaattgattttgatttgtttgttgaagacaagcctgctccagaacacaatgtctgcttacaggtaatggaaggaggtcaagaggttctgaagatggcattgagaaaaagagctagaacggaggacatcccttcatcatccactctagctcctccgccaatcataactatggagcattttctcgagcaagtagcctggcctgaagcacaactcccattggtgagagtcaatgaggctgctctgcctgagcccacacatgtgcaggttgatccagagccagctgacccacaatctccagtggtgaatccaccatcttctcctgagcgtgaagtagttcccccatctccacttctgattgtcatctttgatgcatcatcagatgaagcggctgcccctccagattcaccagctggagaaacagctgacccttctacttccccagttggaggaattgttgatctttcttattcgtcatctggagaagcaagctctcactga

SEQ ID NO: 76518 - DNA, 216 bp, Glycine max
  Peptide Sequence Number=SeqID_168203
atggcagaaatcaaccaaggtaagacgatgaccagtcacgattgcccgcgtatttttgtttcctacttacaggtacatagggacggatcgagtggggctagggtcacgatcgaccgatcgttgccccttcccggcgctaaacaagcagagaacgtcgctgcaaggcagcccagtatcctttgtggttgcagtttcttttactattgtttgttttaa

SEQ ID NO: 76519 - DNA, 188 bp, Glycine max
  Peptide Sequence Number=SeqID_168204
ggctccataccaagatgatgagcttgtagagcttcaagaagtgttggaagttaaccctgatgtcattaatgagtctcttgcagatgttgatggaggtggagaagagatagatgcaagtttactcaaacaactagacttggttgaactagatgaggatgaatgcatattaagtgagaatgacattgaga

SEQ ID NO: 76520 - DNA, 1116 bp, Glycine max
  Peptide Sequence Number=SeqID_168205
atggccccaaggaagcttgcctcaaagagatccaggaaagacaaagcggctgaaggaaccagttccgctcccgaatatgacagtcatcactttaggagcgctgagcaccagcagcgcttcgaggccatcaaaggatggtcattcctccaggaaagacgcgtccagctcagggacgacgagtataccgacttccaggaagagatagttcaccggcggtgggcatcgttggttacccccatggccaagttcaacccagatatagtcctcgagttttatgccaatgcttggcctacgaaggagggttggatccctttcgatgcggatgccctcagccagttcctgggatacccgttagtgttggaggagggccaagagtgcgagtatggccagaggtggaaccaggccgatggttttgatgaggaggccatcgctcatttgctgtgtataccggtgcaggattttacccggactgctgctgggagacgggtgcggatcatgcgcaccaacatgaccaccctgacccagatatggatgacgttgctgctcagcaacatccagcccagcgatcataattctgacctcccattgccgaagtgtcagctggtgtacgccgtcctgacacggatgagcattcacgtggctcagttgatccctaatgccatttatctatttgcaggtatggcgccgaccaggcaccctttggacccggataagtccaacagggccctgggatttcccgcattgatcacaggactttgtcagtcgttcggagtccccgtcacacctagcaaggtgattcagccacccatcacccgggcttttattgagaagtattgcacgcaaagattggcccagggtgatgcaccacaggccacagatgcgccgccacctcatcaggctggcccagctgggtcatttgattcagagtacctgcagagccagggttttacttcttttccatgccctacttcggatcagtacagggcagaggtcgcatggcccggagattggcgtgaggcccaggcaggggaggctcccggcgaggcagatgaggcccgcgaggacgaggagatgaccgatttgcttaacttcttgggagggagcggagccacatga

SEQ ID NO: 76521 - DNA, 860 bp, Glycine max
  Peptide Sequence Number=SeqID_168206
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaattcgatttactccagaagatatgctgaaagaaaaattaattgacggcgtaatagaagaaccacttggtggcgcacattacgacccagaagcagcatatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 76522 - DNA, 815 bp, Glycine max
  Peptide Sequence Number=SeqID_168207
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaattcgattgttcaacgaaggtgaatttgtagacgttacaggtacttctaaaggtaaaggtttccaaggggttgttaagagacataactttggaggatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 76523 - DNA, 453 bp, Glycine max
  Peptide Sequence Number=SeqID_168208
atgtctcttaacaaccccttggaaacctttacctttagaagtacctgtaacgtctacaaattcaccttcgttgaacaatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 76524 - DNA, 355 bp, Glycine max
  Peptide Sequence Number=SeqID_168209
gaaagctggagttgctgcacatgatgtccaacgttatgtcaaggaatcagattgggctgcacaatgcacaaggcaagataaaatgtcaaatgaagaattgaagctgcaggatccacgatgtcggatacaatgtccaggacatcctgcccgaaaatactggacacataaatctgttaacagattgtgctggatccacgatgtcggatacaatgaaaatgatagatctcatccagctcaagttgttgcagcccagatacgcacactgctatttaaacatgaaggctgcacgggtttgagtaccaagtccgggattgaagagttatttagtgagttttgggacttgagtgttttgtga

SEQ ID NO: 76525 - DNA, 375 bp, Glycine max
  Peptide Sequence Number=SeqID_168210
atgggtgaccaagaggagatacaagaacagatgaaagccgacatgttggctttgaaagagaaaatggcttccatgatggatgccatgctaggaaggagacaactaatgaagaataacgtggccaccaatgccactgttagttcggctgccgaagcagacccaaccctcccagctaccgcgcaccatcctctcccaaacatggtaggacgagaaagaagcacactggggcacatcagcaacccccatctgggatacaaccgagtggcttacccttatggattaccacctaattacacgccaccagtcatgcgtgatgacgtgggacatgtcctttcccccatccttgaaggggagcctcctcgacagtcggacgag

SEQ ID NO: 76526 - DNA, 173 bp, Glycine max
  Peptide Sequence Number=SeqID_168211
atggccacaatgattgaggtcatgatgagcataaaggagataatagaggtcaatgcggctgcaatagctgctaccagcaccattgctgaggtggacttgccccccatatggcctcaaccaaataaatcatccaaccccagatatggtaggtctggaaggcaaagagttgggag

SEQ ID NO: 76527 - DNA, 768 bp, Glycine max
  Peptide Sequence Number=SeqID_168212
atgggatcaagtcaaaagccttcgtttaaaaagaggttctatcaagtcaaaatcaagagcttaaaggtcactagtttacgagagttggggcaattaatgggtcaacttcaacggcaagccttccgcaaagcctatggtaagatttgggacctagctagggtagaagtctccatagagtccattgcctcccttgcccagtattatgatcatccgttgaggtgcttcacttttggggacttccaactaccacccatggcggaagaattcgaagaaatcctaggatgtagaaacgaatgggcctcgttcatagacgttctcgcactgttgatctttggaggagtcctcttttcgaatgtggatgggttggtggacctggcagcgatcgacgcttttctcgcctatcataaccacaaggaaagcccggttgtcgctatgctagccgacctatatgacacgttcgaccggggatgtgaaaagagcagtgcaagaattgtttgttgtgcactggctctctatgtgtggttagtttcacacctctttctccaagaaggtaggcccgtctatccgctacaaggtcaccgctcgtgcgtcgaaaaaggaaaggcgaattgggaccaactcttggctagcatggaggggcgtctgttaattggttccctcgctagaaggaaggaagaatcaggattgtatcttcatgcgaaggatgtccaaatgttccctggatgggaacatggggttgtattaattataatcccgtcctcgccataa

SEQ ID NO: 76528 - DNA, 476 bp, Glycine max
  Peptide Sequence Number=SeqID_168213
atggttacccgcacctttcgtcaactgggggcaaacgagcccgttgacgtgaagagactggcatcgtcttctacactatttgccatccagggacatcgagtcaggtggcaggcggagataccttatggtcatccgcgcctttcgtcaaccaaggggaaagacttcgacggtatcaggatgatgttggccggacgatcaggtgcgatggaaaagggaagtaacatggttgttcagccttcatgggaccctcgcttgaccgcttcgaggtacttaacacccattgttaggcaatccgtggagttccgcgacatgtcagaagtcgaagggaagcattgttgcgcaatccgtaaagttccgcaacattccagaagtcaaagaaggggttgttgcgtagtccgtaaagtttcgggtatgcaaatagcgatcaggcccacttgggccttcaaggatgttccaacagaaggcggtgccttctg

SEQ ID NO: 76529 - DNA, 90 bp, Glycine max
  Peptide Sequence Number=SeqID_168214
atgagacacattcgaagcatcgagggagatgaatacggatcggcggcggtggcggcggtggcggcggcggcgagtgaaacgtgtcgctga

SEQ ID NO: 76530 - DNA, 453 bp, Glycine max
  Peptide Sequence Number=SeqID_168215
atggagctaagaggtggaaattcgcgcctctgggttagctcacagttctcgtgggcgtcagcctcaactggaaaagtttttgcttttaagtgcaacttgatggtgccatcaaaggttacagtcttctcttggaaagtggtgctagatagagtgcaaacaaggctgcaatttcgtaaaagaaaacttttgaggcatttcgatgatatctcatgtcctttttgcaaacaacatgtggaaaccgcaaatcacttgctcttcttatgtcaggtctctcactatgtttggatgcgcggctgtaattggcttgaacttgacatagtattgcctaacgaagttattgcacacttttggcagcatgcagggctaatagcaggcactaaaagtaaaaaagggcatggagttcggtgtggatggcggctgcgtggtctttatggacccacagaaatgatatga

SEQ ID NO: 76531 - DNA, 429 bp, Glycine max
  Peptide Sequence Number=SeqID_168216
atggttttagatgctgaatggaaaagttttagcaagacaaattttgagagtaaggctgacaaagttaaagaatgtgatactgatactccttgtttgcatttgatatatgatatgtgggactctatgattgaagaagtgagggagaaagtttttgagcatgagggtgttttggaagcaaggcggaacaaaagcaatacttcccttcactgtttggcgcatttgctagttccaaagtactatagtgagtcttggttacaaggagagagtggaatggaagagtacaaggttggttcatcaagctattgggatgttggtggatatgtacttcttgtggatgatgactatgttgacacttttgcgaatctgtttgttgatgacccggagattgaaggtgtgcttttcaatgatgaagaagagcaagtgaactga

SEQ ID NO: 76532 - DNA, 288 bp, Glycine max
  Peptide Sequence Number=SeqID_168217
gttgatgcattccctatcactgttatgtttggcatgtgctcaattttccttttggtggcttgtatcttgcaaaggcgactgatggtgatttccgataagccaatttccgtctacatatgtgcacgatgcgatttgagtgaaggtaaacctgatgctcacaaagagaagggattgaaggaacaagcagaaaggacgagtggaacaatttttttaaagtgtttttgttatttaccctcagctattaattatggtggtgcttgtgttgcctcacgagtggaaagatgctaa

SEQ ID NO: 76533 - DNA, 3024 bp, Glycine max
  Peptide Sequence Number=SeqID_168218
atggcgaacgaattagtagctcgtgcctcacatgccccaacatctgagttactttcccggaccatctttgctgtatttgacactatcaaagcagccaatgaggttgtgattcacaaggaaaatttaaagagattctctgttcacttgaagaatgtctcactcatattgaagtctttatcgaagcaagacatacacaattccgcgagcttggaaaatgctatgaatggtctctaccgagaggttggtgttgctaagcagctttttgttgagtgcaacaatagaagtaaggtttatcttttaatcaattccagaaagatcgttacacacttgaattgttgtaccaaggatatcggtcgtgcagtaagcctcatccctttggcctctttagacattaactctgatttaaatcaacagataagtgagttatgcaagaaaatgttggatgctgagtatcaaacagctgcagcagatgaggaaattttgaagaaaattgagacagcgatacaagagggaaatgttgatcggtcgtatgcgaatcagttgctaacctgcattgcagatgctataggggtccccttggagcatggtgcattgaagagagaatttgaagagctgaaaaatgaaatggaaaatgccaagtcaagggtagatgtggcagaagctctacatatgaagcagattattgcagtgcttggaaaggctgattttataacttcagcacaagagaaggaaactaggtattttgagaagagaaactccttgggagagagaccattgatgcctcttcagtctttttactgcccaatctctctcgctattatggcggaccctgtggagacttcttccgggaagacatttgagagaagggaaatagagaaatggtttgctgaaggaaacactctctgtcccttgaccaggttgcctctagatactaaaatcctaaggccaaataaaactcttaagcagtctattcaagagtggaaggacaggaacacaatgattaccatttctgccatcaaatccgaacttgaaacaaatgatgaagagggagtggttcaatccttagaaaagctacagaagctttgcttagaaagagaggttcaccgagaatggttaaaaatggagaattacattactgttcttattggacttcttagttctaaaaatcgtgaaataaggaagcatgttctactcatcctgtgtatgcttgcaatggataatgcagacaacaaggaagatattgctaaagtggataatgcacttggattgattgttcgctcactttcacgtcaagctgaggaacgcaagctggcattggtgttgctgttggagttatctaaatgtaaaatggtgtgcagtctcataggaagcattcaaggaagcatacttctcctggtatcaatgataaatagtgatgatgttgaagcagccaaacatgcacatgagctgctggtgaaactctctgttcttgatcagaatgttatagagatggcaaaggcaaattatcttaagcctttactgctgaaactttctacaggatcagaaaatatgaaaatagttatgactgaaactttgtccaaaattacattaaccgaccagaacaaattgtccttggtcaaagatggggcattgcaacctcttgttcagctgctcttaaatgatgatttggaaatcaagaaagtggctgtcaaagctctactacagttctcaagcttgccagagaatggcctccagatgatcaaggaaggtgttgctccaccactgttggaactgctatactgtcacagtttacagtcacctactcttcttgaacaggttgttgccacaataatgcatcttgctatgtcaacaacttaccaacatgctgaaccagaacaggtttcattgctagattctgaggaagacatatataaattcttctctttaatttctttgacggaacctgagatacaaaataagattctcagagctttccaggcattgtgccaatctttctatggcctccgcatcagaaagaggttgagacagatatcagcagctaaagttttggtccacttgttggagcttaatacccaaccagtgcaggtcaattccttgaagcttttctattgcttgacagaagacggtgatgatggcaacatctcatcacatataactgaaagattcatcaaagtcttgcttaccatcattgaggcctctgatgacgctgaagcgatggttactgctatgggtatcatctctaaactaccacaggagtctcacatgactcagtggcttctagattctggggcacttaaaactattttgacttgtcttaccgaccaacataagcatgtctcacacaaaaaacaagtcatagagaattctgttcaagctctttgtcgttttactgtctcaacaaatttggagtggcagaagagagtggcattagaaggcataatcccagtgctggtgcagttgctgcattccggaacaccctttacaaaacaaaatgcagccatttcaatcaagcagttttcagaaagttcatatcgcttgagcgagccaataaagaagcctagcattttcaaatgctgccttgtagccaaagaaactggttgtccagcacacttaggcacctgctcagttgagtcttcattctgcattttgcaagctaatgccttggagccccttgtgcgcatgcttgcagatcaagatgatggaacgcgtgaagcttccttaaatgcactgctaactttggttgatagtgaagcaccacagagtggaagtaaggtacttgcaaattcaaatgctattgcaccaatgatacaactatcgagtgttccaattccgaggttgcaggaaagaattctaatagctttagaaagaatttttcaactagatgatgtgagaaataagtacaaagttgtggccacgatgcacttggtagaaataactcaggggaaagatagtcgaatgagaagtcttgctgccaagtgccttgctcaattgggtgaacttaataaacagtcctcttatttttag

SEQ ID NO: 76534 - DNA, 301 bp, Glycine max
  Peptide Sequence Number=SeqID_168219
agggctttttccggaggagccctggtgcttaccaacatggatggcgaagagctaccttcacccggatttcccgtctgctgtatctctcgttacaatctttcaaagaaatgaacgtggattcgaggctttagtcctcacgttggggcaggatcatcttgagctaccttctggggtgaggaccaaatgtggacagcagaaaccaatcaaggaacggatgcaagtggggatggggtcacgaccgactgatcgttgccctttcgctgcgctagacaagcagagaacgtcgctgcaaggcagcccc

SEQ ID NO: 76535 - DNA, 171 bp, Glycine max
  Peptide Sequence Number=SeqID_168220
atgactgtagcaacaacaaacatccaccaatttccctttggtcaggcttcatatgccgatctagagctcaaaatcaagcttatcgataccgtcgacctcgagggggggcccgcggagggtatactggcttactatgttggcactgatgagggtgtcagtgaagtgcttcat

SEQ ID NO: 76536 - DNA, 465 bp, Glycine max
  Peptide Sequence Number=SeqID_168221
atgacttccaagattattttgatgatgccaaagaatcaagagttaagcaagttccaaagaatcaggagtcaacaagcttcaagaatcaagtttcaaagaatcaagattcaagaacaatcatgtttcaagattcaagattcaagaacaatcaagtttcaagaatcaagattcaagaacaatcaagatcaagattcaagactcaagattcaagaatcaagagaagactcaatcaagataaggtatatcctttgtggtacaagtagagggtacatctacttgggttgttatactgagaacaagagagggtacatctcttgtggatcagttcaagtggagggtacatccacttggttgttcaaagagaacaagggagggtacatcccttgtggatctttggcttgtaaaggattttacaaggttgaaagaaatctcaagaacccttggttgcttggggactggatgtag

SEQ ID NO: 76537 - DNA, 1327 bp, Glycine max
  Peptide Sequence Number=SeqID_168222
atgaacagacgaaagtttctaaaaggttcggcattgctttccggattgtttgcaattaatccggttaatgttctggccaccgaacctgctgtaaaacccaaatcctacaaaaaagctaagaatatcatttttatggtaagcgatggaatgagttccggaacactggcgttagcgaacctgtattcccagaatatccttgggaaaagtggaaactggatcaatttatataaagaaaataaagtatccagagcattgatggatactgcctctgcgagttcaattgttaccgattctgctgctgcaagctcatctttcggtggtgggttcagggtaaagaatggcgtactgaatataggagttaatggtgaaaaatatgttcccatctggcagaaatttaaaaaagcgggtaaaaaaacaggctgtgtcactactgtaaccattacccatgccacccctgccggcttttgtatcaattcagccagcaggaatgccgagcctgaaattgcggaaatgtatgctgaaataggatttgacgtgatgatggggggaggagatgaattttttaatcccgcgaaaagagaagacaaaaaagatgtatacggtttgtataaacaaaaaggatatcagattctaaaaaaccgttcggatctgcagaatatcgataaaagcaaaccggtattaggagtattcaatacaggagcactaccttattcaattgatagggctaatatagcagctttacaatctacaccaacaattgctgagatggcaaagacagcaatagaccagatgaaagatcataaagaaggttttgtgcttcagattgaaggaggtaaggtggactggtctgcacacgcaaatgatgttgcggcacttatccatgatcagattgctttcgaagaagctgtaaaagtagctgttgattttgctgaaaaagataagaacacattggttattatcaccacagatcacggcaatgccaatccgggaacaatttatggcgcggatgctacccgaaacttcaatactattgcccattataaattcaccaatgaatatgtcctgaatgcaatccatcccgattttaacctgcagcaaacgaaagactggatctatgagaccaatgccataagcctggctgatgatgaagctaaaagtcttttaagtttctacaccagtcttgataaagaaggtggcatggatcactcgggtgattatgtggaacttgccatgttcgggccgggaagtgaactgctaaaacctttcgtaaaaaacacagatttacattatatcatgcttgaagccacagagctttcagcacataccg

SEQ ID NO: 76538 - DNA, 101 bp, Glycine max
  Peptide Sequence Number=SeqID_168223
atgaacgcgctaagcacgcttgctgcgcttagcctgttcatcgcaactgttaaaattttggatttccagatgaacgcgctaaacggaccatgtcgcgctaa

SEQ ID NO: 76539 - DNA, 177 bp, Glycine max
  Peptide Sequence Number=SeqID_168224
atgaaaaagaagaagattgcactttacgggagtcgatttgatgaagaaatgagtgagataggaaggtttggaggtttgggaatggaggtacggcgcaaggaggaaggggctgcacaggagattctgaaaaacgtgatatttatagagcaggacgcgtggccatctgttctagtgtaa

SEQ ID NO: 76540 - DNA, 687 bp, Glycine max
  Peptide Sequence Number=SeqID_168225
atgtggttccctggcagttttcccttcaccagttatcccaaattcgtgaatattaatcagtgcacgctttgtgttcgattaattgcctctgagcctaacttgcgttcatgcttaatggacgaagggctaactgaggactacacgtcatcaccttcaaaggactacacgtcctcgccatcagaggactgcacgtccttacctttagaggactgcacgtcctcacctatagagtacttcacgtccttactttcagggggctacacaccctcaccttcagggggctacacgccctcatcttcaaaggcctacacgccctcaccttcaaagggctacacgccctcatcttcaaagggctacatgccctcaccttcagaggactacacgtcctcaccttcaaaggactacacgccttcatcttcaaagggctacacgccctcaccttcagaggactacacgtcctcgccttcggagggctgcacaccctcgtcttcagaggactatatgtcctcccccttgagaggactacacgccctcgccttgagaggattacacatcccccttttcagaagcctacacgctctcggctttagagggcgacacatcctcgccttcggagggttgcgctctccctcgccttttgagggctacgcatcctcactttcagtgggctccatatcaacaccttaa

SEQ ID NO: 76541 - DNA, 470 bp, Glycine max
  Peptide Sequence Number=SeqID_168226
atggagcctgatggatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccagcgtttccccctggcggctccctcgtgcgctctcctggtcctggcctttcggtttaccg

SEQ ID NO: 76542 - DNA, 641 bp, Glycine max
  Peptide Sequence Number=SeqID_168227
gggtattttcatgggtttaccttggtatcgtgttcatactgttgtattaaatgatccaggccgtttgctttctgttcatataatgcacacagctctggttgctggttgggccggttcgatggctctatatgaattagcagtttttgatccctctgaccctgttcttgacccaatgtggagacagggtatgttcgttatacctttcatgactcgtttaggaataaccaattcgtggggcggttggaatatcacaggagggactataacgaatccgggtatttggagttacgaaggggtggcttgttttggttttggcgcatttcatgtaacaggattgtatggtcctggaatatgggtgtccgatcccttatggactaactggaaggatacaatccgtaaatcccgcgtggggcgtggaaggaacgttgggcatattagcagtattgctgctgtcttttttgcagcttttgtcgttgctggaactatgtggtatggttcagcaacaacccctattgaattattcggtcctactcgttatcaatgggatcagggatactttcagcaagaaatatatcgaagagttggtgctggactagccgaaaatcaaagttcaatggacaatggagatggaatagccgtcg

SEQ ID NO: 76543 - DNA, 207 bp, Glycine max
  Peptide Sequence Number=SeqID_168228
atgtcacgaaactttatggattacgcaaccatctcctcttcggcttctggaatgttacgaaactttacggattgcgcaataatgtttcctttcgactcccgacatgtcgcggaacttcacggattgcttaacgatgggtgtcaagttcctcgaagcggtcaagcgaaggttgcatgccatcaaacaatggtccccagaaaaaattag

SEQ ID NO: 76544 - DNA, 309 bp, Glycine max
  Peptide Sequence Number=SeqID_168229
atgatggctcatgtagtagctaccttccttttttttgtgtatgcaaatacaaatgaacagagacatatctttgatagtatcattaatgctgtcaatggacacgctggtggaatgtttttcctatatgggtatgaaggtactaggaagacctttatgtggaagacattagcttctgcactacattcaaaaggtgatattgtgttaactgttgcgtcaagtgggatagcctcattgttattaccaaatgggagaactgcacattcaaaatttgttattcctgtgcgtacattaaaagaactcaaagagtaa

SEQ ID NO: 76545 - DNA, 525 bp, Glycine max
  Peptide Sequence Number=SeqID_168230
atgagcgtccatgtggctcagttgatcgctgacgccatttatatatttgcaggtatgccacctactaggcaccctctagacccagataagtctaacagggccctggggtttccagcattgatcgcgggcctctgccagtcattcggggttcccgtcacacctagtaaggtgattcgaccgtcgatcacccgggccttcattgagaagtattgcacgcctagacaggcgcagggtgatgcaccgcaggacgcaggcgcaccgccaccacctcatcaggctgatccacctgggtcatttggcacggagcggtatctactgtactttgttcgccggcaggcggccaaccacaggggcctcagtcagcagagccagggtttcgctccttttgcgtgccctactccagatcagttcagggctgaggtcgcatggcacggagattggcctgaggcccaggcaggggaggcccgcatggatgaggagatgacaaatttactcggtttcttggaagggagtggagccacatga

SEQ ID NO: 76546 - DNA, 389 bp, Glycine max
  Peptide Sequence Number=SeqID_168231
gactctgccagtcgtttggagtccccgtggcacctaccaaggtgattcggccgcccatcacctgggcttttattgagaagtactgcacctatagacaggctcagggtgatgctccacaggccgcaggcgcgccaccaccacctcatcaggctagcccggctgggtcgtttgacatggagcagtatttatggcatttgagccagggcttcgcttctttttcatgccctactccagaccagttcagggcagaggtcgcatggcccggggattggcccgaggcccaagcaggagaggcacccccagaagctcccggcgatggagaggaggcccacgaggacgaaaagatggctgatttgcttgacttcttgggagggagtggagctacatga

SEQ ID NO: 76547 - DNA, 647 bp, Glycine max
  Peptide Sequence Number=SeqID_168232
ccataagaggatacagttcctcactttggaagggtcacacgccctcaccgttgagagggcttcacgccctcgccatcagaggattgcatgtcctcaccctcagaggactgcacgtgctcaccttcagaggactgcacgtcctcaccctcagaggactgcacgtcctcaccttcagagcactgcacgtcctcaccctcagagggctgcgcgccctcacctccagaagactacatgtcctcgccttgagagtgctacacgccctcgccttggagggctgcacgccctcacctccagaggactacacgtcctcgccttgggtactagttaccctcaccttcagaggactacacgtcctcgccttgagaggactacacgtcctcaccatcagagggctgcacgccctcaccatcagaggactgcacgtcctcgccttcgtagggctacatgtcctcacatcagaggactacacaggactgcatgtcctcaccctcagaggactgcacgtcctcaccctcagaggactgcacgtcctcaccttcagaggactgcacgtcctcaccctcagaggactgcacgtcctcaccttcagaggactgcacgtcctcaccctcagagggctgcgcaccctcacctccagaggactacat

SEQ ID NO: 76548 - DNA, 186 bp, Glycine max
  Peptide Sequence Number=SeqID_168233
atggttgaatcagaaagactttccttcatcagaaacaatcaaaacaaacttagagttgacaagcatttcaatttgcaagagtcattggctacaggttccaccacaggcttgcataaagacctgacaaagaatcatctactagggaaagtagttgcaaatatgtatacaatagaatttcaaaactga

SEQ ID NO: 76549 - DNA, 597 bp, Glycine max
  Peptide Sequence Number=SeqID_168234
ggagatgcaatccatgttgtctgcaaacaagatcagctaaagtcttggaaggctgatttgatggaaaattatacttatgtaatgcataattttaaagtcatgaagaatgatggtcaatttagaatctgtgatcaccagtataaattagtttttactggagttactgttgtgaggcaatccgatttggaggatcttccttttaagaaatataaatttgctgatttcaccaatgtcattgttgggctcttccaacctgagctgttggttggatcttatgcaccctcaatcagtaattcgttgagggcctccaaattattgatcaatgaagctgtgtttgaaattcaagaatttagggagaggctttctgatttaggcattcaggtccggtcagttttgacacctggtggccatgggagttcgcaggagggtgatgttgatttaaatgtttctcctcaagcccttgataagttgctaggttatgtccttgcatttaaagtcaaagttcaacccaagtttaacaatgttgttgttcttagatactcaaatgactcagatttgatcaatgttgtgccattatcgtcatatctgttaccttga

SEQ ID NO: 76550 - DNA, 288 bp, Glycine max
  Peptide Sequence Number=SeqID_168235
atggtggggagtttgagaaggcaaacaacatcttgcattttatcacccattgagaaaaggattgaaatagaacttagacattttttttttcttctgaaaattagtcctttcgctaagcgcaagcctcgtgctaagtgcatcttttgtcatgcgctaagaggagagtctctagcgcttagcactcaacccttgcatcttaggctgatttggtccactaagcaggccaaggctgagctaagcccatttcaatttgatctgaattgggctaagcgatggcctgctcactaa

SEQ ID NO: 76551 - DNA, 276 bp, Glycine max
  Peptide Sequence Number=SeqID_168236
atggtgaaagttggaacctcttacgtgccgatcaacgtctcattttcgccaaaaagttggcccagggcttcccggtatcaacagggacaccaggatttattttttttgcgaagtgatcttccgtcacaggtgctccagtggcttctgtttctatcagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 76552 - DNA, 729 bp, Glycine max
  Peptide Sequence Number=SeqID_168237
atggaagaagccggcgtctcactgaacgagctggcctaccggcgcttcaaacaggcgctggtcacactcagctacaagccgggcgaatatctcaataccgcgcaggtgatgaacgatctggatatgggcagaacgccgatcaatcaggcaatccaccgcttggccaacgaggggttactgcaggtcatcccgcgcaaaggcgtgatggtttcaccgttgtcgatggacgatgcgttggaattgatcgaagtaaggctggctaacgagatgctgtgcatgcagctggcgagccagaggattaccgagaggcaaatcgcgacgctgaccgaactcaatcggcaaatcgaagccgcgagccaggagcgagatagagtgcgaatgatgacactcgatcatgagtttcaccaggagctggcgcagatcgccggcaataacatgctggcggatatcctgagtgtgctgcacgccagggcgcagcgtttttgggccagcaccctgtcgcgggaagggcatatgcgcgaagtgatcgacgaacaccgggcaattatcgccgcgctggccgcacaagacagcgccgccgccgccgaggccgcgcaggcgcatatcctgtcattccgcagcgcgctgctgcacgacggctccgtcgagaggtggccgacgttggtaggcgttgccttaaaaaacagcaaaaaatccggtgagaatctcaccggaccgttagccacctga

SEQ ID NO: 76553 - DNA, 465 bp, Glycine max
  Peptide Sequence Number=SeqID_168238
atgaccaggagaatatccatgaacgattccccgaacggaatgctgtttgtcgcgacggatgtcgccacgcaggatgatgcggatttcaatcgctggtatgaccgcgaacacgtggaggagcgggtgcgggtgcccggcttttatccggcacacgctatcgggcattgcagggcgggcgtcaatatttggggctgtataaaaccgaatcgttggccagttttacctccgaagcctatcgcgccgcgtttcaacaccaaacgccttggtcggtggccagcctggagaaaatgcgcgatccaatgcgccgggtgtgtgcggtggaggcggtcaccggccaagggtgcggcagtcatctctgtatcttcgtgctgccgtcggcggcatcggaagcgctgcatgcccgcatcttgcaactgggcgcacggctggctgaacagcctggctttgtgcgcagcagcctgttga

SEQ ID NO: 76554 - DNA, 544 bp, Glycine max
  Peptide Sequence Number=SeqID_168239
gtgcgcgcccatcgaagatctgatcgcgcagaaggtggacatcatcggcgtggtgccgaacgacgcccgggtactggagccggtgctcaagcgcgcgcaggaggcgggcatcaaggtgatcgtgcacgaatcccccggccagaagtacgccgactgggactttgagctggtggacgcctcgcagcacggggtcaaccacatgaaagcgctggccgcctgcatgaaagagcagggcaagtatgcggtgtacgtcggcagcctgacggtgccgctgcatatcacctggtcggactcggccatcaactaccagaagcagcactacccgaacatgcagctggtgggcgacaagttcggcgtgggggaatcgctggatgacagcgtgcgcaccaccaacgatctgatggccaaatatcccgatctgaaaggcgtgctggcgttcggatcgcaggggccgatcggcgccgggcgcgcggtgctcaaccgcggcaaaagcaacgatatctgcgtcatcgggccgttcagcccgggccagggcgcttcgctg

SEQ ID NO: 76555 - DNA, 330 bp, Glycine max
  Peptide Sequence Number=SeqID_168240
atgaagaatgatgaagaacggtggaaaaccttcacgaaattgcccacggaaacgtctcggaagtgttacggaagcgcctcggcttggattttcttcacggaaacaaattttctcactaatttcaagggaaaagagggaggtggttgccgcccagctcgcccaggcgagttggattgtttccaccagaaggcaccgccttctgttgaaacaccctggatggtccaagtgggtctgaacttgacggattgcctaacgatgggtgttaagtacctcgaagcggtcaagcgaaggttgcatcccaccaaacagatggtccctggacgaaattag

SEQ ID NO: 76556 - DNA, 177 bp, Glycine max
  Peptide Sequence Number=SeqID_168241
atgagccagcatgctggaattcaaccacacattgtttcaagtttaagtcacatgttggatgaacacaatgcccatgctaaaagttttagaatgaccagggatagattggcagatagtcaagtcgataatatcagattgaaattgatagttgctcgtgaaaaagatggtcgtgtataa

SEQ ID NO: 76557 - DNA, 273 bp, Glycine max
  Peptide Sequence Number=SeqID_168242
atggtgaaagttggaactcttacgtgccgatcaacgtctcatttcgccaaaagttggcccagggcttcccggtatcaacagggacaccaggatttatttattctgcgaagtgatcttccgtcacaggtgctccagtggcttctgtttctatcagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 76558 - DNA, 340 bp, Glycine max
  Peptide Sequence Number=SeqID_168243
atggtcatttctccggagcgacgcgtccagctcagggacaatgagtataccgatttccaggaagaaataggtcaccgacggtgggcatcactggttacccccatggccaagtttgatccaaacatagtcctcgaattttatgccaatgcttggccaacagaggagggcgtgtgtgatatgaggtcctgggtgaggggtcagtggatcctgtttgatgcatatgccatcggccagctcctgggatatcctttagtgctggaagagggccaggagtgcgagtatggccagaggaggaaccggtccgatgggttcgatgaggaggccatcgcccagttgctat

SEQ ID NO: 76559 - DNA, 414 bp, Glycine max
  Peptide Sequence Number=SeqID_168244
atgtcagacatggatactgtagagaacagcattagaggcaatggcgagatagccgagaaagaagagcaccaacaccataccagtaagacggagcatcgacgaggaggcatcagaaccttacccttcatccttgcaaatgaattgtgtgatagatttgcgagctctggttttcatgcaaacatgataagctacctcactcagcagctgaacatgccattggtatctgcctcagtcacgctcaccaactttaatggaacttctagcttcactcctctctttggagctctcattgctgactcctttgctggccgattttggaccattgttgtcgcttctttcatctatgaactggtttctcatcctctccttttcactctctacaatctgagtcatattcacctatctcactcatga

SEQ ID NO: 76560 - DNA, 1881 bp, Glycine max
  Peptide Sequence Number=SeqID_168245
atgactgtgaccatttctattggtataaccattatttttaccattaccattataatcgtcctcattgccatcatcatcggtgttgaaggaggtgatggtagcaatgacaacgacaatgatgatgatgatgatgatgattgtaacagtagtcatgatagtgacggtaacgatgaaaaaagtcatgacaataaaggtcgtgacgtagctggttttaatggcaacttgataagttaccttacccaagtgctgaacatgccattggtatctgcctccaacattctcacaatctttgttggaacgggtagcttcacccctcttcttggtgctctcattgctgagtcctttgctggccgcttttggaccattactattgcttctcttatctatcaactgggattgataagtttaacagtatcagctatactaccccattttcgccccccaccatgtccaacacaagagaattgccaagaagccacatcctcacagctgagcatgctctacatctctctcctcctcacatctcttggatccggtggcattaggccttgtgttgtgccctttctgggggaccaatttgacatgacaaaaaatggtgtggcatctaggaaatggaacctcttcaattggtactttttcagccttggattggcttctcttagtgccttgaccattgtggtttacattcaagacaacactggctggggttggggctttggcataccaactattgtcatgcttgtatccatcatagcctttgtgttgggctcaccactttataagactgagaaaccagaagggagccctttggttcgtttggcccaagtgattgtggcagctataaagaagaggaatgagactttaccaagtgatcccaagtttttgtaccaagatagggacctcgatgctgctatttgtttggaaggaaggctcttacacacggatcaatttaaatggttagacaaggcagcaattgtcacaggggaggatgccagagacccaaatgcaccaccaaacttgtggaaattggccacagtgcacagagttgaggagctaaaatccatcatcagaatccttccaatttcctcatcaggaattttactcatagctgcatcatcacaccttcccagctttgtgattcaacaagctcgaacgatggaccgacacctctctcactcattccaaatttccccagccagcatgtccattttcagtgtactaaccatgatgacaggagtcattgtatacgaacgccttttcgttccgttcattcgcagattcaccaagaacccttcagcaatcacctgcatacaaagaatggcaataggctttgtgatcaacactatagccacattggtttcagcaccagttgaaatcaagagaaaagctgttgctgaaaagtaccacttattggatagtccaagtgcaactattccaataagtgtgttctggttggtacctcagtattgtcttcatggtttggctgatgtttttatgtctgttggactctttgagtttctctatgatcaatcacctgaaagcatgagaagcagtgctactgctttgtattgtatagtgatagcacttgggagctatgctggtacatttgttgtgacacttgtgcataagtatagtggcagtaaggagaggaattggttgcctgataggaacctcaataggggtagattggagtactattacttgcttgtaagtgggattcaagtgttgaatctggtttattttggaatttgtatttggtgttacacttacaagcccttggaagagattgctgaagtgagcatggaaaaggatttggagttggaacaggccaattcaaaggtctcatgtgtcaattcgaaagatggtggagatgctgaataa

SEQ ID NO: 76561 - DNA, 267 bp, Glycine max
  Peptide Sequence Number=SeqID_168246
atgaaagtcatccaagcaaataagagaaagcgaaaaactacaagcgaacttgaaaacacgcaatgtggcgttgcttgtggaagagagagaaagggggaagagagcactgtgagaaaacgagatcaccagaagctattgctcaagacgagagggagaaatgtcttgggttttgatgaaagcatgtcaatactcctaacctccgatggagaattagtggaggcggaaggtgagggcgaaaggcgaggagaagaaagtgactcaggttag

SEQ ID NO: 76562 - DNA, 261 bp, Glycine max
  Peptide Sequence Number=SeqID_168247
atgtggaggctgaagatagcagatggtggaaaagatccatacattttcagcacaaacaattttgtaggaagacagacatgggaatttgatcctgaggcaggaactccagaggaacgagctcaagttgaagcagctcgtcaaaatttctataacaaccgtttcaagttcaaggcctgtggtgacctcctttggcgctttcaggattgtgacatacttgcatcaaaccatatatatacgtatccgaaacaacaagaagcttaa

SEQ ID NO: 76563 - DNA, 159 bp, Glycine max
  Peptide Sequence Number=SeqID_168248
atgaccttgaccaacaatcttgatgttctatgtatccaagaaacaaaaatcgaagccattgataggaggatatatcagtatttatgggttgactgtaatctgacatcgagtcaggcaacatcaatcactccagcaggatttcctttgttggaagtctga

SEQ ID NO: 76564 - DNA, 349 bp, Glycine max
  Peptide Sequence Number=SeqID_168249
atgactaggggcaatccaggtgatttacaacccgttgatcctgaaatagatagaacctttcatagattagttaggcatagtgtgcatcctggtcattctgtgcattttgagcattttgagcatcccgatcattttgagcattctgttgttggtgattctgaatattctgattttgagcattcgactgttaattttcacactaagaacatggctcaacctccacctcgtgagatggctgcacatgatttcacttatgaaagcttgtgcattcaatatcttgatgagggtgttccatatgttctcaagactggactaatacatttgctgcccaagtttcatggtcttgcag

SEQ ID NO: 76565 - DNA, 1548 bp, Glycine max
  Peptide Sequence Number=SeqID_168250
atggtgaatccaggattgttttctgcgaataagtctgtgaattcggtgaaagtaagctttcggataccgtattttacccaatggggtcagaccttgttggtgtgtggctctgttccagtgcttggttcatggaatgtgaagaagggtgtgctgctcaggcccattcatcaaggggctgagctcatctggggtggaagcatcactgtgccaaaagggttccgatgccagtacagctattatgttgtagatgataacaagaatgtgctgagatgggagatggggaagaagcatgaattggtactccctgaaggaattcggagtggccacgagattgagttccgtgatctttggcagactggctcagatgcactccctttcagaagtgctttcaaagatgtaatttttcggcaatgctgggatttgagtgacacaaccgtaggagtaaaccacattaatattgaaccggaagatggcatgatgcgggaaataccttggcgtggtgctggcgtagcaatcccaatgttttctattaggtcggaatctgatctgggtgttggagagtttcttgaccttaagttgctagttgactgggctgtagcaactggtttccatttagttcaacttttaccaatcaatgatacatctgtgcatgggatgtggtgggattcttatccatacagttcactctcagtctttgccttgcatccattgtacctgagagtacaggcactttctaagaacatacccgaggcgatcaagaaagagattgaaaaggcaaagcagcaactagatgggaaggatgttgattatgaggctacaatggctactaaactctcaattgctaagaaagtttttgctcaagagaaagatttgatacttaattcaagttcctttaaggagttcttttctgagaatgagggttggttgaaaccctatgctgctttctgtttcctgcgggacttctttgaaacatcagatcgcactcaatggggtcattttgctcattactcagaagataagctagagaaacttgtatccaaggacagcctgcattatgagataatttgcttccactactatgttcaataccatttacatttacaattatcagaagctgcagaatatgcaagaaagaagggagtgatactaaagggagatcttcctattggggttgacagaaacagtgtggatacctgggtgtatccaaatttgttccgaatgaacacttctactggggcacctccagattattttgataaaaatggccagaattggggtttccctacatataattgggaagaaatgtcaaaggacaactatggttggtggagagctcgattaacacagatggcaaaatattttacagcttacaggattgatcacatattgggattcttccgaatttgggaacttccggatcatgctgcgacaggtcttgttggaaaattccgaccatctattcctcttagtctgtcaatttatatttcatgtcttatctgttgtaggaagaacttgaaagagaaggaatatgggactttaatcgcctaa

SEQ ID NO: 76566 - DNA, 2309 bp, Glycine max
  Peptide Sequence Number=SeqID_168251
atgacagaggtgttgatgtgtatcgccagtgtctctgagctgagtccagacgaggagaggatcttgatcagagacattgctctcgcttcccaagctaacagcaaagaaggcgacaccttcttcttaatcactcagagatggtggcaacattggattgaatatgtgaaccaagaccagacaaatacttcatatgatgcatcttccttatcagaacaatttgatttggccaattcaagtgcattaaagaggccagctggtattgataattctgatttgatagacgatgctgtgttagaggactctggtacgggtattgagattcatgatacacttttagaaggccgtgactatgtattacttccccaagaagtttggaaccaattatttagatggtatggtggtggacctacattggcaaggaaagttattagttcaggtctttcccagactgaattggcagtagaggtttatcctttacggcttcaattacttatgttgccaaaaaatgaccgtttccctataagaataagcaagaaggaaaccattgggcagcttcacagaaaagcttgtgaaatatttgatcttcagccagaccaagtgtgtatttgggattactatgcccgtcgaaggcatgctttgatgaatgacatggacaaaactctcgacgatgctaatttacaaatggaccaagatattcttgttgaggtcatcaataatacaaacaacacaagttttgctcaagaaaatgggtctgcacagagggaagcaaattccgctcttgtggagccttcaaaatcaagcttatcaattgctggtggcttatctgctagcagaggtgcatctaaaggctacaacacagacctttcttcatctcagaacttaaattctccggttagagatgtggaaaacccttatggaactagtggtgtcaccacaagaagttcattccttggtctcactggattgctgaatcttggcaatacttgttacatgaatagtgcaatacagtgccttgttcatacaccggaatttgctaggtacttcagggaagactatcaccgagagataaattggcaaaatccattgggcatggttggtgaactagccctagcatttggtgagttgcttcgaaaactatgggcacctgggcgaacaccaattgctcctcggccttttaaagcaaagcttgttcgctttgcacctcagttcagtgggcacaatcaacatgattctcaggagcttttagcatttcttcttgatggtcttcatgaagacttgaatcgtgtaaagcacaaaccatatataaaatctcgagatgctgatggccgacctgatgaagaagtggctgacgaatattgggcaaatcatattgctcgtaatgattccataattgttgatgtatgccagcccaccaccaatagaaccatgacagtgacagtttttgcttgcgatggagcctcccttccattttcttgtacagtaactgtccctaagcagggacgatgcagagatctcatacaggcacttagcaatgcttgctcattgaagcacaatgagaggctagtacttgtggagatacgaaaccatttgatccatagatattttgaagatcctcttcaattgttgtctaatatcaaagatgatgaccgtcttgctgcttacaaggttccaaagatagacaagaacacaaagtatctccagttgatacatcgccaaagagagcagagtagtgactcacacatcatatctggatggaaaccatatggaacacctattgtttcattgatttcatgtgatgatactgtcacaagaggtgatatacaagtaatagttaattgtatgctctctccgctgctaaggaaaggtatcaatgtagaacaagctaccacttctgaaacaagcatcccaaaagcaacatctgatcattgcagttttaattctgatgatgatgcatgtgcccccaacatgatgtcaaattcagtaaataaggatactaccaattcaaaggcacccccaatgccattgccaacattacctcttctcttggtagatgataacaatgcttgcattgatctttcaatgggagaggagaaagtagttaaactgtctccattgtcaccaaagattttagtgtatattgattggtctcagaagcttctggagaagtatgatactcatacacttgagactttgcctgaagttttaaaatatggacctgtaaccaagaaagctcgtactgaacctctctccttgtacacctgcttggaagcttttctgcgtgaagaacctctggtgcccgaagatatgtg

SEQ ID NO: 76567 - DNA, 60 bp, Glycine max
  Peptide Sequence Number=SeqID_168252
atgactcaagaggagtatgctctgcttacagcaattgttatcctgtctccagtatactag

SEQ ID NO: 76568 - DNA, 45 bp, Glycine max
  Peptide Sequence Number=SeqID_168253
atgacgtatcttgaattgagtggatggtgcaaaaaagtagacgag

SEQ ID NO: 76569 - DNA, 333 bp, Glycine max
  Peptide Sequence Number=SeqID_168254
atgatgacaaaaagctcaaagatcaatcaaagaacaactcaagtgaatcaagaacaatccaagactcaagaagaaagtctagagacaagaatcaagattcaaggttcaagatctcaagaatcaagatcaagactcaagactcaagattcaagaatgaagagaagactcaatcaagataaagggtacatctacttgggtttgactaagaacaagagagggtacatctcttgtggatcagttctagtggagggtacatccactaggttcaaagagaacaagggagggtacatcccttgtggatctttgcttgtaaatggatttttacaaggttga

SEQ ID NO: 76570 - DNA, 264 bp, Glycine max
  Peptide Sequence Number=SeqID_168255
atgttgattgatgttggaaatgcattggcatgtgcatgttgtgtatgttcgtggggggcgaagtgcactgaccttccagggtctttggcacttgctttgggccacgttcatacattggatattatgtatgttcatggggggcgaagtgcactgaccttccagggtctttggcacttactttgggccatgttcatacgtcgtatggagtgtatgtcatggggggttaagtgcactaaccttatcggatggcccagacgtgggtga

SEQ ID NO: 76571 - DNA, 366 bp, Glycine max
  Peptide Sequence Number=SeqID_168256
atggaaatctttattcaatcaattgatcccggtgcatggaatgctattgttaaaggtccttgtataccaactaaaaaagtaaatagtgaattggtatccaaagaatgggatgagatgaaagatgacgagaaaagaaaagtgcaagatgatcaaaaagctaaaaacattttaacttctagttatattctaatgaattcttttgtactgcaaggtgaaaaagtgcaaaggaaatatggaaaatgcttaaagtcgctcatgaaggcacaacggatcttttcgaatgaagaatggagaaaccatttcagaacttcaaacaagattcacccatattgtgcatcatcttcttggtcatggaaaaatgtttga

SEQ ID NO: 76572 - DNA, 219 bp, Glycine max
  Peptide Sequence Number=SeqID_168257
atggtagtgtcgcaacgtgcccttttgcgggcgagcgaaggcgaggctcacgggtgcgctttccaaaggaggaaagatgcgcggagtcgccaccaacgtttatttgtggaaaacgtcgggaaaatcgaaggaaaccggtcgacaaaagcggggcttttgctcctacgtaccctccatcgaagaggaaatcagacctacgtagttcttccttatgcgtga

SEQ ID NO: 76573 - DNA, 369 bp, Glycine max
  Peptide Sequence Number=SeqID_168258
atgttggagttcgagtttgagttcgtgttcgtcactgttcgtgttgcagttcccattcgagtttgtgttcgtcactgtcgcgatttagtgaccctggacctcagttgcactgtgcctttatgggtttgtgtttacagtgaccctggagctcacctatcaatgaagtttccatcaaaggttaggtatgttgggtctttaaaattagtttctgagaatgatttgctaaaagatatgggttggtattacaacgaattgctcaagaagtgtgggtggaacggtgttgtgaaggttatagaggcaaagggagagggaggcgtgtttcatttgttgaatccagattgtgacaatgttgtttccttgctcgattga

SEQ ID NO: 76574 - DNA, 132 bp, Glycine max
  Peptide Sequence Number=SeqID_168259
atcatggttaggaccagaggattaggtcatgccttaggtcaggttattggcagaggtgtgggcagaggagatcgtgatgattccgatgatgctccgcagcgtcgacggcctactgcatccgtatggaggtag

SEQ ID NO: 76575 - DNA, 546 bp, Glycine max
  Peptide Sequence Number=SeqID_168260
ttgatgggtcagctccagcgacaagccttttgcaaagcttatggtaagatctgggacctaaccatggaagaggtctccacggaggccattgcctccctcgcccaatattatgaccagcctttgaggtgcttcacctttggggacttccagttaacacccatggtggaagagtttgaagagatcctgggatgccctctgggaggaaggaagccatacctcctctcgggattttatccctccttagctagaatttctaagacagtcaaaatctcgacacaggaattagaccgcggaaagcaagtcgaaaatggggtggttggggtaccaaggaaatgtttggaagcaaaggcgagagtcttggcaagtcaaggcgaatgggccccgttcatggacattctggcacttttgatcttcggagtggtccttttttcaaatgtggatgggttggtggattgggcatcgattgatgcctttctcgccttttacgaccgcaaggaaagcctgattgtcgctatcttagccaatctgtatgacatatttgactga

SEQ ID NO: 76576 - DNA, 231 bp, Glycine max
  Peptide Sequence Number=SeqID_168261
atgcgaccgctgcgggtcacaccgctcagccccgtgatattggttaccttggccgacaatgagctgatgtcggtggcttcttcttccctttcactcggaggtgtatacctccacgggactgcatggctgttttggtatgggaaaggaacaggtttagttgccggggggtattggggtcctttaatggtgattttccaccatggagatgcagcggaagacaaaggagaagag

SEQ ID NO: 76577 - DNA, 225 bp, Glycine max
  Peptide Sequence Number=SeqID_168262
atggcggaagaagaatctggactacctacagtcaatttgcatgcatctcattgtgcagtcatgaacgtgatccacctaaacaaaagagaagtcaaggaaatgagaaaaagacagaagacgacaatattactcaagggccatcaaaacgaagaaagcaatttcatcacttgtgagtgttgccctgagtgtcccttgggaactgcagaatctgttgatcttttttag

SEQ ID NO: 76578 - DNA, 657 bp, Glycine max
  Peptide Sequence Number=SeqID_168263
atgtctcgcaaagaaaatctgatatctaagttacacaccagaaaaggaacatggaaaatagttgtgcgtatcactgatctttggcaagctcgaaagcaaaatagtaaacaaacaattgagatggtgttgatggaccaaacgggttcaaaaattggagctactctctggcaagaactcttcactgaattacgggacaagttacagtgtggttcttcgtatttgattcagaatctgaggattgttgacaaccaatctgaatacagagtcagcccagctccatatttggtttatttcctaaaaactacatctgtcaaggaaatccactgtccagaaattccttctaatatttatctcataactccttttactgatataatctttggcctcgcacaacgccatactttagtggatattgttggtgtggttgctgatctaatcgatgttaagacagttaatccccctcacaggatgacagtcaggctcagggataacagtatgagtgtatatatgagtatgggtgtaagaacaactaacagagactatgctattcatctacgtgaggctatagacaaaaaccctctgcttcaagaaccattggttgttatgttgaccctaggtaaaatcaaggatgctacatgtgtgtctggtgttggttag

SEQ ID NO: 76579 - DNA, 372 bp, Glycine max
  Peptide Sequence Number=SeqID_168264
atgaagagagaatctcctctatccctgcattacaaattgtttgaggggacacatgtcccagacattgtctcgacatcagggaaagctgcttcaggtgctgtgtccaaggatgccttgattgctgaactcaaggacacatgcaaggtgctggaagcaaccatcaaagccaccacagaaaagaagatggagctagaacggctgatcacaaggctctcagaaagtggcattgatgatgaagaagcagctgaagaagaggaagaggcagctgaggaagacaaagaagcagctgaagaagaagaagaagctgctgaggaagaggaagatgcagcagaagagacagaatcagatggtgattctgaagccaccccatga

SEQ ID NO: 76580 - DNA, 495 bp, Glycine max
  Peptide Sequence Number=SeqID_168265
atgttatcacaccagcttggtggctccaagaaaaaacttccctccaagacacctactgctgctcatcttctcccacgaaggagagttcgagatcatcacaagcaccaaccacatggtacaaaaatcacaaggaattatgtatgcacctggctcaactctaaaatgcaatgtggcaccattcatcatgaaatagtccacgtgacactctcatttaggaaaactagacagcaagtatcgaggtcaccatttcatgcacaagcaactccccatccccatggtgatcagcatgagtctcaagggagttccaaaccgagtgatatgcccccaagtcactacacactacaccctctgtgtacctacacagcatacatccatcgtgatgacatcatcaacatcaacatcatctcatctcaatgtcatcatcaacgtcaacaatcatctcatctcaatatcatcaacatcataggcaatcacattccacacacacacacataa

SEQ ID NO: 76581 - DNA, 303 bp, Glycine max
  Peptide Sequence Number=SeqID_168266
atgtcattgcctagcgccgttcatgtgtctccattatcaaaagaaaaaagaaggagtggagacgagagtcgtcatcacagaaagggcaggacggacgaaatcaatgtcctatctgtcgcaacctacccttcggcgggagggcgaagcgtgactcgcgggatgcgtgttccacaaaaggaatacgcgcggagtcgccaccaacgtttatttgaggaaaacgtcggaaaaaccggaaaagacgcgatctatgaacttttaagtgaaaggttcgggagttgtatttacgcacggggaaggtattag

SEQ ID NO: 76582 - DNA, 541 bp, Glycine max
  Peptide Sequence Number=SeqID_168267
atggcgagtccggtgaaaaaacagccgaaaccagacagaaatgagattaaccttccaggattccataactacgcgatggaagttgaaatggctaaaatgagggttgggatcgtttttggcggtaagtcggcagaacatgaagtgtcgctgcagtcagccaaaaatatcgtcgaagcaattgataaaacgcgctttgatgttgtgctgctgggaatcgataaacaggggctttggcatatcaacgatgccagcaactatctgctgaacccgcaggatcccgcccatatcgcgctgcgcccatcagacgtgacgctggcgcaaattcccggtcgcgatgcccatcagttgatcaatgccgatagcggccagccgctggcggccatcgacgttatcttcccgattgttcacggcacccttggcgaagatggttcgctgcaggggatgttgcggatggcgaatttgccgttcgtcggatccgatgtgctgggctccgccgcctgcatggataaagacgtcactaaacgcctgcttcgcgatgccg

SEQ ID NO: 76583 - DNA, 363 bp, Glycine max
  Peptide Sequence Number=SeqID_168268
atgaagtttgttttctgtgttttttttggaaaacatgatgaactcgctaagcgcgtctgctgtgctaagcgagttcatccaaagtgcttgaatatgacatctaggaaaaggaaaagcactgcttccaggcctcaagctcagtatgataccaggagattccaatccttggaagcctggaacggatatacagataacattctcgaccggaggatccttccgaaaaggaatgtaaagatttatcatactgaattcgatgagtttaaggcaaatttggagaggtgtaacctacacaaaagcctcgccaaccttcaggagggaagcatagatgtggctgtagaagcaaaacttcaagaattattttga

SEQ ID NO: 76584 - DNA, 111 bp, Glycine max
  Peptide Sequence Number=SeqID_168269
atgggggtgcaaatagcacccaggcccacttgggccctccagaaggttgttgcttctggaggaagcaaccatgctcgcctgggcgagctgggcggggaggaagtgaagtag

SEQ ID NO: 76585 - DNA, 132 bp, Glycine max
  Peptide Sequence Number=SeqID_168270
atgcggggaataccttatggttatccgcacctttcgtcaaccaaggcgaatgagtcgatggttttacttccgtcatccaaagacattcaagtccgacgacgcgcaagattcttctctgctaggcagggatga

SEQ ID NO: 76586 - DNA, 144 bp, Glycine max
  Peptide Sequence Number=SeqID_168271
atgtcgaccgaaacacaacggcggttgagttcccacgaaataccacaagcgacctcgatggaaatgttcggttggcttcatccggtgatctttttggatagcctcgaccggtccaatgtcaccgaaagcacaacggtcggttga

SEQ ID NO: 76587 - DNA, 1155 bp, Glycine max
  Peptide Sequence Number=SeqID_168272
atggccgaacagctcgacccgatgggcggtgaccagctgcgccgcaagatcgagcgcatgggcgtcaaagtacacaccggcaaaaatacccaggagatcgtcaacggcggcggcaccgcgcgcaaaaccatgcatttcgccgacggaagcctactggaagtggatttcatcgtgttctccaccggcatccgcgcccaggacaagctggcgcgccagtgcgggctggagattggccgccgcggcggcatcgccatcaacgacagctgccagacgtcggatccggacgtctacgccatcggtgagtgcgccgcctggcgcgatcgcaccttcggcctggtggcgccgggttacaaaatggcgcaggtggccgtcgatcacctgctgggccgcgaaaacggcttccagggcgccgacatgagcgccaagctgaagctgctgggcgtggacgtcggcggcatcggcgatgctcacggccgcaccgagggcgcccgcagctacgtttatctggatgaaagcaaagaagtctacaaacgcatcgtggtcagcgccgacaacaaaaccctgctcggcgcggtgctggtgggcgacaccagcgattacggcaatctgctgcagctggcgttgaacggcatcgagctgccggaaaacccggacggcctgatcctaccggctcatgcgggcagcaaaccggccatcggcgtggattcgctgccggaaagcgcgcagatctgctcctgcttcgacgtcagcaaaggcgacatcatccaggcggtcaacaaaggctgccacaccgtggcggcgctgaaggccgaaaccaaggccggcaccggctgcggcggctgcatcccgctgctcacccaggtgttgaacgccgagctgagcaagcaaggcatcgaggtcaaccatcacctgtgcgaacacttcgcctactcgcgccaggagctgttccacctgatccgcgtcgaaggcatcaagtcgttcgaggcgctgctggccaaatacggcaaaggctacggctgcgaagtctgtaagccgaccgtcggctcgctgctggcttcttgctggaacgaatacatcctcaagccgcagcatacgccgctgcaggataccaacgacaacttcctcggcaatatccagaaagacggcacctactcg

SEQ ID NO: 76588 - DNA, 397 bp, Glycine max
  Peptide Sequence Number=SeqID_168273
gttttcaccgtaacacgccacatcttgcgaatatatgtgtagaaactgccggaaatcgtcgtggtattcactccagagcgatgaaaacgtttcagtttgctcatggaaaacggtgtaacaaggttggaacctcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagatcaagcttatcgataccgtcgacctcgagggggggcccg

SEQ ID NO: 76589 - DNA, 168 bp, Glycine max
  Peptide Sequence Number=SeqID_168274
atggctcatggccgtcaagcgcttaccttcaataagattggtaccattgtcggtaatgatcttcctagggagtccgtaccgataaatcagctccctcttgatgaatctgaccactacactcctcgtgacattggtgtaggaaaccgcttcgacccatttggtgaataa

SEQ ID NO: 76590 - DNA, 516 bp, Glycine max
  Peptide Sequence Number=SeqID_168275
atgtcctgcccagtgatcataactctgaccttcctctgccgaagtgtcagctggtgtatgccacccaccagacaccgtctagacccggataaatataacagggccctggggtttccagctttgatcacgggcctctgccagtcattcggggttcccgtcacacctagtaaggtgatacgaccgccgatcacccgagccttcattgagaagtattgcacgcctaggcaggcgcagggtgatgcgccacaggccacagacgcattgccaccacctcatcaggctgatcccactgggttcattaggcatggagcggtatctacaacacttggttcgccaacaggcagccaaccaccgggggcagatcagtttagggctgaggtcgcatggcccagagattggcccgaggcccagacggaggaggcacctgcaggagctcccgacgatgcagaggaggcccgcatagatgaggagatgacagacttgctcggcttcttgggaggaagcggagccacgtga

SEQ ID NO: 76591 - DNA, 388 bp, Glycine max
  Peptide Sequence Number=SeqID_168276
ggggaaacaaaagaattctcaggcggttagtccattgaaatcttttgtttatgggaaaggggaagaatcaaaagaattctcagactgtgtcattttgaattctttgacaagggagaaaggagacacaaaagaacttagggcggttagtccttcattcttttggaaaagggagaagagagacacaaaaacaattcaggcgttagtccttggcgattctttttggcaagggagaagaggaatgaaaaagatgaatagcacacttttgttttcaaggtttagaaaaccagaaaaatttagaaagcttttgacaaaggaagaagaagaagaaaatcaagaagatgttcaaagagatacaaagggtgtaaaagattgtaataattgttcttga

SEQ ID NO: 76592 - DNA, 479 bp, Glycine max
  Peptide Sequence Number=SeqID_168277
gtatgccacccaccaggcaccctctagacccggataagtctaatagggccctggggtttccagcaatgatcacgggcctctgccagtcattcggggttctcgtcacacctagtaagggtgatgcaccacaggccgcagacgcactgccaccacctcatcaggctgatcctactgggtcattaggcatggagcggtatctacagcacttggttcgccagcaggcggccaaccaccgggggcagatgcagatacatgagtgtctctaccagcttagcctcagtcagcagggtcagggtttcgttccttttgcatgccctactcctgatcagtttagggctgaggtcgcatggcccagagattggcctgaggcccaggtaggggaggcgcttgcagaggctcccggcgatgcagaggaggcccgcatggatgaggagatgacagatttgctcggtttcttgggagggagcggagccacatga

SEQ ID NO: 76593 - DNA, 1047 bp, Glycine max
  Peptide Sequence Number=SeqID_168278
atggctccaaagaagcttccagctaagaggtctaggaaagatgccactggagaaggttccagtgcggccccactagtggacatggagtttgatagacacaaagagtatactgagtttcaagaggagatttcccagaggcagtggactcagctggtgtcacccatggctaagtacgacccagagatagtcagggagttttatgccaatgcatggcctatagaggagggagttagagaaaaatgctcctgggtgagaggccagtggatcccctttgatgaggatgccattaatcagtttatggggcatccactggtcttggaggagggccaacactggcaggattttgcccagagcgtagcgggaagagaggtgcagatcatgcgtaccagcatgaccaccctcacacaaatttggatgatgttgctgcttggtaacattctccccaacgaccataactcagacctcctcctgctgaagtgtcagctggtctacaccatcctgactcaggtgagtgtacatatttcccagttgatctcagatgctatgtatcagtttgcagggatagcgcctcctcgacacccagtggacctggagaggtccaatagggccctagggtttcctgctttgatcacaggcctgtgccaattctatgaagtgccggtcaaccccaacaagcttatccggcctcccatcaggtcaggcgccacagcagccagaggaggaccagcagcagccagttgcagatgcaccattgccacctctataggagacaccatccctagggtctatctctgccacttgtggaggatagaactccagatgaacacatacatgcaacatgtgactagccagcaggcggctaatcacaggaggcaggaccccaatcctttcccttggcctactctcgagcaattcggggccaccgttgcctggcccagagatgaggccaattttgagacacaggcaagacccacagggacccctggggacgacgaaggagttgaggaagatgacgatatggctgatgtgctggatttcttcacttga

SEQ ID NO: 76594 - DNA, 936 bp, Glycine max
  Peptide Sequence Number=SeqID_168279
atggcctctatgaaacgcaagagtatcggttcaagacccacagctcaatatgatacaaggagatttcactccttagatgcatggaaccggtacacggataatgtattggggagagacatcttgccagagaggaaggtggagctctaccataccgagtttgatgattttaagactgagttggagaggcataatctccaaaaacgcctcaccaatttggttgatgggagcatagatttggctttggtgaaagagttctatgcaaacctatacagctctgagggcccttcaccaaagcaagccagggttagaggccatctagtgaagatcgacactgacagcctcaacacattcctaaagacacctgtggtgttggcagagggtgagactttgcccacaaactccagatactacaggctgccttcagattttagggagattgaggttgccctatgcataccaagtcgagggttcatcttgaacgctgagggccatcttgggaggatcctaaggaaggacctgatgactttagcccaggtgtggagtgttctctcatacaccaacctggcccccacgtctcacacatctgacctgatagtggacagaactagggcgagggcaaagccaactgagcttccttccacatctgtagctcctactccagcatccacttcagcagctccttcagtcctagctcaaagtcccacagcccaggtaccacaacatgtaaaggatgcatcatctgaggccaccattccagagccattcatggtagaggaggaggaagacccctccactcctatagtcgagataccagaggacccgactacaccagtcctgactctgaacacttctcctccagctactccattacttcatctgacagatgaggagggtgatcaaacacaagatactcaggaccagtcacaggaattctaa

SEQ ID NO: 76595 - DNA, 537 bp, Glycine max
  Peptide Sequence Number=SeqID_168280
atgggtgacatagaagaggtgcaggaacaaatgaaggccgatatggaggccttgaaagatcaaatgacctccatgatggaggccatgttaagcatgaagcgactgatagaaagcaatgtagccgcagcggtcgccaccaatgccactgctgaggcggacctgacccatccattcgccataaaccaagtaaaccaacccatactagacatgttaggtcaaggaggagaagtcttgggcagcaccggtggtccacacattgggcataataggaatgcttacccctatcgcttaccccccaattatacgctacctaccatgcacatacccaatgagaactctaatcatgtcgttcccgttacctttgagggtcagcaaccccagcttatagggggcactcgtgaagaacctcgggagcatgctcaaggtgacttcgacccatacccaactttaatgctatgcctcgacccaataccgcgggagctcctcaaccccgccctctgcaatcactgcatttctcaatatgggggccacctctag

SEQ ID NO: 76596 - DNA, 264 bp, Glycine max
  Peptide Sequence Number=SeqID_168281
atggcgagaatagccaaggtagtcaaaatcttagtgcaagaattggaccgagtaaagcaaaatagaaatggggtagttagaatactgaggaagcacttggaggagaaagcgaagactttggaggatcaaggtgaatgggcttcattctttgatgtcttggaactattagtatttggagtcttcctctttccaaatgtggatgggctggtggatctagtagcgatcgacgccttccttgcttatcaccatagcaaagaaagcatg

SEQ ID NO: 76597 - DNA, 276 bp, Glycine max
  Peptide Sequence Number=SeqID_168282
atggtcgattccgtgatcgttcttcatcgttcttcgtctgttcttaatcgttcgtcattcgtcgaccggttgccgtcccttgtgacggacgtgtggggtgctaataccttccccgtgatgagaatcctgaaactgaccaaatacaggctaaaggcccaagtggagaaggacgaaggcccaagtggagaaggacaaagcccccgagtggagaaggatgaaggcccggaggctgaaacactatcaagattattaattgttgctgaaggcccaaactaa

SEQ ID NO: 76598 - DNA, 279 bp, Glycine max
  Peptide Sequence Number=SeqID_168283
atgaacaggtctataaactatctatgcaaaaagaaagaaaatcaccctgacatgttgaggagcttaggagatcgtccccttcttagatacaacattcgggcagcatggcgcccgatgtatgcatttaagaaggtggtcatatccctcttgatggtttctaatggtatcattcccttcgaaaaacatattgcggcagtagggactaccagcaacaatatgttatcaaagagaaaaactctagatgagggttcactgttatcaagcaagtcggagacctag

SEQ ID NO: 76599 - DNA, 321 bp, Glycine max
  Peptide Sequence Number=SeqID_168284
atgactgccgatgggacaggattggttgtgctgctgatgaggcactacaggactggatgcgctgctgacaagggcgcctcggtccgcgcccctgacatgggcgcctcagtccgtgccctgggagctggcgccttaggacgcgcccctgctataggcgcgactagtcgcgctagggacctaggcgcatccagctgccttaaaacgcagcctgcgatcccccctccccccgcaagccactacctcctccccccccccccccagcccacttgttccccaacaaacaagaattattgtacaccaacaaacacaaaaaatggataa

SEQ ID NO: 76600 - DNA, 141 bp, Glycine max
  Peptide Sequence Number=SeqID_168285
atgccacttcaaggagaagatgagtcaagaagaagctcaccaccacaggaagccatggataagagcttgaagcccactaatccaagatcaagtccaagattctccactgtagaagcaaagactttgcctttgatgttttga

SEQ ID NO: 76601 - DNA, 231 bp, Glycine max
  Peptide Sequence Number=SeqID_168286
atggagtcaggtggcaggcggagataccttgtggtcatccgcacctttcgtcaaccgaggcgaactaatccgacggcattcaagctcgatgacgcacgagattcttctctgttgagcgcgggcgatcgagttcgatggcgtggggaagttccgctggggcaactgtcataccctaatttcgtccggggaccattgtttggtggcatgcaactgtcgcttgaccgccttgag

SEQ ID NO: 76602 - DNA, 489 bp, Glycine max
  Peptide Sequence Number=SeqID_168287
atggctccgaagaaactctccacgaagaggtctagaagggacgccactagagaaggctcctgtgtcgcctcagagtttgatagtcaccgtttccggagcgccgagcaccagcagcgcttcgaggccatcagggggtggtccttccatagggagaggcgtgtccagctcagggaagatgagtactcgaagttccaggaggagatagctcatagacattggacacctctagtgactcccatgcccaagttcgaccctgagatagtcctagagttctacgctaatgcctggcccacagaggagggagtttgggacatgcgctcgtgggtaaggggtcagtggattcccttcgatgcagatgcccttagccagttcttgggtgacccgctgattttggaggaagtccagcagtgtgagttcagccaaaggaggagtcaggccgacggtttcgatgaggaagccatcgcccagctgttgtgcataccagggtag

SEQ ID NO: 76603 - DNA, 696 bp, Glycine max
  Peptide Sequence Number=SeqID_168288
atgactgaagacatttttgtcttcgaaatgtgtgtggattactgtatagggcgtctccacatgctatcgaacttgatcatctctgatgacaaaagggacttcgatagtctttggataggaagggtgtgtgcgaccatatgttgtctccgcgtgtcttcggataggaaaagtgcggataaccatgaggtatctccacatgctatcagaccttcgagtcatgatagtagaattgagactttttggcggtctcggccgaaagacgttgacatctccggggatgctgacatctccgggaatgatgcagatgaccacattggtctctccgtgtcaacgggcttgctttcctctgatgttgtgtttttacgaataaccacttggggtatttcctcctgccacctaactcatgggtcaggatcaacaaatgttgtgtttgtacggataaccacttggggtatttccacctgccacctgacgcatgggtcaggattaacagatgttgtgtttgtacggataaccacttgggatattgtttttgtacggataaccactcgggtatctatgcctgccaccggacttcatgggtcgggattaacaaatgctatctttgtacggataaccactcgggtatctccgcctgccaccggacttcatgggtcgggattaatagatgttgtctttatacggatgaccatttag

SEQ ID NO: 76604 - DNA, 147 bp, Glycine max
  Peptide Sequence Number=SeqID_168289
atggggaggaggttgccgcccagctcgcacaggcgagcaggtggcttcctcaggaggaattttacggaagcattacggaagccccgaaagccatttttcaacaaaacgagggaggagcttgccgcccagcttgcccaggcgagctag

SEQ ID NO: 76605 - DNA, 477 bp, Glycine max
  Peptide Sequence Number=SeqID_168290
gcctcggcgccttcttcttcttccaaacccgaatctgaaaccgaagctgcaccttcttcggttgaatttatacccggctcttcggtgttggctgaaccggcttcgtgttccggttcggaggggctgagattgggttcggaggggcagaaggtgcagcataacggtgtggagaggacgcggcgcatgggggggaaggagagggagaatggggagtggttcggagagaggaacgggaatgggaatgggagggaaggtttggagagaagggaaggatttgggggagaaggaggaggaggagggtgtaagaaaagttaccttatccagggattattgaaattggcgccagctttggagatgttgtgtgtctctacggattttattgcaatttttgcaaatattgttttgttcggtcgtataattacgcttggattgaaaaatgttcgtttcttgcctcttcatatcgtggacatttcgtaa

SEQ ID NO: 76606 - DNA, 822 bp, Glycine max
  Peptide Sequence Number=SeqID_168291
atggcattgtttgatcatataattgacccacctagtagggaagagactttggtggtcataattacttgttttatatcatggggaactgatggtaaacatatttttcagttgcaagatttgaagcagcgtgcattgggtaactcagatgaaacttttcttagccctggaatatctgacaagctgccactacatgtggttatgttgttctcggaatctcatgaagctgtttcctcctttaggttgatccaaaagtttatgggtgctgctgcacttcaaaaatacattggaagcttgggtgggattggaccttcaggagttggatcaagttcttcctatgccccaaaggagctgaataaggaagtgatgcctgaaaagaatgtaaaaacctttaaggatgtgaaaggttgtgatgatgcaaagcaagaacttgaggaagttgtggagtacctaaaaaatccatctaagtttacacgccttggaggaaagttgccaaaggggattcttttgacaggagcacctggaactggaaaaactctgctagctaaggctattgctggagaagctggtgttccgtttttctatcgagcaggctctgaatttgaggagatgaatatgatgtacaataagctgtttagtcaaaactttttccctaacaaaaacgatatctatctccatatgcttcgttctggcttggagaacaggattataagcaatggccacaatcaaggttatcaaactcgagagtttacgcagactcgtgagagtttcatagacttgattagtgactcaactcgtagactcgtaagagtctacttcatataa

SEQ ID NO: 76607 - DNA, 534 bp, Glycine max
  Peptide Sequence Number=SeqID_168292
atggaaaagtttggttttcgtccctgcgaaatttttggtctgcttttcgtcctcatattttatagatgtgtcattttttggcttggagccaagttctataaatatggaaaagttcttcttggtgggccttgggtttgcggaaagttaggggctgcaggttgttggttggattcggggctaggtgtggttgtgctgatcttgacgacgcggtggtggtttgttggagttggtgctcgacgtgttagatccttatttcaagcagccaaaaagaaggctccttgtattatttttattgatgaaattgatgctgttggatcaacaagaaaacaatgggagggccacacaaagaagacattgcatcagctacttgttgaaatggatgggtttgagcagaatgagggaataatattgatggctgcaacaaacttgcctgatattcttgacccagctttaactaggcctggaagatttgatcggcatgtggggaaggaagaaaagggagaaatgaggttcccaataataatggtctattag

SEQ ID NO: 76608 - DNA, 174 bp, Glycine max
  Peptide Sequence Number=SeqID_168293
atggaattagtggtgttattcacaaactatggaacagaagcaaacgaattggccatgttgatagcaaggttgtacaccgggtgccatgacataatatgtctaaggaaggcttaccatggtaatgcaactgggacaatgggagccacaaatcactcaaaccatttggaaatttaa

SEQ ID NO: 76609 - DNA, 234 bp, Glycine max
  Peptide Sequence Number=SeqID_168294
atggggaaaagaggtgcttctccctttctctctcacacacacttttttttgtgcgcatatgattgcgaaggagtatccagttgtataatgtccagtggaggatgtgatgacaagattatctatacagtgccaagggtggaaatcaatgtactacaacccaccaaggaaggctttcttaggtttagctccaactaccttgcctcaaacacttgttcggcacaagagatggtctga

SEQ ID NO: 76610 - DNA, 186 bp, Glycine max
  Peptide Sequence Number=SeqID_168295
atggatggaggtaccggtgggctaaaaaaatgccgcatcgtagaaagacgtggggagttctcctgtctatttttatcgtcaaatgcctcggatcagaggatgagcgcggcgagggcaacatggctggagtccattggctggagggagaacctggtggaggagcagtcaaagttcgcattattataa

SEQ ID NO: 76611 - DNA, 429 bp, Glycine max
  Peptide Sequence Number=SeqID_168296
atggataaagcttcaagaaatggaaacttgaaagatatcaagattagctttgttggccattctattgggaatctcattatcaggatagccttaacagatgaccctgatcttgagaatactttgatctacaatctttccaaggtaacttattggagaagtggttacaggaatgttttgttcaaattcatttgcaagcctatagtgggaaagggaaaggttatgaatcgatgtcagatgcccccatctactaaagatgaagagttagttctaggggagattaagggtagtgccaggagtggctttgagagtactcgttgtagccagaagtggcatagagaatgcttggttggtagaggaaagaaaattcctaaagtgatggaagaaggatatgctgtgaacaagcctcccatgttcaagggagccaactag

SEQ ID NO: 76612 - DNA, 533 bp, Glycine max
  Peptide Sequence Number=SeqID_168297
atgactaggggcaatacaggtgatttacaaccctttgatcctgaaatagatagaacttttcatagattagttaggcatagtgtgcatcctggtcattctgtgcattttgagcattctgaacattcggttgagggtgattctaaatattctgattttgagcattccactactaatttttatactgagaacatggctcaacctccacctccacctcgtgagaggactcttagggagatggctgcacctgatttcacttatgaaagcttgtgcattcaatatcctgatgagggtgttccatatgttctcaagactggactaatacatttgctacccaagtttcatggtcttgcaggtgaagatcctcataagcatcttaaggaattccatattgtttgttccaccatgaagcctcctgatgtccaagaagatcatatctttctaaaggcttttcctcattctctggagggagtggcaaaagattggctatactaccttgctcccggtccattttcaactgggatgaccttaagagg

SEQ ID NO: 76613 - DNA, 984 bp, Glycine max
  Peptide Sequence Number=SeqID_168298
atggaagaatcgtcaaagaaatgtaagggttcatccgcctccgcttcagcttcaagagctcatcgttccggagccactagcgcatccacaacaccaattccaccctcattatcctcttccacattgttttcttccgaagaacagcagaaacggtattcaaatcttttctcatctcgttccattatcgaccctaagtttattgatatggaattcttttctgctgaaacttttgattgcattcaagcctttcagaacctaggttttatacctttcatgtcattacaattgcctgtttatcctgaattggttaaagccttttattgtaatcttgaaattcaagacaacactttaatttctgaggtttttgggataaaaatggtcattgaccaatcccttttccatgacttaacccaattgtccagtgacggtgtaccatttgaaggtacactgaatgatgattggaagtttgatttttctgcacatgatgtccgccagttggtttgcaccaacaatgcagatatgaccgaacgccttcttgccggttcattggcttttgatagccgcatcctacattatctgattgtgcggattttgcttccacgatcttccaatcttgcccaagtttctgaggaagatcttattatcatgtgggcctttcataccgactgtcaacttgactgggcacatcttgtaagatatcgcatgcataaggcattgcaattaaatgcacctttgccatatccatatcttgtcacactctttttccgccattttcaaattcctcttgattctgaaccttatgttccaatcaagagatcttttttaattggtgctattgtgattgcttcttttggttaccgcaaagaccatgatggctcttgggtcaaaaagggcgctcaacccgctgatgaagaaggcaacctaccagttgaagaaaattccactcttcttcgaaggcttatggacaagtttgatggactttag

SEQ ID NO: 76614 - DNA, 642 bp, Glycine max
  Peptide Sequence Number=SeqID_168299
atggattattatgatattgatattgaatttttgcgctttgggattgggtctgggggtgtccaaccctcgaaaaattttacttggatgtcttgtgatggatcaactattggtatgatagtgatggatgtgcaagtgggtaattgcaatcgagaactacataaggatcaacatgcaatacgaggaaaggatggaaaacaagggatggaatactcactcccttattaccattttcaagaccaaaagacaagccaaacgttgtttccctcattctacattgatgttatcgagaccaagtgggaacaagatgacatgctccacatggatcacttctctgggttcctatgtagccatcgtataccagatgtaccaggagataggatttgtattattgacttttacttttcatggacccaccctacgccgtccaattatcattttccgatacccatgccgagtgttgccaaaggcttgggtaccacccagggtagatatggtggatcttgtgtcggggatgaacgagaaaaagaggaggaggacacgtcatacaaggaggatccgtttatggatgaggaggaccccactacggaaccagagatcatggaggaggattcctcgcaggattcatctgaggattcctactag

SEQ ID NO: 76615 - DNA, 186 bp, Glycine max
  Peptide Sequence Number=SeqID_168300
atgcctgggctactcaacaccaacgagctccatgatcgcagaacacagactcccgacgcggaggaagaagacgatgctcattgcgggaacgcggcgcggaggaccgaggatggaaggattccatactttatgtatgatgatgacataatttcaacttctttcaacatcatcagtacacctctttaa

SEQ ID NO: 76616 - DNA, 258 bp, Glycine max
  Peptide Sequence Number=SeqID_168301
atgaaggacatgcacaaagtgtcactatatgatgtgtcaatggggtgtaccaagcaaatgctcaccttccccttaggattgcatcatggccctaccaaggatgttacctatcccttggcaccatcaaagaaggagaatgagcattattttgcaaggtttcttgacatcttcaagaagctggagatcacctttccttttggtgaagctcttcaacacatgcccatgtacacaaaattcttgaaggacttcctcacctag

SEQ ID NO: 76617 - DNA, 330 bp, Glycine max
  Peptide Sequence Number=SeqID_168302
atgggaccatttataccaactaaagaagtgaatggtgaatcggtacctaaggaatgggatgggatgatagatgatgagaaaagaaaagtccaagatgatcaaaatggtaaaaacattttaacttctggtttatcttctaatgaattttttcatactgcaaagtgcaaaagtgcaaaggaaatatggaaaatgcttgaagtcactcatgaaggcactacggaggtaaagagagcaagaaaacatattcttgtatctgaatatgaagcttttcgaatgaagaatggagaaagcatttcaaaactttgtagaagcaagcttcatgatgattaa

SEQ ID NO: 76618 - DNA, 537 bp, Glycine max
  Peptide Sequence Number=SeqID_168303
atgactagtagattgctggccggatcattgacctctgaggaggacttgattttgatgtgggctttccttaccagtcgtcagatcgactgggctcacttggttcagtaccgaatgcataaggcattacgggccaatgtacctcttccatatcctcaattggtcaccctctttctccatcattttcaaattcctcttgatgatgaaccttttgttcaagtcaagcgttcctttgctataggtgctggtgctgtcacttcatttggttaccgtaaggatcgtaatggtcaatggctgaagaaagatgcactccctccacaagacgagcgtactccttctcctcctcctcagcaagatgattcagcccttatgattgaagttctttcagagttacggggtcttcacacttatgttggtgaacgatttgattcattggatggtcgctttgcaggaatggatatccgtctcacgcagcttgaagaggatgtgggttatattcgtcagagcttcgaccttccaccaccaccaccaccctcttag

SEQ ID NO: 76619 - DNA, 699 bp, Glycine max
  Peptide Sequence Number=SeqID_168304
atggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttccgcccccgttttcaccatgggcaatattatacgcaaggcgaccaaggtgctgatgccgctggcgattcagtggtgcttttgcatgtctttccgggttggactcaagacgatagttaccggataaggcgcagcggtcggactgaacggggggttcgtgcatacagtccagcttggagcgaactgcctacccggaactga

SEQ ID NO: 76620 - DNA, 114 bp, Glycine max
  Peptide Sequence Number=SeqID_168305
atggctgtcattaatttagggacgccacaactagcagcagcagaggaggataccactccagctcagaccccacaaccatctccaccatctgcacctgctcctgaggagatttag

SEQ ID NO: 76621 - DNA, 210 bp, Glycine max
  Peptide Sequence Number=SeqID_168306
atggtgaaagttggaacctcttacgtgccgatcaacgtctcatttcgccaaaagttggcccagggcttcccgtggcttctgtttctatcagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 76622 - DNA, 330 bp, Glycine max
  Peptide Sequence Number=SeqID_168307
atgcatcaccaaaaaaggaaaactctagatgaggcttcactcttatcaagcgagtcggagacccagcataaccacagatcaacctctactccctatggctcacacaaaccagggtatagggcccaacatctaaagagcaacctaagtatagcacatgtcatctatcctagggttcaatggcacattatttctaactacgagggtaatagatacaaagatgcacaccaagagataacaacatggcaaaggttatatataagtatgaacaaaacaaaggataagagaaatgaggttgaagcaaaatccacaaaaagaactgtagcagaatga

SEQ ID NO: 76623 - DNA, 114 bp, Glycine max
  Peptide Sequence Number=SeqID_168308
atggctaccattgcattattgagtagatataggagtaagttagcatatgacaccggaattgggggtggtgtttggcctcagatgcgtagcagaagggttttgtgctcgatttag

SEQ ID NO: 76624 - DNA, 627 bp, Glycine max
  Peptide Sequence Number=SeqID_168309
atgtggtatgatgagataatatcaaaaaatgaaaattgtgggagtccaaggttcagcttatgctgtggagatggcaaagttgaacttccattattacaaaatccatcccaatatctccaacaacttctgtttgatgataatacaattgatagtaaaaattatcaacataacttacgagcatacaacatgatgtttgcctttacttctgctggtattaagctagacaaaacaattaatgattccagaggacctcctacaattagaatacagggccaaccatgccacagaataggtagtctattaccaatgccgggaaaaaaacccaaatttgcacagctatatatcttagacacagaaaatgaagtccaaaatagaattaatgtcatgagtcaatattctggaattcaaggccatattgtctcaagtttaagtcacatgctagatgaacgcaatgcccatgctaaaagttttaggatggtcagggatagattggcaaatgatgaagccgataatatcaaattgcaactgatagctactcgggaaaaagatggttgtgtatataatatgccaaatgttctcgaaattactgcacttattgtgacaccctttaccccgacatatatataa

SEQ ID NO: 76625 - DNA, 102 bp, Glycine max
  Peptide Sequence Number=SeqID_168310
atgaatcttttagccagtgaatgtgaattgcctgatcacagattaaggttgcttcctgagataactgcatcatcaagcttatggagtgcacttttgagaatg

SEQ ID NO: 76626 - DNA, 372 bp, Glycine max
  Peptide Sequence Number=SeqID_168311
atgaggggcaaacgggtcttttcattgagtttcctggaccctagctcgcccaggctagcctcaggctcgcctgggcccacaaattacttcatggtgaaggaaccagcttgcctgggcaagccagttacttcaggagtaagcatcagctcacctggacaagctgtcattgccccaagtgcccattttcctataaataggtgtgttagggaggctgaggagaggttccaaggtttagtacttgagggaattgagagaattaagatagaagaagaagaaagaagaggaaacgaagttgaggcgttgccgaatcgcgattgtgatcaatctctacatcgttcctcattcggtgttcttcgtatgaccgtcggttag

SEQ ID NO: 76627 - DNA, 348 bp, Glycine max
  misc_feature (320)..(320): n is a, c, g, or t
  Peptide Sequence Number=SeqID_168312
atgggattgaaccaaacaccctcttttaagaaaaggttctatcatgtcaaaaccaagagcctaaaagtagccagtttgcaagagttagggcagcagatggatcaagttcaacgtcaagccttccgcaagacatatggaaaaatctgggacttggctatgatagaagtttccgtggaagccatcacatccatcactcattactatgaccaaccactaaggtgcttcacgtttggggactttcagttggtaccaatcgtagaagagtttgaagggatcttgggatgcccactaggaggaaggaagtcgtattttttttctgnggttataccccgtccatggcaagagtag

SEQ ID NO: 76628 - DNA, 460 bp, Glycine max
  Peptide Sequence Number=SeqID_168313
atggcaggaatgggaaagttggatcatctagaggaaaggctcagggccattgaaggaggtgaagattatgcctttgctaacctagaagagttgttcctaatacccaaacatggtcattcccaagttcaaggtgccggactttggcaagtacaaggggactactcgctccaagaaccatctaaagatgacctaatggttgccttcattaagcagtgtcagtacaattctgatatggctccggataggatgcaactacaaaaacaaaagatcgaagtggatccgaaaagaggcaaatttgatcatcctactaggacgactgagaaaactggggcaaatgaagagggtgagaaagagggagaaacccatgctgtgactgccattcctatacggccaagtttcccaccaacccaacaatgtcattactcagccaataacaaacctcctccttacccaccaccca

SEQ ID NO: 76629 - DNA, 810 bp, Glycine max
  Peptide Sequence Number=SeqID_168314
atggatcaagttcaacgtcaagcttttcacaaagcatacgggaaaatttgggatttagccatgatagaagtatttgttgaagccatcgcatccctcgctcaatactacgaccagtcactcagatgcttcatatttggggactttcagttagtaccaaccatagaggagtttgaagcaatcttgggatgcctactaggaggaaggaagccgcatctatttttcgaattatacccctccatggaaagagtggcaaaagtggtcaagatctcggtgcaagagttagaccgagtgaaacaaaataggaatggggtggctgggataccaaggaatgtggatgggctagtggatctagcggcgatcgatgcttttcttgcttatcaccacaacaaggaaagcccgaccattgttgttttggctgatgcctatgacacattcgacctgagatgcaagaagagtagcgccagaattgtctattgcacacccgctctttatgtctgtcccttacaaggtcaccacatgtgtgccgagaaaggaaaagcaaattgggaggaactcttggcaagtatggtaggagcgtctgttagttggttccctcgatggaaggaaggagggaccggggttttgtgctcatgtgaaggattcccgaacgtccccttgatgggaacaaggggttgtattaattataatcccgtagtggccataagacaactaggctaccctatgagaggggcgccatcagaagagatcatcgtgccttttgttgtacggggtttcagtgaatgcaatgcaaaaatgtttcagagagtctaa

SEQ ID NO: 76630 - DNA, 306 bp, Glycine max
  Peptide Sequence Number=SeqID_168315
ggtacatccattgtggtacaagtagagggtacatctacttgggttgttgtgactgagaacaagagagggtacatctcttgtggatcagttctagtgaagggtacatccactaggttgttcaaagagaacaaaggagggtacatcccttgtggatctttgcttaagcaaagcttcaagaattattttgatgatgccaaggaatttaagaattattttgatgatgccaaggaatttcaaagatcattcaagatgaatttcaaggatgaagaaagcaagatgtcaagtaaagcaaatatctcaagataa

SEQ ID NO: 76631 - DNA, 725 bp, Glycine max
  Peptide Sequence Number=SeqID_168316
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggacttgctggattatcttgctggatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 76632 - DNA, 777 bp, Glycine max
  Peptide Sequence Number=SeqID_168317
gtacattgagcaactgactgaaatgcctcaaaatgttctttacgatgccattgggatatatcaacggtgttggaacctcttacgtgccgatcaacgtctcattttcgccaaaaagttggcccagggcttcccgtggcttctgtttctatcagctgtccctcctgttcagctactgacgggggtggtgcgtaacggcaaaaagcaccgccggacatcagcgctggcaagtgtagcggtccacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttcatgtttaacctctttaaaaatgctgatatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 76633 - DNA, 288 bp, Glycine max
  Peptide Sequence Number=SeqID_168318
atggcgaaaaggtttgcggatgacaataatttatctctacatgtcatcgggctcgccgcttctgcattacaaaaggtgcagaatgatcataatttgtctctgcgtgccaccggactcgatcgtctctggatgacaaaagactcgatcgtctctggatggcaaaaaggtgtgcgaatgaccaaaatttgtctctgcgtgtcatcgggctcgccgcctctggatgacaaaaggtgtgcggatgaccataatttgtctccgcatgtcatcgggctcgccgcctttggatga

SEQ ID NO: 76634 - DNA, 465 bp, Glycine max
  Peptide Sequence Number=SeqID_168319
atggagatggcactagtgagggccaacattgaagaggacaccaaaacagtgcgtgatggcttcaccaacaagatttctttccagcaccatgaccataaaattattcttaagcctctttcccctcgagaagtgcaaattacaaagaagaatgaaagctatgtcaggaaagccaacaagaacaggaaggaagtggtacttgaacccggtgatgatcctggacatttgagggcaaatgttttccaagaaggagggaaagatgagaatcctaaaattacccaaatacagggacttatgactaggagtaggaccaaacagtcagtggataccctccaacaaattgtaataggcatacttagcaaggccctagtggaaaaggatgaaggcccaagtggagtggagaaggacgaaggcccaaaggcaaaggcactaccaagaatattaatttttactgaagacccaaattaa

SEQ ID NO: 76635 - DNA, 520 bp, Glycine max
  Peptide Sequence Number=SeqID_168320
gaatttacaagatagtggaactctcaagcgggttgcttggggactggacgtaggcacaagggtttctgaagaagatctcattgtcatgtgggcctttcataaaggtttacaaattgattgggcacaccttgttagatatcgcatgcataaggcattgcaattgaatgccctattgccttatcctcatcttgttacccttttccttcaacacttcaacatccctcttgattctgaaccctatgttccaatcaagagatcattccttataggcgcttcagtcatagcatcctttggttatattaaggagcatgatggctcttggataaagaagggtgctagaaatgttggtgaagaaggacatgagggagaagattcatctcttctttcgaagactttggaaaagtttgacggtcttcaaacctttgttggtgagaggtttgacactttggaattgcaagtggatatgcgcttcaatgaaatggagtcaagaatgacaaaggttgaagaagatgtatcttag

SEQ ID NO: 76636 - DNA, 744 bp, Glycine max
  Peptide Sequence Number=SeqID_168321
atgaaccgtatttcaggcaaagtggtggtgattaccggcgccagcagcgggctgggcgaggcgaccgcaatacatctggccgcgcagggggcaacgatggtggtggcggcgcgcaggaaagatcgtcttgacgcactggttcggaaaatcgttggcgacggcggcaccgcgttggcgctgcaggcggatgtgacgaagcgtcaggaggtcgaagcgatgatcgcccaggccgtcaggcagtttggcaagattgatgtcttggtcaacaacgcggggctgatggcgatcgcaccgctgagtgccgtgaaggtcgatgaatgggaacggatgatcgatatcaatgtgaaaggcgtactgtacggcatcgcggcaaccttgccgctgttcgaaaagcagcaattcggtcattacatcaccatttcctccattgccggcaagaaggtgttcagccccggcggcacggtctatagcggcacgaaattcgcggtcagcgcgatcgccgaaggtttgcgtcacgaagtcggcgggaagatccgaaccacgacgatcgcccccggcctgatcgacaccgaactgaaacaaggcagttcgcacgcggaaagtttgcaggccgtcggcgaactctaccagagccaggcaatttccgccgatgccatcgcgcgcgccatcgcctatgcgatcgagcagccttcggacgtggacgtgagtgagattgtcatcaggccgaccgtgcaggagttttaa

SEQ ID NO: 76637 - DNA, 396 bp, Glycine max
  Peptide Sequence Number=SeqID_168322
atggccagagtgacgttggggaatgtttacgagcccggaatgggtttaggcaaggacaacggtggcataaccagcctgataagcgccaaaggaaaccgtgggaagtttgggttaggctataaacccacacaagcggacataaagaaaggcattataggaaggaagagcagaggtcaaggctcgcgattgggacaagaagtcaaaggaggcctgccctgccacatcagtaggagctttgtaagtgcgggtctaggacacgaaggccaagtcgttgcaatatgcgaagatgatgctccaagttggtcagagttggtacaaccatgccctcctggtttccgactaggaaattggcgagtggaggaactcccggatatttatgcagcaagcataatgtaa

SEQ ID NO: 76638 - DNA, 792 bp, Glycine max
  Peptide Sequence Number=SeqID_168323
atgggtttctgggaagacctgaatcggcccagtttcctgtataaaaagcgggcggtcaaggacaagcgccaaaaaccgggaagaacgcggcccgctgaagccggctgcccgggcgccgcaccgcaacccgctgtttccaaatcattaagagaggatacctgcatgtttaaacgtttactgatggtggctctgctggtggttgcaccgctggcgagcgcagccgaccaaaccaatccttacagcatgatgcaagaagcggcgcagaagaccttcagccgtttgaagaatgaacagccgaagatcaagcaggacccgaactacctgcgctccatcgtgcatcaggaactgatgccgttcgtgcaggtgaaatacgccggcgcgctggtgctggggcgctactacaaagaggcgacgcctgcgcagcgcgaagcttacttcaccgccttccaggcttacctggagcaggcttacggccaggcgctggcgatgtatcacggccagacttaccagatcgcgcctgaacagccgctgggcaatgccgacatcgtggccattcgcgtcaccatcatcgacaacggcggccgcccgccggtgcgtctggatttccaatggcgcaagaacagcaaaaccggctattggcaggcctatgacatgatcgccgaaggcgtcagcatgatcaccaccaagcagaacgagtgggcgtccacgctgcgtactcagggcatcgacggcctgaccaaacagctgcaggccgccgccgcgcagcctatcacgctggacaagaaaaactga

SEQ ID NO: 76639 - DNA, 405 bp, Glycine max
  Peptide Sequence Number=SeqID_168324
atgactcgacaactaatgttatccttcagccagatgcagtcccagtttcagtcacaaatgcaatcacagggactcgcactacctcctgagcctgaggttggtccttcagctgctcgtgtcagcacaaagaagagttgtgttgatccctcagggaatgatccagacacgggtgacttagacaaatgcgggttgtacatcgaagaaaattctccctgcctggttgccctaggaagactttataagggatccacaaacattcacaacattcctttgctgcatgatcaagtcaaggtcggtgttgaggaggttacagatgtaaatgatcccattcctgtacccactgaagaggttatgtgggatgctaccgtgtttgggggtataatgaaaacttccccttgtacataa

SEQ ID NO: 76640 - DNA, 244 bp, Glycine max
  Peptide Sequence Number=SeqID_168325
atggcaacccatgttgatgaaggaaaagctgagaagaaggtggaggaacataaacaacatctggcagctgagccggcacttgaacccgtttctgacttagttgaacttgaggaagttgtggaagatgaagatgaccaacaggagagagagacaccaataaaagagagtgcgtcttctaagaaagaaaaatgcgcggagtcgtcaccaacgtttattcaaggaaaacgttggaaaaaccagaaag

SEQ ID NO: 76641 - DNA, 123 bp, Glycine max
  Peptide Sequence Number=SeqID_168326
atgttaaagttattagcatcgcgagcgtctgctaagcgcaacactcatgggctaagcgcgaggaacactctggaggaagatgagttgtacaggttcgctaagcgcaccgcttcatctcactaa

SEQ ID NO: 76642 - DNA, 318 bp, Glycine max
  Peptide Sequence Number=SeqID_168327
atggtgaggttctatgatcctcttgagaagaagcttgttaaaagttgtgatgtgaaattcatggaagaccaaaccattgaagacattgataaggtgaaatatacacccaaggaagacaatggtgtggctgattttgaaccagttgaaccgcctattcatggtgatgctaccgaaccacctcaagttcaactcatgaggtccaacatggagagacaactttctaggaggtattctactaatgagtatgtgatcctaacagataatggagaacctaagtgctttaaagaggccatggaaagtgaagaaaagagaaagtag

SEQ ID NO: 76643 - DNA, 156 bp, Glycine max
  Peptide Sequence Number=SeqID_168328
agacagagagagcaatggaggaagttcgagccgtccacctcgtcgggttcaatggaagaacaaggaagagcaatgttagagtggctagggttcaatggaagaacaaggaagagcctagggtttaattggaagaacaaggaagaggctagggcttga

SEQ ID NO: 76644 - DNA, 890 bp, Glycine max
  Peptide Sequence Number=SeqID_168329
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccaggcgaattggagctccaccgcggtggcggccgctctagaactagtggatcccccgggctgcaggaattcgattgtcatgtaaggaaactgatgcttaaacaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 76645 - DNA, 267 bp, Glycine max
  Peptide Sequence Number=SeqID_168330
atgatgcaagctctattggagcttgtaggcctaggatcttcttcatcaatggattcctttgcttcttggaaaatgaatggcagcggaatggagaaagaagagagagagaggagacgccacttcaaggagaagatgagtctagaagaagctcgccaccataggaggccatggataagagcttgggggaagaaggagatgaatgaagggagagggagagaagaacatgaaattttatgctctaagagagctctgaactttgaagtttaa

SEQ ID NO: 76646 - DNA, 426 bp, Glycine max
  Peptide Sequence Number=SeqID_168331
atgaaagctgcagatggtgggtatgttcgtgctatgtacaatatctctttgtgcttctcctttggggaaggacttacacgtaaccatcaactagcaagaaaatggatgaagtgggctacggattgtggccatagtaaagctcaatttgagcatggacttgctctcttttctacatttgttgtgctaggaaattgggtatatgttgaaataaggggaaaactgaatatgggtccagacttaccaggccgtgattatgatattctacaacaaaggaaaatggagggccacagtgagatacgtctccttggggaaaattttgatgctggtttgatggggaggatgaaggacgatgagtatgaaagccgttttggaagtgataactttgaagacacatctggttatgatcaggatggtggtgatgattag

SEQ ID NO: 76647 - DNA, 802 bp, Glycine max
  Peptide Sequence Number=SeqID_168332
atgaagaagatccaaggcctacttgctccacatagagctacatcagtgaagaatgtaatggacgaagatggtgggtggacaaatgcgaccgcaaccatggtgagtactcctacacacacgataatggaatgtgcgaaatcaatatggtcgatgaaggacgatagtgattcaatggagtatgactacgatgacaatgtggacaatgttgtggaggacgatggttgtgcagggaacgatgatggtttggttggccacgacgatgcagaaaatgacgactccatggaggacgaagtcaacgatgcagaaatcgataacaactttaaagacaagggtgaagtcgtgatgcgacgtggtagcttcgtaagagcatgctctatcgtgagtgttttctctatgacttgttgctcaactagtgtggaagccatggttggtaaatttcttgtagataaaactccatttgatccggaaattacaaaaattgaaaggaagaacaggaagaaaaagaaacaagaaaccgctaaaccaccgggaaatagaccaccatggaggactcttgatgactatgcttatcaacaaggaccaaagcattacaacatcatagtcagtcctcctttcagcaacaaggttgtggaattgaagccagcactgctcagtctgattgcctcacacccctttgctagaatggatcatgaggatccatacacgcatgtgtctaccttcacagagctctgcagtaccatgggagcttctaatgaagatgctaaatttgtctacctaagagctttcccattctccttggcag

SEQ ID NO: 76648 - DNA, 312 bp, Glycine max
  Peptide Sequence Number=SeqID_168333
atgatagcattgttaccacgagtccatgcagcatatgtaggatctgttgtggttggcatcgggagggaaccatctatgaaggccaccttgttcttcattgaagagttaccatcatggcgtggctctatgtggtgtaactcttgtgatcaagaggctaggagcctcgtttgtgcgcttagagagtatatcccgctaagcgaggcaccagcgagctcagcgagacacaagaatctagaagagaatctaccttgcaagcacgcactcagctcgttgtcgctcgctaagcgagtcattcgtcatcttccaggctaa

SEQ ID NO: 76649 - DNA, 195 bp, Glycine max
  Peptide Sequence Number=SeqID_168334
atgaaaaaaaaggaagagcacgccgcaccgtgggcacagctcagcgatgtcacagggttcaacagcaccaccagcaagggcctcgcccgcacttatcgcaaggagctccatgaatctgtgatgctcctccactaccaggaaccactgagcatgctactcagtcaccgctgccatcgacgttccagcaagcaatga

SEQ ID NO: 76650 - DNA, 1749 bp, Glycine max
  Peptide Sequence Number=SeqID_168335
atggcatctgctggtcttgtggggattttagccattgctgtttgctcgtgcacggtttctttcccttggcttcaaaaccctgggacctttgttgcagcacgtgctttgcttgaaactaatgcaaaacttatgagagaagtgaagatgcgtgaagcaatgctagataaggaagcttcagtccaaagagcaaggcaggaagcatctcttgctgagggtatttcttggggcatgggtgaggatgctattgaagaagatgaggatgatgttgaagaagtgacatggcagtcatacaaaggacaacttacagaaaaacaggaaaaaacccgtgagaaaataataaaaagaatggaaaagattgctaacatgaagaaagaaataaattctattcgagttaaagacatttctcaaggtggattaactcaaggtcaacagactcagattgctaggaatgagcaaagaacaatgcagatattggaagaacttgaaaacctggaagagacactgaatgatagtattcgagagagtatgggtgcacgtacaggaaagctgtctcatgggaagaagaaaggtgcagtggaaggcgaagaagaatatttgagtgatgatgatgatgaattttatgaccgtacaaagaaaaaggcttcacatcagaaaactggtgacaaccaatcagtcgagactgcagatactcttcttgataagaaagatgtcatcaccaaggaaatgaatgagaagaaagagttgcttatgattgaaaagaacaaaatattgtcaaacccggagagtgccacacaagatgaagttgatgactcacttgatgcatacatgtcagggctttcatctcaactagtgcatgataaaagtgagcaacttgaaaaggaattgtcaactcttcagtccgagttggataggatatgctacttgttgaagattgctgacccaacaggagaagctgccaagaaaagggagttgaaagtacatgaacccaaaccaaaaaaatctgaagtaaccattaccatcaagaagaaaccacctgcagaagcacagaaaagcagtgggccttgtgcaaaagcagataacaagaatcctcctgtggaaaccctgaaaatccgcgagacccctgtcaaggaagatggctctatagaaggggaaaagcctggagctgcaactttgggtttagacaagtcggaacctgactctgacaggttgaaagctgaaaatgttgtatttgctataccaaagccccaatggcttggagctgtagaggatagggttacagacaatacccaacagtcgatgccctctctgcttctgcatgagatagatgagtccaatcagtttgtggactataaggacaggaaccaaattttgggcagcagtgataatgcaaagacgtcagtgggatctacaattgagtctgctgctggtttaataataaggaaacggaagcaagttgagacaactgcaacaaattgtaatgatgcgtctgaacaattgacatcctccacttcaggtgaaaaaatggctgaggatgccgtggcattattgttaaagcacaataaggggttgtatactaatgatgatgaggaaaaatatgaaggccaagagaggagggggcctaaaagagtgcttgggcctgagaaaccatccttcttgaatgatgagatggattacgatgactcatgggttcctcctgaaggacaatcaggtgatggacgcacttccttgaatgatagatatggctactaa

SEQ ID NO: 76651 - DNA, 1158 bp, Glycine max
  Peptide Sequence Number=SeqID_168336
atggctctagataccattttcgataaactgagtgagagtgagagagaaaatgaaaaagataaagctgatattattgctcagaaagaaaaactcaatgagttagatacaatagagttaggggctgctgctgtcaatctagttgcaggagagaagccagcagatgtttactcaggaatagcagctagcccttttcttaagatgcaaatcctcccttgtgagagggatgatctcaaaataaacagctcagttatagaaaaatcatttctatgcagagtatcaaacatcatgcaaagggatgctcagaaagatcctgcaatttttcctgatgctcttcatgcaaggactttagttaatcaggtggatagaaaattggttaagcagacagtgatgacatctgtgtatggtgtcacatatattggtgcaagggagcagataaaaaggagattgaaagaaaggaatgccatttcagatgatacagagctctttggtgcttcttgttatgctgcaaaggtcaccttaactgccttagaggagatgtttcaaggtgcacgaggtatcatgaactggcttggtgactgtgcaaaagtaattgcttctgaaaatcaaccagtgcgctggaccactcctcttggacttcctgtggtgcaaccttaccgtaaactaggaaagcatatcatcaaaacttcacttcaaatgttgacattgcaacgggaaacagataagaatagttgtctcaaggagctggtaaagaagaaattgcagggtaaaatcacttgtaataaaaagttagttggaagactttacaacatgcttgggaatcttcctcaagtcatggtcacaaggcagaggacagcatttccaccaaattttgttcattcacttgatgggtcacatatgatgatgactgcagttgcctgcaaaaaggaaggtttgaattttgcaggggttcatgattcatattggacgcatgcatgcgatgtggataaaatgaacagaatactgagagagaagtttgtagaactctacgagaccccagtgctggaaaatttactggagagctttcagagctctttcccatcattatcttttccatccttgcctgaacggggagactttgacttgagggaagttttagagtcaccatatttcttcaactga

SEQ ID NO: 76652 - DNA, 204 bp, Glycine max
  Peptide Sequence Number=SeqID_168337
atgtcatccgaggaagaccctgaggaggacccagaggagctacctcctgagcctactgtggatgctcttgactttctagagggtgatgaggacccactccctgaggtggattatcccgaggacgtcatgtcggcatctgaggcagactctatggaggagagcggccctaaagagatggcgactagtggaggctcttcatcatag

SEQ ID NO: 76653 - DNA, 492 bp, Glycine max
  Peptide Sequence Number=SeqID_168338
atgaatgtggttaaggtgggctctcggacttcgcacgtcagactgagagtggccttcgttaggaggccaagagggggaacatgcaaaacaaatgactttgatgctcaagagggtgatgagttggtcaagtccccaagtgtggacaagagttatctggtgtcaagagtgataacatggataggtatcagaattacaggtctatcaggcttgttaagcccccgagcccggacaagtgttgtccgggctgcttctgtcaagttgtctagggtggacatgcttttggacaaggagctctacttctcgttctattggcggtttgaccccaccaggttgaagtcgtttgacaaggatatgttgacccttgtggagagggtcgacaaggctatcttggagcagcttccaacctcattagacacacatgccattctatctcttcccttggcaagtgatcccatcactgccttggacggtattatgagtgacttcccttag

SEQ ID NO: 76654 - DNA, 225 bp, Glycine max
  Peptide Sequence Number=SeqID_168339
atgagattggttaagagactcctatccctcttaagattattgaggccacaaggtccaacagagcagtctagacatacagtggatgcttgccaagcgatcaaaaaaaggttggagcgtctgcttaacctaaggaaagtcactgtaggcacaaaaatacacgaggtgatcaaagactacataaggatcgctaggggtctcacaccagatggcaatgtctatgattaa

SEQ ID NO: 76655 - DNA, 357 bp, Glycine max
  Peptide Sequence Number=SeqID_168340
atggttggtatgttctacacatccatgataaataggatgttgctaggtgcacccagtagtattgttggtgcacctagcatgatcatggttagaactagagggttaggtcgtgtcctaggtagggttataggcagagccatggggagagaggatcatcatgattcagatgatgaagctgcccctgttgttgaggatgctcctgatatgactgaggacgtacctgcacatggtgcaaaagctattgatggtgctaaggggtttgctattgatgatgctgagggattctcaggtgggccgcgtgacccatcagtgctgattgagtatgctgaccatgttgcactaagcatatggaattga

SEQ ID NO: 76656 - DNA, 276 bp, Glycine max
  Peptide Sequence Number=SeqID_168341
atggatatgctagctgatgttgagacatcttcaagaatggatatcccggtttctaattccaatcattctgctcaacatgaatcacaatccctctctgtgacagcagatcatgatcccctgcttggactccccttgacgcctacaaagcggcaaacatttcaagattgtgatgatgaagcagggacctctcaaatttcacctgcacagctttcatccaacaaattaaaaaaaacatggcacaatttagtgcatttggttgtttccaagttgtgttga

SEQ ID NO: 76657 - DNA, 202 bp, Glycine max
  Peptide Sequence Number=SeqID_168342
atggtggtgataacgacgacgacaaaggtcatgatgacaaatgtggtagtgattgacgatggtgacaattatgataatgggcgtagccgtaatcatggtggtaataacaacaatcgtaatgtgcacatatctggtgcatgggacttactgaagaataatggaagcaagttgctaacgagtgactacaaaagaaaaatgcaag

SEQ ID NO: 76658 - DNA, 8589 bp, Glycine max
  Peptide Sequence Number=SeqID_168343
atggttggttttcgagttcatgtgggaaatacatcagcgagtcacataccgtctagcatttctattttccaaagggttgttaaattcgatgaaggaatgaggtcctggtatgatattccatttactgttgcagaatctcttcttgcagatgaagaatttacaatctcagttgggccaacctttaatggctcaacactccccagaatagactcgcttgaagtttatggccgagctaaagatgaatttggttggaaagagaaaatggatgcagttttagatatggaagcaagagtacttggttcaaattcatcacttagtgggtctgcaaagaagcgccgatcgatgcagtctgctcctattcaggagcaagtaatagcagatggactcaggctaattactaagttctactcatcatgtaaacaacaggattgctcaaggtttgaggaagccaggacagagcttggaaaactcaaatgcaagccattactagaaataatattcgagtgtgatagggaaccaattctgcaggcttctgctagtcgtgtcttacaagcggtttttcctaagaaagagatataccatcaagttaaggatactatgaggcttcgtggagtagtaaaatcctccttactactatcatcaaggcttgggataggtggtgctgcaggaagttggatcattgaagagttcaccacccagatgcgtgcagtctgctcagaagtggtggatgtacttgtgcaagttttatggggaattttggattttgagcagcctgacacacaaaccatgaacaacattgttatgtctgcagttgaacttatttattgctatgctgaatgcttagccctacacggaaaagatgcaggagtgcattctgtggcacctgctgttgtgttacttaagaagcttctcttttcgtccaatgaggctgttcaaactgctagcagtttggccatatcttcaagattgcttcaggtcccttttccaaagcaaaccatgttggctacagatgatgctgttgacagtgtggtgtcagtttctggccctgctgacccaagtactggaaataaccaaatcatgattgaggatgacacaattacttcatctgttcagtattgttgtgatggttgctctacagtacctatactaaggcgaagatggcattgtactgtttgtcctgattttgacttgtgtgaggcttgctatgaagtactagatgcagatcgacttcctccaccacactctagagatcatcctatgacagcaattccgatagaagtggactcagtgggagatggaaatgaatttcacttcacagctgatgatgttagtgaccagaacttgttgcctgtacctgttgatagcaacatgcagaattcttctccatcaattcatgtcttggaaccaaatgattctggggattttgctgcttctttaactgatcctgtctcaatctctgcttcaaaaagggccataaattctttacttctttctgagcttcttgaacacttgaaaggatggatggatatgacctctggagttcaggcaatccctgttatgcagcttttctacaggttgtcatctgctgtaggtggaccttttataggcagctccaagccagatagcttagatttggagaagctaatcaagtggtttttggatgagatcaatctcaacagatcatttgtagccaaaacccgttcatcatttggtgaagttgcaatcctggtcttcatgtttttcacattgatgcttagaaactggcatcagcctggtagtgatggtcccatgccaagacagagtggaactaatgacatgcatgataaaaatgtagtccaatttccactgcccacctcggccagtgctaagacttcactagatgatcaagagaagattgactttacatcacaacttcttcgagcttgtgattctcttaggcagcaatcttttgtaaattatttaatggatatattgcagcagctagtgtatgtcttcaaatctcctgttaacaatgaaggtgttcatagtaatgctgggccaggatgtggggctctactaacaatacgcagagatttaccagctggtaattttttacctttcttttctgattcatatgccaaagtgcatcgaacagatatcttcatggactaccacaggcttctattagagaatgctttccggctggtgtacacccttgttcggccagaaaagcatgacaaaactggggaaaaggaaaaggtctacaagttatcacatggtaaggatttgaagctcgatggctatcaagatgttctctgcagttacattaacaatcctcacaccaattttgtaagaagatatgccaggaggctttttctgcatctctgtggcaccaagtctcattattacagtgttcgagactcttggcagttctctagtgaagcgaagagactttataaacacataaacaaatctggtggctttcaaaacaatcctatcccatatgaaagaagtgtaaagattgtgaagtgcctttccactatggccgaagttgcagctgcacgtcctcgtaactggcaaaagtactgtttaaggcatggagatattttgtctttcctgatgaatggaatattttatttcggtgaagagtctgttattcagacccttaaactcctcaattttgccttctatacaggaaaagatgttggtcacactccacaaaaaatggagtcaggagacataagttcaaacaaatcaggtactgtatctcaagaatcaaaaaagaaaaagaaaggtgaagatggagctgaatctggttcagaaaagtcctatttggatatggaggcagcagtagatgtcttcactgacaagagtagcaatattttgaaacagttcattgattgtttccttctggagtggaattcaattaccatgcgtgcagaggctaagttagttttatatggtgtctggcatcatgctaaaccaacatttaaggaaaccattctaaaggaactcttgcagaaagttaagttcctcccaatgtatggtcagaatattgtggagtatacagaacttgttacttggttgcttggaagatcctctgatactagttcaaaacacaagatttctgaacttgtggaccaatgcttgacacctgatgtaattagatgcatctatgagacactccattcacagaatgagctgttagctaaccatccaaattctcgcatatataatactttgagtggcttagtggaatttgatggatactatcttgagagtgaaccttgtgttgcctgcagcactcctgaagtaccttacagcaggatgaagctagattctctgaaatctgaaacaaaattcactgacaaccggatcatagtgaaatgcactgggagttacacgatccagactgtgacaatgaatgttcatgatgccagaaagtcaaaatcagtgaaggttttgaacctatactataataacaggccagtcactgacttatctgagttgaaaaataactggtctttatggaagcgtgcaaagagttgtcatcttgcattcaatcagacagaacttaaagttgaatttcccattccaattactgcttgtaacttcatgattgaactggattcattctatgaaaatcttcaggcattgtctcttgaaccattgcaatgtccacgttgtagtcgtccagtcacagataaacatggtatatgtagcaattgtcatgaaaatgcttatcaatgtaggcaatgtcgcaacatcaattatgagaatttggattcttttctatgcaatgagtgtgggtacagtaaatatgggcggtttgagtttaacttcatggcaaagccaagttttacatttgataatatggagaatgatgaagatatgaagaagggactggcagccatagaatctgagtcagagaatgctcataggagataccaacaacttttgggcttcaagaagcccttgctaaaaattgtatcaagcattggtgacagtgaaatagactcacaacagaatccttctgtacagcaaatgatggtttctttacctggtccgtcatgtaagatcaacaggaagattgctcttcttggagttctatatggtgaaaagtgcaaagcagcttttgattctgtcagcaaaagtgtccagacactgcaagggctacgtaaggtattgatgaattatctgcaccagaagctttccgataccagtgtgggttcaagatttgtggtttccagatcaccaaataattgctatggctgtgcaactacatttgtaacacaatgtctggaactattacatgtgctagcaaggcatccaaattctaagaaacaacttgtttcagctggcattttgtctgagttatttgagaataacattcatcaaggtgctaaagctgcccgcgtccaagcaaggatcgtactttgttctttatctgaaggtgatgtaaatgcagttaatgagttgaacagtctgatacaaaagaaagttttgtactgccttgagcatcatcgctccatggacattgcagtgactactcgtgaggaattgttgttactttctgaggtgtgttctttggctgatgaattctgggaatcaagattacgtgttgtgtttcaattattgttttcttccatcaagctaggtgccaagcatcctgccatatctgagcatgtcattcttccttgtctgaggattatatctcaagcatgtacccctccaaaacctgaaacactggacaaagaacaaagccttgggaaatcttctgcaaatacaaaggatgagagtaatcaaaatgtatctgggtccttgactggtgctgtcactgtcagtgggacaaaaacattcccagactcatcagaaagaaattgggatgctacatccaagactcgagatattcaattattgagctattcagaatgggagaggggagcttcctatcttgattttgttagaaggcaatataaagtgtctcaggcagtcaaaggtactggccagaggtcacgaccccaaaggcatgattacctggcacttaaatatgctctgaggtggaagcgtcgtgctggtaaagcagctaaaagtgacttatcagtgtttgagttgggatcatgggttaaagaacttgttttgagtgcttgttctcaatccattagatcagagatgtgcacactcataagcatgctttgtgctcaaagttcatccagacaatttcggttgctgaacctagtggtttcattgttacctgccacactttctgcgggtgaaagtgctgcagagtattttgagttgctattcaagatggtagattcagaggaggctcttttatttttgactgttcaggggtgtctacggaccatttgtactctaattacccaagaagtgagcaatgttgagtcgttggagcggagtctacacattgatataacccaggggtttatccttcacaagctcatagagcttcttggtaaatttttggaggttccaaatatcagatcgagattcatgcgagatgacttactttctgaaattcttgaggcccttatcgtaattcgtggcttgatagttcaaaagaccaagttgattagtgattgcaatcggctccttaaagatcttttagatagtttgctgctagaaagcagtgaaaacaagcgacaattcataagagcatgcatcaatggtctggaaatacacagagaggagagaaaggggcgtgcttgtttgtttatcttagagcaactctgcaatgtgatctgcccctcaaaaccagagcctgtatatttgttggtcctgaacaaagcacatacgcaggaagagtttatcaggggatcaatgactaagaatccatattcgagcgttgaaattggcccattaatgcgtgatgttaagaacaagatctgccatcagttggatttgttaggtcttcttgaggatgactatggaatggaattgttagttgctggcaatattatctctcttgatttgagcattgcacaagtttatgaacaagtctggaaaaaatcaaatcaatcatcaaatgtgactaattccaacttgttgtctccaaatgctgtcaactcatccagagattgcccaccaatgaccgtgacttatcggctccagggattggatggtgaagcaactgaacctatgattaaagagttggaggaagatagggaggagtctcaggatccagaggttgagtttgccatagcaggtgctgttcgtgagtgtggtggactggagatactattggggatgattcagcgtctccgagatgatttcaagtccaatcaggagcaactggttacagttcttaatcttcttatgtactgttgcaaaatcagagagaacagacgtgctttgttaaagctaggagctttaggtttgcttcttgaggctgcaaggcgagctttctcagttgatgccatggagccagctgaaggcatacttttgattgttgaaagtctgactttagaggcgaatgaaagtgacaatataagcatcacacaaagtgcccttactgtcactagtgaagaagctggcacaggtgaacaagccaagaagatagttcttatgttcttggagagattgtctcatccattgggccttaagaaatcaaacaaacagcagaggaacacagagatggttgctcgaatattgccttacctaacctatggtgaacctgctgcaatggatgctcttgtccagcattttagtccttacttgcaagattggggtgcatttgaccatttgcagaaacaacatttggataatccaaaggatgatcatattgctcagcaagctgcaaagcagagattcacactggaaaattttgttagggtttcagagtcgcttaagacaagttcttgtggagagagattaaaggacattatcctagagaagggtataactaaaactgcaatgacacatttgaaagatagttttgcctatacagggcaggctgggtttaagaacagtgctgaatgggcacagggtttaacactgccatctgtccctcttatattgtctatgctgagaggtttgtcaatggggcatctgctcactaaaaagtgtgttgatgaagaaggtatcttacctttgttgcatgccttggaaggagttgcaggagtaaatgaaattggggcaagggctgaatatttgttggacacactatctaacaaggagggaaaaggagatggattcttggaggagaaggtctgtaagctgcggcatgcaactaaggatgaaatgaggcgtcgagctttgcagaagagagaggaattgcttcaggggcttggaatgcaccgagaactgttttcagatggaggcgaacgcattgttgtgtcccggccggtcccaggtatagaagatgtccaggaggaggaggatgggctggcatgcatggtatgccaggaaggatacagtttaagacctgctgatttattgggtgcttactcttatagtaagcgtgtgaatctaggtgttggttcttcaggaagtgctcgtggaggagagtgtgtttataccacttgccatcaagaggccaagagagctgatgctgctttgaagaatccgaagaaagagtgggatggagcaacacttagaaacaatgaatctctctgtaattctttattccctgtcagaggtccatcggttcctctggcacagtatgttcgctatgttgaccagtattgggacaaccttaatggtcttggacgtgctgatggaagtagactccgcctgctgacttatgacattgttctgatgttagctcggtttgcaacaggagcatcattcagtgcagatagccgaggtggaggacgggaaagtaattcccgattcctcccatttatgatccaaatggcacgccatctcctagatcaaggaaacccctcccagcgtcgaaccatggcaagggccgtatcagcatacatatcctcttcttcatcagatctcagaccctcttctccatctggcacccaacctaccccggggacagaagaaattgtccaatttatgatggtaaactcatttctctcagagtcttacgagtcctggctgcagcatcgtcgtgcttttctgcagcgcggaatttaccatgcctacatgcagcacacacattctcggtctgctatccgtgcaccatcggttacagctcctgcacacggtgtggaatctggaagcatgggccaaagtgctacaacagaaacagggcagagtgatgatcttttgtctattatccgtccaatgcttgtttatacaggcttgattgaacagttacagcatttcttcaaggtcaagaaatcaactggtgcaacaccacctacaaggactgatggggcatcatctaccacagaaggtgaagatgaaagtggaaacctggaaggctgggaagtggtgatgaaagagcgactattgaatgtaaaagagctgctcggattccccaaggagatgctgtcgtggcttgatgagattaattcggccactgacttgcaggaagcctttgacatagttggtgttctagctgaggtgctctccggggggttcacccaatgtgaagattttgtgcagggtgctattaatgcagggaaaagctga

SEQ ID NO: 76659 - DNA, 5138 bp, Glycine max
  Peptide Sequence Number=SeqID_168344
atggccgccgatagcctcgccgtcctcgccgaggctctgtcgccgccggtctcgcccggcgactttctatccaagctccgctccgacgacgccgtcctgttaggtctcaacgcgttctgctccgttctccgccgcggtctccaatcctctgatgacggaacctcgctcttcctatcctggaccgacgcgcagattcatgcgatttcctcgcttgcccacgcaatcgcctccgcttctcgatctttgtcagtggagcaagcggagggggtgctggttgcgattgtgcaacagtctatagaatttgctctgtgctatttggagaattctggagtcactagtgacgatctaggaattcagaacaacatgatacatcttttagagatggctttggttgatggaataaatatggtagcggacatattgcaacctacaactgctagtgccttgatagatatgttgccaatggttgatgattgttgtggtagttttgtggatgactacaaaaaatgccatctagaaggtttcaaatgctcaaaggaagaaaaatcaatggattggcttttaaagactttggcttctgaacatgtgcctcatgataggcaagaatctggattcattgaacagacttattatcaatatttcaataattttgtctttctatcccagcactgggcagttgtccatggaaaatgcactcctcgcttgatcttgctatgcaataagctagctaaagtaaaagatgtatttgatgagagggccgtgagtcaaaattttcgaaggagactgtcattcattttgaggatgttaaagatacttggaagtctcttgaaggatgttccatatgttgactatgatgcctctttgatgggggcagttgccacattttctaatactctgtctagtttgtttagaattaaatttgagtttgtgaatacctgtgctactactgagggaagttttgagagcattattttaatggttatagaagaatttcttcatagtgttcaggttatttttggcaatagcaatgttgcccagaatatccaaacatgtattatagcagctatattggagagtttggattcttctgtttggacatatgacaaatctgctcccaatttgaagccccccttagcttacttcccccgatttgttgtgtatacactgaaactcattactgatctgaaaagacaaagacatctagttccttttgagtggaaagactttgacgtggaacttgttggcagttctactgactcacagatcggttctccttcatgccttgttcatctggagcctgttcctttgcttaagggatttacttttgaagagcttctaaaattaatatttcctgtgtcgagccaatggattgccaatttgatgcaacttgctttgttccttcattgtgaaggtctgaaattaaagccaaaattggaaaggtcccattctagtttggctaaagttgctgggacgtctgaagttgaaaatgcagtgtgccatgaggatgaggctctttttggagatcttttttctgaaactgggcgttccgttggatctacagatggatgcgaacaaccacctgttgctgctttaatttctagttccagctatcaaaatatgccaacacaagctgctatagaacttttgaactttcttaaaacgtgcatcttctatactgaatggcatccttctctttatgttgatgcctgcaacaaactcagtagtagagacattgatattttgctttccctactcaattgtcagggttgttgttctgaagataatatgtctgatagttgtaccccattacttgaagatggaaagattgggcagatccatgatctgtgctttgatattttacacaaccttctcactaaccatgctttgaatgattcacttgaagactaccttgtggataaaatcctaactgttgagaatggttcttttagttataatgatagaaccctgaccctgcttgctcacacattgttttgtagggtcggttcttctggtagtcagttgagaaccaagattttcagggtatatgttgcctttgttgttgagaaggcaaaaactgtgtgcataaaatgcccaagtatcaatgatcttgttggtactcttccctcgctgtttcacattgaggtggttcttatggcattccacttgtcttctgaaggagaaaaggcagtgatggcaaaattagtcttttcaaccctcaaagaagttgcaagtttgacattagatttgaacagcacactgttaacatgttgggctttagtagtttcaaggttgatcttaattcttcgtcatatgatattttaccaacagacttgtccaacatcattgctcatagatgtgcgatctaagttgagggaagcaccactttctggctcatctatgcaaaacaaagttaatgatcacatgtcatcttggtcatcaactgcatttaaaaacatagcaggtgggttgattggagaggaagctgttgttagtagcttgattggacatctaattgatatttctgggtcttctgcttctcttgtcagggaggatttggcaattgacagcttaactttgaattggggagagatatactttactttttctctgattttggggttttggagaggtaaaatggccactgcagttgaggatctaattgttgaacgatatgttttctccctttgttgggatattccttatgtaggctctgaagctgaccatacaattaaatcctgggatcaagaccaccctgtggatccatctaatatgttgcattttttccacttcagtcatttactccatggccatccagagggcatgggaaagttcactatttctccggatgttatattgagcctgcttcagcatttaaatgctgctttgcccataccagaaggcattgagcaattaggttggtatttcctcagaagtggaatgtggctgtctctggtgatctccttcattaacgttggcatatggagatattatatggataatggtatttctggacatggtctaacctggactgggaatgctatgggggatgagaaatacgttaaagttgctggaagcatgatttcctccatgattgagtctggccaatttccattgcttgtaaaactgttctcatcattgctgaacaaatatttacaagtttgtcagaacgctttccttgatatccttaatgacaagcaaaagctgactcctggattttcaccattcttgcttctgaaacatactgaaatggaccaaagcctacaggatgagctcctggagaggagtggttcgaatgcaggtgagctgcagtttgttcttagcctcatttcgaggttggatgctgttgttgataaaaaagcttctggaattctttctagagcttcgtgggagtgcctattgcatggctttccttttaatctctctactcctagttctactatgttttcttgtgtccttagcataagaggaattgtctttgtcttagatgggttacttagaataaaagaagcaggcagtattattaacttggaggatgaaatccttggacaagttcttgatgcagtaatgatcatcaagtatgataggacctttgaaagtgttcatgggaaatgtgacactatctatcacagcttgagtgctgaactggatttgtcgtgttatgaagatttaattctaatgaagcaaatggaagggtttctgatggatgttaatgctggaggagcaagtgattgcagtgttcatgaatggataatctgtaaaattattgaaatattaaacagcctaagaaaagacccttcaaagtctgttatatttcatttttatcttggggttgaaaatgtgcctgagaagatgaataggcttttgcatttgcatcttggtgactgtttggttctaattgatgctttagattcatgcttctctgaatcagtgaatgtgaaggttcttggattctttgtggatcttttgtctggagagcaatttcctgaccttagaatgaggatacaaaggaaatttctggatagagacatacattgtgtatctaagtggttggagaagaggcttttaggaagcatagtgaaatcagattgtggggtggactgtgcaaaggggtgctccatatctcttagggaatcaacgatgaattttagtctgtgtcttgtatcaccaccctctgaacaacaatcaaaagaattgcaacaacatatttttaattctgcactggggtcacttgattctgcctttttgttgtttgatatacatgtagcaaagtcgtttttcaatttcattgttcaaatttctagaggagagtttttgatgaaacagcttttgacaaggactgtaatgttgatggagaaactggtgggcaatgaaaatctgcttccaggactgaaatttctatttgcctttattgaaagtgtctttagtgattgtggatccagtaagatttccttgcaaaagacaactaagaagtcttcttctggcaatagtcttgcggtaggacattcttctgctagactggttggatccagaaaaaattctgagacatttatcctttctgccaatcaagaagggggatcaacctctctcgaatgtgatgcaacttctatggatgaggatgaggatgatgcaacttctgatggagaggttcttagcatagataaggacgatgaagaggatgctaacagtgaaagagcccttgcctctaaagtttgcacatttacttccagtggcagcaatttcatggagcaacattggtatttctgctatacatgtgacttgactgtatcaaaaggctgctgctcagtctgtgccaaggtttgtcatcggggtcatcgtgttgtctattcacgttcaagccggttcttttgtgactgtggagctgggggtgtgaggggtagtaattgtcaatgcctgaaacctcggaagtttactggagatagcagtgcacctgttcgtggctcaaatacttttcagtcatttttacccttccctgaggatggagatcagctgccggacagtgattcagattttgaagaagaaatcagttcagatgcagataactctctcagttatgtattccaaaagaacttcaagaagggattccattgttattggaagaacttgatattgagagtcgg

SEQ ID NO: 76660 - DNA, 807 bp, Glycine max
  Peptide Sequence Number=SeqID_168345
atgactaatttgggttgggggcaaatacctctgcttttggttcaatgtgataagaaccctagaaacaaagttgagttcaccattgtagaagcaactctagttaagttcgcagttggagtagaagctctatctgttcgtgctgcaacgaaagacgaagaagagtggagaaagagcatgaaaacgcacactcacactctccctctccctccggagttgataagagaaattctcctcagtttgccggtgaattctcttttgcaatgcaagcgtgtgtcaaatgatttctatgccgaatccattgatattgactcaccgctgcttatgtgtgcattgcgtttgattctcccccctacatcacccccataccgtgaccaatacgatgaggtcgatcatcgcggtaaacttgagattttgggttcttgcagagggctcatacttttatactacgaccgtagctgtgatctcattctatggaatccatcaataggtgtccacagaatatcacccaagtttaagtgtggtctaacccttgtgtatctctatggtttcgggagattttcagagattcctctgtttgatcattccactatggagaaatatgagctttgtagtttgagggtgatgggaggatgtctcagtgtgtgttgctcggtccgaggctgtgctacggatgaaatatgggcgatgaaagaatataaagtggactcgtcctggactaagtccattgttatccctaacaatgggttttccccaatatgcatcaccaaagatggtggaattattggatcaaaggaagtggaagattag

SEQ ID NO: 76661 - DNA, 264 bp, Glycine max
  Peptide Sequence Number=SeqID_168346
atggtccaaggaggaatcaaacttctgtcaggaattgggttcaagctttccccagccacttctcatccatggactcctgatgtagacgaagaggtgcacaacgaaagacgaagaggaacaacgactaatgatgacagaggaagaggaacaaccaataagcaccaagagaggaacaggaacaaccaacaagcaccaacaaaggaagcgaaagaggaagagacaaagatgacagaggaagaggaagaggaagatgaagcggagtag

SEQ ID NO: 76662 - DNA, 374 bp, Glycine max
  Peptide Sequence Number=SeqID_168347
gtatgccactcaccaggcactctctagacccggataagtctaacagggccctggggtttccggcattgatcacgggcctctgccagtcattcgtggttcccgtcacccctagtaaggcggccaaccaccgggggcaggtgcagatacatgagtgtctctaccagcttagcctcagtcagcaggggcagggtttcgctccttttgcgtgccctactccagagcagtttagggctaaggtcgcatggcccggagattggcctgaggcccaggcaggggaggcgcctgcaggatctcctggcgatgaagaggaggcccgtatggatgaggagatgacagacttgctcggtttcttgggaggaagcggagccacgtga

SEQ ID NO: 76663 - DNA, 594 bp, Glycine max
  Peptide Sequence Number=SeqID_168348
atgtcacgaaacttcacggattgtgcaacaatgctttcttttgacttccggcatgtcacggaacttcacgaattgcctaatgatgggtgccaagtacctcgaagtggtcaaacgagggtcgcatcccaacaaacggatggtccccagacgaaattaggcgctccagggcaccgcatagggttgctgagaagccatgcatccactaaagtcaccgataaagcgaagcaaatactcgattccaaatttgggcctctcaaagacgacgatgatggcggcatcgaagacttcgacgatggtagcaaaatagtggagctcaacgccatagaaatcctcaccgagcacctgcacttctacgagaaaggcttcctgtgcgactcaaacctctgcatgcacatgcgcgcgcacggagaacagttcgagacgatggaggcgatggcaaagccttcagagaccattacgcagtggcgcgcaacgcgattctcgtgtccgtttgaaggatgcaaacggaacaagctccaccaacggtttcagtcgctgaaatcagtgatttgcgtgaagaaccacttcaagagaagccactgcccaaagatgtag

SEQ ID NO: 76664 - DNA, 1044 bp, Glycine max
  Peptide Sequence Number=SeqID_168349
atggtgctacctttaggttctctgcatagcaccgatgtccttgcttttgctcctggagagcttgccctgaccgaaggtggtcatgaagtccatgtagcctttggtctcgactctcttgcctgtaaagccgaggagtggattggcgatatctgcgaagcaaccttggtcaatgagaaccctggacaccatgaaatttgctatgatgatggagacaaccacttggttgacggggttgctacccttgaagtccctgttcgtaaaggtgataagagggagacttcgttactccctggactgtcctccatagggaaagtcgtcatcgatggtgttgattacacctctgatgtgtcgggcaggtcttccgctttccttctgtttgcttcttggttcctgttctgcttctttggatgtccttcgggtcttgatcatgtttgcctcggaagtttcatctggggtagccgaataggtacctccaggttggcgcttgtttggcttatggctcttgtttggcttgtgcgagtcggccttggtgtttgcttcacgcttgtcgcgcttctgtcttgcttggcggacttcattctaaaatctggacatttcttccatctggatgtagccctagacttgttcgcgcagttcgtccatgctactggactggccaaggcggccaaggtcatggtgagacctgctagtggcgtactacacactgaatcgtttgatgggggtgtcaaagctgcctatggacttgggtggaaatccaccataccaggtgtccagatgctcgtctggatcggttgtcccatcgtaccgctcaaggagggatttaggtcatctgtagtgttgtttgtgcgtcaagggtgtgattccccttgtgtgtgttcaggcaagtctctagctggtcatggtaggcctttagccttgtcaactctttctcgtggcatcatttcatctccgcgatgtagttttggagttgttggggtctcgcgtctgatgccagaccgagtgctgaccatggatggatgcgagaggattgacgagagaccatag

SEQ ID NO: 76665 - DNA, 603 bp, Glycine max
  Peptide Sequence Number=SeqID_168350
atggatttgactgttcttcctttctttgtgtaccttgaaatcagcatgctcaaaacacttgaaaggtaccagaaatgcagttatggtgctgtggaagttaccaaacctgccaaagagctcgagcagagcagctatcgtgaatacttgaagctgaaagcaagatttgaatcacttcaaaggactcaaagaaaccttctaggggaagacctgggcccactgaataccaaagaacttgagcatcttgaacggcaattggattcatctctaaagcaagtgaggtccacaaagacacaattcatgctggaccagttatctgatcttcaaactaaggagcagatgttggtagaagcaaacagatccttgacagtgaagctggaagaaatcaattcaagaaaccactacaggcaatcatgggaagctggtgatcaaagtatgccatacggtggtggtccacagaattctcactctcatcagggcttcttccagccattggaatgcaaccctacattgcagattgggtacaatgatgtagcttcagatcagataactgccacaactcaacctcaacaagtgagtggctttattccagggtggatgctgtga

SEQ ID NO: 76666 - DNA, 204 bp, Glycine max
  Peptide Sequence Number=SeqID_168351
atgggcgtggattcagattctgataaatttccaacggtaaaagcgggtggcacagaagagaaacgtgccgagagcgagcgacgacatgggagagtgtacaataccagatattcattccatcagtactatcactcactccgtccaatcatcatcttcaaattcactaatcaaataaatacttctaccatttaccttctcttttaa

SEQ ID NO: 76667 - DNA, 879 bp, Glycine max
  Peptide Sequence Number=SeqID_168352
atggagacacgcatggaagctatggagatagccatggaggagaatcgcgaagcagtggaatcgtggttgagctcgatcgaagggatgatccaaaggttggcagcggcgtgggagaaaaaatcttctaggatgaacgtgcatacaatttacgcgagcgaaggggatgaaggtatggcggtgcacgacgacaatctgtggaggaatttagaattgcccatattcgatggtgaggattcaatgggctggttgaccaggattgagcgatattttcggttacgggcagttagggaagaggacaagctggaagtagtggtgatcgcgatggagggggaagctttggtcactcaaaggtttcaggcttcgagcttgggatatcctgttcaagcgttattggcattgcaacaagaagagactgtgaagggattcatcggagtcatttctagtggaagtgtttctaaggggttaaaggaagagattagtactgaagtaaggcttcatgagccaaagaacttgaaggaagccatggttaaggctcgaagagtggaggataagaatagagttttatggaagttacccttgagtaatatccaggggtataatttgcagaaacccaactattcgggtcagaaatctgtaaaggattggcaaccagcaaatagtaaggcaattgatcttactaatgctgttaaaagaggatccagtgggtggcaaggtagaagaaccttccataatttgtcactcacgaaagtaaatgagaaaatgaggaaaggagaatatttcacctgtgacgaaaagtataatcctgctcatgtgagtaaaaataaacagttcagattgatgattatggaggaagaggatgaaggagacccttgcttatga

SEQ ID NO: 76668 - DNA, 474 bp, Glycine max
  Peptide Sequence Number=SeqID_168353
atgtatgaagcgatagataatgtagaatcctccggtgactttactgattccaggcaagtcggatccctaggaagattgaagaagagtagcagtgaatgtttttggttgaagatccgcataggagtagcacgtggacttcactaccttcatgcaggagtgaagctcaccatcattcaccttcacatcaaccttagcaacattcttttggacaacaacatgaagccaaaaatcaaagatttcagccttagcctaaagggaccacattttatgtcaaagccaaaaccaattaaagtagtttctgttgtgggtacttatgcctacatggctatggagtatgccatgtacgttctgctagatgttgtatgtggaaggaaatatgtacaaataaaagcgcaaagagaatttttggagaagcctgttgaggaggaaattgatccgaatatcaaaggaaagattgtaccagattgttggtaa

SEQ ID NO: 76669 - DNA, 363 bp, Glycine max
  Peptide Sequence Number=SeqID_168354
atgggtgaagtagaggtggaacttgagtctgctctgttgttacaggaacaagcagatatcacaaacatcagcagtaattataccttgtattccaccaccaattttccaaaataccaatggccggttagatggactgaatcactgaactcgggatacagtgatacagatactgaacaaagtattgaatccgtagagtcacaatgtcctaacaaaatgactatggttgtgttgggtaatggggatatcactagtgcatcttcttctagttcttctagtgagagtgaaagtgaatgtgatgtacagcccctgaaaggtgatcctttgatggttaggaggttaatgcgtaagtgtgtgcaaggatag

SEQ ID NO: 76670 - DNA, 453 bp, Glycine max
  Peptide Sequence Number=SeqID_168355
atggaacaaagggaggaagagggggagattacttcaccaagggacagtcaacaaaaactaaagggaggaaaaaagagctccctttttgcacaacaccaaagcttaaggtttctccaatggtgggtttcttggagaaaaggagaagtgttttgggtaacatattatgatcctacaaaaactgatttcctccctactaaatctctcctaaacttctccctctttgtcatcaagcaaaataataaggcaggaataagggttgcagatcaatcatgcttgttaggagatgagtttctcgaagatgagaaagatgaatgcatagtggtagcacttggtgatggtggaggctcatgctgcatagggtccacttcaaggatcaaggcatgtcttgccttatcaaagattcactcctcaaggttaaggaatctctcaaagaactcattcatagtcctctga

SEQ ID NO: 76671 - DNA, 894 bp, Glycine max
  Peptide Sequence Number=SeqID_168356
atggtcaccggcgatcctagacttatatccccatttgcggagaagtggcatagggagaccagcaccttccaccttccagtgggggagttgacgatcacattggacgatgtggcgtgtttcctccatcttcctatcataggggcattacccaggtttgagcctctgggcgtggacgaggcgatcttgctgttaatggagcttctagaggtgtatgagagtagatgccaagcccgacatgggattatagaggctcgtgcttacctcctccacctggtcggttgtactctttttgctaataaaagttcaacccatgttcatgtggtgcatctggaggtttttcgagacctgggtcagtctgggggctatgcctggggagttgccgcactggttcacatgtatgaccaactaaatgaagcttcccagaccccccacacgacagatgggtggtgctggatatatgagtactttcccagtgttcatcagtgcgtcactgataatgcgtatgctgagactaccccacgtgcgtcgaggtggcttacaacgaaggcacacatgaaggggatcaagggagcaccgtacagggcacgtttagatgctctgacgatcacggacgtttcctggtttccctatagtgagcatcggcccgttaggggcttcgagcttatttcatgctaccaggggcagctcagatggggtcatgttgtggtctacatccaaccagagcgggtggtacgacagtttaggtacatccagaccatccctccaccaccgattactagttcgttgtcgtatgacgagatagacgagagttggatgcatttcggggaccatttagcacccgtgggtgagatttgtgttatccctgggcaggcagcagcggactacatggagtga

SEQ ID NO: 76672 - DNA, 924 bp, Glycine max
  Peptide Sequence Number=SeqID_168357
atggggaaaaaagatcaattggcaatcaaggttggaacaagaggtttagctcgtgccttaggtggtggtataggcagaggcatgggttgggatgagcatgatgttgatgttccccagcgtcgtaggcctaccgcttctgcccgtaggcaacgggttcaagttgatgtcgctgaggaagatgttcctcatgtggacgaggacattccgatcgcggacgtagatgctgcggatgtagccgctgatggtgctgagggatcacctgttgagcatggcgatggatgccctagtgggctacgtgacacatcattgctgacattgtttgctgaccatgtggcatatagtatatggcatggcgaggaacgacctgagttgaagctggtctcccacggtaggaaagttgataaatttgggagtccagcgcctgagattgaaggtcttgtttctggcattggattaagtccattgatcggttgttctatggtcaccggcgatcctagacttatatccccatttgcggagaagtggcatagggagaccagcaccttccaccttccagtgggggagttgacgatcacattggacgatgtggcgtgtttcctccatcttcctatcataggggcattacccaggtttgagcctctgggcgtggacgaggcgatcttgctgttaatggagcttctagaggtgtatgagagtagatgccaagcccgacatgggattatagaggctcgtgcttacctcctccacctggtcggttgtactctttttgctaataaaagttcaacccatgttcatgtggtgcatctggaggtttttcgagacctgggtcagtctgggggctatgcctggggagttgccgcactggttcacatgtatgaccaactaaatgaagcttcccagaccccccacacgacagatgggtgg

SEQ ID NO: 76673 - DNA, 1056 bp, Glycine max
  Peptide Sequence Number=SeqID_168358
atggttgttagcaacttcatgcgccttccttgctgcttcttcttcgtggttttcttcttccttcgttcctgctccatcgttgttgcttcttctttgttcttgttcttcattgcttccattcgcgctccgttcattgacgcattttccttctacttcgaggcacgtgttgttgaggatccttctacggccgtggaggaattaaacgaagcacaacaacaaccacctgttgaagaaggtgttactgatgttgaggggttttcaggtggatcccatgacacatcagtcttgggatattttgaaaatcacattgctttgagagagcgccctgagctgaagctatcttcccatggaaggaagatggctatgttcggcaggcttgctccagagattgaaggccttgtggctgccataagactaggagaggtgactaacaccttggatgacgtggcgttgttgttgcatttgtcgatcgtaggggcattcatagcttcgagcaacttcatgcaagagctgaaacgattcaatgtcatggctcttatgttcgactgtcctggctacgagactgggacttatgcttggggcactgctgcacttgtgcatatgtatgataatttaaatggggcgtcaaagaacacgatgagacaacttgaatatgtttgcaaaatatctgtagtgttggatctacgaccatttctcgtctgttggttccgccgtagctaccgaggattacgacaagtgaagaccgcgtgcatgccgatggaggcattacccatgtcaacatatcgtaggcgtctagacagactgacccctgatgttatgtgttggattccatatggtgatcctcgttcatttagagaatttgaggtcatctccttgttttctggccatcttagatggggtcccttgacggtcattcaccgatcggagagggttgtaggacagtttgggtacatccagaccatttcgttacatcctcctgtgccttcggcttttgttgaagaaatgaatgctagatggatgtatgatcgtcagattaaatggagtggttctacatga

SEQ ID NO: 76674 - DNA, 534 bp, Glycine max
  Peptide Sequence Number=SeqID_168359
atgtcatgttttgttgtcgtaaaagagaaacaacgatcacgttgtatcgtgaaagggagcgatgtgtggaattacaatacttcttcatcagattcagttttgataaagaaaatcattcaaataagggactttattatctctaaagagctaagtacggaagaggccaaaaagatgattcaatcttggagcaccaatgaacaattgcttgttggcaaagtctatgaatacattagaggagtcaagcctactgttagttggaaatctctccaagtttgggctcacattcgtgatttggctcatttccgcaggcgtttcacttctttacagcgcattactgactctttaattaagggcagatccacattaggtgttcaaggaaaattacgttgtctggttatagcaattacagtctactgcatctggctgtctaagaacaagctgatttttgaagattatcaattttctgtaatagaggttattagcaagattaagtttcttatgtatagacaagcgcacctgttgcatttgttttag

SEQ ID NO: 76675 - DNA, 174 bp, Glycine max
  Peptide Sequence Number=SeqID_168360
atggtgaagatgtgtggaaaagaacagcaaacgacatatcaaaatttcactacaatccaacaagaaaaagagagggttttgggagaagaagaagggaaaacgaaattgagagtaagaggaggcgtaggaagtattgtgagtcttaaaactgacctaagatggctctatttatag

SEQ ID NO: 76676 - DNA, 696 bp, Glycine max
  Peptide Sequence Number=SeqID_168361
atgacctccgtgaacgcttctcttaagtctttgtgggaggaactagataactatcgccctttgcctccttgttcttgctctgcaaaaacttaccaccaacaggattttatcattcgtttccttaaaggccttgatgagcgttttgccatgaaatcgaacaccacgccgccaaaatgtagccactgcgacaaacttggtcacaccagtgatgtttgctactttaagtttgggtaccctcatggacatccgaaatatccaagtcacccacgtctctctaacaacaaatatacctccggtggcggcacaacctcttcaggtggaggtgcggtgaacagcgctgaagtggtaaccccaacccatggaggagaaagcaagaaagaaagctcaactcaggatcatgggtttcacatcacaatggcccaataccaagaattgatgaatcttctcagcaaatcctctggacctggtggtgcaagctcagagactactcttacgcgagccaacctcactcattctagcccaaatcaaattcacaattctggttttggtagtcattttgttttttctattcccaccacacacacacttaacactcttagtttacacaccacaccatggataattgactttggagccacagaccatataacttgttccttagattgttttatacatattctacaattgcaccaataa

SEQ ID NO: 76677 - DNA, 150 bp, Glycine max
  Peptide Sequence Number=SeqID_168362
atggcggctagaagcttagaggactctgataccatgttagatttcatcttaaaaccaattgagaatcatgccattgttggggagcttttggaagcaaaagcaagtcagcatgctgacataaacaagtcaccaataattcctcttctttaa

SEQ ID NO: 76678 - DNA, 150 bp, Glycine max
  Peptide Sequence Number=SeqID_168363
atgggaaggggcaaagcgggtctgaagggcttggatgaaggcgagccaggaggtacaggggagatggagggaataggttgcgaggatggagaagatgagatggagggtaaacgtatcaagagttcatcgaatttctgggccatggactga

SEQ ID NO: 76679 - DNA, 642 bp, Glycine max
  Peptide Sequence Number=SeqID_168364
atggctgaagatcaacctagaagagtgacccttgaagactactctagttttgttgagccgcagtttttcactagtatagcgtggccagagtctaagcagctgcttgatgcttctgcaaggggaaagattaaattgaagaccccagaagaagccatggaattaattgaaaatatggcttcaagctgcagtatttgcgggggagctcacgagtctagacgttgtattcccttagatgacacagatcaagagcatggttcgaactataaccagcaacaagggcaatggaggtcccatctggaaaatcaattcaacaaggaccagggtggaccatctaataggcctcatcaacaagggcctagcctatatgacagaaccactaagctggaggagaccctagctcagtttatgcagccaaagattgcaaccaacaattcacaagataatcacatccaagatcaaagctcctgcagaggttttgaattcatcaagaagcgtaagaatggaatatctattgatggaactctgttggttgtgagccctgtatcacctcttatggctcttgctgggaaagcacaggttgctactaaggagcttcttgattcaattttggatgatgttgttcgaatatttggtgagtgttag

SEQ ID NO: 76680 - DNA, 948 bp, Glycine max
  Peptide Sequence Number=SeqID_168365
atggaagaggcttccataatccaaagctttcaaaagcagttaaaggttctccaaaagagaaatgggaaagaaaaggtcgtgttaagacagaaacaagaagtgaacctcaaggcactacgcgaggaaaatgatgccattcaagctcagtttcaagcgccgaaggccaacatagttccaactcaacgaggagcaaccaagttggaacattcctcacatgaaaccaatcatcatgccatcaccacaggacaatctcagcaaaagtcctatggtcaacctactgaggcgtgtcatcaacaccttttcgtcatcttggatataccccttcccctggggtggaggccattgaacatttactactacaatggaactacagatcccaatgagcacattgaagcatatgtgataagccaagtcgaccacaacaagaaatacaaataccatcgaaacggccactccactgaagagtgcataattttgaaggataagattgaagagctcgcagaggtggttgtcacaatttttaccaaggcggatacacaaacagacatggcaattaccaaaaatagccagtgggggaagttgaacagcaacaacaagaaactcctcaggaacgtgaacttgatacacaccgagcagtcgccttgctactccatgcctgcaatcacattaatagatgttgactttgttggcaatgactctacacaagatgacccgatgatggtgactatcgtaatcctgggatgggcaatttgtaagacgcgtattgatcaaggaagagaacgggtatatgctaggggcaaagtggacatattaacagtcccctacgtgctggtagatgtagatacatcgtacaacatcttgcttggaagacctaccctcaacaggattagagccattgtgtctacaccacacttggccatgaaattcacttcgtccattgggaattga

SEQ ID NO: 76681 - DNA, 1083 bp, Glycine max
  Peptide Sequence Number=SeqID_168366
atgattcccattcagatccttaataagagcaagaaaaccagattgaatgacagaccacagcattgcaatttgttttctagagtcgacagtcatgatcagcttctgaaccacccgaggcctgatacagcaacactatcaaatttagcatgtcaaaaagaaaaagaaaacatcttcttctaccaaattattgtgaaaggcgttaatgacacccacttgaacaataacactgtcagtctcacgtgcgaccttgtggttccaacctccagcgccagcagagccctttactcccgtccggtcagatttcggcaaccgggaaaccgttttccggcgagcttcaccacattcttttccttctttgttaccagcctcaacccctcctcaatcggtggcggcctcaccttcgtcctttcgtctgatgacgacaccatcggtgaagccggcgggtttctcggcctcagcggtggcggcggcttcgttgctgtggagtttgatacacttatggtcatggagtttaaggaccttaatggaaaccacgtcggtgtggacttaaacaacgtcgttttgagtgaggttggtgatttggcgaacattgaggtcaatctgaagagctgtgacctaatcaacatgtggattgagtttgatggatcgagcaaagggttaagcgtgtgggtttcgtattccaatctcaaaccaaaagatcccattttgacgatgaatctcgaccaaggcagggaggatgacagtgtgggtggtgccggagtggaggatgcggaagagggagaggtcgaagccaaggaacttgaaggggaggagtttggcggtgacagcggagcagaagaggggggcatggtgctaggagggggtgaggccgtgggtgtggtcagagtggaggtgggtgagggtttggaggaagtaagggtgaaaaatgagaagggattgaaggaattgagcgagggatggagagagagtgacaaaatgaaggcttatacaacgactgttttgcctgaaaaccgtcataggtggaaagcaaaaaatatgccaacaaagacaatttttgcatcaaattttaagacaattttttag

SEQ ID NO: 76682 - DNA, 300 bp, Glycine max
  Peptide Sequence Number=SeqID_168367
atgattaagtccatgaaagaaaattacttgccagagttgaatgaaatgtaccaaaaatctgctagtaaacttcagcggcatacctcccttccacaacaaccgaagtcatataaactcgaaaagttgaagaaatttatgaagatgttggaatgtgctatagcattccttcagaagggtgagggttacttacgtagacagagtgagtggtcgaagaaagagagaggaatggactgcgacggaggtgcagcggaggacggaggtgacggcgagcagagaactaaagatgcgagactgcaatga

SEQ ID NO: 76683 - DNA, 345 bp, Glycine max
  Peptide Sequence Number=SeqID_168368
atgcccgtcgctagcaaaaccagaaatatgcttgaaggtctggtaaaagaaggatcattgaaattgttgcttggtgaagaatttgaagagatggaaaattctccttctgctgggaagaactttatacgagagctctctcctgttgcaaacctagttgttcgtagatgctcaaaaatccttaggacctcttcaagtgatcttctggagagcttcaatcaagaggcttctgattctatgaagcatccatcacgatatgcgaggaactttttggaatattgttgtttcaaaacccggttaggacttatcttcgaagaccatggaagcaatattcaagaacaattttaa

SEQ ID NO: 76684 - DNA, 150 bp, Glycine max
  Peptide Sequence Number=SeqID_168369
atggagaatagggtcagaagggtggctatttctgggtattgggaagttgctggtgtggtggctttactactaagttgtgaggatgtaaagaacaaagacaataacatagacaaaagtaaagtggaaataaaagaacacagcggaaattaa

SEQ ID NO: 76685 - DNA, 255 bp, Glycine max
  Peptide Sequence Number=SeqID_168370
atggagtgtgtggcaataatgtggttcaaaaatggttctctttctggtctctcagagtctcagttgaagaacgaggttctcttcctttgtcagctccaccaccccaatatcatgcctttaattggattttgcattcaaaaagacccccaattgattctttcacatgaatacatgcttaacggttccttcagtgatcatcttcttcatagaaacaatcacaaacttgatccacttccttggaaaatgaggctttaa

SEQ ID NO: 76686 - DNA, 1123 bp, Glycine max
  Peptide Sequence Number=SeqID_168371
ggcggcagccaattctgaaacaccacaaaacacaacaaaaaaagaatcagatgcaattatggcttctagcaatggccgaaaagcaagtgagatctttcaaggccaagctctcatatacagacacatgtttgccttcatagattctatgtgcctcaaaacgattattgagcttggaataccagacataatccacaagcacggccaacccattactctttctgagttggtgtcaattctacatgttccaccagctagagtaggtcacgttcagagcctcatgcactacctgtcacaccatagattctttgaaagtgtaagaatccatgaaaaagaagcatatgctctcactgctgcttcagagctacttgtaaaaagcagtgaactttctttagctccaatggttgagtacatccttgatccaactctatcagcttcattccatcaaatgaaaaagtgggtttatgaggaagatctctcagtatttgatatctccttagggtgtagtttatgggattttcttaacaaaaaccctgcatacaacgagtcattcaatgaggcaatggctagagattctcaaatgagtaatttggcattgagagattgcaagttggtgtttgagggactggaatccattgtggatgttggtggtggaactggagccactgccaggatgatctctgaagcatttcctgacttgaaatgcgttgtgcttgaccgtcctcacgttctggagaacttgtccgaaagcaacaatttgacatatgttggtggggacatgttcaaatctattcctaaggctgatgcagttctgcttaagtggattcttcatgattggactgataaagactgcataaagatattagagaattgtaaagaagctatttcttcaaataatggcaaaagaggaaaaataatcgtcatagatatggtgatacaagaaaagcaagatgagcataaagttacagaactaaagctcctttgggatgtagccatggcatgtgtattaaatggaaaagagagaaatgaagaagaatggaagaaactcttcatggaagcagggttccaagactacaaaatatctcccttgaccgggtttctgtctcttattgagatctatccttag

SEQ ID NO: 76687 - DNA, 405 bp, Glycine max
  Peptide Sequence Number=SeqID_168372
atggagttacttaacattggttttataaaaaccgatgctaactacttaatgttaacattgaatgctcttggaacaatcgtgggtgctcaaagctcaaagctttctacgctgccagttaacaagttgattgtgctttacgtggttttcaagcttgacaagagttacatgccgagcaaagtttccatccttgccggtgatagttttcacaacttgaaggagattaagaccgtggaactcatgaagccaactgggtgggtatatctatccttgtctggagctgatcctagtactgccattggccctgcaaagttgtgggctactgaatcgattcatgaccttgtgaagatgcttgtagaattggtattatcagtcgtgaaacatggacacaccattttcctaatctaa

SEQ ID NO: 76688 - DNA, 441 bp, Glycine max
  Peptide Sequence Number=SeqID_168373
atggcgacgccaaagacaaggccggagaacacaacagggaacacctttgatgagaagtccagcaccaatactggtcgggacaacaacaaaatcgcttgcgccacaacttgtttcgtcggcagagggggcacctttgacaacaactccggcgctgatattggtcgcaacgatattggagtgagtggtgttgtcaactgcttctctggagacatcaacgacatggtttctgtgcggtattgcaccatcggtgttgttatcgttgcggagtccatagagttgtctattgatggtaacttctcagaggggaaagatgaggaaggttggctgagtggagttgagctacagcgagttcggcaatggcggcctcaagatggtccaggcgattcgaggaaggttagtcatccgccatcagagctcaacgagagcaccaaaatgctatga

SEQ ID NO: 76689 - DNA, 355 bp, Glycine max
  Peptide Sequence Number=SeqID_168374
gagggtttcccctatgagagatgctcaggctttggatgtattcgctagagagcttcaagactcgccttctgggctaagcgagtatgacaatgatcacgcacttagcgcaggattcgcgctaagcgcgccttttggcttctttgtgggctttctttgcgttaagcttgcactggctgctgagcgaggcgacacgctaggcctttcactcatctccctcatgcttcgtctccctcacgcttctggcaacctcgaacccttttgttactctcgcgacactgaaaccagtgtcgacactatcactctcggtctcactcttgctcatggtctaggtgtcactcttactctcgctctcacg

SEQ ID NO: 76690 - DNA, 528 bp, Glycine max
  Peptide Sequence Number=SeqID_168375
atgaacactccgcttacaggatcaacaagcacacccaagaagagtcgtaaccccaacagaccagaaacaccatggacaacaacaacacctctcacacacattgatacgaagggtggcagacccaatgacatcctttggtcgactgaatcatggagagattccaaaacaaagtttgacaggctggagaaaaggacgagaaaggagaaagtagctcaaggaccgacacacacaagttggacaagcaacatagactggacaagcatcaaccccttcaaaggggaccaagctctcaagggcaagattgagaaacttatacaagcgggttacctaacccagttcgtgaaaagacccagtagcaaccaggctgaaggacgacttggaggtcacaatgaggaccatcgcaggggaagtgatagaggacaagacagaaggggaaacaaaacagaagatagagggagacctaggcatcaccaacaaagacgtgagcaccaaccccaacaagagcaggaaaatgaacctgctcaatag

SEQ ID NO: 76691 - DNA, 660 bp, Glycine max
  Peptide Sequence Number=SeqID_168376
atgtatgatgacttcaactttttctgttgctttttggatggtaagattggggaacttaaaaaactcgttgaggagggaaaaataaaatacattggtctgtctgaggcctcggcttcaacaatcagaagagcacatgcagttcatccgataacagctgtgcagttggagtggtccctatggtcaagagatgtggaggaagaaatagttccaacatgcagggaacttggtattggaattgttgcatatagtcctcttggacgaggattcttgtcatcaggaccaaagttgcttgagaatttgacacaggatgatttccgacagagtctacctagattccaacctgaaaatttggagcagaataagactatattcgagagggttaatgaactggctgcaaaaaagggatgtactccatctcaacttgcattggcctgggttcatcaccaaggaaaagacgtgtgccctatacctggaaccaccaagattgagaactttaatcagaacattggggctttgtcagtcaaactaactccagaagacatggcagagctcgagtcctttgctgctgcagatgctgtcaagggtggcaggtacatggatggttttgctacatggaaggaatctgatactccaccactttcttcttggaaagctgcatga

SEQ ID NO: 76692 - DNA, 639 bp, Glycine max
  Peptide Sequence Number=SeqID_168377
atgcctaaaccctcaaattgtttcaattttaatgaaactgccgattgtcctataaagtctaatcataccaatcaaaatggtgtaacaagtggtgcctccaatgtaccaaggtgcattgtagagaatcacacagagaccatagttcctgcagtacatggtgaagtggataagagagtccacatgagttcccctcctttaaatagagacaatgttggacttgtttcaaaaagaaatttggattcttgttcatgtcaatatatctatgtttatgatcttgctagcaggttcaatgaggatttactgaaggggtgtcactctctcatgaagtgggatgatatgtgccattacatgtctaacttaggccttggtcataaggttatcgagaaatcaaaggagaaggttctgttgaaggaaagctggtatgcaactaaccaattttcacttgaagttattttccataacacaatgaagcactacaagtgcttaaccaatgattcctcattggcttctgctatatatggaccctactatgctggccttgatgtgggttacaaactcacatttgacgtgtctgagagcaggggcactgtggcagggtgtagaaaccgatgtaaaagacattttagcagtagtgactag

SEQ ID NO: 76693 - DNA, 351 bp, Glycine max
  Peptide Sequence Number=SeqID_168378
atggctagtgattctcaaatgagtaacttggcattgagagattgcaagttggtgtttgaaggactagaatccattgtggatgttggtggtggaactggaaccactgccaagattatctgtgaagcatttcctaacttgaaatgcattgtgtttgaccgtccacaagttgtggagaacttgtcaggaagcctcaatttgacatatgtaggtggggacatgttcaaatctattcccaaggttgatgcagttctgcttaagatctgtgatgctgttgatgatgatgtagaaggggaggagaacgtggtggcatgggctggttctaggttttgtgagaagagaaaatggaaatag

SEQ ID NO: 76694 - DNA, 447 bp, Glycine max
  Peptide Sequence Number=SeqID_168379
atggcttcttcaatgaatggtcgcaatgtaagtgagatctttcaaggtcaaactctcttgtacaaacacttgtatgccttcatagactctatgtgtctcaaaagggtggttgagctttggatatctgacaaaatccacaaccatgcccaatccattactcttcctgagttggtgtcagttctactagttccatcaactaaaattggccaagtgcaaagcctcatgcactaccttgcacacaatggattctttgaaagaagaacttgtcaaggaagcaacaatttgacatttgttggtggggacatgttcaaatctattcctaaggctgattcaattcttcttaagtggattctacataattggtttgataaagattgcataaagatattaaagaactgcaaagaatatatgaaaccattcaagtcactatttttcaagaatatatga

SEQ ID NO: 76695 - DNA, 66 bp, Glycine max
  Peptide Sequence Number=SeqID_168380
atgtcccgtttcctcaatacctattttcaggtggctaggtcattgtatcctctcaaaggtgagtga

SEQ ID NO: 76696 - DNA, 1419 bp, Glycine max
  Peptide Sequence Number=SeqID_168381
atggcgtgtcttattaatggaaaagagagaagtgaagaagaatgcaagaaacttttacaaacttctatccttgtgtcgaaagcgaaggcatccacctacaaaagagactccaacgctcaagtgaagagggttcagctaagagttattaaagttacgtggtcgaatgaggtgttcagtttggatgcatgtgtggctggtgggtaccttatctggtatactagccctcagactgattgggtaccttatctggttcgtcatcaaggaagtcaattggaggagtctaaggttcgttggtacaatgatgtgctaccacctaatgcgcctgaaaaggtgggtgagagcattgcggctccagtggtggccgctgctgttgaggtggggatgtcccagagggctacttctcgacctaagaagtgtccacctccttccatcacacttctggagtatacatgggtcgacagagagttggctgtcgatcagtaccataacagatccaaagatgtgcttggtcactctgcacacggtccaagtctttgtgacgacttcacaatgggtgtgctccgcatacttaacgtagctccaatgcagcagcatccgaacaagtgggcggctatgcaagcgaatgattactcgggccaacgccaacatgaatgctttcagctaggctcggcgaaaccagatcgttgcaggaaagcgaaaacacaagaagcagagccatcgggagcatcaaagggcttaagagaccactcccgacaccgagaaggcacttcccgtgagaaaaggctcaagcagtcgatgcttgggttccaacctactaccgccaccaccttggaaaatatggcaaccctaaccaaccaaagcttcttcaataataacttttggtcaaatcgtcttattcagtcgaaaattatttcggagcacggttgccaagtcttaagcaaaggtgacaatgcggccaattgggccaacttttgggtcttcctttctagggtgccgataattgctcaacaccttcaagggtcatccaacatcaaagccttgaaggagcagctattgaaggccaaggattcattgaactcgacacttcaagccaacatgaagctagccggtgacaataagatcctggaggaacgagtgcttcctttgttaaatgatgccaagaggttggagacgcgtgccttaaatgtcgaggccttggtcaggaaaggatttagcaaaaggcctttgatgatgtctataatgcacatgaggttgcatatgtgtgacatctcggacctaagtgtgttcgacatcaacaaggatgtgcatgaagtactgattgatgacatctcggaagatgatattgccctttcaccccacaagccaacgaccctagtcgaggaaccacatgtcaaggagatcaaggatggagaattttga

SEQ ID NO: 76697 - DNA, 1500 bp, Glycine max
  Peptide Sequence Number=SeqID_168382
atggccttgcaaacagctactcctccaacaactcccagtgcccaagttgttggtaatgcatttgttgagcagtattaccatattcttcaccattcaccaggttcggtctatcggttttaccaggactctagtgtgataagccgtcctgattccagtggtgtgatgacatcagttacaaccatgaaaggcattaatgagaagattctttcactaaatttcaaggaatttaaagcagagataaagactgcagatgctcaaaaatcatacaaggaaggagtgactgtgttggtgactggatgcttgactggcaaggataacttgagaagaaaatttgcacagtcattctttcttgctccacaagacaatggctattttgttctgaatgatgtttttaggtatgtagaagaccatgaaccatcagaactgcctccagttactggagatggtgattcagctgctgttacagtaacaccagaactaggcaagattataattcaaaaaattgtatcttctctttcaaaatttattcaggagctgcattcatgctgttctcctttctttacagaacccagtcatgttgctgattcttgtgcaccagagcccacaaattctcatgtgaacaaaggtcaaactgttgctgagaatgcttatgagctatctaataatcatgagagacagatacctgttgagaatgaaggcaatgtagaatcacattttcagtcaaatggtaatgatgattctcaggccacagaactggcttcatcagctcaagacgatgctccaaagaagtcttatgcatcaattgtgaaagtccaaaaagggagttcagttccaactaaagtctatgtgcctactaatacactaaagtctgggcctaacaaaactgagagcaaggtagttgagtcagtagaatctactgaagtgcctgaagcagctttggaaagtgttagcaaccctgaaagtagtgatgctcatgaggaagttgagggtcactccatatacattcgaaatttgcctttaaatgtgacggttgctcagttggaactggagtttaagaaatttgggcccatcaagccaggaggcatccaagtcagaaataataaggcttcacctgttcctattggggggcgtcaagctgtagtcgagataaagagaaccactacccgagttggcagtggcattaatggtactggaagacctaggatcccatctggtaggggtgggttacgaaatgactctttcaggggtcgtgggaattatgttgggggtcggggatacggtcgaaatgattatgtaagccgtggcgggttttctggtaggggtcgtggtcatggagaaggcgctgaagaggaagaattaaatggaaactgggtgaataaccaagagcaagaactgttaaatactgtattgttaaaggatgaagataatgtggttggatatggtatgagtatgaatataataagtaggaaagatctcttggtacatgtatatatggtttag

SEQ ID NO: 76698 - DNA, 1974 bp, Glycine max
  Peptide Sequence Number=SeqID_168383
atgccaattatgtacagaagtcaagtaattaaattccctgtaccatcatcagctaggctgtgtgccgaaactcaaaatgagaagccccaacttggaatgaagttctttgcttctagttttgtgaagaaaggtgaaaattcagctgaaaaggtctcagaactaagtttagaaaagggggaagaagtagctaaggcatctcatgaatctctggtttctgatgccaaatgggtatgtgaaagccccaaagctggtgtctcttcaacagcttcaggatggccttcctttaatgacatcaaagcacctcctctaacttattctctatctgcagaagagaaagcaactatggcagtgctgcaattgcaacacaaagcattagaagcttgccagaagttcttagtcggggatgctggttctgacagtgacgaagatgacaaagatgatgaggatgaagacgaattggtagatgattatgattctaaagaatgtgaggagtacaagttctttgaaaaagtgtttgcagaagatggtgacttgaggagatattatgagagcaattataaggaaggggattttcattgtttggtttgtggaggtatagggaagaaagtatggaagagatttaagaattgtaagacactaattcatcactccactgccatactaaggacaaaaaggaagagagctcacagggcctatgcacaggtcatctgcaaagttgttggttgggacattgatcaattgccagctattgtattaaaggatttggattccttcttcataggttcaaggaagcttttgggttttgagaaagaaagtgtgagtctagacggaaaggtcttggaaccaagttctgaaaatggaggagaaatagttaagagaaagttaccaagattcacaggtgtggatggtaccctgtggcacagctacgagaatgtaatttttggtgctccttcaaaagctgaggaatctcatgaatctctggtttctggtgctgagtgggaaagtgaaagccccaaggctggtttttcttctacaacttcaggatggccttcctttgatgacatcaaatcatcttctctcaattattctctatcagtagaagagaaagcaactgtggcagtgctgcaattgcagcacagagcattagaagcttgccagaagttcttagttggggatgttggttctgacagtgacgaagatgatgaggaggcagaggatgatgagctgctagataatgattctaaagaatctgaggagtataagttctttgaaaaagtgtttgcagaagatggtgaccttaggagatattatgagaacaatcacaaggaagaagatttttattgtttggtttgtgggggtattgggaagaaggttgagcccaaaaatcctgctatgggttgtactgatgatacaaattcaaatgatgttcttccaaagtttgctagaaaggggctcaatttttttgagacgcgagaggagagtaatgagcaaaacagtggaagcaacaacactttgtctgagtctgaacgcgtgacaaaagctgagacaaaaattttggccttgaagaaagccattgccaaattagaagatgaaagggaagctggcttgcttcagtatcagcagagtttggagaaaatgtctaatctcgagttagaagtgtctactgcacaagagaattctcaaaaactcgatgatgaagctagtcttcttcagtaccaggaatgcttggagcaaatatctaatctggagaaaaatatttcttctttgcaaaaggaagcaggagaacttaatgaacgagctactaaagttgaaactgagactgagtccctaaagcaggaacttgctagagtagaagctgaaaaggaagctacccttgttcaatataaccagtgcttggagacaatatcaaaactggaggagagaataaaagaagttgaggagaatgcaagaagattaaggagcatgccgatatag

SEQ ID NO: 76699 - DNA, 1380 bp, Glycine max
  Peptide Sequence Number=SeqID_168384
atgatgctgcttccaacattacttccaagcattttctggcacaattcgcgtagcagtgttgcctgtttccaacttcaagagtgtggcaattctcgacaaccttttcgtgtgacgtatgagtggcaaaagaaagggcctgggttcttgctcacgctagctcaccctcttcatgtcaagcttctacaatataaaaagaatcatcgcatgattgttctgcgtgattttaagtatagaagcattgatggtgatcttgttggtgttgttggagattcatggctgttaaaaactgataccattcctgtgacatggcattctaacaaaggtgtggaaaaagagtcacatgatgagattgtctcagcgctttctaaggatgttgaagcgctaagttcttcaccaatagcaacagaatcgtcttattattatgggaaacttattggaagggctgcaaggttggcgttgatagcagaagaagtgtcttctcctaatgtgattccaacgattcagaagtttctgaaggatagtattgagccttggttggatggaactttccaagggaatggttttctatatgaaaacaaatggggtggacttgtcaccaaacaagggtcaacagattcaggagctgattttgggtttggagtgtacaatgatcaccattatcatttggggtactttctttatggaattgcggttcttgcaaaggttgaccttcaatggggacaaaagtacaagccacaagtttattcacttgtgtcagattttatgaactcgggccaaaaatataactcacattatccacgtctaaggtgttttgacctttacaagttacactcttggacttcaggggtgactgaatttacagatggacggaatcaagaaagtacaagtgaggctgtgaatgcgtactattcagcagcattggtaggtttagcatatgatgactcaaatcttgttgccactgggtcaacactactagctttggaaattcttgctgcacaaacttggtggcatgtgaaagcagaaggcaacttgtacgaagaagaatttgcaaaagagaacaaaatagtggatgctctgtgggctaacaagagagatagtgcactatggtgggcccctgctacgtgtagagagtgtaggcttggaatcgaagtgctaccattgtctcctgttactgagacattgttctatgatgctgattatgtgaaggagcttgtggaatggacaatgccctctttgactagtgaaggatggaagggaatgacatatgccttgcaaggaatttatgataaggaaacagttttgcagaatattagaatgttgacaggttttgatgatgggaattcattcactaatctcttgtggtggattcacagcagatga

SEQ ID NO: 76700 - DNA, 2319 bp, Glycine max
  Peptide Sequence Number=SeqID_168385
atggagatggagatggagatggagatggatgctagttttgcgactatggagcgaaggcgagaagcggttgaagacacattgaaggttctggagatgatgattgctatggaaacacaatttgtctttgagctcagaatcgctcaaacaatgacagaggatagcagcgttagggtttcttcttccgacaaaacctccgcggccaacgatgcttcgcagacgcggcagagaaagaagagaaagtgggatcaaccggcggagtcattgatgccagttgggatggcagttcctggagcactccctttgagcaatgccgtgtctcttggaggggttgcatttcctgccatggctccgatgatctccggagctcttttgaggaatcctctggcagcttcttctcagcttccgcaacacacagttgcagctgctgttgccgcacaaaaattgaatcaagtgagtgtgggatttctaatctcttatgatcaaaagatccaagatgaattaataattgctcgagaaattgtcataaatgatgcagagtcttctgttcgctacaagttgacaaaacgccagacacaagaggagatccagaggtgcactggtgccatagttataactagggggaagtatcggctacctaatgcgccacatgatggagggaagccgctgtatcttcacatctctgcaggagctcatataaaagagacagcagaacggattttagctgttgatcgtgctgctgcaatgattgaagaaatgcttaaacaggagcaaaattcacagtcaatttcttccgcctcaccttctgctttggttaatatactgaagatgctgagtacatgcgtgtttttgggctttgatgctgatccttctttgaacattgttgctcgtatacgtggaccaaatgaccagtatataaatcacattatgaatgaaacaggagcaacagttgtactgagaggacgtggttcaggaaacaatgaatgcttgaatggagaagatggacagcagcccctgcatctgtttttgtctagtaacaatgcgaaaagtcttgaagatgctaagcttttggctgaaaatcttttggatacaatctgtacggagtgtggtgctttaagtgctgttccacctccacagcaggtatacactgctgttccacctccccagcaggtttatagcggcccttctttgttgaagcagattcctactgccatttcacccccacaacaagtttatagcgctgttccacccccacagcagttgttgactggagttcagagttctggaattgacctagaggcaggtactagcctaacctctagttcaatgtcagcagctggggtcttgacaccggttcctccagcttccttggttggagtgactggtgtcactggttccctcactttagggactccatcacaatctataggacatttaagctctgggcctcaagcaaacatgattggttatactcctccccctttagtatcaggtggtactagctatattggatatggtggattatatcctcaagctacccctttgcaacaagttgcccttgccttgagacactcacctcctgtcacatctacagatgctcccacaacatcagcatcaaatggagaatccaggccaacctcaagctctgatcttgaaaaggagaaacggccgcctcagagacgaaaatttcaagaattgccagttggttcaaaaggcacaacaaaactcaatcagggattgcaacctctaaaaccttatgaacaatctgacggtctggttgtgaggaatatattaacaatgcctgcccctaagaagttggtcccgccatcatccaatggaatgccacctcctctactgagaaccatgcccccaccacctccgcctaaattttctgatccatttgaagttaaagtacacaacaagaacaagactttgcttaagacaaaatctgatgcagttcctgatacattggtcaacctaatggaatatggagaggaggatgatgatgatatagacgattctagtgaggaatcacttcctcatgacacccgagcaactggggacatgaaggtggtggtggcttgggttgcatcactttgtgtcaaagatgacattgtcgtcactttggttggagcacctcaagagaaacaaattatataccacaaagacagaaacttggagattcacttggttctgaaaccgcaagaggttcagttgttgatgttggggtcaaattcgttgatgaaggattggaaggtgttccaacacgatgagggatctagtgcaaaatggagaggaagaagggggcgtgaagtggagtga

SEQ ID NO: 76701 - DNA, 1959 bp, Glycine max
  Peptide Sequence Number=SeqID_168386
atgtcttcttttcttttccctcaaacacaatccacagtcctctcagacccttcaacctatttctcctcaaacctcctttcatctccactccccacaaactctttcttccaaaacttcgttattccaaacgggtcccaagctgagtacattcacccttacctcatcaaaacctcaaactcttcactatcagcttcataccctcttctgatcctcttcaccactgcagtgttgtaccagacttttgtggcagatatcaccatctcttcaactcaaacaacctcacaaaaccatgtaatctcatcatacagtgaccttggtgtcactttggacattccctcctccaacctaaggttctttctctcaaggggaagcccttttctaaccgtttctgtgacatctccaacatctctttccatcacaacagtgcataccatagtctctttgtcttccaatgatgacaacaacaccaaatacacccttaagcttaacaacactcaaacatggctcatatacacttcctcaccaatctatttcacccataataatgcttcagaggttacatccaagccattttctggcatcattcgtgtggcagtgttgcctaaccacaactacgtaacaattcttgacaagttcagcacttgttaccctttgtcgggtaatgcaacactcgtagagcctttccgtgtggtgtatgaatggcaaaaggaaggttctggggacttgctcatgctagctcaccctcttcatgttaagcttctatcaaataattataatggtctagttactgtgctgaacgattttaagtatagaagcattgatggtgatcttgttggtgttgttggagactcatgggtgttggaaaccaatcctattcctgtgacatggtattccaacaaaggtatggaaaaagattcttatgatgagattgtctcggcacttgttaaggatgtgcaagagctgaattcttcatcaataggaacaagttcatcttatttttatggaaagcgtgttggaagggctgcaaggttggcgttgatagcggaagaagtttctttttctaacgtggttcccacgattaagaagtttcttaaggagtctattgagccttggttggatggaactttacaagggaatggatttctatacgaaaataaatggggtggacttgtcaccaaactggggtcaacggattcaacagctgattttgggtttggagtgtacaatgatcaccattatcatttgggatacttcctttatggaattgcggtccttgcaaagattgatcctgagtggggacaaaaatacaatccacaagtttattcacttgtcacagattttatgaacttgggccaaaaatataactctcgttatccacgtctaaggtgttttgacctttacaacttacactcttgggcttcaggagtgactgaattcgcagatggaaggaatcaagaaagtacaagtgaggctgtgaatgcgtactattcagcggcattggtaggtttagcatatggtgactcaaatcttgttgccattggatcaacactactggctttggaaattcttgctgcacaaacttggtggcacgtgaaagcagaaggcaacttgtacgaagaagaatttgcaaaagagaacaaaatagtgggtgttctgtgggctaacaagagagatagtgccctatggtggggccctgctacgtgtagagagtgtaggcttggaattcaagtgctaccattgtctcctgttactgagactttgttctctgatgctgattatgtgaaggagcttgtggaatggacaatgccctctttgactagtgaagggtggaagggaatgacctatgccttgcaaggaatttatgataaggaaacagcattggaaaatattagaaagttgaaaggttttgatgatgggaactcgttgagtaatctcttgtggtggattcacagcagatga

SEQ ID NO: 76702 - DNA, 546 bp, Glycine max
  Peptide Sequence Number=SeqID_168387
atggcattggtagatgaagagtattgcagtgactgcaaaagcaagctacactccattagtgatgatgatgacaatgataatgatcaaaatgagcatcacaaaaaagaatccagtttgagtgcccctttactgactagtggagctggccttagcactagtgttgcacatacaccctccaatagtgacttaagcataaaaaatcatgctaaggaactctacaagaaagcacaaggtcgaaagatatttaagtggagaagacattcaagggcctctatgatggcatgcttgtacttggcatgtcaagaagagggttttccaaggacagtaaaggaaattcaaagtgttgctgatggagccaaagagaagcagattaacaaggctataggagtattcaataagcatttgcaggctgtgagagaagtgctgcacaaagcacacgagttttatgtaaggaggaagccttctatcatcttggcaacaacaattgatatggttgatcagctttcttcgaagaataagatctttcaaggcagggttatcctttga

SEQ ID NO: 76703 - DNA, 273 bp, Glycine max
  Peptide Sequence Number=SeqID_168388
atgaaagtgttgaagcacaagttacattctctctttcaagagtatgtcaacaattttaagaaagagacaactacaaaagggcaacaagaatctcaagctcatccttccttggccaaaggaaagtcaacaccacaagttgcattaactgatgagttcatccagtttgggaatgataacatatcacaacatggaacctctcaattggatatttatttggaagagcaaaaattgtctttggcatatcatccgaatcttgaaattttgaattattga

SEQ ID NO: 76704 - DNA, 192 bp, Glycine max
  Peptide Sequence Number=SeqID_168389
atgggaatgaaaaaaagaaggtttggagcggaaggagaagatgaaggcttggttattatgtggcagggagggtttgaaggaaaggattggagtgcagcgtcatacatgggtttggaggggaggagtggggtgcggcgcgggagccttatgtctgagattgaaaccactgaagctaggaagttgggtgattga

SEQ ID NO: 76705 - DNA, 639 bp, Glycine max
  Peptide Sequence Number=SeqID_168390
atgttggccctagttgacctcaaggggggagcctgcatgggactcctcccaattcattttagaggtcgcatggctccgctactaggacaacatacacctccaaaacatccttctgaagcgaaacatggaaaggtcattaaattcgatgctcagacgttgaattccttttttgagaccctcgtcatcattctagagggtgagcagctgaccatatactcccaatacctccacacctacccagaccataaagccatcgcggccaagttgtacacatcaggtggtcaattcattctgaatgctgagggggctccgtggaagattctacgaaaggatttgaccaccctcgcccagatgtggagtatcctctcctacttcaacctcgcccctacctcccacacctctgacctcaacgtcaaccacgttcaactgatatatgggcaggtgatgaagatggacttggatctgggcagcctcatctcttttgagaatacacaaattgcccagtccatttcatcgtggttgggtttccctaccctgatcacgactctttgtgacgcaaaggaggtcacttttgactccctgacctttgagttgctgagccccatgatcaacctggcctacatctggaagaactgctag

SEQ ID NO: 76706 - DNA, 801 bp, Glycine max
  Peptide Sequence Number=SeqID_168391
atgaaggctgtctttatcaaggtcaagtccatacccaggagactccaccctctcagagtggttaatgagaaagtggtcgatatcgatttgagaaccaccaactctgttgtggccgccaaggaaggcggctcgttggccagatcgccaagcgttaggcagtcattaacctcgagaacactttcttcttcattaagaggttcattagacgcaagatgtttgaggtcgaagaagagtccaagtaggtctcttacaaagtcattagagacaacgacgacaacatcaaactcaatcgccccgccattggcaaacagttcgcaactaaggaaatttctacctaggtttctctgtcgtctcgttttgaggaagcttgttgatgctgcttccaagtttttgaacgataaggttaccaaggttgttgtcacggtgcctacttacttcaatgactcccaaaggattgccaccaaggatgccagtcggattattggtctaaaggttcttcatattattaatgaaccaatcgctgcatccttggtttttggtttgaaaagaaaaacaacaaaactatccttgtttttgaccttggaggcagtacctttgatgtcactgttcaaggttggcaatggagtctttgaggtcctctctacttttggtgacacccacttgggtgggaggggattgtaccacaaaagaccaaagtttgatcaagaaaccaaaggaaaggtgaatgaggaaacatatcctgatgaaagatgcagaaaagatcaagagcagtatctagatgcatcaacaaaaaagtgttaa

SEQ ID NO: 76707 - DNA, 1329 bp, Glycine max
  Peptide Sequence Number=SeqID_168392
atgggcgtccctcactttcttctaattccatatccaacactaggacatgtgaacccccttatgcagttgtctcaggttcttgccagacatggctgcaagatcacttttctgaacacagaattcaaccacaaaggagcaaatacagcagcaggtgttgggatagacaacgcccatataaagtttgtgacactcccagatggtttggtccctgaagatgacagaagtgaccacaaaaaagttattttctcaatcaaaagccacatgcctcctatgcttcccaaactcattcaagatatcgatgctttggatgctaacaataacatcacttgcattgttgtcacagtgaatatgggttgggccttggaagttggccacaaattgggaattaaaggagctcttctgtggcctgcatctgcaacttcgttggccacgtgtgattgtatcccatggttgattcatgatggaattatagattcagatggaaaccccatcaaaaaacaagaaattcaactctccacaaatctgccaatgatggacacagaaaacttgccatggtgtagcctaggtaagatgctctttcatcatattgcacaagagatgcaaactattaagttaggagactggtggctttgcaacacaacatatgatcttgagtctgccgcattttccatatcacgacggttcctaccaattggtccattgattgcaagtgacagcaacaaaagttcactctggcaaggagacacaactttcttagactggttagatcagcagccacctcaatcagttatatatgttgcctttggtagtttggcagtaattgatcacaaccaacttaaggaattagctctaggactcaatttccttgacaagccttttctttgggttgtacggccgagtaatgataatgaggcaaacaatgcatgctctgatgaattccatggaagtaaaggcagaattgtaagttgggcaccacagaagaagatattgaaccaccctgccatagcttgtttcattagtcactgtggttggaattctaccatagaaggtgtatgtggtggcgtacctttcttgtgttggccattagccaaggatcagtttgttaacaagtcatatatttgtgatgtgtggaaggttggactgggattagacaaggctgagaatggattaatatcaaagggagagataaggaagaaggtagagcaattacttggcgatgaaggcataaaagcaaggtcgttgaaactgaaggaattgaccttgaataacatagtagaaggtggtcactcttcaaagaatctcaaaaactttatcagctgggcagagtaa

SEQ ID NO: 76708 - DNA, 474 bp, Glycine max
  Peptide Sequence Number=SeqID_168393
atgcttaagtacacgaacaagcaagggcatcggtcggcgattaggatctcacggatcgtgtcagaggcgctgcgactggggatgaaggacatgcagtggttcatgatgagcgatgacgactccattttcttcaccgaaaacctaattcacattttgagaaaatacaatcacaatcgttctattagatggggagtttgtcggagagtcacttgcaaaacattttcttctcttacaacatggcctatggcggaggagtggttttggacacaaactgatggagtggaggagacaaagagaggtatagagagcaagaaggtcaagtgctatggtagatatggatactttgaagccaatcaagtggttcactacatgtatgaacagactaatcatgggatagatcttgacatccaaaatccacattcctcttcattcttgttgtatgaccatagatacaaaagtttcgagtctgcatga

SEQ ID NO: 76709 - DNA, 345 bp, Glycine max
  Peptide Sequence Number=SeqID_168394
atggcgaaatacactgaaggactgccacgtgtccctgtttcgccaacaacaatggcaaaatgtcctgcatgctgccatttacccagtttggtcaatttgtcgattgatctccttaagaagccttttctttgggttgtacgtccaagtaatgataacaacaaggtaaacaatccatacccaaatgaattccatggatctaaaggtgtatgtggtggcatacctttcttatgttggccatttttcagtgaccaattcattaacaagtcatatgtttgtgatgtgtggaaagttggactaggactaaacaaggatgaaaatggattaatattgaagggaggtagataa

SEQ ID NO: 76710 - DNA, 1011 bp, Glycine max
  Peptide Sequence Number=SeqID_168395
atggatctttatgaagctacttggagaatctttggttttccaatacatggcagaaagcctgttgttgaaagattacatttccatcttccaagacaacatagtgttctttaccaagaccatgatgatattgacgctgccctgtctaatccaagcatctctgattcaaagtttatttcttggatgaacagcgaccaaagctttgctgaaggaagaactcttatgcagaatttgtttctaagaccaacctcatttaaggatatcagaacggttgctaatgttcaatatcctgcatatagagaagcatgctttgctatgggttttttgcaagatgatagagaatttgttgaagcaatcaaagaagtgaaagactggggcatagcacattatttgagaaagctatttgtgttaatacttttaacagctaccatgaacaaacctgaagaagtttgggaccaaacttggcattggttagttgatgacattgcgtatcatcataggaaaacaaaaacaaatatagagatacgttttaatgatgaccatttgaaaattttggtgttgcttgaaattgaacaactattgcaagccaatcaaaaatcacttagagactatcctttaatgccatatcctgaagatggaaactgggcaacctgtctagacaatagcctgatattattagagctaaattacaacaatgatgaggtcagattggaatttttacatcttttttctcagatgacaggaaaaacattcatgtggaaaacactggcaagttcattaagagcagacaataaaattgttattatggtttcttctagcggcatagcttctctattgtttcttggaggtagaactgcacattccaaattcaagattcctattccaatttttgaagactcaacctgcaatatacaccaaggaagtcaattagctgaattactaaatcaaacaagtctaatcatttgggacgaagcacccatgactcacaaattttttttgaagcacttgatctaa

SEQ ID NO: 76711 - DNA, 450 bp, Glycine max
  Peptide Sequence Number=SeqID_168396
atggctaggaagttaaggcttcgaagccctaatttttctggaattttcgatgtactcgctaagcgagcctgctcgctgagtgagcttaaggagccatgctcgcttagccattgtgttgtgttagctaagcgaggatggcatctaggaagagataatcaaccgcctcccgacctcaagaaccatatgacacgaccagatttgtttcagaggcagcctaatggtcgtattgatgtggccctggttaaagagttttatgctaatttgtttgattcagaggacaagtccccaaggaaagttcaagtacggggtaagctaattacgtttgatggggagacgctgaacgcattcttggagaccccggtggttctggagccaaggagcatcctggaagctcctgaggaaggatttgactactctggcacagacctagagcgtcttgtcatattctag

SEQ ID NO: 76712 - DNA, 697 bp, Glycine max
  Peptide Sequence Number=SeqID_168397
atgactcaggcggtggaggtcctgaaccggtatgggacggatctggttggggagccgagagattctgattctgagtgtttggcgggttttgagtgttttctgaacattgtgagggcattgggaatgggatcgtgtatctcagaggttggagctggtggtaattcacctcctcttcttccttattcgcctgaatccaacatggatggtggaaagagaagaaggttgaggggttcctcttcgtttgatttcaaagtgcctgggaggatgttcttgaatggttcaagcgaggttgcatccatgtattgcaagcaaggaagaaaagggatcaaccaagatgctatgcttgtttgggagaacttttgttcaaaggaagacaccattttttgtggtgtttttgatggtcatggaccttatggccacagagttgcaaagaaagttagggattcttttcctttaaagcttaatgcccaatgggatttgcatcataaaaatagagacagactcagtgatcatagcagtgccacaggaagttataaatctgaagggaatggatttagactggtggatgagaaaactagtcccattgatcatgaacatgaagaaacagatactattttgacattacgagaatcttttttgaaggcttgtaagattatggacaaagaactgaaacttcatcctgatattgactgctttt

SEQ ID NO: 76713 - DNA, 657 bp, Glycine max
  Peptide Sequence Number=SeqID_168398
atggatcagtttaagtctttcggatatgaagacttagcaatttctacaaagagtctattggacgatggatgtttggaatcaatcctgattcctccatctgataggttcgagggatttaatccctcaatcaatgaggccataaacttaatccaagcagaaatgatggactacattgccatcaagataacgacctgcccgagcaatttcactgctcaaaattatcattgccatgttatgaaactcttaccagaggatcatagagattatccctgcctattcaatgatgaatacgaaagctggaatgtacaaggtaatacacaataccaatatagccatatgagggcacaaattcagggctatcaatggttcttctcagaagaggacaaaccttttcttgcccttatacaatgggaaatttttcattcctttcccggtggatcaaaatatagttcttccagaaagagaaaaaagacaatgagatttatgaagccagcggatgccatggacaacaaactcctcctttcccttctactgatctctcaatggaagattaatctgacattttctgttctgagaatatccaagacgaagaagatgttacgatcactaagtcaactaagagttaaagacaaatgtattctgcctaaacacagttaa

SEQ ID NO: 76714 - DNA, 204 bp, Glycine max
  Peptide Sequence Number=SeqID_168399
atggcagcatttcggaaggctttgccagagaaccagccagatgcgcatatgaagaactataaagatcctctcaagaagatatccaaatggatgaaaaaggatggcctttatttgttcattacttttgccacaaagcatttgcctacctctttgagtcatccaccattggctagtaaatgggaaacactacacacagaccagtga

SEQ ID NO: 76715 - DNA, 531 bp, Glycine max
  Peptide Sequence Number=SeqID_168400
atgagggttcataccactaaggcacttaaatatgctctgggcaaaggagccgttgattatgaggattttctccagagtggagatccagaatatgcatggaaacccccagaggatgagtggcagagcaattcattgggttacacatccggtaccactgctagtccgaagggtgtggttttacatcaccgtggagcctatctcatgtctctgagtggagctcttatttggggaatgactgaaggagctgtgtatctttggacacttcccatgtttcattgcaatggttggtgttacacttggatacttgcagctctgtgtggtacaaacatatgcctttggcaggtaacaacgatggtagtatatgaagccattgccaagtataaagggagtcatttttgtgcagcacaagtggttgccctgttgagaagtttattaaatggaaagctatttgtggaatggatatgtccagctgttgcacaagtctatcaatgtcatatcagtgcacatgctgttagaacaaatctcttttaa

SEQ ID NO: 76716 - DNA, 219 bp, Glycine max
  Peptide Sequence Number=SeqID_168401
atgccgcaagtgagagagagagatgatgcacgagggagggcttcactaaggggaactaagcacttcaacagagggcttcacacgcgagggagctcttcactgagggaaggcaaacttgttgacagagggcgaccgcgaaagtttgagagatcgagctcaagagttcgagagatcgtggaagttttgttggttgcacatggaccactcttgggcttttaa

SEQ ID NO: 76717 - DNA, 453 bp, Glycine max
  Peptide Sequence Number=SeqID_168402
atgaagaataggtcaaatgaatcagattttgctccacatatgcaggatctatcttcaatccttacacctgagcgtcttgatggtacaagttatcctgaatggcaccaaaatggaaaaaatgtgaagtctcccaaggacaactccaccaccgctactggatttgttggtacatttcaaccaatttgtggtttttctgttactactaagggtaataattggataattgatacaagtgcagcaaaccatatgacttgtgatagaaatatgtttacacaattttcctctaatagttttgtttcagtcattataaacactaatggtgcttcttccccagttatgggtagtcgtacaaatatacatacgaagaagaagattagccgtggtaaaagaagtgaaggattatactatcttgaaggtaattctcacaaaatgacttgtacaagaatgacttga

SEQ ID NO: 76718 - DNA, 1698 bp, Glycine max
  Peptide Sequence Number=SeqID_168403
atgctagaggcttatggggatattttgttttgggcatggccagctgcgcaaggggattcgaggactgagattaagaatgggttcttgcaggaaatgattgaggctgccatacacgctagtttcggagcttttgcttcatatattatgagggttttggaagcttttattaaccacaggaccaccgatggggttgagaaaatcctttatcgactcgccgagcctgtcatatttaggtctctacaggctacttacagatatgattgtctggaagtgagaacaattgttgttgagggttcttgtcgcatccttcatctgttttgggaagttattccttcactaatcataacaaagatgataacaaaaatagttgatgatatatcacacgatggatgcaatgagacttcggcacctaatgttggacaaagtcctagcaatacgagttgctgcagtggatctcttactccatctaaaggatgttcgagattttcagttcaacaaggcggtggagctagatgtgctattgtctgtgcttacaaggctccaatggctggcgcaagatttttccagtttgctatcttggaaagagcatctaaatctcatcttatggaactggtcaaagtatttctgagtttaattttgtcaccagataagctagatgcaaatcagattaacggtttccttgttgctactagctatgtttgtgatagcttggcttgtgagccatgctataaaaatgctctcaaagagttactcgatggagagaaaatgaaagaaccagaacacaatggaacttggaaggcagctggaaggggagccttgacaacatacaaaaacataccaaacttagcaattggttttgaggaaggacttcaagccaaagcaatggcaaaggctgaaacaagggctgaaacatacctgaagaaaaggacgagacgtttgaaactggtccggcaagtttccggtggccggagggcgatgcgtggacttcacgcactggaaacgaggcattgcagtggcgacgcgtggctgcgctgttggtcacacgacttgcaggggtggattgcgctcctcgaggcacacccaaccctggtttcgccgaaaaatttgacggcgacggcggacagcggcggcgaacggagacagtcagaacaggatcatgatgttgctagacttcttgaagaatgcatgggtgttgtcacaaactgcagtggtttacccgaggatgttgatcgacaaattgaaatcaggtctgcacacaagttgttgctttcactgggtggttttgatgacttgattgaggccttaacggcctccttgcataaggttgcctatcgttgccacattaaatttggtgtagacatgccatctcatagtgtttcatttgctaaaagaaagaaatctaagtcctctggaaaattttcaattaaatcaaagataattaacagaaaacaatcttttgaggatgattatttagtagctgttggggtgacatggcaagttagagatttgcttctgcaagaagataccagaaaagctattttggaatctccgagtttagagatgtcgtttgtttctcttaaggtgatttctgaggtcagcattatgcattgcgggcaccacgaatacatagacatatgtcctgttttggcatatgttgcctttgctgtccaaatgactgttgataattggcagaagtag

SEQ ID NO: 76719 - DNA, 1428 bp, Glycine max
  Peptide Sequence Number=SeqID_168404
atggccgccgtagcatcatcaccgacgccacgtaagtctcgatccaaaaacctcgagaatttcgatcccaacaaacaacaacaaagccctgttttcaaaccctcttgttcctcttcttcttctcctctcgtgaaaccaaagaaccctaataataaagtcaagtacttctcccctcagaacaagatccggcagagaaagttcttggtcgcaaagaagaagaaagagacgaagaaggaagaaaaagagggttcgggtgctgctgactcttgcaagtgcaaagcaactggtgcaaatgccaacaagaaccacaagtgtgtctgtgtggcttataacaacctaaggaagtcccaggaagagttcttcaagaacaaagatgatggtgttgttgaagaagggggttttgagagtgagactgagagtgtggttgttgaagaagaaaaagaaggagaatcattattggggaatggtttggttgtgaagcgtaggagggagaggttgatggaagaagcgaggaagagtgttccacaaagtgggtctgggaaagttatgcatttggtgaaggcatttgagaagcttctctcaattcccaaaaccgaggaagaagaagatgaggaggagggatctaaatatcaagagaaggatgataacaagatggtggggaaatgggcactgccagggttgcagcaacacgattctgaggtttcattttgcccaccaaactgtgtcctcacattgcaaaacctcggcttggatcctggggcatcagtttcggcttcgtgggatagcagccgtgcaagtgtgtctagcaggacttctactgggggtcgaagaagcaggagaaatagcctggaatcatcaagtacttttgggagaagaaggttgaaaaagaagcagcagaaagtgactagccagaagccattcaagctaagaactgagcaaaggggcaagttaaaagaagaagaatttgtaaagaagatacaagagatggcagcagtagaagagaagcaaaggatacctgttgcacagggtcttccttggacaacagatgaaccagagtgcttggttaagcctccggtgaaagatatcacaaggcctgttgacctgaaacttcacagtgatgtgcgggcattagatcgtgctgagtttgatcatcaggtgcaagaaaaattgagcttaatagagcaatacaaattggaaagggagagacaacagaagttggcagaagaagaagaactaagaaggttgaggaaggaactagtaccaaaagcacaacccatgccatattttgatagaccttttattccaatgaggtcaatgaagaatccaactatacctagagaacccaagtttcataatcataagaagatcaagtgcagcttatcatcatggaacgatatgagcccgtactcctccagctgccttaactaa

SEQ ID NO: 76720 - DNA, 486 bp, Glycine max
  Peptide Sequence Number=SeqID_168405
atgggtgttaatgcattttgcaaagtggttagaagattggtaaaagatgaagtcgttgctaatgggagacaagatcgttcaagtggtgtcatccaagatcgtgacagtggacttgggcaagattcatgcggaagtagtaagcatgctgatcataggtatccggatccgaaggagggagaccagtcagggtcacgatgttttgcgagaatgctccaaccatatgagatcagcataggcttaaaggagcactcaaacccggtgacccccaaggcctacactccgaagagtccgtcagggcctctccctcctgattcagacagctccgggtttctgcgggaaagaaaaaggctacaatgcgaagggtgtttctctcagttcagacatgatatcgaaattctcaacggtgagaatgctcggaattgtgttgcaaacgtggtgctcaaatttcacgacgatccaacggtgaatgagtccgagatcgtttga

SEQ ID NO: 76721 - DNA, 2163 bp, Glycine max
  Peptide Sequence Number=SeqID_168406
atgctgaacgaatttgtcctgtgtcgagggagtctgtctgatgttgggggtagtagtcttgacaagcagagggtgacgaatttttcaagccccaagtatggacgaatgttgttcggtgttgggtgtgctgtccgtgatggacatgtcgttagcgtgtcagaatggacacgtattggagtagcggttgtgcgtgagtgggggagcttcgtggtgcaaaattttagggcaccacttcagctcttgcctgtggcagtgactctgggggctcgattgagcaacccatcatggatcgagaggtcatctcgattgatagttcctcattggaggatactcaccgagatgcctctgatagtgagtcctcttattaggagaggggtgcgaccttccattgctgtcgggaagcttgtcccagttactatgatcctccctcattctgcttttgggggtgtgaggagaggtagcgacggtggagatacaagtcctgtctcacctcggcagcgagtgtcgttgtgcttcaacgctaggccactcatgaatcaggtcagacttgcgggtaggtttgtgccatcgtctgttgctgctcttactattggagaaggaggtgaacttgttgttgaggttgccccttttgctgttgttgttgagtcaagtcgccttatgacttcacatgatgtgcatccggctccaccgaccattgaggctcgtactgttgctgctattactcctgctccttcacctcctcctgttgttgttgttcaggaggttacccctactgctattgaacttactgtgccagccactcaggctgactctattgtggcaacgtcgtccactatcgtgacacctttgctaattgccgatgtggtaaccattggtgctcccatggtgttggctctttcctcgttggctccgatggcttttccttctactgttttggtgacgatggcgtcaccttactcgttctctcgccttcgtgtctccatgggtcacttgtacacctctagtaatgctaaccaactgtggggttatctagaagatgggcgtcctaaggtggagcgccttaaagtggccaatgccaccgttgcttttgttgagaccgtaaggtcgaaccaccaactgtatttcaaagttggtgtccagcttaaggagttagagtcctggttagagagcatgacaactgagagggacgggcttgccaagataattgttgatttagaggctaagcttaaggagttagagtctaggttggaggagtctaacctgcgggctaccaagtacagggaatccagtaaggagcctgaggaagagctacttctgtacaagaaggagaccgaccttgacttgggtcttttcaatcccttcaaggatgtgaaggatggtgtcctagttgatgaggaagacattgctgtggaggagaaggttgttgatgaatggcaaggtgttgcggagcaaggcgatgatgcttgtgtctatgttgcctttgtttttatcttcttttcttctttctcaggatttgaccatagagttatgtttgacttgcccctggttgaaggtcttgccaaccagtcggggaaggggtggacagttgctcctctgatggttatgaagagtaaatgtgagctacatttgattgaaggtatgacttcgacccgattaaaagtcttgccaaatagtgggatgcaagttcacttggttgaatttggacccttgacagtggttatcgtagttgctacatatgagcggaccaagggagtgccttggataacggttaggaataaagaatattgtcaagggcatacttgtgtaccttcagttcctgtggagatggagcttagtaaaagaaagggctcaccaaggatgaaccttggatttgacgagacttggactcgagacgtgtttgccttgggttttgtcaagccttcggagctatgtcgaggcttaccaatgagggacatgacactcaccgagggtggcatgtactggagacgtaatggcatgctattgcatatgtgcctcttacaaagtggcacgtactggagtgtcatgtactggaggcttagtagtatgctcttgcctttatgtcactcgttgtgcgtggcaaatattggagtcatagtggatgctgctgtgcacatgtcactcgccatgggtgacatgtactag

SEQ ID NO: 76722 - DNA, 356 bp, Glycine max
  Peptide Sequence Number=SeqID_168407
atggctgcgaaatcgacatgggtatggctggaaaatgaggacttgagagcgttgaatgtggatttgatggaagcaagcggcgtggcggagggagtggtgggtgtagtggttgagagaggattcgagggtttcgatgcggtggaggagggaggacatggtggaatgaggttggcgttgagggtgatggttttgagtgggaaggttgagattttggtgggtgtagtgttgttgggagggaatgggaatgggaataggggtgtgcaacaggaggaggggtgtggtggtggtgatggtggtgagaggccattcagtgtgtgtcctgttgagcccaccagcaccactgtgaaggaaaaagg

SEQ ID NO: 76723 - DNA, 591 bp, Glycine max
  Peptide Sequence Number=SeqID_168408
atgagtgcagctgcgtcatcctccgctactccttccgctgcccaagtcctctccctcttccgatccctcctccgcgccgcgcgcgagttccccgattacaatatcagggagtacaccaaacgacgcaccatcgattcgtttcgccacaacgccactctctccgacccgtctcaaatttccaccgccttcgcccacggcaagtcacagctcgccgtcgttaaacgacaggccgtcgtctactccctctacgattctccgctccgcagcgtcatggaactccaacaaagtctaaaacctcatgaaagggaagttgaagacattgttggagaggttgaggaatcaatggccgaagtagaggttggagaggaatggaggagaccaaaccaagaacaatgggtaatggaggtattccgagagaatggggtgttgtcagtaatggttgctctgatttttacaaaaatggtggtgccaaaaagtgtatttcatgtgaattgttcattgtctaccatgcatgttcttccatcgtggttacttagcgtatcggtttttgcattgggatgggctgattcctggtatgcagggaatggttga

SEQ ID NO: 76724 - DNA, 753 bp, Glycine max
  Peptide Sequence Number=SeqID_168409
atggtggtttgcattttggccgttgaagacgaaggtgcttcctttcatcttctttatcacatcgtcgctaggatttgtgatgaaatcactcttattttgcaccacaatggtaaattgatacaaaatgcaaacgaggcactagatggtttacaaaggctagaaaatgactatgatgtgttatctctctgcaaaattgggcttgctaatccaaaaaaaaaagtgcatgtatacttagaacatgttgagccagaggggggtctggttattgaaattgggctagagattgaaatagatgtgttgcctctaaattgcaatgcagagaaagtggttgttcttgaggactctactcagaatgttattgaagatatggatgttgatggtgctaacaatgtgggtaaaggtggtctagatggtgaaactggagttgttggagttgaaactcaagttgatgtgcaagatgctaaaactaaagttgttggagttgaaactcaagttaataatggtgtagatgatgatgaagttaaagaacatgataaggatgctaactttttttatcattctgaaagtgacctagactatatgcttgcaatcaaggattcaaggttggttgcaaaccttttattggtcttgatggttgtttttttgaaaggctactatggcggtcatttgcttgcagcaatgggacaagatgcaaataatgtaatttttgtgattgcatatgcaatagtaaatgctgaagatgaagataactag

SEQ ID NO: 76725 - DNA, 504 bp, Glycine max
  Peptide Sequence Number=SeqID_168410
atggcaacacctccaaggtcccctccatattcagatattccttcgaaggctacgtctaggaggactagacaatccatttggctaagaaggttgactataggaagcttggatcagcaacgaccaatggttaacgtcaatcctgccagtgggagaggatcagggcccaataaagaaaagtttcatagttatctggaggccaaattagacatccatgagggcggcaatgccaaaaagaagggtcaacaaaaagatgatccttctgttaagtatggtattgatgcagcaacttgggcggaatttgcaaaaagtcgacaaacccctaactggcaggggacaggtgtgaaaatcagtcagtactttggtcaggcctcacgtggctccaacacttcctctgcatcaatcactcaacaacaattgactaaaatcatcggtaacctgaaggaagagtggaggaaagaagtagaagaggaaaataagaatcttcaggaatcgtggaggaggaag

SEQ ID NO: 76726 - DNA, 432 bp, Glycine max
  Peptide Sequence Number=SeqID_168411
atgacagttggtgacaaaactcacttcaatgcaatcacgaccagtatcgacaccagagttctcattgaaggtgaccgctatagtgaagaaacaagttacggcgcaagtgattttgtcgaaggcattttgacactaccgtatccgccttgttgtgcagaaaaccactgtcagttctcaaatgtactcaacggtaacaacaacgacagctctgatgaggaggcggagacgaagctggcacaactgcaaagggaacacgcagagcaagtgaaggggtttcggaaagaatacataagagagatggaagtggtgaagattgagaaggagtgcaaagccaagaatcgcagggaagtcctcagagtagccaacgaagagcacaagaagctcgaggctcaagcctcgcagctcagagcgcaggagcacgaccttgaatga

SEQ ID NO: 76727 - DNA, 1785 bp, Glycine max
  Peptide Sequence Number=SeqID_168412
atggctaaggaaagtgttgatttaccactgattccaaaagtaactatgtcaagtggggttgcattaagaaggcactcagcgggaatagcaaattctggaaataatgaaaaaaaacttgtccctcattatctcagagcatctactggctcctgtcatgatttttgtaaatatgggaggaagaatgtggaagaagcaagggagaaactctccattattaagagagctggaagaaaatcactttcccgaagttcagaagacattattgatgggataatgacatcagttgccaagcaaaaaacatctcttgattccacgtcaacaaagatgtcaacagtgaaacatagtgaatcagttggcacaaataagatggaactcccaacaaaatcatctggcagccaaaaacaaatggggaataaagttctagtgaacacaagcaaggcatcattggtcagtgtcaaaccatcattccttccaaaatcacatatttcttcaatccccgaagcaaggagaggggggatttctttaagttttgaggtggaagctctatcaaaaccaacttccaaaagggtggaagcttcaccaacagaaacttctgagagggtgaaaactcatcctaaatcaacttcccaaattgtcaaaacttcaccaaaatccatgttcaagaagaagcaaactttaaaggtgtctccttttgaagaaaaagaaatggagttgtctgataaacatgtgacttctttgaatccagatttcatcacaaagcagaccatatcttctgtgaattcttctgatgtctttggcggccaaaggaatagtaagattaagatgaacaagaaagaagtctcctccaaatcttcttccagaggaattggaagtgttagtgcaagaaagcacaagggcctgaaaattgtgcctcatcttatgaatcaacccaagcctataaaagttgaacttgaggaacacaacaatgaggctcaggaaaagactttgtacatcatcaagatggaaagtacaaagcaaagttcgcactctgatcaaaatgaaagccaggatattgaagaccaagaggaatctgaatactcaaatagtgaatttgaggaggatgcttgtccagaaaaccatgaaattgaatacatggctaatgtggacactttggaagttgagaagaatggaaagcctcaaaatgatgagattgtttgttctgaagagaaggagtgccaacagttaggggggaaattggttgaaactcaaattgaatatatggctaatgtagacacttttgaagctgagaagaatggaaagcctcaaaaggatggaattgtttgttctgaagacaaggagtgccataaattaaggggagaattggttgaaactcaaattgaatacatggctaatgtggacactttggaagctgaggagaatggaaagcctcaaaagcatgggattaattgttctgaagccaaggagtgccaaaaattagggggagaattgcttgaaactcatattgaaaagggtagtctgaggagccttgaagtccagaaagaagtgttgggggccatcactactgatgtcaaggccgttgctataactgctccagagaaggttcttttgagacatcaacatgtgcaggtcaagaaagatggacaaggattgtacaataatgtgattaaggaaacaactaaacatgttgaaactcagaagggcaaggttaaagcactgattgatgcctttgaagctgtaatctctcttgaagagaaaagtatttctgctgcaaacattgtcaattga

SEQ ID NO: 76728 - DNA, 363 bp, Glycine max
  Peptide Sequence Number=SeqID_168413
atgttagcctctgtaaccttgacctcctcctcggctttgagaatcacatcaacatcgtcatcgggtgctggtccaactttgaaatcctctgcatctccaaaccccgctccaagctacccctcggctttggagaccattgccacgaagatcaacaaaaggagaaggaagaagaacaagaaccttttcctcaaattcgtggattacgcaagatccaggctattttcattggaatgtgatcaaaacgaagatgacgaaggttctgatggacttggatggagttgtattgtggctcatattctcaagacttgcgttgcttattcaagcggtgtcactctcgtgatcttgctctctgaaatctcttag

SEQ ID NO: 76729 - DNA, 600 bp, Glycine max
  Peptide Sequence Number=SeqID_168414
atggagatgccgaaggcaggagctggaggagcagaagaagaaggggcaaaagcgtccgatggtccccgagccctagctttgcgggtccccgaaaaagtgatcgtgggatcatccggggactcgaaggtcaatgagtctggaactactcctcgggccacgcacaaggctgtgataagtatagggaatctaagcctggaggagttagaatatgacaggacgctccaggtctacgctagtgtattcaaatccttcctcaggagcttccagggtctatgcgagtgttgcagaacctggtatatgcagtatactgctcccctggctccagaactggtggtttgcataaaattccttgaaccaggccacatttatgtgcccatccatctacctggtcaaggatttatgccaattctgcctctcaagttccttgcgaaactcatcgtactccgtgatggctccctgggtctggaggcggtagcttttctctttttggaggccatctccatcaaaaagaaccacaggaatcaagttagacagggtgcacttagtgcgactacacaaaaacaaagactctggctaagcgagacacactcgcttagctga

SEQ ID NO: 76730 - DNA, 345 bp, Glycine max
  Peptide Sequence Number=SeqID_168415
atgaagaagaagaaggttgaagcaactggtgtctcgctaagcgaggcactcagctcgcttagcaagttgggagaatctggaagagaatctgtcattcatgcacgtggtcaacgtgccatcagctcgttgttcgcttcgcactcacctaactgcgatactaatcagcaagtgtacagagtcacaagtagtataaacgatagtaaaggattttacatcaaagttcagcagaaacccccaacaaaagagttagccttccattgcaagttagcacctttcagcccaagaacaggttttggaaggataagtaagattacaaagttgtgggggtgtctcctccacctctaa

SEQ ID NO: 76731 - DNA, 267 bp, Glycine max
  Peptide Sequence Number=SeqID_168416
atgagtatgaagttttcgtcttcatcagtctggtcacgcaaggagattggatatggagatgatggggtgattttcacaactagtagcaatgcaaaatatccagaaaagatgtttcgcataagccctaattggaaaggtttggattcgcttagctggagtttggaagccacaaatgttgttgaaggtttagatgcgcttcattgggtgtttggatggggtaggtgggatgtaatttgttatgaatttgggttgcacaaggagaggtag

SEQ ID NO: 76732 - DNA, 255 bp, Glycine max
  Peptide Sequence Number=SeqID_168417
atggagggggagttgcctgtgcacgataagatccaaggagcttttgctgagccttctcaagtgtttgcttctaggtccaaatataacggattatttagggaaaaaatatatgaagatgaagatttaagtgaggaagagctaaagaagaaggaaatcaaagtatggcatgaggttaaagaaatctttcgagatgacaaaaatggtattcgaatacttatgacaattcgtaacaatgatgtggaactctatacatga

SEQ ID NO: 76733 - DNA, 228 bp, Glycine max
  Peptide Sequence Number=SeqID_168418
atgaaagtgaaattagcggagagagagggaattgtttggggattgagaatggagaagagagaaagctcaccagagtgttgttggagtgaacggagtttgggagtgaagaggaataacgagattaaaggaaccctaaagttgaagattgggaaggggacgaagaaccaaagaggaacaaaacatcgcgttctccttcgatgtttgcatctgcgtcagcgattatgctaa

SEQ ID NO: 76734 - DNA, 72 bp, Glycine max
  Peptide Sequence Number=SeqID_168419
atggctaagatcatgttgaaggtcacggttgcatcagatgctattttaaacacctttaacgctaaggaccag

SEQ ID NO: 76735 - DNA, 192 bp, Glycine max
  Peptide Sequence Number=SeqID_168420
atgtccaacataagtgggctcctgaacttcgcacgtcggttgagagtgatctttgttaggaggacaagagaaggaacctgcaaagcaaaggacttcaacactcaaaaacaacagcagagaaagaaaggagaagcacatagacacgcaaaagaatgctatactgcttctcttttggcttggacgtgcacataa

SEQ ID NO: 76736 - DNA, 396 bp, Glycine max
  Peptide Sequence Number=SeqID_168421
tcaaaggagtttcaaagaccaccaactacttggaagaaatatcaatatcgtcgagatgaaatcttacaacatttgacagaggaaggcacttctacacaggattcccctaacactgctacttctgttaatgataataaaatatatttgaatgttgttggaggtccaaattacaatggaaacgtgtacgggctagacactttgagcaaaaggtttagttgctcaaaatcagctccatctacttctattgctcctatggaagaccaaatagaggaaatacgcgagacaattaataaattgaatgctgagcttttggcaaaggcaaataaggagaagacacttaaggaaaagatgttacagttgatggagaatcatgaccaccaaagtcaggagatgtga

SEQ ID NO: 76737 - DNA, 828 bp, Glycine max
  Peptide Sequence Number=SeqID_168422
atgcatatccagcaggaccataacctggttggtggagtggtggtgagacagagacagatacacaaggaaagaaagcaagacataaaagagaccttcaatgaagacggagaggtggttcaagaaggaattgacttggtccttgtagatatagccaacggaggcaaaaccgccaacaacaccgaggagcaagagaccggccaagagggtgcccttcaaggcggttccatcctggaagtcgaggtcagcgtcggcgtcggcgtcggcgtcaccttcgacttcggtcttgttgttattgggactaaacaagcgcttcaagccagactcagacggggcagtggaggagcatggagtcaggaagtgactgtgagagcgtctatgaggtgtgaagataaaagaacaagggggagagaagcgtccagactgcaaggctatgtaaggtctcattcataccatggcttggttcagaatattttgatacttagactcaaggagggagcttttcctaacttcacacgcttcgtgaagctaaccaagtcttttccaccgccctcaccactagccgcaacagctcttccaccacccccaccaccagccgcaacgggtccaccgcctccactaccatccacggaggatcacactcactcatcacagttaccttacattggaagcctagtcacattgcaccaccacctagcactttgtcttccccatctccaaatggatccctggtgtgaggcaaatcatgttagggctgagaaggatagcagtgtgcccagcggtagtgtcatttccgacatgtcaaacatcaaggtagtggtggcaaagtaa

SEQ ID NO: 76738 - DNA, 810 bp, Glycine max
  Peptide Sequence Number=SeqID_168423
atgagtgagagtaacgggaacagcaggaggcgaaatgttgaagatcaagatctgggactgtacttcttggaggcgtgtagggagatgaaagagaaagaggaagaggaagaagaagaagaggaggaggaggcacccagggagctcaacaccattaacagctctggtggtttcgtggtggtgtccacggacaagttgtcggtaaagtacaccagcgtcaaccttcacggccacgacgtcggtgtcattcaggccaacaagcctgctcctaccaagcgcctcatgtattatttcgagattcatgtcaaggatgccggcgttaagggccagatagcaattggattcacctgcgagaccttcaagatgcgaagacaaccagggtgggaggccaatagctgcggctatcacggcgatgatggtctgctctaccgtggacattgcaagggggaggcgtttggcccaacctatacttccggagacgtagttggtgccggaattaactatgctgcacaggaattttttttcactaaaaatggccaagttgttggctctgtttacaaagacatgaaaggccccctttttccaaccattgctgttcacagtcaaaacgaagaggtgcatgtcaactttgggcagaaaccatttacttttgacctaaaggtttatagtattgtggggatcagtgtaatcagaattgcatcgcttaattgtgatgcaattctgcatcttagccgtacatatctcttcttggttcattttggtgctggatttgtgcattggagacagtgtgaaagggttgaggctgaggaatga

SEQ ID NO: 76739 - DNA, 348 bp, Glycine max
  Peptide Sequence Number=SeqID_168424
atgatgcttctctcacccaacaaggcaaggccagaaaacggtttcaaagtctgccagtatctattcgatgaacttgcccttggacaagataggcctaaacccataaaggtagcaagggcaaagtcaaataaagaaataaagaaattccaacttaagtcaatcaaggaacaattgcagagagtacggacactccagccccttgctgtgtctggtgtccgacacgctccgtgtcagtgtccgacaccgacacgacacccgtactacgttctatattttggacattacaggtgtccacatgtccgtgtccgtgtcgtgttcggtgtccatgtcggtgttgatgcttcatag

SEQ ID NO: 76740 - DNA, 539 bp, Glycine max
  Peptide Sequence Number=SeqID_168425
atgaaggtgaaggtgcgttgtggtggtcgacggcggcaaacaaggtacgcagaaggtggtggctgtgtcgcgaacatggacgaagatgagtggatgtatgaaataatgtctgaacaagcggatatggattatgaaaatgaagaagcatgtggtgcgaatgatccacatgttgattgttcggatgcgttcaatacttctcaggctcgattcgttgctcatgaaaacagatttgtggcggtgattttaaggtcagatacaaacacaggtagtagaggaaggactacgtttgtgttaattggttatgaaaggagtagcgagtataggtgtaggaaaaaagaatttatccgaagagatactgggactaggaaatgtgggtgtcccttcaagcttcgttgcaagctagtggttggaggagaaggctggatggtgaagttgatttgtggagtgcataatcatgaattggccaagtcattagttagacatccatttgcggggcgattgactaaagctgaaaaaacacttattgctgatatgacgaa

SEQ ID NO: 76741 - DNA, 351 bp, Glycine max
  Peptide Sequence Number=SeqID_168426
atgcctaggctactcaacaccaacgagctccacgattgtagaacacagactcccagcacagaggaagaagacgacgctcacggggggaacgcgacacggaggacctcgacggtaggtcaagcttttctgaaaccagcaaccacttcatgcaaacaaaacgaaaggaagaagaatgcggctgaggtgaggtcaggggtgaggaaggagaccaaaaccactccacgccagcaaagaagaagagaaaatgccaggggtacaaaggtatttttgcatcaactgttgggtgcaccagcaaaaatgctgggtgcacctagcagcactcgaaagttttggataatgttcttcgggtaa

SEQ ID NO: 76742 - DNA, 405 bp, Glycine max
  Peptide Sequence Number=SeqID_168427
atgggggcgagccctggtgcagcggtaaagttgttgtgccttggtgacctgttggtcatgggttcgaatccggaaacagcctctttgcatatgcaaggcatatacgtctggctaggatcttttgattttcagcttgcctatggctgtgccattatttttatgcattctactttttggtgttccaagcttgtactcttgaagaaggttgaatcaaagttgagggaggcaactatgaggcttgaggaacaattggcagaagagcaagctgcaagacttaaggcggaggagaatgcaatgttagctcaaatgagatcagatgatgaaatacgaaaactcagagaacatcttgagaaggcacatgaagaacttcgcaagcgaggtggaggtggttgtgccattctttga

SEQ ID NO: 76743 - DNA, 960 bp, Glycine max
  Peptide Sequence Number=SeqID_168428
atgggtgaagttcaaactgatggcacatggcgtgatagacttaataaatggagagagatccttagtaaagaacgtttttctgagcaagtggattccttaaatgccaaatatgtagttgaattcgacatgaaagaggttgaaaatagtcttcgcaaggatgtggcagaaaaggtgacacccactcagggtacaagggctttgtggatagctaagagatggtggcgctatcgccctaaacttccttacacttatttccttgacaaactcgatagttctgagatgggaggttacaaggatggggagtgggagtggaatttatcttggagaaggccattgtttgataatgagataccaatagctgtcaatttcctaaaagatgttgaaaggtcggctactcagacaaatagaagagatgagtgggtgtggaaggcagatccaagtgggagatacacggcgcaaactgcatacaatgtaatgaggggggttgcagttgatgggatccaggatagggcttttgaggagctgtggaagttgaagataccaatcaaatttgcaagatattggataggagttgcccattttgcagaagaagcggaagaggaagcaagacatttgttcttccactgcaacaaagtcattcctatttggtgggaatcattatcctgggtgaacaagtctggagctttcccaaaagacccaagacaacattttctacaccatggagatatattgggtgatggcagcagggctactaggtggaaatgttggtgggtggtagtgacttggactatttggcagcaaaggaataagatgatattctccaacgaaacatttgacagcaacaaattgattgatgaggcagctttcttgttgtggacatggctgaggcatttggagaaggatttctcattgcattttaaccaatggtctagtaactttagagaagggatagtgtattag

SEQ ID NO: 76744 - DNA, 480 bp, Glycine max
  Peptide Sequence Number=SeqID_168429
atggcttccgcttcatttcctcctcctccaccgtcatcatctccggcaatgacaccttctccggcttcattttcgcattctattccaacgaaactcacaaactccagttacattctttggtgtaatcaggttcagccggtcattaaaggtcatggtttgtcgtactttctggttgctccgatcattccatcgcggtttgatactgttgccgattgcaatgctggaattgtgttgaaggagtatctaaactgggaaaagcaagatcagtttcttctttcttggcttcaatcaacgatttctaatgtcgttcttcctcatctcgttggatgcaatacgtcatggcatctttgggaaaagcttcatgcacacttttacctccctccaggtctcccattggttgcaaatgggtcttcagggtcaatgaaaaccctgatcgtacagttaacaaatataaagtcaggtcccaagagcatggtttga

SEQ ID NO: 76745 - DNA, 2322 bp, Glycine max
  Peptide Sequence Number=SeqID_168430
atggggagggagagtccaggtctcatgtacatggcaggtttgaaagtttgggctttaaaaaatggcctatatgaggtcttaggcgccttagatacaggaaccaagtcttgcaaggtttggcccatccttgccaattaccgccctaaaattgaaggaagggaccattaccgcataatgatcggctacgatatcagttacccgacttgtatcctgctcctctccatagatgttgacaccttcagatcttcatgttacaacctcatttgcaacagttctaattggggacagagaaatgggtttgatggtgtgagagcaagatgggaggggagagatagtgtgagaaggagagagactagggacccacgtcggaatatcgtcggagaagggaacggtaaacaacaaagctatgtgaggacaaattggagggactatcacaacatttcttcattctacttcacccgttttcccgaagaagcaacgaaggttgaactatggcaacatttcaaaaatgtgggtgatgttagagaggtcttcatttccagaaagaggaatagaagtggaaggagatatggttttgcaagatttaagggagtggatgatgtgaaacagctagagaggaggttggataatattgttttgggaggtttgaaattgtacgttaatattccaaaatatgaaagagacacacatgaagggagacaaccagaaactagagctcaagcagccaccagacaacagaagtccagatcagaagtgcacctcgaaataccgttatcagggaaaaaatggctacaggatgcatgggtgggaaggttacaaaacctcaccatgtatgatagaattgaggaagacatgctatgggatttcggactagatatagtgccgaaatacattggtgaggacatggttctgctcctcggacttatagaagaaaaagcaagacgattgatggaggtggacgaagagggaagggatgctctgttttactcgctagaaaggtggaatccgacggtgagagtaaggaacagacttacatgggtgcaggcgtggggaatacctttgatggcgtgggacgcgcaacacatgaagacaatagtggctggaataggagatgcggtggatgtcgatgatgatgtagaggagttgcggaaaatggaccgggctaggatcctaataaaaacaccgtggccggcgcttattcaacatacagttacagtccatatccaaggggaagaattcatggtgcacataatcgaggaaacaggcgcttactccaacacgtgtcggtgtcggaggggtatagagtacagttcatcggaggatatcctgtcggaagaaagtgaactgggtgcgtcatgtatgatgggagtgtcggaggagatggcagtgcagatagggtcgtcggaggaggagatggtgcgggccatcgcgatacacaaggctccgatggagaagacgagggccaggggagacttgctggagatggcgttggcggcacaaaaggggtcgccggagacgaaggcggtgcgaagtcgggagttggagatggtgacggaggaggaagctgaaattggctccgatgaggcggaactcgaacggttattatccagtgagtgcgccaaacaccatgaccaagtggataatacctacgatacggagaggtcgacatgcatcctgaccacaggtggcgtcaaccaaacagcagagacagctaggggcaacgcaggtggggtagtgacagttttgcctgatttgggagaagaaatagaaaatgggtcaaccacagcaccgttggcagtagacattcacaaaaatggtagggtgcatgcagaggagaccgttgaagtgctggaaccatttttaaaacaaagtgaagtggcacgtgtcaaagaaggagctgaaatatgtgggctgggctttactcctcacacccccattaacccaaaagtacaactccagcaaagttttttgaaaatacaagcagaaaaaacacccattattaatgtgtactcaaaaaagagatggcgcaaaaagcaaacagagccaaaaagcccagacaggtacctgctcaaacatgtggaccaacaaggaagcccacctaaccaggataagaaaaggggagataacttatacgcaaaacagcaacaaaaagaggatgtctacaacacatcagtggagttgaaacaacacaataatattgacaaggaggctgagagactatggcagttggcacaagaaatggggattgcatacccgaaggaacaaacaagtcaagtgcagagattagtacacatggaagaaagggacatcatggagacgtag

SEQ ID NO: 76746 - DNA, 222 bp, Glycine max
  Peptide Sequence Number=SeqID_168431
atggaggtgcaaaaactgaagcaccaactgccatcaagggttttagccctctataacgccactatttggggtttcattccccatcctaagcgacaaatattttcgaacctaaaacggtttgacatgtggaaaaatcaagggatgtctagactatcatgtctcaaatcgaaagacttagagcttgggagccttgtgtattgtatcaagcccagaggtagttga

SEQ ID NO: 76747 - DNA, 246 bp, Glycine max
  Peptide Sequence Number=SeqID_168432
atggtgaagtgcgttttggaagatggtgtgaaattggggtgggattggaaggagagatgggccaaagtggtgattgttgttggtggtggtgcattggaactcgaaggagtggatgggaggggaagatttcttgtgatttcttgctatttcttgcattggagtgaaattctgtataaatttcttatgagtgacgtggcattgcagggaccacaaaaagtgttatgggaaccacaaaaagatgattaa

SEQ ID NO: 76748 - DNA, 909 bp, Glycine max
  Peptide Sequence Number=SeqID_168433
atggaccttacactttacgacataaaggaatcatcctctggtaaattagttccctgtgatcaagagttttgcaaagagatcaatggaggtctgctgactggttgcactgctaatatttcctgtccatatctggagatatatggcgatgggagctcaactgctggttactttgtaaaggatatcgtactttatgatcaagtgtctggggaccttaaaactgattcggctaatggaagtattgtatttgggtgtggtgctagacaatctggagatctaagttcttcaaatgaagaagcacttgatggaatacttggatttggaaaagctaattcatcaatgatttcacaacttgcttcctctggcaaagtgaaaaagatgtttgctcattgcttaaatggagtaaatggaggtggtatatttgctattgggcatgttgtgcaacctaaagtgaacatgactccattattaccagaccagccacactacagtgtcaatatgactgcagttcaagttggccatactttccttagtctatcaacagatacatcagcacaaggagacagaaaagggacaataattgacagtggtacaaccctggcctatctgcctgaaggaatttatgagccgctagtatataagatgatttctcagcacccggatctaaaagttcagactctccatgacgagtatacatgctttcaatattctgagagtgtcttgctgttggttggaacaagtgcaagtgttttgctagcttactttggcatacaggctttagaagaattctttgttgtccagttagttttggaaggaagggtggggcctaaagtgtgtggttttgataatggtggttcagggttgacaatgttattaacagtgcttccatactgtaatggcatagtgttttga

SEQ ID NO: 76749 - DNA, 1311 bp, Glycine max
  Peptide Sequence Number=SeqID_168434
atggaacctaggaatgaagagttccagtctggatctcaatcagtaattcaggaccatatggatggcatgcatactatcagaagaccgcctgactatagcatgtcagattttaaaccagtacttaattattcaatacagacaggtgaggaatttgctcttgaattcatgcgtgatagggtgaatctcaggaagcccgtattttcaaacgttagtgattcccattccaattacgcaactggttgtatggaactgaaaggcgtcttaggaatcagtcaagcaccttctgaaagtgggtctgacatttctatgctttcgaaagccgagaaaggttcaacagagtttaacagacagagtacttcattacatggagacagaagcaattatgggtcaattagatcaataccaagaacttcattgaatcaggagaatagtcgatttgtacgtgggtatggctcttctgttggttctgacagctcatcaacaatgatgaagtgtctctgtagctttggtggaagaatattaccacgaccaagtgatggaaagctaaggtatgttggaggtcaaactcgtattattcgtctaagaaaggacatatcttggcaggagctcatgcagaaagcattaccaatctataatctggttcatgtactaaaatatcaacttcctggggaagatcttgatgctttggtatctgtatcctctgaagaggatttgcagaatatgatggaggaatgtaatcttctagaagatagagaacgctcacaaaagcttaggttgtttttgttctcattgagtgatttagaagatgctcagtttgctctcggtagcataggtggtgattctcaggtccaatatgttcttgctgttaatgccatggactttggatcgataaacagctcaaccccactaggtgtcagtttttcagcagatgatctacatgaattggaaaggcaaactgcggagagggaaacttgtagagttactgtagaatctataggtgtcagcaatgctcccttgagtaataaatctgactcttcattgactattcattcttcacaaccagttctaccaaatgcctctaatgcttatgaaatcaatcgactgtcttatggtgatcaaatgacacaagtttgggattatagtcgtcaatattttgttcatcatggccttacttccagtcataaccctgttgttggagagactcctgttcctatggctcctcatctgctgaacaatcaacaaggggttctgaatgaagataatctacctagtggattacaagtacaaaattctcagttatctacaatgcag

SEQ ID NO: 76750 - DNA, 673 bp, Glycine max
  Peptide Sequence Number=SeqID_168435
atggataagagcttgaaggtaggaaaagaagaatggaaggagaaggagagagggagcacgaaattttgtgcctcaaaagaggctcatgagaatcctagggccttctcttgcatctctggcccaatctacttggaatcttctatccaatgcccttgcaggggttatacggtgttgaaatttcaagcctttggtgtggtgactaagaagtttgatagtgatagtgagaatgaagttgttacaaatgttggtaatgaaaacaatgatgataaagcagatgaggttgcttatgataagaagcataatagggtaatgcataagtttttatgtaacaaagaggggtttagggacaagaagcatttcataaggaataataggaaaaaggatcacagaccccttacatgcaccaattgtgaagcaaggttgcatgcccgtttggataaggataccggtttgtgggtagtaaaaacctttttggatggtcataaccatagattatgtccttatgattatgttcccctaatcctaacctactgtggattatcttatggagacaaagcggaggttgatgctttgcataggcaggtcgaaagaggagatgtattggctgcaattaatcattcgcaagttgacaatgatgctatgttttttgcaagatacatgcttacagaggatg

SEQ ID NO: 76751 - DNA, 807 bp, Glycine max
  Peptide Sequence Number=SeqID_168436
atgttgttgttgtcgacatacaacgacatctggaacaaagacggtgtggggcccgtcgtagataccgattttaacattttttatactaaaccttatataaatacttcattgcctacgattaagcgggaggctgcaaatctatacacacagaatgtttatgatttagttaagaagaagattctcaatgtcggaggggtgaatgttataaatagatgtcaagtaggagacaaggttactttcaagtgtgactgtatgatgtttgagtcctccggtattccatgttcgcacattatgtgtgccatgcatcttgaccacatccatgcattcccctcaagcttgatttgttcaaaagatgctaataacttcaagtttgtaagggatggattacttaagttgactgaaaggttgcagaaacgcctagatttgggtggtgatcctgttaggcatcctagtgacgacctaagttgcggtgaagattttaacttcaatgatccttctgttaataacactgaaggggctaacgtaagtttcagtcaagatgcagcaccggttggttgtactgagacgcctgttgcaatgtcgaaaaatgcaaatgccaacaaagtcatggatgaagtgggtgtattaagcgagcggttaaacatgaacaatccattgactttggaacataaatcggatgttaacatgggtggtgaaatatgtggatcaagtaaccccattcagaccacacaaacttctgataataaaggtgcatccatatatggctcaactaacctagttcaacaacgttcaggtttctggctatag

SEQ ID NO: 76752 - DNA, 507 bp, Glycine max
  Peptide Sequence Number=SeqID_168437
atggatgttgagatttttaagaaaaccctcaagctcacttctacttcgtcccggagaggatgcaacatcgaatcgctcacgtttggcctcaatgaggacaaggctattccttcatctccaaggaggagtttctcggtatggtggagcgagaggagctgctggagtacatgttggtctacagtgactacaaggtggggtgccacattgaaggtgttcgggaagtcagtggtgtttgtggcgacggagagcgagatggtgttggttgagaggctcgtggaccggaaggcggagattatggagtcgttgctggtgaggattggtactgccagggaggagatgaagcatgtcaagaattttgattatgttgtggtcaatgcgaaagggaagcttgataatgcggtcaagttgatggagtctattattgatgctagaaagctaggaagtcatggtttcattgatgatgacacaaataaagcactagatggctatggagcaagaagagactaa

SEQ ID NO: 76753 - DNA, 381 bp, Glycine max
  Peptide Sequence Number=SeqID_168438
atgcaatggtggttccaaagtcagaaaagatgcaaagacaagctggaactaacaaggaacaagcatagaaccatggttacctcgaaggaaaacgaaagggttcctctcggtgtggggtttcaacggagaacaacggcgatttgtggtggctactggtggctgtgggtgatggagaagaagcttggcacgttgaaaatgaccaaatttcgagaagatccaacggttaacgaaggctatgaagcgtttttaccgagacaacttcatgtagcttccttgagaagcttcattaagaggcttcctcgtggcttctttgagaagcttttctcgagaggcttctttgagaagctagattttatctacccacacccttctattaactaa

SEQ ID NO: 76754 - DNA, 381 bp, Glycine max
  Peptide Sequence Number=SeqID_168439
atggcggagaatacacgttctgcgacaacaataaaggaggttgaagatcgagttgtggctaggctggaaacacgtctcatcaagttagcgggtaatattcagaaggtgcttgaagactctttgaaggattcactgcaagaattggtcaaggacacccaagaacataacactccttctctaagctcgggcctaattcctcgcggtgaccattctcttaatcttcaatacaattgtggcacgaggttagctcgcatcgattttcccatatttaatggcaagaagcttctcaaagaagcctctcgagaaaagcttctcaaagaagccacgaggaagcctcttaatgaagcttctcaaggaagctacatgaagttgtctcggtaa

SEQ ID NO: 76755 - DNA, 1251 bp, Glycine max
  Peptide Sequence Number=SeqID_168440
atggggagggaggacactaaaattattgttattagtttttgtggctctataaatatttgggaactggagtccatagacagcaagcaagaatgtttgattaaagtggatgaggagtggtcaatgtctaaaatttccaagctttcctcgatatttggagattcatactttacaacagcaaaaacaaaagtcttgtccatcccactaggtgaggttgactacatggatcacatgatgccatttggatccattaaagactggagagtggagattcatactttctttgtaaaagtggaaaatggaaaggctcaagctgctaattttccattttgtacaatagagccaaatgtagggattgttgctgttccagattctcgtcttcacgtgctttctgatctcagcaaatctcaacgagcagttccagcatcaatagagtttgtagatattgctgggcttgtcaagggtgcaagtcaaggagagggtttgggcaataagtttttgtctcatattcgtgaggtggactctatacttcaggttgtacgatgttttgaagacaacgacattgttcatgtgaatgggaaagttgatcccaagtctgatattgatgttatcaatttggagcttgttttctcagatttggaccagattgaaaaaagaattgataagctaaagaaaggcaaggcaaaggattcacaaaaactcaaggaagaggcagaaaagtctgcactggaaaagattcgtgaggcgcttatggatggaaaacctgcgcgatctgttaccttaactgattttgaaagggatgctgtaaagcatctctgcttgctcaccatgaaacctgttatatatgtggcaaatgttgcagaatctgatctagctgatcctgcaaacaataattatgtcaaggacgtaacaaatgttgtgtctgagttgcagtccagaattgtaacaatttcagcacaggttgaggcagagcttactgaactaccagttgaagaacgacaagaatatttgcaatctcttggtgttagtgaaagtggtcttggcaacctaataagggcaacatatgaccttctgggtctcagaacttactttacttctggtgagaaggagacaaaggcatggacaatacttgcaggaatgactgcacctcaagcagctggagttattcactctgactttgagaagggtttcattcgagcagagacagtaagcaccaaggatataattttgaactactatatgcatataaaatag

SEQ ID NO: 76756 - DNA, 525 bp, Glycine max
  Peptide Sequence Number=SeqID_168441
atgcttctatcagcaccagccgacaacttggtggttacatcacgctgctgcagagcgtacatctacttgggttgtgatactgagaacaagagagggtacatctcttgtgcatcagttcaagtggagcgtacatccacttggttgttcaaagagaacaagggagggtacatcccttgtggatctttgctttgctggatatacaagcacttttcctcagtcgcggagtccactgctgatctggactacgacgaggattcatcgcgtgcctgtaggtggattgctacgaagaagaccgtgaagagcagacgtacaccggcatacagggagtgcctggaccgactccggatttcggatgtctattggatcccatatagggagcaccgaccggtctgggacttccatatgatttcatgctattccggtctcctacgctgggggcccgttgctgtgtattaccaaccagagatggtcatgcaacagtttagacacacccagaacattcttgtttcgcctgttgattcatag

SEQ ID NO: 76757 - DNA, 333 bp, Glycine max
  Peptide Sequence Number=SeqID_168442
atgggactgtcgaaagtaaaagggggtataagtcgaggtcgcggttctgggtcatcttctccgttcgcgtcgccgtcgttcacgccgtgctcgtcgccgccgttcacgccatgggtcgtcgctgctggctgcagcgggtcacgcgcggctggttccgaggctggttgcaggggtcgtggctggttccgaggtcgcgctgtgttgaagcttcgagggttacagcagcgttctgaaagaaaaccgctacgcaactccgccatggcgccgccatggccgccatttaacaacactgcttgtaatatgaatcttatgaagatagcaggccttcaataa

SEQ ID NO: 76758 - DNA, 90 bp, Glycine max
  Peptide Sequence Number=SeqID_168443
atgggtgcagaagaagtggaaggacaaggtaaaggtgaaaaacctggaagaataagaggaacaaagcttgaattaacaggtgatgcttga

SEQ ID NO: 76759 - DNA, 768 bp, Glycine max
  Peptide Sequence Number=SeqID_168444
atggttattgatgaatttgttttcttttcattgacacatctacccagtcaaggtgcaccttttgagggcaccattgttaatgactggaagtttgattactccagtcatgatgcctgccacatggtttgcattgaccaggcggacatgaccggtagactacttgttggttcattgacatttgattgtcgcatcatgcactacatcacaattcgcattttgctacccagatcatcaaacttggctcaagcctttgaggaggatttaatattgatgtgggcttttctcactggtcgtccgattgactgtgcccatttgatcagataccgcatgcataaggcattgcggtcaaatgcacctttgccttatccacaacttgtcactttgtttcttcaccattttcaaattcccttggataatgagccctttgtgcaagtcaaacgttcttttgccattggtgtcggtgtggtaacctccttcggctaccgtaaggacatggatgggcaatggttgaagaaggatagacaacctccgcaagacgaacacactccttctcctccgcctcagagagatgactcctctaccctcatgcatgaagttctctcggagttacgaggcctctgctcctatgttggtgagcgctttgattccttggatggtcgtatcaatgccattgatgctcgctttgcagggatggacacacacatcatacaacttgaggacgacatgagtttcattcgccgttgctttaatcctcctgcggattcatag

SEQ ID NO: 76760 - DNA, 225 bp, Glycine max
  Peptide Sequence Number=SeqID_168445
atggggcccgcggtctgtgagggttacggaccaatttttttaaacggtccattgttatgtcatatttttgggcccgccccgcttaacccacggactatgcgggtttggcccgagaggtccacgggttgcccacagcccgcattaggaaaaaaagatgaagatatgaagatggagaaggctcaagctacttcaaatatggaatcatttgttgttggagatgtttaa

SEQ ID NO: 76761 - DNA, 282 bp, Glycine max
  Peptide Sequence Number=SeqID_168446
atgagtgtcatcgttcgtgtcacagaaacaccagaactgccacaccatgccctttacaaccacaaattaaagaaaaaggagaaaggagacgaactcgtttgcgatagttccaacatcaatcgcggcaaagacgaactcgtttgcggtagttacaactttagcgacaatgctagcttcaatggcggtagccctgttgggaggaaggagaaaggagaaaccaaacgggagaaaggaaaagagggttttagcgcgtgggggccaaaattggtttttaatttatga

SEQ ID NO: 76762 - DNA, 840 bp, Glycine max
  Peptide Sequence Number=SeqID_168447
atgcagaactcgctaagcgcgaatcttcgcgctaagcccaatttcctctctggaatttcaaatttttgttctgggctaaatgagtttgcccgcttagcgcatgagtatgagaactcaaacatcaattttgctcgcttagcgaaggtatgtgttgaagggctgcaaaaccccaatctttctagagttttcgacgaactcgctaagcgcgactgtgcactaagcgaggtcatcagttttgcttgtttttttgggtttccagatgaactcgctaagcatggccctgacctgctaagcgagttcatcttctctgatgaaggtttgaatcctgggctaagcgagtttatctcactaagccccaggaacttgtgtttatttttgaatgggtgtctaagcgctaagccagctttgctcgctaagcgcacaatcttctctgtttttgttatttttggaactgggcttagcgagccctgctcgctaagccatttatttttccagaggttgtgtcgcgctaagcgtaccttgtgcgctaagcgcaatttgttttctgttttcgaattgggcttaacgagccttctcgctaagccaattatgcagttttgcaaactacgcccagaccctcaggagctggcagcccgactatgtatccctggcaggggatttgtgctgaatgcagagggcctaccatggaagcttctaagaaaagacctcacgactctgacggagacttggagcgtattgtcctacttcaaccttgcccccacatcacatacttctgatcttaacttggacagggcaaggttggtgtatggacgaactcgtgatgaagatggatatgaatga

SEQ ID NO: 76763 - DNA, 549 bp, Glycine max
  Peptide Sequence Number=SeqID_168448
atggcttctgctatgtcaaatctcatttctcagttgttccctaactctattgcagagaagcttgatgattcgaattatctccactggcgacaacacgtcgaaccagtgatcaaatcgcacaagttgcaacgatttgtcgttagtccaatcgttccgcctcgttatctcatcgaggatgatcgtattactgattgcgttaatccagagtatggaatttggtttgggtcaaaatccatgaatatttcagtctccacactaaatcatgtgcgcatcaactccacaactgatgaatatttgcgcaagatgaaaggatatgtagatgaactaactggtgtaggtgttcctgtttggcatgaggagtatattgatgcgctccttgaaggattaccatctgattatgcactggtaatttttgtcaatgagagcttgtttggccgtggtggtggtcgcgacaccttttttgatcgaaatcgggacgtggtagcggtggttccagcaaaggccgtggaggtggccggtttgccaatttttagtgccaaatctgtctaa

SEQ ID NO: 76764 - DNA, 363 bp, Glycine max
  Peptide Sequence Number=SeqID_168449
atgtggatcaagatccaacatctccccattgagctttacaataatatcttcctcgataggataggcatgagtctcaaaaaattccttaaggtgaataggttgacatcaattcactctagaggaaaattcgtgagaatatgcatggagcaggaccttaagaaaccgcttgaaactcatatttatgtttgtgggttcaagcttaatctggagtatgaagggaaaaagggacctaacaaaaatatagagtcaagcatgatcaccaacaatcgcataggtgagcatggaaaaaattatccaaaatatatgatgaggaagagcggtggacagtcaaaacatcttgatcatgtggctcaaaaagactaa

SEQ ID NO: 76765 - DNA, 177 bp, Glycine max
  Peptide Sequence Number=SeqID_168450
atgcaaaagcagagacggagaaggaacgaaattctcagcatagtgattgaagcacatcgatatcaagaagcagcacctatgaaggaagccattgcgagctctaagagcccaggcatgatggattcaactttgggttcatcaaggatttctgagatactctcaaaggtgattttgtag

SEQ ID NO: 76766 - DNA, 300 bp, Glycine max
  Peptide Sequence Number=SeqID_168451
atgccgatgttggatcaatttcagccatttatacataatttcattgacaatattgtggatgtcaaagctgatggtatgggtgaagattcttggtccttggtgcgcaaccatttgcttaaagaacttgtcaaattctcaaatgactatatcaagctcttcgatggcacagacaaattcgaggaattaaggaggtcccgacttgttgatgggttatccaaggtttatttaaaagaccgttgtcctttaccgcctctagcattgttatggtctaggagttgtcatcctgaggcaaagcagtga

SEQ ID NO: 76767 - DNA, 615 bp, Glycine max
  Peptide Sequence Number=SeqID_168452
atgggctactatgttgttggaagtgctggaagtaaagataaggttgaaattttgaagaataagttcgggtttgatggggcttttaattacaaggaggaacaagacctggatgcaactttgaagagaatgctaaaaatattaaatgttgttggtttaaatggtgctaggtactttcctgaaggcactgatgttagatcaagtgatcttgatgagcctcaaggcataaagaacttagtgaatatcatatacaagcagatcaaagtagaagccttcacagtttatgattactatcacctctatcctaaattcttggatactgttttgccttacattagggaagggaagataacatatgttgaagacataactgagggtcttgagaacggtccaattgcactagaagcaatgttccaaggtcgtagtgctgacttgatgggaacaagaactccttcaatggttcttgacggcgttgaggtcgagggtgatggcattgcagacatcgagggacttgatgacacggtcgaggagctccaagagtaccttacaaagaagttcaacctttgtatggtttttcctttgtactctctcgatctagaaccttcaaagggaaaatga

SEQ ID NO: 76768 - DNA, 120 bp, Glycine max
  Peptide Sequence Number=SeqID_168453
atggtgctccaacacagggtatttagtcacaaactctttgcctgtgtattgctatgggtatttcaaatatgtcatgggtatttctatggtgaatggtggaagaaagatgttgaggtttaa

SEQ ID NO: 76769 - DNA, 228 bp, Glycine max
  Peptide Sequence Number=SeqID_168454
atgtgcttcggtttcatccatggtgccgcgaaggtaattggtgtcaagggtcatgactacgttaatggtggcggagggaagggagccacagtcctcgccggcgggggcctctcggaagagatgaagctctggggatggacgactgacaataataatttaatgtatcacttgcctgaggttacaaggacaatgatggccaaaaaagccacgaagacttggatacgctaa

SEQ ID NO: 76770 - DNA, 930 bp, Glycine max
  Peptide Sequence Number=SeqID_168455
atggttacagggaaacacaacggcggagttaccaacaaagccgcattggaagccacacgaataacggtgtcgttttttgtcaatgagctcaggggaaatggaaatggaaatggaaaggaaaacaatgataatgttaacattcctttgagtgttgtagacacaaatggcgttgtttacgagcttcaggtgttggtaaagacgggttcagatagtcgatcctgtatagccaaagcgggagcaattttgctactagatcggttccttaatgcagaggagaatttgagcctacaggctaacatcgtgatgacgacgacgatgaaggtgtttagcttgtcaggttgtggggttggcaaagagtgggccagaggggcaaggagggacgcgttggcggcgatgttgaatttggtggcagataaggagacagtggcaaggttggtggagaggggtgtggtggggatatcagcaatgtcggaagaagggttgacgattctagaggcggtggtgaaaagggaggctaggggcggtgctgagggagggatgggagagagtgagggagagcgtggcggcgatgctagtgactcggttgaggattccacggcggcaaggcttaatggcggggagaaggaaaggttcacgacaactactaccatggtttcttcgtcaactatattgaagagcattctctactcacggtaccatgttgttatcatgttccgcaacacgcgattcgggattagactattgataaagccacttaatgaggaagaggtatccaccatgcaagagatgcttctaagagctaatgtaagagattatggaagatttgatcctccaccaggtcacgttcaaccccctagcaaaggaataccagcagctgctccagacccaaatcatccacctcctcctcctggtaacggtggatgcaaatga

SEQ ID NO: 76771 - DNA, 1790 bp, Glycine max
  Peptide Sequence Number=SeqID_168456
atggctatggcggccgccatccgcaacccacaacgccaccgctatttggtggcgttttttccgaaaatttgcgacgccagaccgccatggcgccgccataaccgctatttgataacactgttgcctattgttaagaccacaatcaaggctgtcactgctcaaaggactttaaaatctaaatccagattgtctcagaacaaattagaatcaacgacagcaacatcatctcagaacaaatccctatcagctcagaaaaatctagaatcaactactgtgacatcatctcaggacaaggaatcagtttctctgtctcttcctgagaaaagtttgacagtttctgatgatacaaatcaaagttgtcttccatctggagagagcaatctgacaacaaatttgttagagttaattccaaggaaaaaatccttccgccggaaatcatatacaacttcattaattgaaggatctaagattctcaaggaaagtggtgatgttcgagagcaggataacctaccaaatatagataatgaatgcaatcaacttgaagtttctgaatacattgatgacatatatctgtactattgggttactgagacactgtatctcactgttacgttgttggatcaatatctttccctagtgactatcaaaaagaccgatatgcagttagttggccttacagcacttttacttgcctcaaagtatgaggatttttggcatcctagggtcaaagatttaattagcatctcagcggagtcatataccagagatcaaatgcttggaatggaaaaacttattcttagaaaattaaagttccgtcttaatgctcctactccttatgtttttatggtgaggtttctaaaggctgcgcaatcagataaaaagcttgagcacatggcattctttctggtcgacctatgcttagttgaatacgaagctttggcattcaagccttcattactttgtgcatcagctctctatgttgcacgatgtactttgcaaataactccaccatggaccccactacttcacaaacatgcacgttatgaagtttcacagatcagggattgtgcggatatgatactgaagttccacaaagctgccggggttggaaagttgaaggttatatatgaaaaatactctagacaggaactcagtagggttgcagcagtgaaaccgttggataaacttccatggactcccactacttcacaaacaagcacggattgtgcggatatgatactgaagttccacaaagctgccggggttacatacgaaaaatactctagactggaactcagtaagggggttgcagcagtgaaaccgttggatagacttaccctaggttttttctttccaggttgcatgtacaaccttggttctagatgggatgctgttggatgtacaaccttggttcaacttgtaatgatggatggaccaaagcgcaattctgaagcacgcgctaaaatcatggcttttcttctatccaacctgaaaccctcactgctaccccaaaccaaatcaaaacccattcctcaaacgccttcaccatcatcagcaaaacccacttctcaaagtccttcattgttcttcttcacttcatctgctccactttccgcactccaaagttccactgcacaggttgctcaggggcacacaccaacaacaggtgccagagacgagcttcagcagcagaaggatgagttttacctcaatcttggccttgctgtcaggaccctccgtgaggacatgcccttcatcttcgtcaaagacctcaattatgacatttacag

SEQ ID NO: 76772 - DNA, 789 bp, Glycine max
  Peptide Sequence Number=SeqID_168457
atgtctacgtccgacgctggaggtgctggatccaatgattccaatgctaccaggagacaaagcaagagacccaagtactcaaagtttactcaacaagaacttccagcatgcaaacctattctcacaccaagagcggttatttcagcattcttgattgtcaccattgtgttcattcccattggagttgcttcattaattgcttcgcatgatgttgttgaaattattgataggtacgactcacactgcataccatcaaatgtgacagacaaggtggcatacattcagactcctggagaaaagccatgcaacaggcagctaactgtggaaaagcgtatgaaatctcctatctatgtttattaccagcttgacaacttttaccagaatcatcgacgttgtttatcacttcaatgtcttcgactgactggttccttcaataattcagtcttcgaagtttggtatgttaaaagccgaaatgatgatcagctgagggattctggaaaagcaagctcagtaagtggttgtgaacctgaaaataatgtaaatggaatggcaattttaccttgcggtcttatagcttggagcttgttcaatgatacgtacagcttctcacgcaacagcaataatttaacagtgaacaagacaggcatctcatggaagagtgacagggaccacaaatttggaagtgatgtttttcctaaaaatttccaaaatggtcctataataggtggtggtggcctcgatgaaaatgtacctttgttatttgattacttcaggaaccctaatgactag

SEQ ID NO: 76773 - DNA, 450 bp, Glycine max
  Peptide Sequence Number=SeqID_168458
atgaagcagctgccaacgctgctgatgaagtccctctcactctcagtgtgttctttgccagcagcagcttccacaaccacccttcaacaaattgctctccatcaacccaaaggtgttgcaaaggttgtacttaaaaaggggaagacacaactctttaaggatggcaacccaatggtgtacagtggagctgttgatagaataattgggaggccacctcccaagaccggggatgttgttctggtagcagatgggactgagaaaccaattggatggggcatgtacaactcagtttctatgttctgtgttcggctcatgcagcttgaagatgaagctactagcttaagcccattgaacaaacagtgtaggacaaaccaagagtgtgcttcttggctaggtactcccttgataaacaaaccaagagtacttctcttgggcaaggtattcccttga

SEQ ID NO: 76774 - DNA, 258 bp, Glycine max
  Peptide Sequence Number=SeqID_168459
atggtcaacactcggtctggccttagatgcgagacccccctcgaaaactcccatcctcatccggcagctatgacagacacagacactctacaacaactccaaaaccgcattgcagagatggagcaacaccatgagaaggagttgacaaagttaaaggctaatcatgacaagctggaggctcgtgtcagacgtccccaaggcaacgagcaatccgcccacacctttcctgaacgcactcaaggggaatcatatccctga

SEQ ID NO: 76775 - DNA, 999 bp, Glycine max
  Peptide Sequence Number=SeqID_168460
atgtcactcgcccatgggtggcatgtactggagacacaatggagtgctcatgcgtacatgtcactcgttgtgggtggcatgtactggagacacagtgctacaagaagggctcaccaagggcaaaccttggattttaagagcctcattggtatgactatggacactcttgtcttgataagagaaatccccttaagccaaaaccctgatttttctatttttgggacaatagacctgagtagggaaaagagtacaacattgggtttagagtgtaggttagctgaagtagaacttcagtcggtacgctccattgtcaaggttggctatgaccctgaagggaccttcccagttggggccaagctttcccgttcaggaatcttttctggcttcacctcggactcaccatacgagggccctgaggatgactctattacctatctctgcatgtccgttagtctgaggatgttcgatagagatgactatgtgctggatacctcgccttgtccggaagttttcataagtataagttttgaattgagtgccattatctgtgacaatgacgtatgggaggttgtacctgtagatgagtcgatgacaacttgtaagtatttaactacaccttgggcctttggcaatggtcccaatatgtccattccccacatggcaaagggccaaggggaactcaaactgttaagattgtcaggaggactggctggcacgtttgcaaactcttggcatcgtctacacctcctgggagcgtcctccagtatggagaccacagatcccttcatgaagttatctcatgacatagtctgcctgttggtatcgggtttcatcctcgtttggtggcagtacctcccggatcaggaagttcttgtagggggtcatctagtttggtttttgctcttctctagccatatcttcctcaacatctatggtgggagtttggagcgtctcctagatgatggtcttgaggtgcccaaccttcttgatgctggctag

SEQ ID NO: 76776 - DNA, 201 bp, Glycine max
  Peptide Sequence Number=SeqID_168461
atggaaggtggtgatgatgctagcaatgacgataatagtcaaggcaacaaagatatggtagtcaataatgataataacgatgatcatgatgacaaagaggtgatagtgacagcggtcgacgacagtgatgatgacgatgataattatggaggtagcaacaacaataacaatgatagtgatgatttatgtgagatagtctag

SEQ ID NO: 76777 - DNA, 348 bp, Glycine max
  Peptide Sequence Number=SeqID_168462
atggatgtgaagacaatatttcttcatgatgatctaaaggagaaaatttacatggagcatctggagggtttcagtaaatgtggaccaggtcgaatggtttttaagttgaagaagtctctgcgatatgagtattgtaacatccctgattttcaacttctcagtgactgtcacactacgacacttcacacggtggcacttcactcaaaatccttgttggtcaaaactcttcacaagactttgcaacgtgttttgtccttacttacacgctttctgggaaacttcccaaaaggtcacccatcccattactactccaagccaagcacgcttaactttggagttcttatgtaa

SEQ ID NO: 76778 - DNA, 252 bp, Glycine max
  Peptide Sequence Number=SeqID_168463
atggatgaagatgatgataatgatgttggaaatgatttggtatttgaagatgatgatgcactaaattgggcaactgtgtatgaggcttcggggggaaaaaagcaaccaacaagtgctggtattactcctactgctgctgctgcccacacatctaaaaaacaggcaatggttgttggatcttcatcaaggaagcaaaaagcagttcaagaaaatgatgaggatctagtgtttgaggatattgaacttatctga

SEQ ID NO: 76779 - DNA, 381 bp, Glycine max
  Peptide Sequence Number=SeqID_168464
atgtctgatgataacaccaaagcttggaatcagatattgttgctgacaattgtgcttgcaatttggtggctactgtgtcatttagcagaggatagagaaaccaatcccattgacaatgaggttgatgatgagctgggggagatattagagcaccccaatggtgaactagaccattattttgatgaggatggtcatcaccgggccgctgagcctggtggcgatgccaatgggagacacggtggttgttccatctgtggaaattttagcaccacaaggtgtgctagctgcaaggctgctagatactgggggtctcttctgtatgtgggtgccgccattgacactgacgggaagcttgaaccgccagtgacaatggcgggatag

SEQ ID NO: 76780 - DNA, 489 bp, Glycine max
  Peptide Sequence Number=SeqID_168465
atggtggactacttgtatccacgttattgctacatatcacagtttgaatcctgggaaaacattgaattccacaaaaatcaacttgttaacaatgattttgtagttctgttgctagatcactatggcgtgttgaaaatagaatccaacggcagtgaacatgtcatcctttactcttcacctcaaccagcaaacaacaacactatggccaccctgtgggataccagcaactttgtgctgcaacaacttcacccgaatggaacaaagagtatgttgtggcaaagttttgattatcctggtgatgatttgctccctaggatgaagttaggtgtcaatttcaaaactgttcgaaattggtctatagtttcgtggatgggttctcttaaccctagtcttgggacattcaggatggaattgggaacacagaagaagagaattggtcatcaagcaacaaagacaatagtgttggacaagtggagagctaaaaaataa

SEQ ID NO: 76781 - DNA, 1548 bp, Glycine max
  Peptide Sequence Number=SeqID_168466
atgaatggaagaacactcttgagaaccgtcatccccaaaccacaacaacaccaccaccattgtcgtggtttctcaacatacgacataggaacatgcatttccaccctccaatcatgtgcgcacaatgcaaacctctccaaaggcaaggaacttcacacccacttgctcaaaaacgcgttcttcaaatcccccatcgccatcaccaacctcatcaacatgtactccaagtgctccctcatcaaccattccctcagagtcttcaacttccccacccatcacaacaaaaacatctttgcctacaacgcgctcatcgctggcttccttgcaaacgcgtttccccaacgtgcccttgctctgtataaccaaatgaggcatctaggtattgctcttgacaagttcactttcccgtgtgtcatcagagcctgtggtgatgatgatgatggtgtcatggttatgaagattcatggcttgttatttaagcttggcttggaattggatgtgtttgttggcagtgcgctggttaatacttacctgaaattcgggttagtgagggaggcgtaccgggtgtttgaggaattgcctgtgagagatgtggtgctttggaatgccatggttaatgggtttgtgcagattgggaggtttgaggaggctcttagggtgtttaggaggatggagggaaacagggtggttccttgtagatacacagttactgggtgtgttcgagatgatggacgagatatatatttttcatggaactcgatcatgtcggttcatgaacggtgtagtgatcattatggaactttgaggctttttgatagaatgatgaggagcaacagggttcagcctgatttggtcattgttacaacaatacttccggcttgtactcatctagcagcattgatgcatggtagagagatacatgggtatatggttgtaaatgggttggcaaaggaagaaagtcacgatgtttttgatgatgttctactgaacaatgctttgatggacatgtatgcaaaatgtgggaacataagagatgcgcgaatggtttttgttaatatgagagagaaggatgtggcatcatggaacatcatgatcactggttatcgaatgcatggttatggtggtgaggcattggatttttttctcgtatgtgtcaggctcaaatggtacctaatgaaatcagttttgttggattgctatctgcatgcagccatgctggcatggtctttgctagtagcctgtcgtctccacaacgacatagacttggccgaggttgctgctagtaaggtgattgaacttgagccataccattgtgaaaattatgtgttaatgccaaatgtttatggagttgttggtcgatatgaggaagtattggagtggaggtatacaatgaagcaacaaaatgtgaagaagagaccaggctgtagttggattgaacttcagttctgcaagagcatggctacgtcccctttatctagcatttggtctgcaaagaaagttaggcatgagttcatgacgacttatgttgttgggatggatatgtgttga

SEQ ID NO: 76782 - DNA, 746 bp, Glycine max
  Peptide Sequence Number=SeqID_168467
aggtggcaccgggagacgagtactttccatcttctagtggggaaggtattcatcacgttggacgacatcacgtctcttcttcatctgccgatcgttggcgacttccacgccttccagcctctgcacatcaacgaggcggtgttgatgttgacgtataccggcatagatgtcagacccaacactggacagctgcagctcgtgcttatcttctgcatcttctgggttacactctttttgctaataagagtgtaacccatgttcatgttgtacacttagacgccctgcgtgacctcactcaggctaggaggtatgcatggggaacaactggccttgtccatatgtacgatcaccttaatgatgccagtatcagcaccagccgacagcactttccgtctgttgcggagtgcaatgctgatccagactatgacgagacatcagatcctcctcgagatgaatctgggacacagcccagacatatccctcaagagccagcaccagcatcgacacatgcgaatactgatgcgaacgagcccagacatgcagtgtcctttacaagcaaagatccacaagggatgtaccctcccttgttctctttgaacaacctagtagatgtaccctccactagaactgatccacaagagatgtaccctttcttgttctcagtcacaacaacccaagtagatgtaccctctacttgtaccacaaaggatgtaccctccaatgtgttaagacaaagttctcaggcg

SEQ ID NO: 76783 - DNA, 615 bp, Glycine max
  Peptide Sequence Number=SeqID_168468
atgaggctaggattaggaagacaagtctgtcccacaaaatttggggatgaggttgctgttgaagtggagcgggacgaagatgaaggtggcatggttggagaaacatttacagattatcggccgccaaaagtatctattggacctccacacccagatcctgttgtggagacatcttctttgtctgcagtgcagcctcctgagccaacttatgatccaaaaattaaagatgatttggaaaattcaaaggctttgtcttgcttgcaaattgagacattggtctatgcttctcagagacacctccaacacctctcaaatggagctagggcagggttttttattggagatggagctggtgtaggtaaaggtcgaactattgcagggctgatttgggagaactggcatcactataggaggaaagcattgtggatttctgttggttcagacttgaagtttgatgctagaagagacttggatgatgttggtgcaacatgcattgaagttcatggggtagtagttttttcaaatatatcacatagaactgggattttagatgtgtacgtgggtggttcatggccagtgattcccaataagatcaacactgttagaatacaatga

SEQ ID NO: 76784 - DNA, 417 bp, Glycine max
  Peptide Sequence Number=SeqID_168469
atgtcgctttccttttgtaattcctcgtttcacgaaaccctaaaagcaaatccacaattgcaagcgtcgttgttctcagcactctctcccgcctcctttccccttccacctcctacctccacctctctcccctcacctcgcagctttacacaggaatcagccaagccccatggttcacctggaactccaccaccgccgccgaactcaccgccctcctccacagtctcggccgccactcccaatctgaatccctcattttcgacgccagttccaagttacagccatgccaatgtgacctcgttcttttctacggcaaactcatcgattcacactccaagcgaaactcccacaccgccttcgacgccgcttttggttacctccataaccttgttcgcacttcctcctcccttcacgtga

SEQ ID NO: 76785 - DNA, 849 bp, Glycine max
  Peptide Sequence Number=SeqID_168470
atggctgactctggcattgaatctactgactctgatgatgagtttcaaatatgtgaaatttgtactacagaggaggaaaggaaaaaattgctacagtgttcctgctgcagtaagttagtccattccacatgcctgatgccaccaattggtgatatagttcctgaagagtggtcatgccatttgtgtaaggagaaaacagatgaatatcttcaagctagacaggcctacatagctgaacttcaaaagaggtatgatgcagcctcggaacgcaagacaaaaatattagacataattcgtgctctggatcttccaaataatcctttggatgatattgttgaccagctaggaggccctgacaaagttgcagaaatgacaggaaggagaggcatgcttgtgagggcttctactggaaagggtgttacttatcaggctcgtaatacaaaagatgtcactatggaaatggttaacatgcatgaaaagcagctctttatggatggtaaaaagtttgttgctattatctctgaagctggatcagctggtgtatctttgcaggctgataggcgagctgcaaatcagaaaagacgggttcatttaacacttgaacttccatggagtgctgaccgggcaatccagcagtttggaagaactcatcgatcaaatcaagcttcagcaccagaatacaggttttataaattgatgctgaatgaacatattgtctgcaacaaaacaatatcgcaaaatgataccgattccgaacgaaatcacagtggggttaaaaatagccgaaaagccgcaacaaaatggtgttgcggcctcaacaagcattacaagaatccgatttcagtctag

SEQ ID NO: 76786 - DNA, 483 bp, Glycine max
  Peptide Sequence Number=SeqID_168471
gttgcaggatgtaccatctgtgggggagctcatgaatctggatgttgtatccctattgaagaacaacccactcatgaagttaattacatgggaaatcaaccaagaaacaattttaatgcgggaggattttctggattccaacatggtcagcaatacaatcaacaacaagggcaatggaggaaccaccctggaaatcaattcaatagagatcaaggtttctatgtccaaccagaagagcatagagtatgccataaagaatctggagatccaagtgggacaactaatacagagaaaattcccaaggaggagtgtaaagctgtgatgactagaagcagaagggcaatccatgtggatgaaagtgaagctgagaagaagatggaggaacataaacaacagctggcacctaagccagcacttgaacccgtttatgattttgcagaacttgaagagattaataaggaggctgaaaatgataaggaataa

SEQ ID NO: 76787 - DNA, 465 bp, Glycine max
  Peptide Sequence Number=SeqID_168472
atgacccctactcatgatgccctattatattacaacgagaggtggaacatgccacgccaaaatgagtttgtcgattactcgttcacaggaaaaaatccaaaaaagtttgacattcctttcgaatgtaccttcgatgaactgaaggatttgatcaagcaagttgcacctcatgggattcccccttatggtattcatgaatcacaaacgaaactatggttgatatgtgcatcgcctacgtcgagacctcacatacacattgtcgtctactatgacactcctagcaatcctgatgtagtcttccatgacctcgtgtgtctctgtgcctgcgatgactatcatgttccttatgtccgagctgcaaggtacattggtcagggtttcacgattaccctatctcacgcaaataggttgagcaaacgctccaacctttcagcgatcgcttggcaagtgtccaaagcaaaatag

SEQ ID NO: 76788 - DNA, 1107 bp, Glycine max
  Peptide Sequence Number=SeqID_168473
atggcggaaccatcgaagaagcggaaaggatcctcgagtcggagtcaacgacattccgggtcacaggaaacaccaattcctccctccattccctctggatcattgttttcatcagaggaacaacatatatgttacacaaacctcttttcatctcgttccattgtagacccaaaattcatagatatggagttcttttcaaatgagaattttgaatgcttccaagcatttgaaaactccaatcttattccattcatgtctctgaaattacctgtctattctgaattagtcaaagctttctattctaatttaaaaatccatgaaggtatcctaatgtctgaaatctatgggattaagatggtcattgaccaatccctattttatgatttaacaaaattgcctagtgaaggtgtgccttttgagggtgcactgattgatgattggaaattcgatttttttgtgcatgatgcctgccagttggtttgcaccaaccaagtggatatgaccgaaaggcttcttgccggttcattggcttttgagagccgcatcctccattaccttattgttcgcatcttactccctagatcttcaaaccttactcaggtttctgaagaatatctcattgtcatgtggacctttcataaaggtttacaaattgattgggcacaccttgttagatatcgcatgcataaggcattgcgattgaatgccccattgccttatcctcatcttgttacccttttccttcaacacttcaacatccctcttgattctgaaccttatgttccaatcaagagatcattccttataggcgcttcagtcatagcatcctttggttatataaaggagcatgatggctcttgggtgaagaagggtgctagaaatgttggtgaagaaggacatgaaggagaggattcatctcttctttcgaagattatggacaggtttgatggtcttcaaacctttgttggtgagaggtttgacactttagaattgcaagtggatatgcgcttcaatgaaatggagtcaagaatcacaaaggttgaagaagatgtatcttacattcgttcaagcttcgatcttccaccaccgccgccaccatcatcttaa

SEQ ID NO: 76789 - DNA, 303 bp, Glycine max
  Peptide Sequence Number=SeqID_168474
atgaatttatgcatgggtttcctgcaattcgatgtaaaaccaagatcttgtgccgcagtgacgacgcgatgtagtcgaagcagtggctgcattgcaactaagggtcgtgcagcagaccttaagcacggtcacgtgaggtcagatttagcggcggaggtgtcatattccacggtggaggggcgacagagggtggtggttgttgttgtggaggggtgcagcgcggaggatggtggtggttggggaggagaaaatggaatcaccctgctgagaaaggatggggatattttggtgaaaaatcattaa

SEQ ID NO: 76790 - DNA, 249 bp, Glycine max
  Peptide Sequence Number=SeqID_168475
atgagctcggacatggcttggaacctttggcagtgtgaaacaactgatcaaagttcttcgaggattgttgagggagaaaagggtgttgaggattggaggtggatgagggaggggttatggcttcgtccgacgagcaaatgggttgttggtgatccggtgtggcagatctggatagtggtggtgtttgggtcatggccacagcccgcatggctgggttgtgtgtgggagaaaaaatctgagaaagtttga

SEQ ID NO: 76791 - DNA, 672 bp, Glycine max
  Peptide Sequence Number=SeqID_168476
atggcattaggggtcatggcagctcgcccaagcgagctgttgcttcaacctgaagtaaccctgctcgccaggcgagctgattacttcaccttaagctatttgggggcccaggcgagccagaggctagcctcggcgagccaagcaatccttcaagaactcagaagaaagcaaaaacttccaagaggaagcaaggcgaatgctctcaggctactctcaacagtagaaatgatcattgatgttgctgcgtggaaggaagtagtcaatttggacatgggtggagtccgcaagtgcgatgaaatagatgatgtgtacaacaagatgcaaacatacagggaaatgtatcttgacccaacaaggaacttgaggaatttcttaggagttggtggactgactgtagaagacagaataatagtctacctcattacctacattctcactccgaggtcctacaatatgctgaagagtcatcgtatggtagattatgaatttccttatgctatatttgccttaagattcattgactatgtcaatgtcaatgtctccaatgagattgtggaatttaccaaagcatataagccaatagctggaaattttgaacagatggatgaagatcctgaagccgaagatccacaagagcctgcacatcaatggagtcctttgagtcacttatga

SEQ ID NO: 76792 - DNA, 1191 bp, Glycine max
  Peptide Sequence Number=SeqID_168477
atggttccttctcaaaacgggaagcaacaacagaacaacattaataggagtggtgattatgttatttacggtaacacaacaacgaatagtgcgatgaaccaagttgaaggaggctacaattgcttgttaggagctgatatagtggtgaggaggcacatcatggccgaggctgaagaatcatcgagacacaacaaccctaacgaggaagatgaagttggaggttgtggttcaacctcaaaggaagaagaagaagaagaaggagcacacaacaacaacaacaaaaacaataactggcttcaattaagcataggtttgacaagcacaaagcaagagcgtgataatcgaaccgctgttccaacaacaaccggttcagggcttgttgagttagacttgcttccttcacggcggagctcagagcagcagccatcaccggcgatttttccgggggtggcttcagggagaggaggagggtctagttttggtggttcttcttcatctcgtttgctttttgagcagcatcgcccaacgacttcgtattcttcttcttcttcttcttcttcctcttccatgtcgtcgtcgatgatgtctatggcaagtggtccaattacatcatcaacctttggtcatcacgagatgatgaaccgggcatttggtccactacttcctcattcaatgcctattatgccctcttcttcttctttcactcctcttcctattccttcttcttcttcctcttcacaaacttgttactcttctttgaggcctcatcccttaggatcttactttcccacagtaccctttcatcacttcccttcttctacttcctcttccgggtttgatcaatatgacgtggcagcagctggggctggaccaagctccgataatgtcaccgttcgggttgttgatcctcctagaagacctcattctggaatatggtttatgttactagtctctccaaatcaagcgagagaaccattcttgtcacaaatacctaagaactaccttagaattaaggatggaaggatgacagttcggttgctattgaagtatctggttagcaaactcagactggaaagcgaatcagagagagatgaagaaaatgaacataggggattacataggagtgtccgaaaaggaaatggaactacgttctcatcaaaagtaccaaagtacattaaaatagaaacctag

SEQ ID NO: 76793 - DNA, 1242 bp, Glycine max
  Peptide Sequence Number=SeqID_168478
atggttagaatacgaggtttgggtcgagctttaggaaggattatcagaagagccctcgggagagaagtcaactgtgatgtagatgatgctcctcagcggcgaaggcccacagcatccgcacgtaggcaatgggaagttgcacttgttgctgaggatgttgacaatatggatcatgccgataaggaaggttttctaggcaaaccccacgacacattagtgttgcaagactatgtttatcatgtggccgtgaaagtttggagtggagaggtcgagaagtttcgcaggcctgcccctgagatcgaaggcttagtggctgccattggattaagtcctatgatcacatgttcgttggacattggtgatcggggacttatgtctgctttcattgagaggtggcataaggaaaccagtagtttccatctgccaattggagagtctcttcatgtggacgatgccatcttgctgctagtggaattgcttgaatggacacccgcagctcgtgcatatttgttgcacctttttggttgcacactctttgctaacaagagtgcgacacacattcatgtcgtattcttggacgcattgatggacctaacgcagattggaagctatacatggggagctactacactggtgcatatgtatgacagtctgaatgatgcatcaaagagcatgactagacaacttgtaggatacatcacacttttacagtctgggaaggcatcaccaatatcgatatatcgtaggcggttggatagattgacgtctgatgttgtatgttggattccatatggtgactaccgtgcctccagagagtttgagaccattcctccacaccttgctactacttttctctgtataaaagacattgatgatagatggattcaattttctaaatacactgcaccgattggtcagatatgtgtagcgcttggacagccccctgtgcagcagcatgacacatttaaggaaccacatgttgctcaacatccaatggcgacaatgggtatgaatgaagcagctgaagatgcatatgctggtgtagagcgacctcgacatgctgtggaggcttgtcaagcaatgggcaaaaggttggagcgattgctcaacctaaggaaagtcactaaaggcacaaagacatacaatgtgatggaggactgtctgcggatcgctagaggtgtgactgtggatcacaatgtatatgtacggtcgcgacgaaggcgtcacactgaagatgcgtga

SEQ ID NO: 76794 - DNA, 240 bp, Glycine max
  Peptide Sequence Number=SeqID_168479
atgagctcacccctcctaagccttcttattttgatgcagatcccagagccatccccagcacccatacctgatgatgccataccatctgcaccaacacctgagttagagcaacctatctctcaggattcaccagctgctcaggtgttggacctgaatgagcatgcacagggcaaccacatgagcaggacattaaaatttgtgcatcttgaacattttagtttattttcagttattttatga

SEQ ID NO: 76795 - DNA, 162 bp, Glycine max
  Peptide Sequence Number=SeqID_168480
atggctgccaatgagaaaagggggacaggatgggatttgatgaaagaaggaagagaaggagcggagaaatcggttcaaagagggaaatgcttaacagaaagcacagttggcaaaaggagattgggaggagaaaattggagagtcgtaagaggggatggatga

SEQ ID NO: 76796 - DNA, 339 bp, Glycine max
  Peptide Sequence Number=SeqID_168481
atggacgagaatgtggaattggatgcttgggagattgagtacgttagttacggtggggagcaacacctccctctcgtaatgaaccttgttgatcaagaactcagcgaaccttactccatcttcacgtaccgttacttcgtctatctctggcctcagctttctttcctggtgcttcctcaactttttcactttcagatggtatgtaagatggggaacaccgtaacactttcagaggctacattgtcatgctggttgtcatcaagccctacagaggaagaggcattggttgtgaagaggtatgtatgtgcagtgttctgtagtttaagcatgtggaaatga

SEQ ID NO: 76797 - DNA, 153 bp, Glycine max
  Peptide Sequence Number=SeqID_168482
atgtttgcttacagtcctttcactaagcgcaagactcgcgctaagcacatctttggtcatgcgctgagcggcgagcctttagcgcttagcgctcaacccttgcatctcaggctgatttggtccgctaagctaaccaaggctgagctaagctga

SEQ ID NO: 76798 - DNA, 327 bp, Glycine max
  Peptide Sequence Number=SeqID_168483
atgacggggaagtacgaatgcacgctctcagcgagtcgtttgtcaccttcaaggcttagtgcgagtttggcgctgagcaaaaattcacttactcgcgctaagcgcgagaatggcgctaagcatgacatcaagctcatcagttgggctaagcgcgcatccaccgctaagcgcagctttagcgcacttagcgcaatagaagaatctggcagagcatcaatatcaaggctgcgcgctaagcgtgagatcagtgcgctaagtgtagcaggtgtcttcaacctgtctcaacgcacgattggcgctaagctcaaatccacttactcgcgctaa

SEQ ID NO: 76799 - DNA, 339 bp, Glycine max
  Peptide Sequence Number=SeqID_168484
atggacgaagagcagtggatgtataatagtatgatgtctgaagaagttgatagtaatgttgaaaatgagaaagatgttggcatcaaattgtttgctagtcgtgatgaagttttagaatgggctcgatcattggctcatgacattgggtttgttgccattataatgaggtcaaacattgatactggtgttcgagaaagaacctcatttttgttgatatgttgtgaaaggagtggtgagtataggcctaagaaacataatttgctaaaaacatgcactggcagtaggaaatgtggatgtccgtttaagttgcgtgtgaagacaattttgagaggagaatga

SEQ ID NO: 76800 - DNA, 624 bp, Glycine max
  Peptide Sequence Number=SeqID_168485
atgggtagggttagtgaggatgttgctgagatgagtgcggacgtacctgcacctggtgcaaagggcttagctggcgatggtgccgagggattagctgttgatgatgctgagggattcccaggtgggccacatgacccatcagtgctgacttcttttgctgagcatgttgcacatagcatatggagtggagatgaacgtcctgaattgaagttggtctcccacggaaagaaggttgagaaatttgggaggccagcgtctaagattgaagggctagtcgctaccacaggattaactcctttgatcgcatgttcagtagtcatcggcgatccggaagttatatccgcttttgtcgagaggtggcacagggagactagtagcttccatcttttagtaggagagctgaccatcacactggatgatgtggctttactcctccatctgcagatcataggcgccttccacatcttcgagcctctacttatggacgacgcgatcatcatgttggtggagttgcttgaggtctcgggtgaggaggctagagctgagacctttcggtgtcatggggcatatgtacgcctgtcgtggctatgggatatctatcagacaagatgcgaggcccgatag

SEQ ID NO: 76801 - DNA, 396 bp, Glycine max
  Peptide Sequence Number=SeqID_168486
atggaggtgtatttagtaaaaaagggtgtgcaaatagcaatcagacccacttgggccttccaggatgttccaacagaaggcggcgccttctggtggaagcaacccagctcgcctgggcgagctggaaaggagggcagaacaaattcgttcaaccctcctgaaaatccaagccgaggcgcttccgtaacgcttccgagatgtttccgtgggcgatttcgcgaaggttttccaccattcttcatcgttcttcgttcgttctacgtcgttcttcggtcttcaaccgttctcaaagaactacgtaggtctgatttccttatcacaaatgaggaatacgtaggagcaagggaaacacccttgtcgaccacaaaaagatttaaaaaatacaaaaaggcgtaa

SEQ ID NO: 76802 - DNA, 594 bp, Glycine max
  Peptide Sequence Number=SeqID_168487
ctccctcctcccccacctttttggcttctttcttttcttcttctgctccttcttcttccccgcgccttcctactgccatttctgaccaaccgtcgttgctgcgtttttgccatcgagacgttgtcggaaaaaatggggaaaaagcggacttggaatgtttggttcgtccagaagaaccttctttcggaaactttccggaagaaccacttcttccgagagttccggaagaagttgttccagaagtttctccggaagaaggttcttccagaaactttctggaagaaattgtcccggaaactttccggaagaaggttcttatggatgaccatttggttcttctgaaagaaccttccggaacaacttcttctggaagtttctctagaagaagtggtagggttataagcagagatagacaggatgagcatgatgcagttgatgttccccagaggcataggcctattgcatcagcccgtaggcaacaggttcatcagatgactgaggatgttcctcacatgactgaggatctccctcatatggctgaggatgcacctgagatgactgcggacgtacaggcgactgttgcagaggacttag

SEQ ID NO: 76803 - DNA, 264 bp, Glycine max
  Peptide Sequence Number=SeqID_168488
atggtgtcagtgcttccggatttagcagctcatccagttgtttgcttttcttctcctccatcaacttattttctagacattcataacccccacgagataacacgatccacatggactaggggtctctctaccccaactggtctagtaaccaatgatctcaggcatgtgacttttcttgtccgcttcaaggtagaaggggaatgtgatgctgcatcagtaggaggaggaggaggagagttgggtggtgtagtaattttccggtaa

SEQ ID NO: 76804 - DNA, 346 bp, Glycine max
  Peptide Sequence Number=SeqID_168489
atgactaggggaaatcctggtgatttacaaccttttgatcctgaaatagatagaacctttcatagattacttaggcatagtgtgcatcctgatcattctgtgcattttaagcattctgagtattttgttgctggtgattctgaacattctgattttgagtattcgactactaactttcatactgagaacatggctcaacctccacctcgtgagaggactcttagggagatggctgcacctgatttcacttatgaaagcttgtgcattcaatatcttgatgagggtgttccatatgttctcaagactggactaatacatttgctgcccaagtttcatggtcttgcag

SEQ ID NO: 76805 - DNA, 207 bp, Glycine max
  Peptide Sequence Number=SeqID_168490
atgcgaggtctagccaagaatgttgtggccaccatagtcgaggcaatgccatgccactccaccatggcacttggcaaaaactcaaccatgcgaaaaaaatacctactcacagagaggcagagtcgcgaagacggagctcatacggagaagaggcagagccgcgaagacaaagttgagtcgaagaagaagagagcgcgaggaaaatag

SEQ ID NO: 76806 - DNA, 225 bp, Glycine max
  Peptide Sequence Number=SeqID_168491
atgtctacagccttcaaaacctttacgaaatctacaatccctcctttgcgtctccctcttctcttgccatggctagaacaccgagtcatgatggttcttgaagccacggactcaccggcgtgctacttccgtagtgctgccaccgctatgaactcgatcattgatggtctaggagtcttactgcgaacaaggggaaactcaaatcacaaaaacacggccgaatag

SEQ ID NO: 76807 - DNA, 525 bp, Glycine max
  Peptide Sequence Number=SeqID_168492
atggactatatatatggaactatcaaatggatcctgatattgatcgtcgaatatcagagcatgtccttcgtatgcattgatttggttctgctgttgatggaggtgaggcaacacttgatgggagctcaagatatggaagagaaaatgaagctgatatggactcatttactcgatcccacaaaatttttagggaacattgtggttgaacatgattatgctgagtgcactggatcttctattcaagctttagttttgtttaagaagctatatccaaggcatagggagatagagataaagaattccattgccaatgcagttcatggtatggaagttagggagtttgctacatttatgtcacttggtttgcacttcgtggtcttgcagcggcgggtaaaacttacactaattgtgctgccattcgcaaagctattaaatttctactttcaacatagaaacatgatggtgggtggggagaaagctatctttcatgcccaaaacaggtttgtaattgaatggtcatggtaa

SEQ ID NO: 76808 - DNA, 240 bp, Glycine max
  Peptide Sequence Number=SeqID_168493
atggagtcggtgtcgcgtgctaatttctttccattcgaaagattttggctaccgtttcagtcatttttaataaaaacacggtgcccgtatgggctattcttatatcctgagaattctgctcctggtcaactcccaagaacagtggatgtaattgcagaagacgaccttgttgacttttgcaagcctggagatcgagtggaaattgtggggatatataaggctcttgcaaggaaaaggtag

SEQ ID NO: 76809 - DNA, 882 bp, Glycine max
  Peptide Sequence Number=SeqID_168494
atgttgaagggcctcacaaaaggagtcacaaagatctcaaagattatctccccagactcactctcttatccttccaaactcatctcctcaaacccacttcaagaggtttctaagattatctctaacactgtctcggatgttacttcagacactctttcagatacttcaaacattatcttagacgtctccaaaatcatctcttcagacccactctcaagtgcttctaacatgattatctcctcatgggctatctcaaatgcttccaaattcaactcttcaaacccactctcaggtgcaccaaagaccaatccctccgacacactttcagattatgcttccaagatcatctcaaactcactcccaaatgcttctaaaatcaactcctcaaacccactccaaattgcttccaacatcactgacactgtctcagatgtcaccaataccatcacttcaaacacttctgatatcgtcacaaacacactctcagaaacttccaacatcgtctctgactcactcacaggtgcttccaaattaatcaaccccttaaactcactccgaaatatctcatatgtttccaaaaccgtcgcctcaaagacttctgatatcgtctcaaacgctctctcagaaactgctgacaccatctcagacgtctccaacatcatcatctcctcatcaaactcactctcaggtggtactgcttcctcctcctcaaaccctctccaaattgcttctgataacatctcagacaccgtgtcaggaatttccaacactatcgaagatgtcgccaacatcttcgtcccaaacccacttcagattgcttcaaagatcgtcacttccaagataactggtaatgctggcaataaatccaaaatcagtacctaa

SEQ ID NO: 76810 - DNA, 228 bp, Glycine max
  Peptide Sequence Number=SeqID_168495
atgaagtatggaagaccagactctgagttcatgaagtggaagtggaagccaaacggatgtgacctacctgtgttcaaccccttccaattcctagagattatgaggggaaaatccatggcatttgttggtgactcagttggcagaaatcagatgcagtccatgatttgccttttatcaaggactcaggaaattctaaataaattcgggaatttaccaacgagtcaataa

SEQ ID NO: 76811 - DNA, 552 bp, Glycine max
  Peptide Sequence Number=SeqID_168496
atggcaaagtatgtcactttggttcaagtttctagagaaatctgcgaagctgcctaccgtgatcaaaaggagtatgacaaaatgttgcatttcctatcaaatgagcttagaaggataaagtccaagaaaaacaagcaaccatgtttaaatgagaatgataaccaacaggctgataattatgatagtattttagaccttgttgttgttcgaactaaaggatgcaaacaagttggaatagatgaatctggcaaggaatgggaagaatcaaaagaattctcagattgtgtcgttttgaattctttgacaaaggagaagggagacacaaaagaattcaggcggttagtccttcgttcttttggaaaagggagaagagagacacaaaaagaattcaggcggttagtccttggcgaattctttttggcaaagggagaagagaatgaaaagatgaatagcacaagttttcaaggtttggaaaaccagaaaacttcagaaagcttttggtacaaagaagaagaagaagttcaaagagatttagggcttgtaaaagattga

SEQ ID NO: 76812 - DNA, 1436 bp, Glycine max
  Peptide Sequence Number=SeqID_168497
atgacatcctacactttacagaaacaacacggtttcaaaaccaatttaggggatctccatgacctactcttcaagttttacatggtgttgggcatcgattatgaacatgatcaaacatacatggattgtgacatgctcgagagtgatgacagagggaatggagacaatgaggctgaaaaatcagttgggattaagggtgaagctaggaaagaacattttttagaggtaccattgccaaccaatatgggttcactcagggtggaaaaggataaagtggtggttggggatatctctggtggggcaaccctggatgatatggtggctgcaataaagcatttggggcaaaaaatggaaaacatggataatcataacaaaaggagacttgatgccatggaaaagactaacacaataatgctgaaggccatgtgcaacttggttaaacaagattacaatcagtcagccaaagatgttgtcaaggatgtggcaatgagtgggactcacaatacctccacctatgatgaaacattacgttgtagaaatcctaataaggcgatatccaaggcgactgtaaggtgtagaagaaagaaagcatatgggaaatgtaaagcatatttcaaaaatatagaaaccatcttcatcccaggggacgatgatgatgactttccaatgccgaaacataatgttgtgaaggcaaaattccaggccattatgagcaactatattagaggagtggaagcaaagcccgaaagcaataaagaaacctcaatggcgcctagaaagttgtcgttcccccatcataactctgttagtcagacctcgaagaagccaaaaattgagaagcaaccacatattttgaatgtgccaaaattccaatacaccaaaggcacttccttgggcaacatgagcaaggcaagccgaatctttcaaaggcctcagactaattctaatatgccctatagcttcaaaccaattattgacatgaatcttacttttgaggagacacaagtttatgcatatgtcttcaatccaaatgtggacccgagtgggaacgaaattttgtatggggtaggaaacaacttggggacacgacaaaactttcagtcgttgtgtcctaataagccaataagggaggagctgtatggttctttcatccctaagtatcctattgttgcttatagcaaactctaccacacaaggagtgtttggtgtatgcccccagcttatgcgttggacgtaattgatggaaccctagtggaaactctcattaagcattatgggaaggattggatgccttcgttttcaaacttaaagctgggtcatgtcatgctcaatgttctccaaattgtgtttgaaacacaagatttgctttttggatttgatggaatggatagttgggatattgtggaagccagaggaatccctaatcatggatccat

SEQ ID NO: 76813 - DNA, 546 bp, Glycine max
  Peptide Sequence Number=SeqID_168498
atgcagttagagctagtgcttgagctagagtgtggagtaggcaaatggtacccaaatgtggcacggggtgtcgaccactttattgagtacctcagattcatgatgatgtccttagttaagcttgtagaggcaccagtcctatactattgtaatactgttatgccaccttatggagatcatagagatttcctcttctttgtcgtcatcattttcattcgacacaccaaactatgcactaggtatgagcaagggccaccatacgccgaggaagactctcctcattatgtgctagggccaccatacactggggatgacttagagcacactgtggcaacccctcttgttccaataccaaatgtgagggacgacaacattgaggaggatccagagatgatggaggagtatcgatcaaaggtggcagaggagcctagtgatctagtgatcaggatgatgggggagcttccccaaggaggagtcgagtggctcataggggagagtagtgaggaggaggatcccgacaaagatatgtacgacgcttcctcctaa

SEQ ID NO: 76814 - DNA, 372 bp, Glycine max
  Peptide Sequence Number=SeqID_168499
atgagggcaagagtgatttcgaaaatctgcacttctatgcagaattttgctgttaaaaaaatgcttaggcatgactgtctgtggaaagggttgtacatattgggttctggaagttttctagaggagggcacgagctggtccaaggaagtgggggagctggaagatgccaacggtctaggagggggaggagcaactaggggtgcctctgctggagccctacgggaccccgaaaaagtgataaagggatcatcgaggctaagggactcgaaggtgagagagtcaaagacaaccccatgggccttacaaagagttgtgatcagagccgaaaagcccaacctggaggagttggattgggctatcagagaaatctaa

SEQ ID NO: 76815 - DNA, 372 bp, Glycine max
  Peptide Sequence Number=SeqID_168500
atgaaggtaggcttagcggtcgaaaccaagctagagaatcacagttcccatgaagacaacaacaaaactacaaagcctagaggaaaagatgtggaagagaaatgcacgaaggtgaggtggtgtaggatagaaagaaagaaatggagggaatggggaaacaagagtgaagttggcagaatggtgagggttgggggtttagggcagtttatgaaacttcctgcagttatggattgtgcgcttaccacggccatgcgcttagtgcgtagtctgacaacagtaatggcattaaagtaccaaacgcttagcgaaggcatctcgcttagtgacctgaggacgaagtcctttggtcttccccccaacgtattattataa

SEQ ID NO: 76816 - DNA, 477 bp, Glycine max
  Peptide Sequence Number=SeqID_168501
atgactccacaggtctcacctgcgaccacgccagttttggaggtctttgaggatgaagaaggcgccgaggacacagactatgcaacagatttacaggcggcacagagtacttgggatccctggcttacagctgcacaggagacacctcagccagctcaggatactccttctccacctcatggcgagcaaacatcaccacaggaggagcttgctgctgatgtctcactaagcaaggcttgtgtgcttagcgagaatcatgcgctaagtgaggcactcatcccgcttagtgagttaggagaatctcaaggagaatttgagaagcttctgcgtgctcagcgtgtcattagctcattcagcgaggagtttgtctcttctcgcgctaagaagggaccagtcactagagccatgagcaagaggctccaagtggattgggctagagttgctgaagaaggccctagggttctcatgaaccttagg

SEQ ID NO: 76817 - DNA, 332 bp, Glycine max
  Peptide Sequence Number=SeqID_168502
atggcgtcttctccaccaccttctccgttttcgcgaccgcattctcaatcactctcagcacaagccgacactgacaacctcctcgtcgtcgacattttctccaaacctgcggattccgaggacttcaaaaccctcctcgattcgaatcgcgttatgattacccacgacgcggtcctcgcagttctgtggaagctagattccaacgtcgaggcggcgcggaggttcttcctttgggtttcggagaaccaccccgagaggttgagctccaagtgctacaactcgatgctgcgcgttttggggaccaatggtgttgttcacgagttttggacttg

SEQ ID NO: 76818 - DNA, 564 bp, Glycine max
  Peptide Sequence Number=SeqID_168503
atggagccacaacatgtgactgatcagaatatagaaactcaaaaatcatcaacaaaggggctagctgataaggtggcagttataactggtggtgcaagaggaattggggcagctgcagctaaactgtttgctgaaattggagcacatgtggtaattgctgatgtgcttgatgatctaggtaccacaatggctgaatccattggtggccgctacatacactgcaatgtgtcgaaggaagatgatgttgaatcagccataaaccttgcactatcatggaagggcaatctagacatcatgctcagcaatgcaggaattgaaggccctaagggaagcgtcacaacccttgacatggaccaagtgaggcacttgttctccatcaaccttcatggaatcaatcatgctgcaagggcaatgatcaaagagcattggattcgtgttaactgcatttccccacatggggtcccctctgagatgcttctaagtgcttgtagaaggtttgctcatggtcatattaaccctcaagggttgaaggaactgattgggagcagggcaattttgctttag

SEQ ID NO: 76819 - DNA, 785 bp, Glycine max
  Peptide Sequence Number=SeqID_168504
atgcctgaagtaaatgagcttgcgtattttttcctcacacactcagctgacgtcccccgtcactcactagccgtggaacgtggtgggatgccatcgtcatctcctcctggtccacgcgccacccacgaggcgaccagtcgtgtggcgacacgagtcaaagctcaccgttctgaagtcctcgacgggccgcgagatcgaggcccgctacgagctgggccgcgagcgggcgtagaagaggaggaggcgggcgatgctggagtggtcgtggagttcgccaatggctttgggaaacacgtggttgtcgaggcttttttcctaggagaggcattgggttttcgtgaagcggcaggcgtagctggcggcgcccgagtggaacttcacaacatggaccatgtcatccctgtcgaagaagtggtgccccacgacgggctcatagagtgggttcgcgccgttgcagatgtagacgcattcgatgcatttggggatttttccgatcaccgggaggaattgatgcgccaggtgctccggcacgggggtgaagttgccagtgatttggacacgcaggtcggcgattttggggagtggggagaagcgattactggtttggtttctcttgctggggtggtggtggtggtggttgttgttgtggttgtggaggaggaattgattgcaaatgaatcatctgacaagcaagtagtaggtgaaactagtgtccaaattaactattctgatggagatggattatctgaactagagaaactattaaagcagaagactttcaccag

SEQ ID NO: 76820 - DNA, 729 bp, Glycine max
  Peptide Sequence Number=SeqID_168505
atgatgttgttagtaatccattgttgttttcgggatgggaggaggctaaaagatatttggatgtggatgcttacgttcaaggatgttgtttttgggattgttgtggagggaacctttgttgagggaataaaggaagaggttgtactctcccctacgcatgctctgtcccttatagctgccggagaaggatgcactgatgttcttatggtaattgctaaattaacagatggaaaggaaactcatattccttatcgagattcaaagctcactcgattgttacaatcatcccttagtggccatggacgaatttctattatggatgagaaatctctgatcaagaagtatcagaaggaaatttctgagttaaagcaggagttgcagcagttgaagcgtggcatggttgagaatcccaatatggccacatcttcacaagaagatctgattactttgaagcttcagggttgtgctgatgcatatatcttggattatctaataagtgtcactcttgaagctgtgcaatccaaattgaagtcaagattgcaagaggaggaacaagctaaagcagcattgatgagaagaattcaacgactaaccaaattaatcttagtttctacaaagaatgcaatgtcatcaagcattgcagaaaggcccagtcatagacgaaggcattcttttggggaagatgagatacaaatttccaatttcttcgaatggccaataaaattgtaa

SEQ ID NO: 76821 - DNA, 294 bp, Glycine max
  Peptide Sequence Number=SeqID_168506
atgtcagtgaaaaatctcgtcgagcgcctaggagtacatgacaagacagaccacatattggtaagtcaggtcactctcactaggtttccaagcgttaaagataaggaaaagggactggagcttcaatttcactatcttcgtgtgaagatcatttctctctctacaaacactatttcacaaattccaatggttcgggtgtgcgagaaaaagagaggattttggggagatgaagtagggaaaacgaatttgagaggaaaagagagtgcagagacacatcgtaaatgtaaaaactaa

SEQ ID NO: 76822 - DNA, 75 bp, Glycine max
  Peptide Sequence Number=SeqID_168507
atggtccgatcaccatacttgaagattgtatcagcaatggtgagccatgatctcttcagcaatggtgacccataa

SEQ ID NO: 76823 - DNA, 216 bp, Glycine max
  Peptide Sequence Number=SeqID_168508
atgtgtcgatgctattcactttacaatctactttgcacgtctacgagaactcctttggtttactgccacacgaatcaatgtgacaagaatatgaacaagatcagtggggtcctgatccaaggagaaagaggactacaaagggttgtcctgtttcaactcgcatttctactgagatggacgaaaaagaaaatgaacgaaagagtagaaaaaatgtga

SEQ ID NO: 76824 - DNA, 1407 bp, Glycine max
  Peptide Sequence Number=SeqID_168509
atgggtgatgcaacgtgggggaggcaacttgtgttaatggataatcattttggacaaaatatgcttacatcaggtggacacaggcaggtcttctactgtgtcgaaggatttattgtactgaagggtattctgcttgtagttccttaccaaagttatcaggtgcgtgagtattcagcaaagcaaatagggactacttgcaaaagatacttcaacgctcaactgttgcccaatgtggctgaaaaggtggctaagagtgttagggctccagtggtggccaccactaccgaggcagggacatctgagaaggctgcttctcggcctaagaggctcccaatgttgaaggagaggtgtctgcttcctttcatcatgtttccagagtatatgcgggttgacaaagaggtaggcacctacttctcccgctacaaccacaaatcgtacttcaccaacctcattagttggctaccaatcaacaccataacggacttggagacgtatctggtcactgtccacacaattcagttagacgccacaccgctcgcagagttcgtgttcatgaaccgaggggatgaacaaggacttctttcacatgaccatttctacgatttggtagggaaccatttgttccccttctactggcagcagtgtcctcaacgatatgacaagtacccaaacaagcatctaagtgttgacgaaagtcgagacctcgaattcctcgagtcgctccctcgacaacttcctgctaggcgaaaccgaatcgctactactggtggtcaatcgcctcatgctaccactaaccagacatcgaggccccgcgaggaccattggagtggctcaagggaacactctggacaccgggaaggcatctccttggagaagaggcttaaaaatgattttggagcagggtcaccaagtattgagcaaaggcgacgatgcagccaactgggccaattttggcccttcctttctagggtgtcggcggtcgctcaacaccttcaggggtcattcaatgttgaagccttgaaggaccagctactgaaggatcgggtgcttggtttgtcaaatgatgccaaagggttagagacacatgccttgaatgtcgaggccctaactaggtctcaagatactgaaattgttaggctgaggtcggccttggctaatgccaacaaagaaatggaggagaataatgttgaaaaggaaaggattcaacataaggtgctgcacatgtgcaacgtcttgaaccctagtgtcttcgacatcaacaaggatgtgcatgaaagggagctaatgttgattgatgacatcccggaggatgatgtcacccattcacctcaaaggccgacgaccctcgctgaggagctacatgccaaggaaaccgagggtagagagaatgtagagcccagggactaa

SEQ ID NO: 76825 - DNA, 285 bp, Glycine max
  Peptide Sequence Number=SeqID_168510
atgttgtacgcagccttacccttgcatatgcaaagaggctgtttccggattcgaacccatgaccaacaagtcaccaaggcacaactttaccgctgcaccaggactcgccctctaaaacttcgtaccccattgcccagaggctcttcgctatgcgaaggtatgggggagggatattgtacgcagccttacccttgcatatgcaaagaggctgtttccggattcgaacctatgaccaacaagtcaccaaggcacaactttaccgctgcaccagggctcgccctctaa

SEQ ID NO: 76826 - DNA, 1818 bp, Glycine max
  Peptide Sequence Number=SeqID_168511
atggtggtggtggttttgctcgcgccgcgtgctctcttcttcaaactcgatcactacgtgtatgtgtgtttgcgcattttcgataacgaaggttttgaaattggaacatcatcttgtcccaaatggggtgatgtccaccttctcaatgaagagagtacgagggaacttgatacttataatgtggagagtgagctacgggtccttgttgatatgggttgttacggtgatgtaacaacccttgtagataattaccgatttgtagataatagccaaggttgtccattgtcaaacgagattgtcccatgtcgagggagattgtttgaagtcgtgggtagtagcctcgacaacttgtcaagccctcgagcttggacaagtgttattcatgatgcttctgtcaaattgctctgggtggacatgcttttggttttgcaagcgagttctgacattactcttccatacaagtcgctcgtggagtgggcacgtactagagatgtggatacttgccacggtgtctctaagagcgaatccttttcctcggagaggttgagggtttctcgtcgtactggtggagacacttcttgcctccgcaggagggcgcaaccttcccatgcttccccggctggggaccttatcccgatcactatgattctcccccattttacttttgggggagtagaaaagagtggtggcggggatgtgagggacgacatcctgaaatacaagtcctccatcacctttgtggtgagcgttgctgcattgcaatgccaagcggtgttgggcaacccgcccttcttttttatgtacaagtgtctgtttgaggtcttgggtcttgtccttcccttaaccgcctttcagtgtgctcttcttgagcacttgaacgtgacaccttcacaactccacccaaacagttgggccatggtgagggcctttaagattttgtgcctcttcttcaacatccgacccagatctattgacccttatggagagggtcgacaaagctattttgaagtagttgccgacctctttggacgtgcgggaattatgggtgactttccttggaggccacttgtgaaacaagttggacctcttggtgggactgtgtcactgtctgctattgctattgctgctggagaaaggagtcaacttgctattgaggttggccttgttgctggtgttgctgaggatggcgacgctgggatgtcgagccgtaagaagttgagagctctttttagccttcatgccctgagacaagctgcttttgctttcgctgttgttgttgttgttactcctactcctccacctcctcttgttgtgcttgttcaggaggccactcctactactgaagttgatgcgccagctgctttggctagtcctattgtgtctccttcgttcaccgtcgctacatccttgctgagtgtcggtgtggtgaccatgagtgctcctatgatgccgcctcctttttctttaactccactgtgttggcatcggcttccacctcttttcaccccctatgctggggtcaaccatgccacgaattctgctaaggtctttcttctgcggagtttgacaatccttgaaaaaaatgggcaaaggaaccaagaggcgctaagcaaagtggcgtccttggagtgccctaaggtatctagtgctaccgtcgcctttgttgaagctgtgaagttgaaccacgaactgtcttccaaggttggcagtgttttggccaagttgttgcgcactaggttggatgttgaggtatggtgtgaattaaccatgtgtgatttgcttgatgttgatgttgagttatgtggagttatattataa

SEQ ID NO: 76827 - DNA, 873 bp, Glycine max
  Peptide Sequence Number=SeqID_168512
atggagaagataagctcagggaagcatcaatatccccctgtaattggaccaaggacaacattggctccagaaattggcaatacatggaggtcaacgataaacgtcatggctcgaatggaaatggaaacagctttgcaaacacagtgcttccaccgtccaccagaagcactacggcatggccagagatcgtcaccacaaaacacaacgtttcaggcactaggtaacctgccagagaattcagacttaattgggccgagtatggatccaggtttatgggtgaggtatcgggtcaggaggttcatcctcttccgtgatgaagaagaataccttagaggcacaacggtgacctctatgggaggtcgtggcgaaggaggagggagagcgggtagaaaggacgaaaggggaggtaaaggattaaggcgagggaaaaccagtggtggagggcaaggtcgcgacagtggtcagggtcgttggtcgccgaagatgaaacagctgaggaggaacagcatcggcaagccaacaatgcgattggctaaatcttcaaactctgataggagtttcgttgctggtaatcgattacatgttgaaaattcaaattcaaaacccttttcaacagctatttctcaaccttgtcttctggtaatcgattacactgcctggtattgtggtggtggggctgagggtcgaggaaattggtggagtggaggaggagaagaaaggggtcacacggtggagaagcgaatgagggtagcttctagcttatcaacggatgtggaagacttagaaggaacaaccatggtgaagaacaatgagagcaccaattgttacaagctgcaaactaaggattgttttcgaggaccagggcctccatag

SEQ ID NO: 76828 - DNA, 378 bp, Glycine max
  Peptide Sequence Number=SeqID_168513
atggcttctttagaacaagagctaattctcatggagggagaagcaattgatgcttgtgaaagatggcttgaggcagataatgcacgcgagatattgaagagaatttcaaaacaactgttggaacaattgaaagagaaggatgttcctgtggacaagattgaacatttgaatgataaactaattcttgccaattctcaggttgtcgctttaagtgtcaaggtgtgttcacttgagaagcagctaaatgaatctgaatgccagattggaatgcttggagggatcattacaccaagtggaggaagcaaaagtggcatctgcaaaagatatcggaaagcagaccaaagtattaaaaaaattggtgatgtagctggctgttga

SEQ ID NO: 76829 - DNA, 351 bp, Glycine max
  Peptide Sequence Number=SeqID_168514
atgaacgggattatagactctgaggaggatgctaagattcttagagaaaaaggggttattttgaaccgtttgaagagtgataaagaggtggctaacttgtggaacaggatgagcaagtccattaaattgacaagggtgccattcttggataaagtcattgaagatgttaaccagcattataatggtaggatgaatatcaaagttaggaaattcatgaagctttatgtatttgcttcatggaaatttctgacattccttgctgccatcttcctcttgttcttgatgtccttgaaagtgttctgctctttctataaatgcaatcacagatgtcgtgccagtgtgactagatga

SEQ ID NO: 76830 - DNA, 147 bp, Glycine max
  Peptide Sequence Number=SeqID_168515
atggagaaagcagaaatcaccagaagctgtgtctctggcagagatgagaagaagctttggatagaggcgtggtttaaccccttttatctgagccgttcgatgtgtgccagttttctgcctttcatttctgccacctatgatagatag

SEQ ID NO: 76831 - DNA, 405 bp, Glycine max
  Peptide Sequence Number=SeqID_168516
atggaccaattaaagcgcctaagcatcccctcagaaatgtttagattctctaaccatgctagttacccacgtctaggccatccgacaagaaaaatcagcatgcaacaaggacaggcagatatcctcatagctaggttccctgaccctaactatggtgttaaaacgattagggttttcgttctctaccgaaaccgcaagccaagttggaagattccgcttcggttgaagggttcctctcggtgtgggttttcaatggagaacaatgatggtttgttgtggttaatggtggctgtgggtgatggagaaagtgcttggaactttataaatggctttggaagaaagaaagaagaagaaatgacatttttcgtaagctacacgaaagcaaaggctgaaatgcttaaataa

SEQ ID NO: 76832 - DNA, 585 bp, Glycine max
  Peptide Sequence Number=SeqID_168517
atgaacggtgtggttagggtcgaagtggaggaagatgtcggagggattggggccggagaagaggttcgtgtaattagaatcttcaatggagggaagagaatcgaggtaggtgaggatttttcggtagagactattgtccaaagagtgaagattatagcgagggattttgaaggactagtgaaggtggagacggtttttgaagcaaaggaaccattggttaaggatgtgaagtgcagagttgtagttgcagggtacaagcaagcaggggaaagaactttgtatgagaaagaggatttttgttgctcacatgatttcataaaggggcactttacagaaaatgacacacttacagcgagagtcttggatgagggtattggttcaaatcttaacttcataatacattcaaacaatggctatgagttgtttgctaggctaaaatcgccaaccacctctcaagaatcaaagaagaacttggccttgcgacatgctagacaaattgtacaggaatcaagtggagatgttcattatggtgggggtcgtcaacctattgtcttgaggacatttagtcaaaggcttcgcaagtaa

SEQ ID NO: 76833 - DNA, 270 bp, Glycine max
  Peptide Sequence Number=SeqID_168518
atgacttttcaaagttttttttttgaaatctcttcactggtaatcgattacaggattctgagattgaataatattacaattgatggcaatgtcaacggacatggttactttgctggagataatgatatggatgaagatagtgctatagatggacatgataatttcgatggagaagacgatggatatggatgggacatgattactttgctagagataatgaagtggatggagaagatggcatggatggacatgatgatttgctatagatga

SEQ ID NO: 76834 - DNA, 1266 bp, Glycine max
  Peptide Sequence Number=SeqID_168519
atggcggagagcgacggcagacaccgtcggagggaaccgcttccggtgtcatcggaggaagatgctgctaatgcttcgtggagacttaacgtggaggagtttcgtttgccaaaccaaacgcatgatcatcatcaacagcaccgttccttcactttccgcggccttctccgcaagcccagtgtgcaagcccattttcctttgaatgttcaagctttgaactttaatgtctttgctttgtgtgactgtttccctcttagtggtgatgctagtgaacaccgaagaagtcagagcagtgggaagcaacgcaaagtggcagaatattataagaaacaggagagtctccttgaaggatttaatgagatggagacaatgactgaaacgggtggtttcccaggaacgcttactgaggatgaactgaagcaactagctaagagtgagaggattgctgttcatgtatcaaatatatgtaacttggtgctgtttgtagcaaaggtttatgcatcagttgcgagcagatcattggcagtcattgcttcaaccatggattctctcttggatctcttgtcaggcttcatattgtggtttactgctcatgccatgaaaaacccaaaccaatatcgctatccaattggaaagaagcgcatgcaacctgtgattttgattgaatctggtcgacaacttatttccaaggtcaagcctgacatggattcagcaaaactgcattggatgatggggattatggtgtttgtgactgtagtgaagttcattcttatggtctactgtcgaagatttaaaaatgaaatcattagagcatatgcacaggatcacttatttgatgtcattactaattctgttggattagctgctgctgttctagctgtcaagttctactggtggattgatccaacaggagctattgttatagcattgtatacaattaatacatggaccaagactgtcattgagaatgttggttcactcattggaagaacagcaccacctgattttctggccaagttaacttatctcatatggaatcaccatgagcagatcaagcacatagatactgttagagcatacacctttggtgcacattactttgtggaagttgacattgtgttgccagaagacatgcttctccaccaagcacacaacattggtgagacactccaagtgaagctagagcagcttccagaagttgaaagggcttttgtgcacatagattttgagttcactcataggccagagcacaataccatggtatga

SEQ ID NO: 76835 - DNA, 2178 bp, Glycine max
  Peptide Sequence Number=SeqID_168520
atggagtgtgcaataaaacaagatgttactgaactaattggaaacactccaatggtgtatctgaacaaagttgtggaaggttgtgtggcccgcattgctgccaagttggaatcaatggaaccctgctcaagtgtcaaagacaggttagcattaagtatgatcaaggatgctgaggacaagggactgattacaccaggaaagactgtgcttgttgagactactagtggaaacactggcattggattggcattcattgcagcacttaaaggttataggctaatcctagcaatgccggcttcaatgagtctcgagcggagagttgtgctccgtgctttgggagctgagctgcatctcactgatcctgctaagggcttcaaaggtagtcttcaaaaggctgaggagctgctgagggagacacctgatgctttcatgcctcatcaatttgaaaatcctgcaaacccaaagattcactatgaaaccactggccctgagatatggacagattctggaggtaaagttgatgcccttgtagcaggtataggaactggtggtacaataacaggtgcagggaaattcctcaaggagagaaacccaaaaatcaaggtttatggagtggaaccagttgaaagtgcagtcttgagtggaggccagccaggagggcatctgattcagggaattggtgctggtattgttcctgctgtgctggatgtgaatctgcttgatgaaattcttcagggtgtaactgatcacccttctagtcatcaggttttcaaatctaaagatgcgatcttccacaaaaatgagaatggagggtgctgtgacacattggttatacatttggagccaaaagagcccagattcagattgggagtcattttccacatctttgatcaaaagattcatagatcgctatgcatggacggaagtgggtcagaatgcagtggagctaaggctagttctttgacaagaaaggtggaactacccagctttgatagaagcatagaagggggaactgatttaaagggtagcagttttgagtgtgacagtgacccattgcagttcttgaaatcagaaaacagaagtaaagaaggttcaataatcaagaaccacacccgttgtggtggagaagaaaccaaagatgatgaagcaaaattagcaagagaaacaaagattgaaaaggttatggaggaagaagttgatccattgataaagagggagaagcacaaggaaaatagagtgacgaatgtgggtgcgaagacggaagttgaagctggtgatgcaaccaagcctcattgttttcaagattcagatttccatacaaagattgttatgatgaagcataaatcgctcatgaaggtggttggaacatcgatggtgctggaatcttggaatgtcaacttgctgggtgagcttttagcgttaaattttgttgtgtctatggatgatagcttgacaatggagccaaggcagaagggaggtacagagacagtcatgatgattcaacttcctgggagttcaccctcatccccaccactatcgaagccaccggatttgagtttgcatgaagtggccagcaggatgagaaagaggaaagggaagttttggaattctaccaaatcccaagcctatggcaggaaagcaccgaaatgctatctggaaaggcagatgaagatcatggtgatgaagatgagccatgggatccagcttccacatttccaaccagaaacttggagtttaaaatgggtggcaagatttataccactaaacttggatgccggtttagctgatgacatgattatagagaagaggtggaaaaagattgctgcatcagccatggaggtccaatcagaatttgctttcatcccaacctccacctctacccgcatgcaaggaagtaggtcattcccagatttgacccttggttttctatctgttaatatttttcaggtatcaagtgaggaagctatagaaactgctaagctgttagccctgaaagaaggtttgctggtagggatttcatctggagcagcagcagcagcagcaattaaactgggaaagaggccagaaaatgctgacaaactcatcgttgtggtgttccctagttctggagagcgctacctctcttctccattgtttgagtccattagacaagaggcagaacagatgacatttgattag

SEQ ID NO: 76836 - DNA, 291 bp, Glycine max
  Peptide Sequence Number=SeqID_168521
atggagggttccaaaatcaaacttgttgaatgggaggaagaccataaacctctgctaccatattgtcgcttcatcaaaaacctactccaatcaacgcaaatgtgcaagcctaagatcgtgaaggatgtgcgagtccgggatcctttcacaaatccttccatagtgtggctcatccccaaccctaattttgcaacaacagcgtggtcccaagaatggttgaagcaatgcaggggtattcttgaccgtttggattttttgggaggtgataaaagcctccaaagagtttattag

SEQ ID NO: 76837 - DNA, 867 bp, Glycine max
  Peptide Sequence Number=SeqID_168522
atggattctgttgtgtatgattggttattttcttataatcatggctattttgtatattttagatatgttaaaagccgaagtgatgagcaattgcgggatcgtagggaagagaactcaacaagtgcttgtaatcctgaagatatagccaatggaaaggcaattgtaccttgtggtcttatagcctggagtttattcaatgacacatacagcttctcccgtgacaataagaatttgactgtgaacaagaatggcatctcctggaaaagtgatagagagcacaaatttggaaaagatgttttccccaaaaacttccagagtagtgctattagaggtggtgcaagtctcaatgaatccataccagaggatcttattgtctggatgcgtactgctgctttgccaacttttaggaagttgtatggaaagatagaggtggatctcaatgcagctggcttggtgggaagaatgacttcctgggcattgcctatctcactgttggagggttgtgtttctttttggcattggcttttaccgttgtatattttgtcaagccaagcaagaggcaatgaaggaggaataagtggggcccaaacagggggacacgtggcagaactaggaggagagaggcgtagcacaaggctcaaaataaccaactccaagctagccgagtattcagactatgaaacatggacactccagctccttgccgtgtccggtgtccgacacgacaccgacacccatgtccgggttgagtttgatgtgtttgacaggtgtttacgtgtccgtgtcgtgtccggtgtccgtgtcagtgtcggtgcttcatatcagagcaattcagatgggaggagagcatatctagcatatgtttaa

SEQ ID NO: 76838 - DNA, 795 bp, Glycine max
  Peptide Sequence Number=SeqID_168523
atgtgtcacctaactacatatgtttgtgtttactacgacggccaaatttgcaacactaatgagggcaccaccttcgttagtaacaacacaaaaactttcatggtcgataaggtcataacctttacacaattgcttgaacttgttcaccaaaaactaaacattgacccagaacaacatatccaacatctccattttcggcgccctatatttgagtcaggacaacgttatatgtacacatcttttattctgcgagatgatgctgatgttcgacaaatgttcaacattttttacaacaacccatcactaccatttgtggagttatttgccataatctgtcacaataatgacccaccaggcaaccaacatggctcaacctctaatcttgaggacttatcagaattattatgtaccattattagaacatcggatgctatactcaacctgcttcaatcaaccatcactcctactcatgatgcaattatgtattacaacgggaagtggaacataccacgtcaaggtgagtttttgggttactcctttactggaactaatccaataagatttggcattccttcgggatgtgacatggagaaactcaaggatttaatcaagcaagttgcacctacaggggttccccctaatggaattcacggatcacaattggttagacgattgttctttcgacaaccaggtcattctaagtattccgaaaatttgattgaatatgacataacagaattggaaaatgatgaagacgtgctaaaggtgttagcacaatccaactattggaaatga

SEQ ID NO: 76839 - DNA, 279 bp, Glycine max
  Peptide Sequence Number=SeqID_168524
atgtggtttggaatctcgaggcattacaattacattaattgtaatattgaggccatgcgaaatgttgagaacaaagctaatgcggttatcgtacgcatgtgggtgaatagtgtgcaagaaaatgtcattggttcacgtgcattagaatctcgatgcgtgacagtaccacagttgatgttaatgtgctttggaatctcgaggccttgcaacgagacaattataaatgtgctttggattctcgagacatttacaattaccttaacgtacacatgcgggtga

SEQ ID NO: 76840 - DNA, 273 bp, Glycine max
  Peptide Sequence Number=SeqID_168525
atggaagagcatttcctcgagcatgatggggagcgtggtgtcatggctgtggaccaccattgccatggagtcgccgacgagacagatgtcgacgtcaatcgtgtcgaggtgcaccacgacggggtagtcgtaggcggtgaccatggtgataggctgggaggcatggtgcttctaccgcaactggctcagtgttacacacttaagtcatccatcatgaggtggaagatgaaggttaaggaagagaaggaacgaaggggaatcagaatcagatga

SEQ ID NO: 76841 - DNA, 123 bp, Glycine max
  Peptide Sequence Number=SeqID_168526
atgtcgtataattactttatttttcttctttgtagggctgattttgagaggacgggtctaagcagcttagtcaccatgcaagttagggacattcagggtgaacctacttcacaggccaaatag

SEQ ID NO: 76842 - DNA, 405 bp, Glycine max
  Peptide Sequence Number=SeqID_168527
atgacagggttgcaaatttttcactcactgggaggaggaactgggtctggaatgggtaccttgcttatctcaaagatcagagaagagtatccggataggatgatgttgacattcttagtgttcttatctccaaaggtctctaacaccgtggttgaatcctacaatgccactctctctattcatcaactagttgatattactaatgaatgcatggtccttgataatgaggcactttatgatatctgtgtttgtacactcaagctcacaaatccaagttgtattgatgttggatatcagttctattctcgtgctgaaatggttgcagttggctttcatagccactggttaaatggcattgattatatgggccagagctatgccaaagcggagaaagaaaacctttga

SEQ ID NO: 76843 - DNA, 1044 bp, Glycine max
  Peptide Sequence Number=SeqID_168528
atggcaccaatgagtctcccacctgggtttaggtttcaccccactgatgaagagcttgttgcttactacctggagaggaaaataacaggtcgctcaatagagctagacatcatcgctgaagttgatttatacaagtgtgaaccatgggatttgccagataaatcattcctcccaagcaaggacatggagtggtacttttacagtcctagggacaggaagtacccaaatgggtcaagaactaaccgtgcaacacaagctggatactggaaagctacagggaaagataggccagtgcactctcaaaagaaacaagttggcatgaagaagacattggtgtactacagaggtagagcaccacatgggattagaaccaactgggttatgcatgaataccgtttaattgaatcagttcctggtgctactctctcatctttgaaggattcctattcgttgtgtcgcattttcaagaagacgattcaaattccagccaaaactaataataaagaggaagaacaagttgagaatgcaaagaaggaatcgatgtggatctcagaagaacaaatgctaggggaagactcaagtggcactgagatttctagagaaatggaagctgtggatgaaaaaattctcaatcatgaacaccctaaatttccttgtgacgcttcttcctctgatctcactcaaggaacatgtacaccaacagataccggtatagcagaagattttcaaccacaatttgcatgtgatgaagcaaacagtgcagccaattcatatacaatgggaataggataccccacaaatctatttcaggatgtacaaatacctagctatgctggcatgcattatcaactcccgtacacacctttggtgatggaagatttcccacaaataaatttaccggagacaaagataacgaagccagaagtcactgatgactgcatgttatatgacagatacagggactgcatgaatggaacactagaagagatcatctctttgtgttgcactcaagataattccgtcccttttcccatgctagaatga

SEQ ID NO: 76844 - DNA, 663 bp, Glycine max
  Peptide Sequence Number=SeqID_168529
atgaagggaagaatgcataaatatgggtttaacaacaataaacgtaagaagccagagaagatcatgggttctccacctgccttccctcctcctcctccttctcctcctcattctcctcctcctcctgctccttcggacgcatcagtggtccatgttgatcctgctaccggcaaggccaacggtccccacaggaagaaattaagaacatatttggggattgtggcgcgtgataacgtggacgtcacatacgagaactggaaggaggtccctactgctcagaaggacctgatttgggaggatattcagcgaaatttgatatcccagaagcttctgacagtaggacgaaaaggaagttacttcagaccgttgggtagagatggaggcagtttaaatcagacctcacgaggaaatgggcccttgcagctgatcaagatgatgtcgaggacactgtctgtgagaaatacggcatcagcaaagaaaagtgggcccaattttgccagactcgcagagacccttcttgggaggatgtgcgcaagaaggcacaagccatccagaagcagaatactgtcccccacgtttagtctcgtgggggttatgactatttggagcagaagctcctggctgagaagacaaagaagaagctgcacagtcaggaagtgttga

SEQ ID NO: 76845 - DNA, 528 bp, Glycine max
  Peptide Sequence Number=SeqID_168530
atggcggtaatgcccgccggcggaggctgcgtccacagtgcaagaggtttcttcagttcagagaatgtggtggaactgaaaatttctaatgaaaaacgttgtggcctctgcaacacgacctcgttttgctcccctgtcatcagtgccaaagtttattttttaaacataataacgcgacctcgtttacgaggactcaatgtaaatcataaaaccgatccaaggagtgaagtaagacttcaatgcttggggttagagtacttaccagatcatccatctttcccatggttagagcatttccttgctaaaatgggtgtacctgaaactttcctcaatggccatgattgtgacatgcttgaaaaactatccagaatgttacatgactcaatactacattgtcgtggtgggattcagacaaattgtttttgcatctttgccatggtattgaattctcgttgttcttacaacatagtgaataccatatgctactttcgtggtaatttggaatggtttgttcaaagtggtacataa

SEQ ID NO: 76846 - DNA, 1335 bp, Glycine max
  Peptide Sequence Number=SeqID_168531
atgagcaaagagttagctaatgcattgcgtgcagttgcatctgctgaatcaagggctgctgttgctgaggcaaaactctctggtcttcaaagaaagatgggttccacagatgacaaggcaaaagacgagattgaaaagtggaaagaggaagcgcatgccaacaaagctcacatgctgcagtataagagcattgctgaggtgaatgaagatgcattgaaagagatagaaaaggcgcatgagaagtttaaaacagaggctgacaatggaaagaaagttttggaatctgaacttaactcacttagagagaagatgttagagattgaaaatgaatcttctttgaaatatgaagaagttgcttctgaaactgttggaaaggaagaggctcttacatctgctatggctgaaatcacaaatcttaaagaagaaattttaaccaaatcttctcaaatttcagcaatggaaattcagatctcaggtttaaaagaaaacctggacagggagcatcagaaatggcgggcaactcaaaccaattatgaaagacagaatgaactaaagactaagtgggaagatgagaaggcacaactagaaaagtctaggaatgatgctgagaagaaatacaatgaaatcaatgaacagaataaaatactacatagccaacttgaggcttttcatattcaatgggccgagaaggagcgtaatgctgctggtatttcatctggaagtagtagtgcagatgcctttggtgatgctggtcttcaaaacgcagaaacagaagtttcgttgttaaaacaagagaagctgcgattacagtcacagcttgagactgctttgaaggcagcagagtctgcacatgcatcactagaaactgagcgtgcaaaatcaagatcatttttgtttaccgaagaagagttcaaagcattgcagcttcagaaattgcgtgaactggcacaaaaggttagagctgagacagagaacctagagaatctcctgaaggaaagagaaattaagcttgatggccatacgaaagaaattgaaaccctaaaaatggaaaaagatcatctcaataagaaggttactgagctgcttgaaaggagtaaaaatgttgatgttgaggattatgatcgagtgaagaaacttgctaaagagatccaggataaactaagagagagggatgctcggattgaggaaattggtaaaagtctatcagaaaagcaggattctgtttcatccctagagaaagatctttcaaactgccgattggagcttgcagagagagagaagagaattaatgacattctgcataatgaggtctctgagatactctctatctttgat

SEQ ID NO: 76847 - DNA, 369 bp, Glycine max
  Peptide Sequence Number=SeqID_168532
atggttaagtttggttttggtgtggttgggttagggttttgcgtcgataggcttgattttggtgtggctaggtttaggtttggtgtggctagtttagggttctttgtggccgataggggagggattatggacatccatgagaacgcatatgcgcatgaagaaacaaagatagttcgcattatttttatcgtcatattccataaattctttgatgaaattaccaaggttttgtccaacaatatcatacatgaaacctataggaatattgtgaacttggatccagtagggacagtaaagaaaggaatcaatgcaggatctttgtcttcttttatagcacccaatatcaaaagaagcttatcaaaactctag

SEQ ID NO: 76848 - DNA, 366 bp, Glycine max
  Peptide Sequence Number=SeqID_168533
atggagatggctgtaaagtttgtagaagtatccacccggaccgagaagacaagtagatatggaaggaagatgcatctggtgtatacacagcggggagtgggtacaagacgcttatgtcaacccaaactaatgaaaatcaggatggtgtttttactaagttgtggaaggtcaaggcccctagcaaagcaaaataatgccgctttggtgggaatcaatatcgtggacaaacacttcaagaccatttttgcagatctcgagaatgcacttcctctagcatgtggtttggtttggaaaggaaatggcagtagttctcagaattggaaatgctggtggatctccttgacctggactatttggcagcattaa

SEQ ID NO: 76849 - DNA, 588 bp, Glycine max
  Peptide Sequence Number=SeqID_168534
atgcactacgatcatggtgaatccaccacaatcgtgatcgcaagtgacattgaagccttgggtcattatggattgaccatggccctcttggttgaccgtgaccctcatgaattgaccataaccctcatgaatttgccatggtcattgtcagatcgtgatattattttggagggttgttatcacttcattgtggccatgctgcttactatggtcgtgattatgggatgtgagtgcaattgtaacctccttcaaactggtggtttctttccaggacttggacatatgctgactctccaatttcgtccatacttcccccgaagacgccaggcctataacgtaatacatgacctcacatgccaaacacaatcgtatggtcgtcgcaaccctctccttcaactcctctcaatctgcatagtcgatgccataaacctacaattcaattttacaatatcacccatgtaccgtactatgaggacctcatcctacactaggcatggcaagaaaacccgtacccgtgtttacccgtccgaatccgtctcaactttgacgggtaatacccgagttgaccgggtatggattcggatttga

SEQ ID NO: 76850 - DNA, 948 bp, Glycine max
  Peptide Sequence Number=SeqID_168535
atggaaggaatggggttgaaacggattgaagtgctttctgttttcttgattctggaaacaagtgttgctattgaattgggtggggctcaattatttgacttttctaatcttattatccttgacagctatgctgatggatcatctgcaaagggattctttggcactgactctatcacagtaggcctcacaaatggaaagcaaggaaaactgaataacctcacaattgggtgcacaaaatcaatgctaaatggggtaaacttcaatgaagaaactggtggcatattggggctaggctttgccaaggactcattcattgacaaagcagctaacaaatatggtgccaagttctcctattgtttagttgaccatttgagtcacagaagcgtttcaagtaatctaaccattggtggccaccacaatgccaaattgttgggtgaaatcagaagaacagaactcattttgttccctccattctatggtgtgaatgtggtaggaatctcaattgggggccaaatgctgaaaatcccacctcaggtttgggatttcaatgctgaaggaggcaccttaattgactcaggcacaacattgacttcactacttcttccagcctatgaggcagtttttgaggccttgaccaagtctttaaccaaagtcaagagggttactggtgaagattttgatgcattggaattttgctttgatgctgaggggtttgatgatagtgtagtgccaagattagtgttccattttgcaggaggagcaaggtttgagccaccagtgaagagctacatcattgatgtggcacccctagtgaagtgcattggaattgttccaattgatgggattggtggtgcatctgttataggcaatattatgcaacaaaatcatctttgggagtttgacttgtcaacaaacactgtagggtttgctccttctacctgcacttaa

SEQ ID NO: 76851 - DNA, 276 bp, Glycine max
  Peptide Sequence Number=SeqID_168536
atgtcgtccacactctgtttttctcccttgccctgcctcttcagtatcaagttttttagcccctcacgatctttcattttgttgataaccaaattcggtgccgccattgacattgtcgaggaagccaaccagcaccggcatgaagcattccgttctgaagagaaaatggtggttctcctcgaaacgcttgcttttcaagagcaagttgaaccaattgtcgctgtgagtgtgcaaatcggagatggcgacgatgatgtggtccttggagaggagtga

SEQ ID NO: 76852 - DNA, 537 bp, Glycine max
  Peptide Sequence Number=SeqID_168537
atgacttgtcttccaaatagatttatgaatgagtgcggtagaagcaaagctgatcagtcactatatggtttgctggagcctcaatctatacaaaatgctaaggaaagacgtcaacaatgccaacaatacattgaaacatgggtcaaggaatcacaaaggcagttggcacattggcaactatttgttctccacccaagggaaaacacggtcgtttggttttgttctctgaggaagaagcctgatattaacatcaaaggcgcaattaacagtgcaatgaagacaataactagttcttttgaaggcatgtctaatcaaggtgcaccttggtgggttgaacccaagactaatgtgcaaagtagagggtttgagtgcggatattatgtcatgcactggatgtggtgcatcgtgactgccgatttgaaggatgactggcacaagtggttttctgatggctcatcgttagacgtggaggccatcacaacagttcgacagaaatgggcaacttactttttatctcttaggaaaagcagttgctaa

SEQ ID NO: 76853 - DNA, 108 bp, Glycine max
  Peptide Sequence Number=SeqID_168538
atgggggaagatgtcagtggtggaggatgcaggattgtggaacatggggtgtttggatttggtggggttggtgcgtttggtggtggaaggagtgaagttaaggattag

SEQ ID NO: 76854 - DNA, 273 bp, Glycine max
  Peptide Sequence Number=SeqID_168539
atgaatgagatatcccgtcagtgtatttctgcatttctatcttcacacaccgcttatgaattacttcccgagtcaggcaaggttgttgctttggatgttgatctaccagtgaaacaggcatttcatatattgcatgagcagggagttttcatggctcctctttgggacttctgcaaggggcaatttgttggtgttcttagtgcttcggattttattttaattttaagagagtttaatctcaacttgttcgatcctgcagagatcaatttatga

SEQ ID NO: 76855 - DNA, 198 bp, Glycine max
  Peptide Sequence Number=SeqID_168540
atggaatttcaacaagcaactggtggtcacatcgaagcttcatggagatatgaacccagaatcaacaaatcttaccatgtactagttttgggttcaggggatgaaagcaagtctagaagggcaatgagagtaagggcctatgttgatgtgaggaaacctctaaaaagagccatgaatctgaaagtgaggccaaactaa

SEQ ID NO: 76856 - DNA, 573 bp, Glycine max
  Peptide Sequence Number=SeqID_168541
atggggggttggatagtaaaaggcatccatacccaagccatacccatcaagaaccctcatagggatgaagcactactccactgttactttcctttctcaacatatggaaatccatcgattttttctaaatatgaacttggcttttctatattgagcaagattctcaaaaagggttatgagctagatacagtaacattcaatacactcatcaaaggtcatactcctatcaattatgctcctcctaatgcggtgaccaaagaccaagttcaagatatgattggtcaagctatgaatacttttgctgaatgtcgacgccaagagaacgagcaattcagtctctcaatgcaaaatgtcattacaatacagttcttcaaccttggtgttgtgttgcttcagaacttgcaacaagcccagatgtcgatgttaggcgttgttgcttctcctgcacctcatgttgttgcccctgcacctcctgctattgtccaacctccgccaactactgttgaaccaacacctcctcctccaccacctacgcagccttcttcaccaccacaagttcaagagtggcaatga

SEQ ID NO: 76857 - DNA, 270 bp, Glycine max
  Peptide Sequence Number=SeqID_168542
atgaatacaaggagggaaaggatgtttagtgaagatatctctatgttttcctttgcaagattccttaatgaatgcaaggagattcttggtgtctggaatgtgaatgaactggagcaaagtctagatactatatgcattggaaacattaagatgcatgtgaatctacctaggtttgttagaggcggtggaagggaggatgtatcaaaaggtgtcgggagaaaggagtgtgtgcttggagcaagtggggaacaacacaaagttggaggatga

SEQ ID NO: 76858 - DNA, 492 bp, Glycine max
  Peptide Sequence Number=SeqID_168543
atgcggtatgttgatgttgggattcctgccaataataaggggaagcatagcattggttgtctcttctggctattagctaggatggtactgcagatgcggggtactattcgtccaggtcacaagtgggatgtaatggtggacttattcttctatagagaacctgaagaggccaagcaacaagaggaagatgaagcaccacctgcccaagattatgccatttcagacttcaatgccgctggcattggcagcttccctgcttctgatggccaatggcctgctgcagtcgaacaaccttggactgaagaagcaccacaaccaatctcagcagctcctactaacttgacaccagaagcagctgtcacaatttgtttgactgaagttcctcttgcagttgcaggcgattggggtgaggctgttccagctccagttccagctccacaagctggtgtgcctccagcccaagcttttcctcccgctactggctgggactag

SEQ ID NO: 76859 - DNA, 1695 bp, Glycine max
  Peptide Sequence Number=SeqID_168544
atggcgtccctgaccccaggcgttctctcgaagctactcgacaacgccggctcgaaggtaaccgccccgcaccggcaagcccttcttcaggtgacggagatcgtgccgcgcctctcctcaacctccccattacaaagccgcggctacttcctcaaactctcggactctcttcactccgcctacgtctccgtccccgacgccgacgccgacctcatctccgccggcaagctcaaccttggccagttcgtctacgtcacccgcctcgacgccgcctcccccgtccccctcgtccgcggcctcaaccccctccccaagcggagaccctgcgtcgggaaccccattgagttggtaccaagtgagaggcttcgcgttaccaccaccaccaccaagaagaagaagaagaaagtagaggtttttaagagagggaagggttctcccgaatggaagaaggagaaggggttggagatgatgaggaggttgagtttggattcttctagaagggtttgggatcatagtccggtttctgaagggataactgcttctgcttctaacaaactcaaggccaagaaatctaaccccactttgcctaacgagatagacaagaaggttttttctgtcaaaccagattctccactaaaatcgccaacatcaagtatctcacccttgaagaataaaaacgagaacctttgtccaaaatcattgacaagcacaccctgtggtggcactgttcatagccaacttgttaaagtgccactcaattgcaagagttggcggcatgatactcctgcatgttgtgaagatgtctcatcccccatgtgtgatcttggaaaacaagttgtagctcatagaaatgttgcttttttggcagctgtgcggtctcttgaagaagcatcagctacagatactgtgatccaatgcatgtgcatgtatgcagaactttgccagtctggtcaaacacattctcctggatcacttgtgaagcagtttttggagcttcacctgagtttgcagagagtaacagtgctgattgatttgttacttaacccatttcctgaaacaaagtcaagcagccactctaccctacagtgtctaacagaagatgcatgcaaagttcccgctcggaagaatgctatatcttgggtacaagctgccataggtaccaatctttccaaattcaatctattcaaaacacaggcaaaaagtgaggttctaaatggcgagaaatgtcattatgttgtcattgagagttctcctgaggacatcaataccgagaattcacctgctcaaaacaagcaaaatcgtgtaactcaagcaaaccacttgccaaattcaactgctaaaaaacttccttcttcaaagcggaatctcttggcagccaagaacaaggatgctgacaaacatgatcgatcaaaagaaatcaaattaaaagaggttgcgagtttggcagaaaaactgcttgaggcatctagcgaatggttcctgaagtacttggaggagtctctgagtaatgaatatgggttgaaaaatgaagggaacattgaaattgcaagtcttcttggccagctcaaacaggtgaatcactggttagataatttggctggtggagataaggttgatcacagggtagagaagctaaggaaaaatttgtaccggtttctacttgagcatgttaattctgccgttacttgtaattag

SEQ ID NO: 76860 - DNA, 375 bp, Glycine max
  Peptide Sequence Number=SeqID_168545
atggataatcgtgggagattcttgatgggattctcaagtttcttaggaacttgtatgataacgcacgaagagcttaatgtgattttgaaagggcttcaactagttaaatctaaaggactggtgaagattctagttgaattcgattcaaagactgctatcaagttcttgagcaaagggtgcccattgaatcaccatgtggtccatgtggtagactctatttggagacttatttttgctgatatggaagtggtagaaaatcaaggaaactacaaaatcatgatgacttctaggatggatcttcttcttgaaggaataatagatagagcaagcatggagcttgaagttgtgttcttctctttcttttccggggtttag

SEQ ID NO: 76861 - DNA, 543 bp, Glycine max
  Peptide Sequence Number=SeqID_168546
atggtgacaacgaagaaacttgagactcgcctggaatcatttgagcagacatttacagaggcacaagaatcaaccaagaaaacattagattcgttgcagaaaatgttggagagtctcgtttcatccatagcatccttgaatggcgaaaagaaaatcttgaccgatgaagacgacgatatagatgctccagattccagtcgaccaatagtagaatgcgcgcaaattcaattccctatgtttgatggaacaaactttcggtattggagagcaaaagctgagcaattttttgaattagaggctaaatcgatagcacaacatgtggcatatcgatttgatgacagtgcatttgatgatcctgtagtggagttatcgagattgaaacaaggagatttaggtaaatatttggaagcatttgattctctgccggctcgtggtccacaaactgtagtctctgcaagaagccgtacatattgcaagattgcaagaagaaattctaaaagaattggaaaagaagatgtagcagaaaagaaagggcagacttaa

SEQ ID NO: 76862 - DNA, 846 bp, Glycine max
  Peptide Sequence Number=SeqID_168547
atggttggtgttgcaaggtggttgatggtggccaaggtcattggaggaatggttgatgggctgagcaacactcgaatgcaattgcaggttataaagtggagatgtccaaagcaaactatccctcccaatgataccggttttcaaaagaaactcctgtatctggaatccatcggtattgactctttcttgcttattgaaaaccatccaacagtgatcacaacctctcttgctgacataagatccaccgtggagtacattacctccttggatttcactgcaattgagtttcggcgtatggttggcatgtgccccgagattctgaccacccaagtctcagacctcatacctgtcttcaccttccttcatcgtgaggttcatgtgcctggctcggatattaagcgtgtaataaatcgtcgtcccaggttgcttgtcagcagtgttagtaagcgacttcgtcctaccctgtacttcctccaaagtattggcatagaagaggtaaacaagcacactgacttgctatcatgtagtgttgaggaaaagttcatgcccaggattgattactttgagaatattgggttttctcgccgtgatgcaacttcaatgttccgaagatttcctcagctattttgttatagtattaaaaataacttggagcctaaatacagttactttgtggtggagatggggagagatctgaaggagctgaaagaattcccacagtatttctcatttagcctagagaataggattaagcctaggcataaacagtgtgtagaaatggggtacaacattgatggtgctgtgcctggctccccgagtcatgcgacttgtggaggtttttattga

SEQ ID NO: 76863 - DNA, 495 bp, Glycine max
  Peptide Sequence Number=SeqID_168548
atggcgttcttcagaagcgtttctgcactttctcgacttcgctctcgcgtggatctttattctgagttgaaggaactagttccagagtatcaggaacgtgttaagaagctgaagaaagatcatggaagtgttgaattgggaaaaattactgttgatatggtacttggtggaatgagaggaatgacagctttagtatggctaggctcagctgttgacccggatgagggaattcgctttaggggcatgtcaattcctgaatgccagaaaaagcttccaggtgcttttactggtggggagcctttacctgaggctgtactgtggcttctattgacaggaaagataccaagcaaagcgcaagttgactcattatccaaggaattgcgaagtcgtgcaactatcccagattatgcttataaggcaattgatgcattgcctgtttctgctcatccaatgactcaattcacaactggtgtcatggcccttcaggttgagtaa

SEQ ID NO: 76864 - DNA, 144 bp, Glycine max
  Peptide Sequence Number=SeqID_168549
atgaaagaatggggagttaaggaaacaacaactgccacgggaagtagcctcatggaatgtcagagtcatgacatttggcctaatgttatttcatctcatatcaagttgattctcaaatggtgcttgctgttggagaaagggtga

SEQ ID NO: 76865 - DNA, 957 bp, Glycine max
  Peptide Sequence Number=SeqID_168550
atgtcttatcgaagggggtctgatcagccaccacaaaggcggatactgcggactcagactgctgggaatttaggagctgacccgatcttggacagtgaagtggttccttcatcacttgttgagatagctccaatcctccgtgtcgctaatgaagtagaggctagcaataaaagagttggttatctctgtcggttttatgcctttgaactagctcacagactagatccgcaatcaagtgggcgtggtgttcgccaattcaaaaccgctcttcttcagcgtctagagaaggaaaatgtcacaacacaagagggaaggaaaaagagtgatgctcgtgaaatgcaagctttttataggcagtactatgaaaagtatattcaagcattagataaggctgctgataaggaccgtgcacagctcacaaaagcatatcaaactgctgctgttttatttgaggtattgaaggcagttaatcgaatagaagatattccagtatctgatgagattatggaagctcatattaaggttgaggaacagaagcaattatatgccccttataatattttgccacttgatcccaatagtggaaaagaggctataatgagatatcatgagattcaagcttctgtttctgcactccgtaataccaggggtttgccttggccaaaggaacatggcaacaaagtaaatgaagacattctggactggcttcagctgatgtttggtttccagaaagacaatgtggaaaatcaaagagagcacttgattcttttgcttgcgaatgtacatatacgacaagttccaaagcctgatcaacaacccaaggttgccaaccattcagcaggaaatgcaacagcgaaaattattatatatgggtctatatcttcttatatggggagaagctgcaaatttgagatttatgccagaatgcctttgttatatctaccatcatgtaagtaa

SEQ ID NO: 76866 - DNA, 1368 bp, Glycine max
  Peptide Sequence Number=SeqID_168551
atggaggctaaggttgcagcaatagagtcggaggtggcaggactcaaaaccgctatgaaaagtatgcagctcaaggcagaggagaaccacgagaggttgattaaagccgaattgcctatgttcgacagagaagaccccacgggttggattgtttgtgtggaggtctattttcaagttcaagagatgcatcccgatgtgaaggtgagcttggctcaactatgtatggatggatctacaatccatttcttcaagtcgcttctcaatgaacacaatgtgctgacatgggaacaactcaaggcggaactcttggagcgatatggagggatcggagatggagacattttcgagcagttagcggctatccagcaagaaggaagcatcaatgagtacattaccaaattcgaatgcctcactgctcagtatgcgtacgctgggtccattaacgtattcgaggatgatgaatctcaccaaggcgacggaattatagttccgagagggaaagagattggcatgggtttcgatcacccaatacgaggcagaagtggactgggccaagggaacaggaatagcccatcattcactagtgagtttcatggatccgatctgagcccaattttgaaccacaatgttctacccccaatgacagaggcatttgtcatctatcctactaggagcagtcggagtgcaagaggaaagggctctgctacaagggaagaaatggacgatgaggcaaatgctatgattgcagaagacgagcttgatgatgaagaggacgaaggagaatgcacaaggatcaatggagttccagttcttgtgttggtcgataggggggcacacataacttcgtctcctagaaggaatgtgcaagggtgttaccttggaagtggattcattgtagttaacagtggacatagtgttattttatttggagggcatcaacttgattttgggggtagcctggctcactcctttgggggagatgcgagtggattggctagtaacagcaccataacaccagaacctgaggcagtgttagctccgcggtctgtccagaaaggtggagaattggtgaatcaggtgttagttcaatggaaagacgagggactcgaggaagcaacctgggaagaagaattcaacatcaaaagtcaatttcctgacttgcgacttgaggataagtctctttttgaaggaggtattgataggaatgggagtgtgggcttagaagtaagggagaggcccaagatatggagggtgaatgcaaggagaaacaaaagtgtcaaagagagagatgggtattgggaatttttagaattctgtcatggagagagaattgtaacctctctggaagagcttggctctgggcagtag

SEQ ID NO: 76867 - DNA, 612 bp, Glycine max
  Peptide Sequence Number=SeqID_168552
atggattttgacttcatcaccaacggacatgtccaaaacttgcattccattgatagcaaaggaggccatttcatagtgtttggatgtgagaacatgaccttcacagacctaaccctaaaatcccccgagaacaatcacaacacagatggaatcaaaatatcccaaacaaatgggataaacatcacaggtgtgaaaattggcactggcgatgactgtgttgctatgatttctggcactaagaatgttcggatttcaaatgtcgtttgtggccctggtcatggaattagtgttggaagccttgggaagaatgatggagaaactgatgtggaagatattgttgtcaagaattgcacatttgttggtactagcaatggtcttagaattaaaacatgggctgctccattgaagaaaaatttgaaggcttcaaagttcgtctatgaagacattgtcatgaataatgtgcaaaatcccgttgtcattgatcaacaatattgtccactacatcaatgtgaccttaagttgaagctgaataaaatatttggtgtttggaaactcacacgtgcaaatcagcaacgtggcatgcagaaatattcgaggaagcagcaaatctga

SEQ ID NO: 76868 - DNA, 234 bp, Glycine max
  Peptide Sequence Number=SeqID_168553
atgtgtgcgagaggcagagaagggaagggaagggtcttgtgtgttttagggaagggaagggttttggaatggaaggagaaggagaaaggaggagggtctcgttgggggagaaaggaagaggaaaaagggaggggtagggaattatatgaaattgggggcaaaatgactgacagaggaatgcatccggtagttgaagaggctagaaaaattatagacatgagaatgcaagattaa

SEQ ID NO: 76869 - DNA, 1410 bp, Glycine max
  Peptide Sequence Number=SeqID_168554
atggttaggactagaggtttaggtcgtgctttaggtaaggtcattggcagagctctggggagagaggatagtcatgattctgatgatgctccccagcggagaaggcctaccgcatcggcacgcagacaacggggagttgtccctgttgccgaggatgagcctgtggtacctgcggatgagcctatggtacctgtagatgaccctgtggtagcttttgatgagcctatggtagctgcagacgtacatgacactggtgcagacactgttgcagatgagcctgagggatttccaggtggactaagtgacccatcggtgcttactaagtatgttgagcatgttgcagccagcgtatggagcgaagaggaacgacctgaattgaagttattctcccatgggaggaaggtgcagaaattaggtaggcctgttcctgcaattgaggggttagttgctggcacaggactaagtcctttgatcgcgtgttcagtagacaccgacgatcgggaacttatatcctcatttgtggagagtcagtgccttccataccttctagcctctgcacgtcgacaaggcggtcttgatcgcaaatgtcaggccggacattggacagctgcagctcatgcatatcttcttcatcttctaggttgcattgtttttgctaacaagagtgcaacccatgttcatgttgtcttcttagacactctgcgtgacctcagtcagattgggatgtatgcatggggagctattgccctgctgacagcttactggttacatcaccctcttacagttgcggagtgcatcgctgatctagactacaacgaggtgtcaccacgtgcatgtcggtggattgcgacgaatgcgactgtgaagaccaaatctacagcgacgtacaggcaacgtctggatcgactcaggattcctgatgtctgctggatgccttatggggagcatcaaccggtccgggagtttcatttaatttcatgcttttccggtcggctccgttgggggcttgttgctgtcagacaccgaccagaaagggtcatgcaccagttcggatacgtccagagtattcctacacaacctattgattcatgggagtcatttgatgaaatagacgacaggtggatacactacttagaccatcttgcgccaacaggtgagatgtgtgttgtgccagagccagcaacaacatcgacacatgcccgttctgatgtggagcaatccaaacatgcagtggaggcttgtcatgcgattgttgaaaggttggagcgtctactcaaccttaggatagtcacgaaaggcacagagacatacgaggtcatggaagactgcattaggattgtcaggggtgtcatagaagaccacattgtgtatgtgaggtctcgacataggccgtgcatggatcagcagtaa

SEQ ID NO: 76870 - DNA, 978 bp, Glycine max
  Peptide Sequence Number=SeqID_168555
atgtggagatttaagccattcagtcacaaagaacagactggtcttgaaggccgcactatagatgttagcaatcttaaaataaatatcattaaggccattgccgaaggagggttctcttgtgtctacctagctcgagatgctgtacacatgtcaaagcaatatgctttgaagcacatgatatgcaatgacgaagaatcacttggattggtaaagaaggagatatctgtgatgaagatgctggcaggacatcccaatgttgtcacacttcatgcacatgccatcgttgatatgggtaggacgaaagaagcattcgttgtgatggaattttgtgagaggtctctggttaatgtgctggagagccgaggagctggttattttgatgagaaacaggttcttttgatcttcagggatgtgtgtaatgcagttcttgccatgcactgccagtccccacctattgcacaccgagacttgaaagcagagaatcttttattaggttcagatggcttatggaagttatgtgattttggaagcacttccaccaatcacaaacgttttgagaagccagaagaaatggggattgaggaagacaatatcaggaagtacacaacccctgcctacagggcccctgaggtcaccattgaaggttgtggtgaaagcaccacagcctcttccaagttatgggagttcctgggttcaatcttggattgtccatctggtgaacagatgtgggatctgttcctgagagaagtcattaatgagaaggtggacatatgggcacttggatgtctcctttttcgcatatgctacttcaaaagtgcttttgatggggaatcaaagctccaagtcttaaatggaaactaccgcattcccgaattaccaaaatacacttcacctgtcacggacttgataagagaaatgctccaagctagaccagatgacagaccagatatcacgcaggcaagcgctttgcttgattga

SEQ ID NO: 76871 - DNA, 306 bp, Glycine max
  Peptide Sequence Number=SeqID_168556
atggtttatgataaaatccaagttgagaatgagttttcagagctatcaactacagaaagacaagaaattttgatgaagaaagccaaactaattggtatgcttgatgaggtggagcaaaggtataggcagtaccaacaacaaatggagatagtggttttatcctcttcctctcctcactctatagctgcttatgagagtatcgacatgcaaaacccaaaaaggttcgctgcacaattgaaaggtgagcaatgtggtagcacactgctaccactcgatgtttctgagtccctcacaatttcttcttag

SEQ ID NO: 76872 - DNA, 264 bp, Glycine max
  Peptide Sequence Number=SeqID_168557
atggatgatttacggggtacactagggtataatgggcagagaggttcaaagaacttaggggaattagcaagtggtaactacctgacatttgacgtactcatttggcgcagggaactcatagatctcactttgctactcctaacgggctctgatactatgctttttggagttgagagcttggggatcgatatacgttgtacccgtaccagcgtcagaggagatcatgatgatctcatgcctacggagatagaggagtacaaatag

SEQ ID NO: 76873 - DNA, 1200 bp, Glycine max
  Peptide Sequence Number=SeqID_168558
atggaggtggcgtttcggtttttgcaccttcatcatgagtttgtaactcttgaggttgtcattgatggtgagaagtcaaaaggtccaaaaacttcttttggtgctgatgttgttgttgacgacgtcgtcgacatcaacaacaacaccgctctggttgaccataacatgggggattcttcagttgatgtctttgagccattattggatgaggctattggaggtggtgatggaggggttaaggtgagtgaagatgggaaggttggatgggtttccatgatgggtgcacgagggtctttgttcaccctgttcaattcgtcttggaagaaattcaagactcattttcttaagattacactgaacccaaaactaggagatttcccttttattggcaagaattctcacaaaggttcaaatctcggacaagcccattactatctcctgaggataggaatcatgaaaggtttcaatttcaggaaggtttgggcttccatgtcgaaatctcataatcctagcataccaccaacactttgccgacctagtgaagccaaagaaaaggaaaagagttgctacagagtccaaaactactgcgagcctgctactaagggtaggaatgttgatgtgatccaaccacataacgatgagaagtcgatcactaatgttgatgttaatgacaagcacgtggagaagtcgactactttgattccttctaatcaaccccaagatgagaaagatgttcctcataatactttgtttgaaaagcaaagtgggggtatggtgatccgacatcatcaaggtcctccacgtaggattgatcatgtgattataactcacgatcttccttcgttatggaatgttgacattaagggatttgagttcattactactgatagattgcttacaaaggttgactcggagatgatggacttcgttagagctgacaatagcttagattataccaaagtctttctttacaagaaaattgtcaaagcccttaatgagaagaactcattaatgatcggaaaaattgagatcattaagggtattcaaaagaaaattgctaaccatgaaaagatggtttccatgaaggctgtagaaaatcaaaagcttgttaaggccattgaaagtcttaacaagaatttcaatgccacagttaaggatttagaagaaaccaagaatactgtcaaggccttaaatgattaa

SEQ ID NO: 76874 - DNA, 765 bp, Glycine max
  Peptide Sequence Number=SeqID_168559
atgacatggaaaatcggtgatggatccctagctaatatttggagacaatcttggctgagatcaaagcataattcctttatttcttcgcagccaatgattgggaatgagcatgctactgtcaatgcccttattcactcaaactctttcctcgtggaagagattctacccattcctttactcaacaaggatgacactgatcaaatcatacggaaacaaagtcctaatggtagctacacagttcgtttagcatatcaccccactcatggattcaattgtagatatctcgagtttgaaggtccctggaaactggaagctcatctggaatttaaatattcatcccaagatcaaccacttcatttggcgttatcctttggagcatttggaactcaaggaacgacaaagtatggcaagaaaatgacaatccagctcaagtggtggtatctaacagtttgcaatacttcaacgattggaaggattcaagtgcaatgtcgaagcgactcttttcaaagaagatctttcttttggcgttgctcaaactcttgtacaaatggtttgcctgagcctaaagaagctgaatcatgcggccttctccaagctgcaatctggatttcctctcttaatatgcacaaggtcacctttgagtttgactgcaaatcagtcatggatacgatcaacacagcaactcaaggaatttcagaaacaaatgtcatcctatcttcatgtactcaatttcttcttgattctccaaattgggtgatgagttga

SEQ ID NO: 76875 - DNA, 237 bp, Glycine max
  Peptide Sequence Number=SeqID_168560
atgggtggacagatgatggagagcagtggagccgaacacaatagagcatatgccctttggacttgggtcacttgttgttgggttacaatgtgggttgagggtgcggggatgcagcaacaccaatatgccctcacgacccccatgacgacgatgacagcttcaacagtaagagagcaacggtgcaggaaacactacggcggtggcactaagaggcgcaaagagatcaaggcggaatga

SEQ ID NO: 76876 - DNA, 357 bp, Glycine max
  Peptide Sequence Number=SeqID_168561
atggagttgtatcaactcaaaatggagatgggacgagatctccatcaacaagttcaatcagtgaatgtcattcttagagaaaatgaaagaattttgataactgaaaatgttgatgatgaacaccatgcactagttgtggtggagtctaagcaagggaggaatcatccaaggagacatgatgagccaagaggaagatcaaaatcgcaatcgcaatcgcatccacaacgagctaggtgcaaacaaatgaaggaggacttgatgaagttaagagatataaacaaagatggtgtcaactcccaagctaatgtagtaaaaagtgttaaaaatgaaaacgatgaggtcgctaaaacaaaatag

SEQ ID NO: 76877 - DNA, 969 bp, Glycine max
  Peptide Sequence Number=SeqID_168562
atggcgaaaattgccaatttagttaaactggtttcattctttttggttatggatatgccagaacttcacctacatttaatgaccaacatttccaaacttgatcatgcaggtgatcttcaactttaccctgtttctgttaaaacccaaactggggagaagcttgagcttcagttgaatcctggagactctgtcatggatgttagacagttcctccttgatgctcctgagacatgttttattacatgctatgatttacttttgcatacgaaggatggatccactcatcacctggaagattataatgaaatttctgaagtagctgatattactactggtggctgctccttggaaatggttcctgcattttatgatgatcgatctataagggcccatgttcatcgtacaagggagttgctttccctttctaacctccatgcttcactatcgacatcacttgccctacagaatgagatagcacaaaataaaggtgcaaattcaggaggagataccttgaaacctgaagttcctgagcttgatgggcttggttatatggaggacatctctggttcattgggtaatttattatcgtccccattgaaggatattaaatgtgttgagagcatagtgttttcatcctttaatcctcctccgagctatagaaggcttgttggagatttaatttatttggatgtggtcactcttgagggaaacaaattttgcattacggggagtacaaaaatgttttatgtcaactcaagctcagcaaacaatcttgacccaaggccaagtaaagctacttttgaagcaacaactcttgttgctctcttacagaagattagccccaagttcaaaaaagctttccgtgaagtattggagggtagagcagctgcccatccttttgaaaatgtgcaatctttgttgccacctaattcttggcttggattataccctgttcctggagtacattaa

SEQ ID NO: 76878 - DNA, 1338 bp, Glycine max
  Peptide Sequence Number=SeqID_168563
atgagtgttatgtatagtcctgttctcaattactcagatgtggagtatcagctatggaaaaaccaagacatggattcaagtattggacatccacaacaacactgtcaccaatccaattctggactattgaggtactgttctgctccaagctcaatgctggcaagccttattgacaacaccattcatggctgtgtcaatgaggaaccattcacaagtgagaatcagcagcagcagcagcattatcttccatccacgagttcagaaatggagaccatgttgtccaaaatgccaccatccaacattggatggagtaactcagaacctttgcaagaatttggaggcaagcctgtgaagcaggaaatagggcaatctgttccacaaggaccaccaaagcagaatggttattcttatggtggctctcagttaatttaccaatctcagcaaattcaaggcttgccaaatggttcttccattgcttctatcagtgcttttgatggctcttttggtgcggtgaactccatggcttcagaggactccattcaatctaaaatgggtgtcaggaattgctccaatctctttaggcaaaagagctcccctgctggatttttctccattgaaaatgatcttgcggcattgagagaagtaggaagctttaaagacaatgatgtttcaaatggacaagccaccgcatcaactagtgggttgcatagttctcttactttctcatcgagatcatcttcatgcttgaaacagatgccaccacaaatagctgaaaatggaaatgaaagcctagaagaaaattatgatcaaagtagaaacctagtaaatgacaacggtagctcaaaatgttacatacctagcttcaccaatgaattctgggaaagttctgcattcaatgcccccaaaacagaaaatgaagatgaaatcatgttttccacttcaaatggtttggaatctcaggaaacagatttcagctatcaaaatcatggtttgactcaccatttgagtctacctagctcttctactaagatgtcatccatagagatgtttcttcaaattcaaggttctgttccttataaaattcgagccaaaagaggctttgccactcacccaagaagcattgcagagagggagagaagaacaagaattagtgaaagaatcaagaaactgcaagacctttttccaagatcagaaaagccaacaagcacagcagatatgttagatttggcagttgagcacattaaggacctgcaacaacaagttcagatactctccgatcgtaaggcaaagtgcaaatgtaccaggaatgagaagcattacactagaacttgtgcctga

SEQ ID NO: 76879 - DNA, 522 bp, Glycine max
  Peptide Sequence Number=SeqID_168564
atgagaaggaaacgcaagagctggacatcaaaggatgaaacaagggatgaaacatgccttgaagaaaaggacgagacgtttgaaactggtccggcaagtttccagtggccggagggcagcgcgtggacttcacgcaccggaaacgaggcgctgttgtggctgcgctgctggtcacatgacttgcaggggtgggtcgcgctcctcgaggcgcacccaaccctggttttgccggaaaatttgacagcagcggcaaacagagacagtcagaacgggatcggtggcacaaatctcgaggacaaaaatcaggccaattacgtcgagccatttgaaaatgtcgttagagaagagagaggggtcactagcaccttggccaccgccgaggttcatgtggattggactgcaatgtacactttgtcgccacgccaccaccgtgtcgtgatgccaccattaccggctcactggcctcgcgccattgggccatgcatcaatggcgccacagaggcgtaccacccttcgtggtag

SEQ ID NO: 76880 - DNA, 1284 bp, Glycine max
  Peptide Sequence Number=SeqID_168565
atggacaagggggtgcctcctagcctcttcgtcaatgatggttctttcatggagaggttcaagcaacttcaacaagagcaggataaagggaagaatgtcaaattggaggattctaaaccaattaaggttatttcagggtctttgtctcccaatccttcctttaccaaaacgcctgtggacttgaaggttaatgacacaaggaaaatatcccagggtggttccagtggaaagctagctttcagtttaaaacaaaagtcaaagctggtgccaccccctgttaagttgagtgctgatgaggatgaagaagaaacagaagctgggtatgtttcaaacgatgcaccactaaaacggcaaaagttaggccaggaggaaggcattgaccaatcatcaagacaacttgatgttgcacctcattccccaagtgatcctacagtgaagaaagttgctgacaaattggcaagttttgtggctaaaaatggaaggcaatttgaggatgtaacacgtcaaaaaaatcctggggatacacctttcaaatttttgtttgatgagagatgtgctgaatacaagtattatgaatatcggcttgctcaagaagaaaatgctcttgtgcaatcaagggaatcacaggtgcctcgtaatgggggtacaagcacttcatcttccaaacagactaatggtcatcagagatcatctcagcagcatacataccaaattcctgcatctgctttatatgaaagtgctgacaatccaagagcttctggattttcaattcaaacatcatcagtaggaagcagtgaagagcccagtggttcatcaaatgctgattctttggcactaatggagttctacatgaaaaaagctgcacgggaagagaagtataaacaacctaagcattcaaaagatgagatgccccctcctgcttctcttctaggcaaaaaaggccatcacatgggtgatttcattcctccagaagaacttgaaaagttcttggctacctgtaatgatgctgcagcgcagaaagctgctatggaggccgcagagagggctaagattcaggctgataatgtaggccacaggctcctgtcaaaaatgggttggaaagaaggtgagggtctgggtggatccaggaagggtattgcggatcctatcatggccggtaatgttaagaagaataacctgggggttggggctcaggaacctggagaggtgagtgctgaggatgacatatatgagcagtacaaaaagcggatgatgcttggctaccgttacagacccaatcccctg

SEQ ID NO: 76881 - DNA, 225 bp, Glycine max
  Peptide Sequence Number=SeqID_168566
atggctaaggacagagggtttcccttaagggatagactcaggctttggatttctacaatggatagctctgagacttggtctaaggcttttcctcgtgtgccttctcacgctaagctggtcctacacgctgagcaagacatcgcgctaagcttggaacttcccgctaagcaagtgtcacacgctgagcctgggttgagccgtatggaagaaacaatactaaagtga

SEQ ID NO: 76882 - DNA, 228 bp, Glycine max
  Peptide Sequence Number=SeqID_168567
atggaatcaacaaaaagcatgttcatgtccttggccgtcatcctcttcatcgccctcttctccgccaccgtctctgctcagggctccccaacaccggctcccgatggcggagcagccggaacagtttcaagctccgcctccatgatcggggctgcgaatatgagggaatttttaagcttgggaggagttgtcactaaattaagattgaggaaactaagaggacattaa

SEQ ID NO: 76883 - DNA, 282 bp, Glycine max
  Peptide Sequence Number=SeqID_168568
atggcatctcaagcaacctctttcaagtcctttgtcattgctcttattgtggcgcttttcttcgccgccgccaccgctcaagatttgtctccggcgcctgcgcagggacccgatgtcggagttgccggatccgtttcgagttcgatggccgtgattggagcttcggaattcgacactatggttgactacatggaagagagttcaacaaaacaaggtttccaggagcaattagaagcactacagaagaagaaatggcctccttgcaacaaaagcaggaggtag

SEQ ID NO: 76884 - DNA, 1584 bp, Glycine max
  Peptide Sequence Number=SeqID_168569
atgacgatgacaacgatggtggtgaaggtagtagtggaggtggtggcgatgtcgatggtggtagtagtagcggtgttggtgacggaactacgcgggttttccatgactgcgcgaacatcttccgtcactctcccgacaaaatcacgatacgctctcctcttccccctctccgcttcttcgcattctccgattctttcttccgtcgcggattttgatacgttcgagagcggattaggcgacgatcgggacggcaaccggctgatcaaggcgaatttctccgccgacggagcggtgaggctgaaggagagtttgatggagaagctcaaggagttcatgggggattatacggacgacacgcttgtggttggcacaatggtaaggttgccttgtgaactagaggtcatgggttcagatcctggaattggtctctgcttgcaggggaacggtaggcacaaagaacaagcaaggaatgatttgaatgtttttctgggagaaaacagcgattcatttgtatcctggctctgggatcatctggatatatatttagattcatatgtacaacctgaagcattgctagatgaagctcctaaaaaaaggtttatagcagaggttcaagctggggaggatgattctcagcatttaaactcacagtcagaaagaggaaaatctagtaagttatctagaagtcggcataacaaagattggaaaggattgatgaggggagaagctgaatcaccttccattcgaagctctgtggttgacaatgctcatttggagcttgaagccaatcaggggccaaggtccctatctcctaagcctccagttcagaagaaaaggggccgagctgatgaacaaccgaggatgaagagggatgttgtctcacaagtaaatattgctgctccacggaggctgcttcaatttgcagtgcgagatgcagtagcgacttcaaggacagccacaggcatgtcagtggagccttccctaaaacgtcttcgttctgtagtttctacatctgctggcgattcatctttcgtggaacgtccacagaggatgcagcttgcttccagggtgtcaaatccaatggctacaatgattaaggctgtggcagaagctgccgaagatgtgataaagtccaagccatctggaagtgtatttgatagacttggtcgtggtattgatacatcagatgacaacaggcaacttgaagatagttaccaacatcaggagcaacatcatttattccattctcaaagaactgagtacaatggggggtatgctgcaaatacaactatggcgggacatgaaactggttatccttctgattctaattcagacaatgaagggtttaatgatattaatgtcatggatcatagggtgtctggagcttctcagatccgcccctctgttggaaacaggggcaacgattcactgatggtgcagtatagtgtagcaaaaaatgttgatgatagtttgcgccaaaagcggaatcgagaacaggagcaacttgcagcatcacccaacacatctcataagatagtgaatatttctgttaatgtaaatacatggaaacctccacaacatcag

SEQ ID NO: 76885 - DNA, 774 bp, Glycine max
  Peptide Sequence Number=SeqID_168570
atgggaaaggttgggattggctttgtgcacttcctaggcatagtattaccacctgggatcatcagtgcaccaacaaattcatcccgaagtactttttttgtggtgaaaactaatcaaatacagaaagacattgagaattttgctcataagggacaagagagtctagcagaagcgtcggagagtgtgtcctctaataacaagacaatcttcgatgtcgcgggtgggggtaacttaattcttaaaccacctttagaagccatatggatcattaaaaacatgtcttttaacccatataacaactctagggatgagagaattttgaggaggcaagtgaatcagattttagccttcacacttccaccctttacttgtgataagtgtggggaagctcatgctgcaggagagttcctggtgagtgatgcacttgcccaagccttggaagatgatggaggaatcacccaaccactcttggaaggattagaaggagcaaagctcttttgtctcaaaagctactgccacacttccttcaattcccaaactgaagccaatgctaagaaggaagaagtgaatgttatgagtactaggaatcgaagtaaggatgttgaagttttgattgaggcacaatggtctctggtggctagaggtgccttgggtcttgaagctttaaacttcacagatgagaggagaagcaaaatatttagaggaaatggtgaggggtctacacacaagagtaaaagaaagggagagctttatgcacaaaatcagagtgaatag

SEQ ID NO: 76886 - DNA, 670 bp, Glycine max
  Peptide Sequence Number=SeqID_168571
atgctttatacctacaccacttgtgtgcaggatttcttcatgcaaagtttgcagtcagtaggattatatatgcatagagaaggagagagaatgagaggagagagaaacagagggtgggagagagtgagagagagaggtaaggctttcgagagagacagagtgaggctgagagagaggcaccaatatacgcaaaacagactcaaggataggaatcagcgacactgcaatcaaacaaactggcgagatcggaccgagataacgtcattctacttcacgcgattctccgacgaatgcactgagaaggagttatggcaacatttcaaaaaatggggagacgtccgggagatatttatctcaaaacaacgtaacaagaacgggagaaggtatggttttgttagattcaagggagttgaggacgaacgaaaactggagagtcaattggacaatatggttataggaggactgaaactatatgttaatcttccacgatacgggagacagaggggagaaaagaagactacggaggtgttacagcctcaaccacacaatccccccatttggaacaagcatgaggtagcccatcatacacagaggaatagaagaacataccacttgtcctatgcggaggcagtagcaggcaggaggaatggaactcacacccatgaagatg

SEQ ID NO: 76887 - DNA, 792 bp, Glycine max
  Peptide Sequence Number=SeqID_168572
atggcactgtgcaaccgcgtcagatcgggaatctctctcttcaccaaatccacgttcctcacttcccagcgatccactctccaacgatccctcgttgcccctttcatttccctcgcctccagaaattacgccaacgtgccggggcaaaaggaaaccaaagttaaggggttagtcgccccacaccacaacgaactaagattcaaatccttgctaggagaggtccctctggctttgtttggaggttcaggaaactatgcctctgctttgtatattgcatctgtgaaagccaatgcagtggaaaaggttgagactgagcttctgcaatttgttgaggcagtaaagaatagtcccatattttcacagtttataagggacttgtctgtggctaaggatgttagagttaaagttatccaggatatttgtggggaagccaagttttcggatgttacaaagaacttccttgttattgttgctgagaatggaaggcttaaaaacatagacaccattgcaaagaggtttgcacagttgtcaatggcatataagggagaagtgcaagcgactgtgaccactgttgttcctcttccccctgaagaggaaaaggcattgaaggagactcttcaggaaataataggttctggagcgaaggttcatcttgaacagaagattgatccaagcatacttggtgggcttgtgcttgaatttagccagaaggtctttgacatgtcaattaagaccagggcacaacagatggagaggatcctccgagagcccgtgtccattgccaacatctag

SEQ ID NO: 76888 - DNA, 531 bp, Glycine max
  Peptide Sequence Number=SeqID_168573
atggattctagtgtggggtttattaggcctttggctctagaactacaacagctagcttttgcggcactatacctgagtacacctggagttcagaaatcagctacaatgaaggcggcagtggctgtgattgaaggcaagcttagggtttttcaagatgcagggataaagactcccagactgcgagctacgataccaagtagccctttccgagaaactatcaaccaagatccgatagctgcaaggcctgttagaggtgaccttttaaggcagctttccaacaataggcagtcctcctgggaacagctggaagagattgcaggattaaacagcaagaacactgccacggcatctgcagctaaacaacatataaacagcattaataagaaggggacaggatatttcatgaggcaacagagagagcggattggtggtgagtggaattctgttataagaggggctagtaggatcagaggggtagacaatttagatggtagttatggacagagaatgttgatctctggaggagcttag

SEQ ID NO: 76889 - DNA, 846 bp, Glycine max
  Peptide Sequence Number=SeqID_168574
atggcatatgtttcatacttcaatttttcaatgtttggtgttgaaaaacggctgttttgtatacgagctgtcccggtctcagcctctacatcccaaaacatcaaaacaactggttgggctccttgtatggcttcttcctcagttggtagaagagctacatattcaacacaatctgtatcgacaaatgagccagttgtatctgtagattggctttatgataacctgaaggagccagatatcaaggtactagatgcttcgtggtacatgccggatgagcagaggaatccaattcaagaatatcaggttgctcacattcctggtgcccttttctttgatgtagatggaatagcagatcggactacaaaattaccacacatgctgccatcagcggaagcgtttgctgctgctgtttctgctcttggcatagagaacaaagatgatttggttgtttatgatggaaaaggattatttagtgcagctcgtgtttggtggatgttccgagtatttgggcatgacagagtttgggtattagatggtggcctgccgagatggcgtgcatcaggttatgatgttgaatccagtgcttcaagtgatgctattcttaaagccagtgctgctactgaggctatagagaaagtatataagggacaaacagttggcccactcacatttcagactaaatttcagccacatcttgtttggaacattgatcaggagaacaacactttggaaaaatggaggttgacaatgttggtagttgtagaagtatcaaaaattttcttgttagagtccataattagttacctcaaggatgaagttaggtttgaagtagcagctgcaatttga

SEQ ID NO: 76890 - DNA, 516 bp, Glycine max
  Peptide Sequence Number=SeqID_168575
atgtcgccattttatatatttggttgctacattaatttgcagatcgcaaggtttccagaatttaaactagcggaagggattgacagaagtggcgtgacaacaaagatcctgacctgcaattgttccttgaatttaatcatagagaataaatccaggttctttggtcttcacattcgtcctcccacgatggacatgaaattttccaacttaccctttgcattttcaaatgcccccgagctctatgctgagagtggcataacaatctttgcattacaattgggagcaaagaacaagcccatgtatggtgcaggaagaagcatgcaagatatgctagattctggaacaggattgcctctagtaatacgtgtaatcttgagctctagtttcaaagtggttcctagcctcataaagcccaggttccatcaccatgctgaatgtttggtgtttctcaagaaggcttacgacaaaaaacatcgaaccctagcatttgatagcacctgtaaagtaacatcttga

SEQ ID NO: 76891 - DNA, 231 bp, Glycine max
  Peptide Sequence Number=SeqID_168576
atggtggaagaagaagaaacgcgaaggagaaacgtacctcgaagaagaagcataaactcgaagatgaagcagaaacgcaaagaagaagctttccacttgatcccgacaacaatggcggcaacgaagatgaggaagaagcagaaacacgaagaagaagacttcacttgggaagaagaggcagcgcgaagaagaagaagaacgttgaagatgcagaataaagcagtagaatga

SEQ ID NO: 76892 - DNA, 663 bp, Glycine max
  Peptide Sequence Number=SeqID_168577
atggaggctatgaaagaccaaatgaccaccatgatgaaggccatgatgagtgtgagaaaaatgatggaggtcaatgcggctgcagtcactgccacaagtgccgccattgaggtggacctgactcacccatctggtatcaatcaaagcaagcatcctatcctaccatatggcttgcctccaaactatgcaccatccaatgttgcacatgcgcccgatgagaatgtcgacaattccactcccatacccattgtgagccaaaaaccccagtctagtcatgcacacgtccctcaacccatgggggagacacatgaagtaccccgagaccacactctagccgaattcgagcctcacgtcggatatgccattaaggggcaagcatttggtggcgtacccctgccaaacgctttagggggccctcagtatcgcccacaaccacaactacaacccttacattttacgatgggaagactgcctcctgccatggtggaaagggaaaaatttgatcatatagaagaaaggattaggaccattgaaggaggtggagattacccttttgtcaacatggcgaaactgtgcctagtgcccgatgtcatcatttctccgaagttcaaggtgctggattgcgacagatacaaggggactactttcccaagaatcacttga

SEQ ID NO: 76893 - DNA, 423 bp, Glycine max
  Peptide Sequence Number=SeqID_168578
atgtgcccgcataagttcagcgaggatgaccttattctgaagaaagtgtcgcaggttcagaaggatcatcgagggaaatgggccccaaactatgaaggaccatttatggtgaagaagatggctccgaaaattttttttgctaagagagctacgaaggccactacatgggaaggatccagtgcagccccacaagcggaaattgcatttgatgggcaccacttccgatgcgaggagcatgaatgcctctttgagcctatggcgaaatatgatccagaagtagtcatggagttttacacaaacacttggcccactgaagaaggagtcatggacaagcgctcctgggtgtggggccaatggatcccatatgacacagatgccatcaaccaattcttcgggcatccattggtcttggaagagggataa

SEQ ID NO: 76894 - DNA, 447 bp, Glycine max
  Peptide Sequence Number=SeqID_168579
atggcttctccttcgccgaatttattcagatccctcgagcctcaggctcagagggaaaccatcaaaattgcatgcaaagagaagccactaaaatcacccaacgttcacgtacaccacgatcaccaacaccaatgcaccaaaacgcgcaacaactccatgctcccgaaaaccctaggttgcttcaaatacagcattctcctccccgcgaattcatcgaccggaactctcaattccacctcctcttcctcctccccctccgccaccgccaaccgccgccgtctcctccatcccctgcctccgccggagctgctccctctcggatcaccactcaaaaacactcgccaccgcacagatcgaaaaccccgcaaattacgaaattgcgtgttttatagcaatgaaacaaaactcgcagagaaaaacagcacaggaaatatcaaatcttgttga

SEQ ID NO: 76895 - DNA, 888 bp, Glycine max
  Peptide Sequence Number=SeqID_168580
atgctgaaagccgtggcgccactcttcagccgtagccacaagcagcagtctcggtccttcaaggagtactacgcagagtggttcaacaccctcaagaacaaccacctccccctcctccgccactccatctccggcgactccctcaccattctctccacccacgtcgagatgctccaccagcacttccagtcctactaccacgccctcgacgccgccgccacctccgacgcctcccagctcctctcccaggagtggcgcaactccctcgagaaacccctcctctggctcggcgacctccacccctccctcttcaccaacctcgcccgctccttcctccaagacgaacattcccccgaccacaccgacgacgaagatgattccgatccccaccaccaccaccaccaccaccaccactttcccctccccgaacgcccctggcaggtggcgatggcctggcgcaacccttcggaggctctaactgcccgcatggaccagatcgagtgcggcctccgcgtgattgtaccggccctttcggaccgcctgaaacacgcggaggacgcattcgtgggccgcgtaatggggaactggttccgctgccgtgaccatcatcacaagggcagcggagcctcgtccaaggttgctgtgggggccgatgtgaaggcccacatggaggagctcgtgagcgtgttcctctacgcaaaccgcctcaggaggaacgtgcttgtggacatacttagtgccaccaccgtttaccaggccgcgctgtttcttgaagggttggcccagtttcttattgggttcagggaccatgagttggtgaacgccgttgaacactgcaaggccttgcctctcgcaaacaataaacagtgtcgtcctcgctgccattga

SEQ ID NO: 76896 - DNA, 354 bp, Glycine max
  Peptide Sequence Number=SeqID_168581
atggatcacagcaattcattcgaagagggccttatttggagtgatattatgcagtatttgaaaggtagaaatcagctgttatgggaaggggtgccacttccattccatgcgaaaaaaacagtttcaagggctgagatgttttatgcagattggttattggctcgaaagtttgatggttatattgaaaacggatccacaaccaacatgagtgaaggagatgccagaggtggttttatagcaggcaaagcagcttggagggagaggctattggactgctacaagctttacaatgggttagcaatcttgatccttttccattttacaaactttagagttgagtttgtgaggagataa

SEQ ID NO: 76897 - DNA, 405 bp, Glycine max
  Peptide Sequence Number=SeqID_168582
atgtctagtggtagatctggtgaagaggggttctttagctcaagaacccctattaaagatgctcttacatacaagctaggtactgttgggcattatgatgggattgtaggggcctattggtgccttggctgcatggatggggctattgtttgccctaatggatcaagttcaccaccgtcgtctcaccagattgtgtcgcaacatcgtcgtcgcatcatcgtcctctctgatttgtgcatcgtcgtcttagtagtgagcagggctttgcaatctagaaccaaatggagcaatgacggtgacatcaatccactccactgtccctcctacaccttcatgacgtcaacttcacaaccagctagaaggcgtggtggtgagcacgtcgagatggaaggtggagatgattag

SEQ ID NO: 76898 - DNA, 1212 bp, Glycine max
  Peptide Sequence Number=SeqID_168583
atggcaaagcaaaattttcctatggattgctcctttgtctgcataaccttaatccagttcattgcttcaatgagtttcagcaaatcccagagcctcataaacgaaactaataccagcacaactaccactactactaaggcctttttcatattaggtgactctactgtagattctggcaacaacaactacataaacactattcctgagaacaaagcagattacaagccatatggacaaaatggtttttttcaagaacccactggacgattctcagatggccgtgtcattgtagatttcatagctgaatatgctaatctgccactaattcctccgtttttacaaccaaatgctgattatagtaacggtgccaactttgcttctggtggggccggtgttcttgttgaaaccaatcagggactggtgattgaccttcaaacacaattaagtcactttgaagaagtgagaatattattatcagaaaagcttggagagaagaaggcaaaggaattgatctcagaagcaatttatttctttagcataggaagcaacgattacatgggtggttatctaggtaacccgaaaatgcaagaaagctacaatcctgaacaatatattagaatggtcattggaaacttgacacaggcaatccaaactctatatgagaaaggggctagaaagtttgggttcttaagtttgtctcctttgggttgtttgccagctcttagagctttaaacccggaagccaacaaagatggttgttttgaagcagcttctgctcttgctctagcacataataatgctttgagtaatgtcctcacaagcctcgagcatgtccttgaaggattcatgtactctaactctaatttctatgattggcttcgagaaagaatagatgaccccccaaattatggttttaacgatggagttaatgcttgctgtggaagtggaccttatgggggtgtcttcacttgtgggggtacaaagaaaattaaagagttcagtttatgtgacaatgttggcgattttgtatggtgggattcttttcacccaacagagaagatccatgagcaattcgctaaggcgttatggaatggaccagcttcctcggtagggccatacaatttagaaaacttcttcaacaaagagatcaagctcactattgctgatgtagttgatgccccagaaattcaccatggagaatttcactactga

SEQ ID NO: 76899 - DNA, 185 bp, Glycine max
  Peptide Sequence Number=SeqID_168584
gtactgttactgctagagcaaaggacgtattaacaaagtggaatcgtgtaaaagtaccaactgaaaccttcgagtccaacaaaagtcagtttgtgcctcattggaacccttctccaataggctcgacacgctcaagtgcaatgttgatgcggcattctttgcatacatggggagtttcagtttga

SEQ ID NO: 76900 - DNA, 369 bp, Glycine max
  Peptide Sequence Number=SeqID_168585
atggaaggaaccctaattaaggggccgcctctgcgccccccggttcagctcggcgagatcacagcagaggagctcaaggcctatgatggcaccaatcccgagaaacccttgctcatggccatcaaggcccagatctatgatgtctcccagagcagaattatggttttggtccatgggaaggttatgccattgtttgtaaattttctgcagttctatggtatgtacatagaaatttgtaaatttgttcttctaggtgagaattgtgccgagcaatgtgtgcctgttagagtcattcgtggtcatgaatcttcaagcaattacactggtaaagtatacacatacgatggcttgtacaaggtaattctttga

SEQ ID NO: 76901 - DNA, 651 bp, Glycine max
  Peptide Sequence Number=SeqID_168586
atgtcgacgacgatctcgacggcgatgacagaaagagcgagagggagaccgtcaccgcgaacgttcctctggtcgtcacaggagcgagagagagagacggagagaggaaagacagggataaggatagaaagaggagggataaggataaggataggagagaccgtgatagggacagagagcgcgagagaagagagaaggatatggagtgagagagggaacgagcagagagggagagatccacaaggagcaggagttgctccgagagggacagagacagggagcgagattttgatatgcgcgatgcccgtactcactagtcagctactagtttacttgaaatccgtttccatatccagaattctttttaaagagttgtctatggcggcggtgacacctcttcagacaccttaccttggggccttaggcattcatttggctactctgactcttagatttagccggattcatgatgtaggtattatgttattatatatttccaggagatttagggataaaaaagaggttgcagaacctgaggcagacccagaaagggatctgagaactgtttttgcctaccagatgccgctaaaagcaacagagacaaatgtgtatgagttcttttcaaaaggtggcaaggtcagttgcttttaa

SEQ ID NO: 76902 - DNA, 267 bp, Glycine max
  Peptide Sequence Number=SeqID_168587
atggtgaaaccttctgaagctgaaaagaaccttgttcaatctaatgcttctggtggagcagccggtgtaactggcccctatggagctgtggaccgaaaattgtatgtggggaatcttcacttcaacatgactgagagtcagctgtgggagtcatggagtgattccgtagggaattcagataccgaattatctaaaaatcgcaattatatcattgaagacactgcattcaaagtcggttattacataacaaccgtctttgaatgttga

SEQ ID NO: 76903 - DNA, 219 bp, Glycine max
  Peptide Sequence Number=SeqID_168588
atgggactaatagcaaccccaatgccaagttatttgaaattaatcatgggctcatggcctccaatggcttcgaaggtcaaacttgtggtagcacaaagaccgagactgcttcaccacataagcatgggtattgttgcttctacaaccttcgtttcagattgccccaccaatgatccaaacacacgcttgaacgttgagtttccaacatatatatcatga

SEQ ID NO: 76904 - DNA, 366 bp, Glycine max
  Peptide Sequence Number=SeqID_168589
atggcaagaaatcatcagaagatgggtcaatgtgttgagcatcaatcttccaacaccatccaacaatgcccttatcatagattactactcctctacaagttgatcaatttcagaagaggagggtgtagcttcagctaccttatgtatggacggagggcatgtgacaatcttctcctcaacgtccagtgggagttgcatccagttagtggaaggtcagaattccatgtccaatctcctttgaatgttgtaagcattctcaaaaagaaaggccacaagaaaatgcatccttgcaatgtcatcgacagtgaggttggggtcgatggcgggtggtccttgatgttggaagtggtcaaggtggatgggtga

SEQ ID NO: 76905 - DNA, 1215 bp, Glycine max
  Peptide Sequence Number=SeqID_168590
atggcaaggattcttgacaagattaagtctattgatgggtcaagagagacgcttaaacttgctgtgagaatcacgaatctttggttcgttgggactcctaacaagtctgagcaagcagaaatggttattgttgattctgagggtgatcaaattcatgctatttgtaaagcggaccaactaaagtcttggaaagctgatttgaaggaaaattcaacttatgttatgcataatttcaaagcggtgaagaatgatggtcaatttagagtgtgtgaacatcagtacaagttagtttttaccggagtgactattgttagagaatctgatttgcatcagctgccttttaaggaatttagatttgttgaatttggaaatgtcattggtggaaatttcgaggctggcctgttggttgacattattgagttcgctgatcagttcttagcctatttgaatgaacgtggaaatgatgggccgatcgttattattttgacacatgccagaataaaagatgcgcagggaagttatccaccttcagtgagcaattcgttgaaggcctcaaaattattaattaatgaacctatattggaaatccaggaatttagggagaggattttagatttaggtgttgaggtcagcccagttttggcacctggcgatcaagaaagttcacaactttcaggggcaagccagttatcatcaaaggatgcatttctttcaaaagctgaagccaaaactatttccgagatcaatgccatttctgaggtggtccagtatagagttgaagtaatggttagccagaacaatgacagtagcaagtttttgctctgggaccgtgaatgtactgagttgattggtcaaacagctgatgaagtgaacagggtcaagattgaagatggtgatgttgatttgaatgcttctcctcaagcacttgataggctgttgggttatgtccttgcttttaaggtcaggattcaatcaaaattcaggaatgttgttgttcttagatactcaaatgaattagattttatcaatgttgtgctcgagatgctggctgatactgagacatgttccaaaatagatgcttcgaacgttgattgcaatgatgctacgcatgttaaatgtcaatctctgtctgtgacaacagatcatgatccagttgcaggattccctttaacgccaaaaaaagcctatcatctgatgaagttgatgatgaactag

SEQ ID NO: 76906 - DNA, 177 bp, Glycine max
  Peptide Sequence Number=SeqID_168591
atgacgacctacccctcccccttcctccgcccccctccacgaccctccgtcgccatcgtttgcgatcacgtccaagtatatcaaagatctttagagttcttgtggaggaactcattcttcaccctgaagatctttgatcatcctttattgggagatccacacaaggctaaatcttga

SEQ ID NO: 76907 - DNA, 282 bp, Glycine max
  Peptide Sequence Number=SeqID_168592
atggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggcttccctcgtgcgctctcctgttcctgcctttcggtttaccggtgtcattccgctgttatgggccgcgtttgtctcattccacgcctga

SEQ ID NO: 76908 - DNA, 480 bp, Glycine max
  Peptide Sequence Number=SeqID_168593
atgcaagacaaaattgattgcaacaaaataaatgagataagggaagagagaaatgtaaactcaatttatactggttcgaccacctctcgtgcctacatccagtactcaagcaacccacttgagattttccattatctttgtaaaactccttttacaaagtctaaaccacacaaggacaacccttcccttgtgttcaaaattccttacaacttaagagaccctcggtcctttaaacaagctctttgtataaaaagaataaagaggaattctctcttgaagagaaggatattacaattgaagttcatggatgaactcttaatggatttacaagtgtttgcccaagagtttcttttgagggagcatttggcaatgaagttctcttggaatctctctcattgctttttgaagtttttgataccacttgttggacaaatgtggcctattaatagaatttccctcaggaaatggaaagttagatga

SEQ ID NO: 76909 - DNA, 591 bp, Glycine max
  Peptide Sequence Number=SeqID_168594
atggggacaaatcaaaatggaaaaaggttttatcaagtcaaggttaagggtctagatgtcaccagcctcaaggaattgggacgattgatgggacctctccaaaggcaagccttccgcaaagtgtacgaaaagattctagatttaaccacagcggaggtatttacggaagctgtcgtatccctcgcccaatactatgatcagccgttgaggtgcttcacgtttagggatttcctaatggtaccaactgttgaagagtttgaggaaatattaggatgccctctcgggggaagaaaaccgtatcttttctccgggtttcttccttccttgagtaagattgcagctgtggtcggagattcgtcaaaagagttggaccgcatgaagcaaactcgaaacggcgtagtgggcctgccgcgaaaatacttggaaggcaaggcaagggatatggcgagccaagagaagtggggcccgtttacggatatactagctctgttgatctttggggttgtcctctttccaaatgtggacggtttggtggacttggccgcaattgatgctttccttgcatatcaccatagcaaggagagtttagtg

SEQ ID NO: 76910 - DNA, 259 bp, Glycine max
  Peptide Sequence Number=SeqID_168595
aaaaatcgagtcgaagtgcttccgtaacgcttccgtaagcgatcctgtggagattcttcatcgttcttcgtcgttcttcactgttcttcacccgttcttcgttcgttcttcgttcttcaacggaccacgtcttttccggtttttccgacgttttcctcaaataaacgttggtggcgactccgcgcgtattcctttcttggaacatgcacccgtgagccctcgcgccgccctcccgccgaagggtaggttgcgacagtag

SEQ ID NO: 76911 - DNA, 66 bp, Glycine max
  Peptide Sequence Number=SeqID_168596
atggcacgcagcgtgtttgcttcgtgcccctattttagggacctacatgggagggtgatcgaggcc

SEQ ID NO: 76912 - DNA, 1193 bp, Glycine max
  Peptide Sequence Number=SeqID_168597
ggctacacgccctcgcctttgaagggctacacgccctcaccttcagagggctgcacgccctcgcctttgttgggctacacgtcctcaccttcaaaggactgcacgtcctcaccttcagagggccacacgtcctcaccttaagagggctgcacgcccacgcattcagaggactacacgccctcgccatcagaggactacacgtcctcgcctttagagggctacacgccctcacctttagagggctacacggcctcaccttcagaggactacatgtcctcgccatcaaaggactacacgtcctcgccttcgtagggctacacgccctcaccttcagaggactacacgtcctcgccatcagggggctgcacgccctcaccttcagaggactacacgtcctcgccttcagaggactgcacgtcctcaccttcagaggactgcatgtcctcacctttagaggactccacgtcctcaccttcagagggctacacgtcctcgccttcgtagggctacacgccctctcctttagaggactacatgtcctcgccttcatagggctacaagccctcacaatcagagggctgcatgccctcaccttcagaggactacacgtccttgccttcagaggactgcacgtcctcaccttcagaggactgcacgtcatcaccttcagaggactacacgtcctcaccttcagaggactacacgtcctcgccatcagagggctgcacagcctcaactttagaggactacacgtccttaccttcagagggttgcatgcgctcgccttcatagggctacatgccatcacgttcagagggctacacgccctcgccttcagaggactgcacgtcctctcctttagaggactacatgtcctcgccttcagaggattacacgtcctcgccttcagagggcaacacgccttcatcttcagagggctagacgtcctcaccttcagaggactacacgtcttcgccatcagaggactacacatcctcgccttcagagggctgcacgtccctacctttagaggactgcacgtcctcaccttcggaggactgcacatcctcaccttccgaggatcgcacgtcctcaccgtcagaggtctactcgccctcgcctttagaggactacacgtgctgaccttcagaggactacacgttcttcaccttcagagggctacacgcccttga

SEQ ID NO: 76913 - DNA, 318 bp, Glycine max
  Peptide Sequence Number=SeqID_168598
atgttagccatcatcatcaagtaccaagaagaattaaatttagccaccgcccacgagcacaaagtggcggatgaatacgcccaagtgtacacagaaaaggaggctagaggaagggtgattgactcgttacatcaagaagcaacgatgtggatggaccggtttgctcttactttgaatgggactcaagaacttccccgattactggccaaggccaaagcaatggtagacacctactctgcccccgaggagatccacgggctcctcagctattgtcagcatatgatagacttgatggcccatataattaggagtcgttag

SEQ ID NO: 76914 - DNA, 855 bp, Glycine max
  Peptide Sequence Number=SeqID_168599
ttggaactcttacgtgccgatcaacgtctcattttcgccaaaagttagcccagagcttcccgagtatcaacagagacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatcctccgttatggtagcgctgccgttagcgacccgctcgcagaggaccctcctccgcttccccctcgacggggttgggggggagaagcgagggttccgccggccaccgcggtggtggccgagtgcggcatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 76915 - DNA, 716 bp, Glycine max
  Peptide Sequence Number=SeqID_168600
gactacgcgttctccccttcagaggactccacgtcctcgcctgaagagggcaacacgcactcgcctttagacgaactacatgtcctccccttcagaggactacacgtcctcgccttgagagggctacacgccctcgcgttcagagggctacacgccctcaccttcaaagggctgcacgccatcgccttcagagggctacacgccctcgcctttagaggattacacgtcctcatcttcatagggctacacgccctaacctttagaggactacacctccacgccttcagagggctacatgccctcgccttcagaggactacacgtcctcgccttcagagggctgcacgccctcgccttcgcctatgctcctgggttaggggctagtagtttgcttttatcagttcctaggccaccccctgatattggagggcggccaactgtggatcgcgcccacaagacaccttgtggacctgaagaagtccaacagggccctagggtttccagctccggttatgggcctctgtcagtcctaccggggatcgcgcccacaagacacccagtggacccggagaagtccaacagggtcctggggtttccagctctgattacggacctttgtcagttctatggagtgcctgtcgcccccatcaaggtcatcaggccccttattaatcgggctttcatcaagaagtattgcgccccccaggaaggcgcagg

SEQ ID NO: 76916 - DNA, 303 bp, Glycine max
  Peptide Sequence Number=SeqID_168601
atgcttgggttgaggattggattcccctcaaagaccaatttccagatgggaattcacaccattaggcagatgggaattcacaatgacaagggctgggaatggaaattttcatggagaagactgctttttgacaatgaaattgatacaaccatcaattttcttagggaggtagaaggacaaaccatacagcaacagcaaactgacatttggaagtggctaggagatccatcagggaattactcaactcgcagcgcttacaatctgatatgggaggaaattgttggtggtcagaaggaggattag

SEQ ID NO: 76917 - DNA, 270 bp, Glycine max
  Peptide Sequence Number=SeqID_168602
atgaatatctctaaagatactaacatccctgtaatattgggaaggccattcatgttgaccgcaagttgcatagttgatatggggaagaggaagctagagctaggttttgaagatcagaaaattgattttgatttgttttttgaagacaagcctgctccagaacacaatgtttgcttacagctaagcgagcctagagacccgcttagtgagagttgtaggttttctaatctgcagatctcgctaagcggcagaatcaacgcgctaagctaa

SEQ ID NO: 76918 - DNA, 450 bp, Glycine max
  Peptide Sequence Number=SeqID_168603
atgtgtgttcgagaagaggaaaggttaattatgcaagagggcgaaagggtgaacttaaccgttcatggaaagaagaaaggggatcaacccaaaaacaagggcaagattcctgctcaaccagtcataaagaaagagtccaagtgtttcttatgcaagaagaaaggacacatgaagaaaaactgcttaaagattaagagctggacggacaagaaaggtactccatttgcttttgtttgttatgaatctaatatgggtatggaaaacctaaggaggccagtgggaagtgagcaacacatctattcaggaggcaagatgagctcacatgtggagtccattgggacatgcaatttggttgccaccggggttaaacaatgtgttgtgaatgaggaatcctctatggtgtggcaccgtagattaggacacatctctatcgagagaattaagagattg

SEQ ID NO: 76919 - DNA, 1176 bp, Glycine max
  Peptide Sequence Number=SeqID_168604
atgacaggcgccgtcgatgctgttcagacagagggagtggctactgatgggagcttggggtcacctgttgcagatgtgggatttcccggtggaccacgcaacccatcgattttgaccgattttgctgagcatgtcgcacatagcatctggagtggacaggaacgacccgatctgaagatggtctcccacggtagaaaagtagataaaattgggagaccagcgcctgagatcgaagggttgattgctggcaccagattgagtttactgatcaggcgttctattatcaccactgatcctggactcatatccgccttcgtcgagaggtggcatcgcgagactaacacgttccacctgccagtaggcgagttgacgatcacgttggatgacatggcgtcactcctacaccttcccatcactggcgcgctgcatacgttcaagccgcttgttacttcagacgcaattggtctactgacggagcttcttgaggtcagtcatgaggaggctacatttgagacccgacaggctggtgggcctcatgtccagttggggtggcttcgggacttgtatgagagccaatgcagggccagacgatgggttgtagcagcccgcacgtatctgctccacttgtgggttgtactcttttcgccaacaagagtcaacccatgtacatgtcgtgcacctggaggctttcagggacctggcccaggcaaggggatttgcctggggagcgactacattagtccacattgctggatatacgagcactttcctatagtgcatacatccgtcgtccatgatgcttatgatgacgggagcccacgggcctgcaggtggcttacgggtaaggctcatatgacggggatcaagggagttccgtatcggagacgtttggatgccctgaatgtgactgacgtgtgctggatgccctatgaccatttggtgccttcaggggagctctgtgtagttcctggacaggtggcgccagactacatgaagtggttttttcggatatcgcacccattcatcacgtggaccgaggagactgctacaccgagacatccgcctccccctcatcatgaggagttcgtcgagccacccatccccgaggttttagtcgcgatcaatctccctacgcattcagtggttcactgggaaggatgtcaggggatggcttag

SEQ ID NO: 76920 - DNA, 147 bp, Glycine max
  Peptide Sequence Number=SeqID_168605
atgatacaggtttacaaactagggttagggttagggtttgaagcattggatttcctgatatactgtcgtaaacaaaagtgtcttcgtcgcactggcaaaaggcaaaagtgtctccgaatgagtgacagatttaggggtcaaacttag

SEQ ID NO: 76921 - DNA, 147 bp, Glycine max
  Peptide Sequence Number=SeqID_168606
atgacacatggtcgaccaataggcgaccaagtccaaagcctaaggacacacctagtttctcatgatcctaggaatttaaataaaacaagcgcaagctcgaaaggtagtcatacctcacaaaatatatgtatgtgtgtttatgtatga

SEQ ID NO: 76922 - DNA, 354 bp, Glycine max
  Peptide Sequence Number=SeqID_168607
atgtggctgaaaggggtgaagacccctgtggttttgtctagaaattgtgatgaacgtgctaagcgcgcctgtgcacttagcctattcatcgcaactgttaaaattatggatttccagatgaacgtgctaagcggaccatgtcgcgctaagcgtatggcatctaagaaaaggaaagctccttttacacctacccaagccagatttgatagatctaggttcacatccccagaggcttggcagagatatacagacattgtgatgcctcaaaagctactaccagagaggaatgtggtagtttattacacagagtttgatgagttcaaggaggaactcgagagaagacattgggattag

SEQ ID NO: 76923 - DNA, 180 bp, Glycine max
  Peptide Sequence Number=SeqID_168608
ggggctgttctaagggtcccggatccccctgatgatgtatttcagctttatttggtgaaaaaaattgtttccgtgaagaaaatccaagctgaggtgcttccgagatgtttccgtaagcaaatccgtgaaggttttcctccgttattcaccgttcttcatccgttcttcgttcttcaacgg

SEQ ID NO: 76924 - DNA, 354 bp, Glycine max
  Peptide Sequence Number=SeqID_168609
atggcaatatcctcaaataatcatacaacaaaggcatacatgacatttagcgtgttcgcttcatgcccctattttgtagaagcaaggcttcatggtgaatcaaaagtgattcaaaggtgttttgatgataacaatgatgatgacaaaggtgatgacaaaaagctcaaagatcaatcaaagaacaactcaagtgaatcaagaacaattcaagagttcaagaatcaagaagaattcaagactcaagaagaaagcctagaatcaagaatcaagattcaaggttcaagatctcaaaaatcaagatcaaagattcaagactcaagattcaagaatgaagaaaagactcaatcaagataa

SEQ ID NO: 76925 - DNA, 576 bp, Glycine max
  Peptide Sequence Number=SeqID_168610
atggttggcgacttgcacgcctttcagcccttgcacgtggatgatgcggttcagatgctggtggacttattgatggtctttgcagagtctgtcagggctgagacagcccagtgtcgtgaaccgtacgtacgcctgcaatggtgctggatttacgagcactttccctcagtcacagactccattgctgatcaagaatacgacgaggattccccgcgtgcgtgtaggtggattgcgatgaagaaaactgtgaagagcatacatacatacactaacgtacagggagcgcctggaccgaatccggattctggatgtttgttggatctcagggtcgtgcgacagtttggatacaggcagaccattccttctcctcctgtcgattcatgggtatcatatgatgatatacacgacaggtggatgcactactcggatcatatcgttccagcaggtgaggtgtgcgctatgccagccccgagtcgtcccttagaccccacagacggatatccctcacgtgccggagccaggagcatcgtcgacatctgtggaggagccgagacatgcagtggaagtttgagatga

SEQ ID NO: 76926 - DNA, 389 bp, Glycine max
  Peptide Sequence Number=SeqID_168611
atggacagagccaggttggtttacggcttagtcacgggcatggatatgaatattggagccctaatctcaggtcaaatttctaccatttcccagagtaactcctctaggctcggattcccagccttgatcactgctctatgcagagctagaggagttacctctgacagtctgacctatgagagcttgagcccgaccattaacttggcctatattaagaagaactgttggaatgtggatgatctgacagttaacatcagaggggctaggaaggggaggcaccatccactagggaataagccatggaagaaggagcttcaccaccaagaatgtgccttggataagaagcttgaagaggatgctttaatggaggaaaagaaagagagaagggg

SEQ ID NO: 76927 - DNA, 138 bp, Glycine max
  Peptide Sequence Number=SeqID_168612
atggaggttgaggaaccttggctggggttacgactactattgagttatcgagtagatatgggagcaagggtggcctttgtggttggtttagagatggcctttgtgattgatttggtggtgggtaatgagaagagctga

SEQ ID NO: 76928 - DNA, 87 bp, Glycine max
  Peptide Sequence Number=SeqID_168613
atggctaggagactccaagaagactgggcaagagatgtaggagaaggccctagggttctcatgagccttaggggctccatagtgtag

SEQ ID NO: 76929 - DNA, 462 bp, Glycine max
  Peptide Sequence Number=SeqID_168614
atggagcgccagattgacttgacctttgtggtaaggaggctgagttgtgacacagagcaaccaagtacatggaagaatttgtcgaatacaagagccaagtttgagccaaggctatatcaaccaagaaagagatcaataagcccaactttaacaagactagggaggggggacgaagggatcaactgccccgagaacctcataacgcctattacaccccatagtgctagcaaatctcatatcttggatcaagctttggctactgaaatcctagccatgcccaaaagagctaacactcccccaaaggccaacttctccaaactttatagataccaccctaaccgaggacattcaaccaaggagtgcagcattctaaaagacaagatagaagacctcatcaaagttgggacacctaaaggattttatccacaagcctcattcatatcagcacaacaacaactatag

SEQ ID NO: 76930 - DNA, 360 bp, Glycine max
  Peptide Sequence Number=SeqID_168615
atgggtgaagtagacgaggtgcaagagcagataaaggccaacatagaggctctgaaagagcaaatggccacaatgatggaggccatgatgagcatgaagaagataatggaggtcaatgcggctgtagttgctgctaccagcaccgttgctaaggtggacccgactccctcatttggcctcaaccaaataaatcatccaacctcagatatgataggcagggaggcaaagaattgggaactcccaactatacaccacccaatgtggtgcacactcccaatgagaatgtcagtaactccactcccatatccattgagagccaacaaccccaagctgatcatgcacatgtctctcaacccataa

SEQ ID NO: 76931 - DNA, 976 bp, Glycine max
  Peptide Sequence Number=SeqID_168616
aggacagcatgtcctcgcctttagaggactacatgtgctcccctttagaggactacacgtcctcaccgccagagggctgcacgccctacccttcagagggctgcacgccttcacctttagagaactgcttgtcctcgccttcagagggctacaccccctcgcctttagaggactatacgtcctcatcttaagaggactacacgtcctcatgttcagaggactaccgtcctcgctatcagaggactgcacaggactacacgtcctcgccatcaaaggactacacgtccttacctttagagggctgcacgccctcgcctttagaggactacacgtcctcgcctttagagggctacatgccctcgccttgaaagagcttcacgctatcgccttcagagggctacacgccctcgctcttagaggactccacgtccttggctttagaggactgcatgtcctcgcctttagaggactacatctcctcccctttagaggactacacgtcctcgccatcagagtgctgcacgccctcccctttagagggctgcacgccctcgcctttgaggactacacggttgcacgtcctcgccttcatagggctacacgcctttaccttcagaggactatacgtcttcgccttcaaagggctacacgccctcatcttcagagggctacatgtcttcgccttcagagggctacacgccctcgctttcagaggactataagtcctcatcttcagaggactacatgtcctcaccttcagaggactacacgtcctcgccatcagaggactacacatcctcgccatcagagggctatacgccttcgcgttcagaggactccacgtcctcgccttcagaggactgcatgtccacgccttcagagggctacacgccttcgccttcagaggacaacacgtccaccccttttgaggactacacgtcctcgtaatcaaaggactacatgtccttacctttag

SEQ ID NO: 76932 - DNA, 426 bp, Glycine max
  Peptide Sequence Number=SeqID_168617
atgattcttgacccacggatgaagcttgaagcactttggttttactattcaaagcttgatgcttctacttgtgatgaaaagattaataacataaaagagaagatgtacaagctctttgatgaatatgtgattgtaaagtcaagttcatctactgcatcaagttctcaacaacctactgttgaagaagatttcagtatagaagaaaatcaagagatggatgatccatataatgaatatatcaattatgtgagtcaaaatgttggtgctcgtgtgctaaacaagtatcacgctagtcttcttccttccaatgttcaagcactaattttaacccaaaattggataaatggttttgaagatattgatgaaattaatggtgatgttgagaaagaagaggaagttgttttggatttcgcagtccatccatga

SEQ ID NO: 76933 - DNA, 156 bp, Glycine max
  Peptide Sequence Number=SeqID_168618
atggaccgtaaaagaataaaggtgattcctgagtggcctactccaccaagtgttgtggaaagaatccatgagtttcaagaacctctggatttgaggtcaaatccttttcaagggggagggaatgatgcaatcctaccccctaagggcattggatag

SEQ ID NO: 76934 - DNA, 270 bp, Glycine max
  Peptide Sequence Number=SeqID_168619
atggtggcgactccgcgtgtattcctttcttggaagatgcacccgcgagccccgcgtcgccctcccgccgaaggtccctatgctacaaagcttattccaaggacagtttattatcatgcacagcctgtgtcgcaacgtgcccttttgcgggcgagcgaaggcgaggctcacgggtgcgcttttcatttaaggaggaaaggtgcgcggagtcgccaccaacgtttatttgtggaaaacgtcgaaaaaaccgaaggaaactggtcaaaatga

SEQ ID NO: 76935 - DNA, 894 bp, Glycine max
  Peptide Sequence Number=SeqID_168620
atgaagaaaggggcattgattctccaacacaggctgaagagattgacacaagggctccattccaatcagttatacgcaccttcatggaagcatcatattacagaaccaaaaacacctttactccaaacttcactaagagcccacccacccaaagtgaaaacctcattagaattagagcaagaggagcttgagaagatccctaaattcaaggcaatacctctaaataagaagatctttgaaagtaaaggggatattggagtattctgccttaccaagaaacatgttagcgaacctcaagaatttcactttgccacagacgaaaggattccgccacctgctgccatggctgatttatttggcaagctttctttgaattctgaaccttcacgtaatcacaacccaatcccaagaaacacgactccaaatccgtttcatcttcacacagagaaaagaggtgctgagaaagagaagaagctggccatggaccttctgcagaaacagtgggaagaggaaaacgcaaggattcccaaggctaatccatacccttacaccactgattaccctgtgatcccagcaaaaccagaaccaaagcaatgcacaagaccaaagccattccaattggagagcctgggacccaatccccgttccgagaaggtccgcaaacccctaacccaagttcaggaatttagtttacatgtgaatcattgggcagtggatacagcacaatttgatgaaaggaatacagaaaaggaaatgatgtacaaacgatacagagaagagagtgaagcaacaacaatgatagaggaagagaaagagttgaaacagatgagaaggacaatggttccacatgctaggccaggtcctaataacatgcaagatctacccgaaatatag

SEQ ID NO: 76936 - DNA, 225 bp, Glycine max
  Peptide Sequence Number=SeqID_168621
atgactccccttatgcctatatgctctaccaatgcatgcacagttcatcacctatttgattcatgcaatgtttactatgttatctcaatgatatttaaagcattggtgatccttgtttactcatacagaaaatgtgattctcagtcatcatcatttgaagttaatgaagacgtgaaatcacaagcaatggccaagaatttagagacaaactcagagcctggctaa

SEQ ID NO: 76937 - DNA, 1206 bp, Glycine max
  Peptide Sequence Number=SeqID_168622
atgatgattggatgtggaataacctggatgttgtggaagcttaggaggattgatggggacccgacattgagaggaacgaggataagggctacgtgggagtacgtgagctcagttggaggtgggcaacaggggatgggtgagacttcctgcttttattcgttgaccatagagtggtacctggagatatgtcgcgggggtcaggagaccttggggacgcgagctcctggcagtcaacaaataaaaggaacaaagaccacaaagctaggaggcttgcttaaaaatgaagacaggagactaagatggtctctggtaatcgattaccaaggggtgcagcatgttttggaggcctctggtaatcgattaccaggctgtgtaatcgattacacagaggaacatgtcattggtaatcgattaccagttaggctgtgtaatcgattaccagagatgaaaagcctaaagataccccttttacttgcatgtagtggttatgagatgcattgtgttgctaccgcaatcgtgatggcggcgcagctaatccatgatcgagtggagatggagtgcctagagggagcttggaagaccctcaaaggcaacacgaggtgccgatttcggggcacgattcgatttacagctacttcattggtgcatccagatgaacccgcgcacacgcttcagcgcactgtggagtggatactacccacgcctacaccataccgtctagtggagccagtccacgtgattgaggtgacgtcatccgaggaagaccctgaggaggaccctgaggaactacctcccgagcctgctgtggatgctcttgactttctagagggtgatgaggacccactccccgaggtggattctcccgaggacgtcatgtcagcatctgaggcagactctatggaggatagtggccctggagagatggcgattagtggaggctcttcatcatacaaatatttagaggttatgagtgatcagaaagaaatgactccgaatagagttgtgaactggccattcaggactctatatcattattttggggacgccacagggacaacccatcccttgtgttcaggaatccttacaactcaagagaccctcggtcccttaatcccttttcagaatgtttgcccaagagttcttgagagggcatttggcaatgaagttctcttggaatctctctcattttcttttgagagaggataa

SEQ ID NO: 76938 - DNA, 237 bp, Glycine max
  Peptide Sequence Number=SeqID_168623
atggagttgatgatttcattcgagttgcaaatgaatcagggcacattcccagtccatgtgcaaaatgtaggaagcgttatagatgaagggaaacaaaagaaagcaagaaaggtgatgtttgactttattagatcctttttccctcaatcctcaaaaagcatggaaataaaattagaagcttccaatgtgaaatgcagtattctaatctataaccaagatgacacaatctcaccttaa

SEQ ID NO: 76939 - DNA, 183 bp, Glycine max
  Peptide Sequence Number=SeqID_168624
atggaaaagatcgatggtctgcgtattttgaaaatgaaggttcgggagtttttcactcatggggaagttgaattttattttaatggtgattatgtgatattacggtatgaacgatcggtcgaaacacactttaaacaaagaaaaagatcaccggtgatcaaagaaggagatgaagatgcataa

SEQ ID NO: 76940 - DNA, 522 bp, Glycine max
  Peptide Sequence Number=SeqID_168625
atgtggttgacaaaaggatgtcgacggacaatccttgctggatggtgcatgtgggagagactcagatcatttgtagtgttgcctgtacgtcgagggtgtcattccccttgggtgcgttcaggaaaggtgtgggaggattgctcgtcgttgtggggacgtctaacacaagcctttagttggtcatggtcagtctttagctttgtcaactcttcctcgtggcgtcgctccatctctgcaatgcaattttggagttgttgtagaatgcatgtgtctgtcatagatgccgaacaaggatgggagtctgtgaggggggtctcgtgtctgaggtcagaccgagtcctaaccatggatgaatgtgagaggattgacaagaagtcgtggggtattttttaccggggccccatggtgggatggacgtggttgagtggggtccctaacttcacacgccgacttggagaggtgcctttgacaggagagcagacctgcaaaacaaaggactccgatgctcaagtaagaatatga

SEQ ID NO: 76941 - DNA, 357 bp, Glycine max
  Peptide Sequence Number=SeqID_168626
atggcttcctatggtgtggcatctccattcatctttctccttctccattccactgcaatcagacctcaagaagcaaaggaatccattgatgaagaagatccaaggcctacaagctccacatggagttacatcaaagcccccaaagtcactgccacccagaccgatggtagaatcagacagaaaggaagacattatggtggatggaagtaccttgggaagttggaggaagaagaaggggaaaccaaaaatctagaaagcacaaaatcaagcaagaaagcatggaaacaagaaggcaatgaacagttacccgaaatcaaacgcccactccatttaaaggggagacagactcttcaataa

SEQ ID NO: 76942 - DNA, 270 bp, Glycine max
  Peptide Sequence Number=SeqID_168627
tggattaggaaacaatatttaccaccacctattcctgacgagcgtactcggtcttctcctccacagagagatgcttcctctactcttatgcatgaagtcctttctgagctacgtggccttcgagcgttcgtaggtgaccatttggatgccatggatagttgcctggatgccatggatgcttgttttgaaggcatggatacatggatgactcagcttgaagacgacatgggtttcattcatcgttgcttcaatccaccagctgccccatag

SEQ ID NO: 76943 - DNA, 282 bp, Glycine max
  Peptide Sequence Number=SeqID_168628
atggaggccatgaaagagcaaatgaccacaatgatggaagccatgatgagtataagaaaaatgatagaggtcaacatggctacattcgttgccacaagtaccaccactgaggtggacccgactcacccatctggcctcaaccaagtaaattgcccagcctcaaatatggtagctcagggaggcaaagcattgggaagtacgggcagcccccattttgtgcaagtccagagcaagcattttttcccaccatatggtttacctcctaacaatacaccacccaat

SEQ ID NO: 76944 - DNA, 240 bp, Glycine max
  Peptide Sequence Number=SeqID_168629
atgagcgcgagtgacaccatgagcgacagtgacgacattggtttcaacaccatgagagtgagagtgagagtgacaaagggatttagaggagttgactccgaagctggctctgtaactcagcaaaaggaaggatatgagaaatccaagtcttttaaggacgtaattcctcttgaaagttcccgtgcaagcaataggtacaaggcaacaatgttgaacaggaagttgaaggcagagttttaa

SEQ ID NO: 76945 - DNA, 171 bp, Glycine max
  Peptide Sequence Number=SeqID_168630
atgagaggatgcacctttggtttttcgccttgccttcctgccgaagggtacattaagggactatcccaacctacccttcggcagaaaggcgaggcgagatacaatggtgcgtcttccaaaaaggagaacgcgacggagttgccactaacatttattcgaggaaaacgctag

SEQ ID NO: 76946 - DNA, 159 bp, Glycine max
  Peptide Sequence Number=SeqID_168631
atgtgcggagtcgccaccaatgtttatttgtggaaaacgtcgggaaaaccgaaggtcgacaaaagcggggcttttgctcctacgtaccctcctttggagaggaaatcagacctacgtagttctttcttaagagtgaatcaagcgattctttttacttga

SEQ ID NO: 76947 - DNA, 312 bp, Glycine max
  Peptide Sequence Number=SeqID_168632
atggctggcatacttttatttttgaaaaagcaacatattttaaatgttatgtgggatcagaaagaaatgactccgaatagagttggacgccacaacagcttgatagctaagaaggacttcgtggttggagagaaagttttattgtataactctaggctcgaactcatgagtgttgagatcaaaagtgaatccacagataagagcttcaaggtcaatggacaccggctgaaaccattcctcacaaatccttccttggtggatgtagtggtgaaggagaccttcttacttcaccctacttctcttccgccatga

SEQ ID NO: 76948 - DNA, 345 bp, Glycine max
  Peptide Sequence Number=SeqID_168633
atggcagcgcagttaatccatgatcgcgtggtgatggagtgcctagagggagtttgggagaccctcgaagtacatccgaaggaacccgcacacacacttcagcagcctgtggagtggatactacctacacctactccttatcgactagtggagccagttcaagtgatagaggtgtcatcctctgaagaggatcttgaagaggacccagaggagttacctcctgaacctgctatggatgatcttgacttacctgaggatgatgaagacccgctccttgatgttgattttccagaggatatcatgtcagcatctgaggcagactccacagaggagagcggcccttga

SEQ ID NO: 76949 - DNA, 1332 bp, Glycine max
  Peptide Sequence Number=SeqID_168634
atggattcacttaaaaccctgtatcacgcgcatatctcaacgctgcagcagcgtgcgcaacaggtgctggcgcgctttaagctggacgccatgctgattcattcaggcgagttgctgaccgtatttcttgacgatcatgactatccgtttaaggtgaatccccagtttaaagcctgggtaccagtgacccaggtgcccaactgctggctgtggatcgatggcgtgaataaacccaaactgtggttctactcgccggtcgattactggcacaacgtcgagccactgccggacagcttctggacccaggatgttgaggtcatcggcctgaaaaacgctaacgatatcgctcagctgttgccggcacagcgcgacaatgtggcctatatcgggccggtaccgtctcgcgccatccagctgggcatccgcagcgaggggatcaatcctcagggcgtcatcgactttctgcattatcatcgcagcatcaaaaccgattacgagctggcctgtatgcgcgaagcgcagaagctggcggtggcaggccatcgcgcagcgaaagaggcgttcttatccggcatgagcgagtttgatatcaatcttgcctatctgaccgccaccggccaccgtgacattgatgtaccgtatggcaatatcatcgcgctgaatgaacatgctgcggtgctgcactacacccggcttgatcaccagccgccggcgaaacgtcacagcttcctgatagatgccggcgcagagtatcttggctatgcggcagacctgacgcgcagttacgcggcgcagagcaaaacgcgctacgcggaaatggttgctgcgatgaataaagaagagctggcgctgatcgccacgctgaaagccggcgtgcgctataccgattaccatctgcaaatgcatcagcgcatcgcgcgtctgctgctgaagtttgaactggtgcaggggctgagcgaagagacgctggtggcggaaaatctcaccgggccgtttatgccgcacggcctcggccatccgctcggcctgcaggtgcacgacgttgccgggtttatgcaggacgacagcggcacgcatctggcggcgccatcgcagtatccttatctgcgctgtacgcgggtgctgcagccgggcatggtgctgaccattgaaccgggcttctatattatcgattcactgctggcgccgctgcgcagcggtaagttcagtcagcactttgactggcaggcgattgatgccctgaagccgtacgggggcattcgtatcgaggataatgtggtgattcacgccagccgcatcgaaaacatgacgcgtgacttgcatctggcctga

SEQ ID NO: 76950 - DNA, 483 bp, Glycine max
  Peptide Sequence Number=SeqID_168635
atgactttccaatcttttgaagtagtaagcatcgcctccatagattccctctctaggcagcctcgcctgttcgatgcggcaatgatggtggcccgggtaatgctggggcacgactacgagcccggaatgggtttgggcaagaacaacagcggcaggaccagcctggtaagcaccagaggaaactgcgagaagtttgggttagactataaacctacgcagactgacataaggaaaaatatctcagaaaggaagaacaaaggccagggcccgcggttgggacagcgagccaaagaggccctgccaggccacatcagcaggagcttcatatgtgcgggtttaagacgcgaaggtcgagttgctgcgatatacaatgatgactccccgacgagatcggatttggtacggctatgccttcccggtttccaactaggaaattggcgggtggaggaacgcccggacgtttacgcgaaaagcataatgtaa

SEQ ID NO: 76951 - DNA, 282 bp, Glycine max
  Peptide Sequence Number=SeqID_168636
atgcctttagcaatttacacctttggatatggtagcaagatgcttggatttgtgtacatgaggttgcatgtcgtttttgctttgaaggaaatggccccaaggaagcttgcctcaaagagatccaggaaagacaaggtggttgaaggaactagttctgctcttgaatatgacagccatcgttttaggagcgctgagcaccagcagcgcttcgaagccatcaaaggatggtcattccttcgggagagacgcgtccagctcaagacgttaaagaagcgctactag

SEQ ID NO: 76952 - DNA, 597 bp, Glycine max
  Peptide Sequence Number=SeqID_168637
atggaggccataaaagagcaaatggccacaatgatgaaggccatgatgagcatgaagaagataatggaagccaatgcggttatagttgccgctattagcgctgtcgctaaggtgaacccgatgctcccatctggcctcaagcaaatgaatcatccaacctcaaatatggtaggcaaagatttcggaagtacggatgatcccatgatgtgcaaattcaaaacgagtacgccttcccatcatatggcttgcctcccaactatacaccacccaatgtggcatacactctcaatgaaaatctcaataactccactccgatactcattgagaaccaataacctcattgatcaggcacatatctctcaaaccatgggggagacacatgaaattccccaccacaatctagctgactttgagccttggctcggatatgccactgaagggcaagcagttggtggtatatcctttgaaaacactttggagggccctcagtttcgcccacaaccacaaccattgcattttgcggtgggaagagcccctcctgctatggccgaaaaagggaaaggcggatcatctaaaggaaaggctcagggccattga

SEQ ID NO: 76953 - DNA, 2130 bp, Glycine max
  Peptide Sequence Number=SeqID_168638
atggtcgacggtgacggcaatttccagctgctggaagttaacacctcgcctggcatgaccagccacagcctggtgccgatggcggcgaagcaggcgggatacagcttcccgcaactggcggcactgcgcgttagaaatcgcgaacctcaggagcgtgcgcgctccggacggagcaacggggcacggctgtttggcatcgtgttcctgctgctggtgatgggcatcatggtggctggcggcctcgtggtgctgaagtggatgaatgatgcgtcgcgtctgccgctgtcgaagctggtggtgacgggcgaaacccactacaccacgcacgatgatattcgtcaggcgattttatcgctcggcgcgccgggaacgttcatgtcgcagaacgtggatattatccagcagcagatcgagcgtttaccgtggattaaacaggttagcgtgcgcaagcagtggcctgatgagctgaagataaacctggtggagtacgtcccggtggcacgctggaatgactcgcacatggtggacgccgatggcgtctccttcagcgtcccggccagccacatcggcaaagagacgttgccgatgctgtatgggccggaaggcagtgagaaagaggtattggccggctatcacaccatgagtgatgtgctgcgggccagtaagtttaccctgaaggtcgcgtcgatgacggcgcggcgctcgtggcagctggtgaccagtgacgatgtgcgcatcgaactggggcgcagcgacaccatgaagcgtctgaaccgttttattgagctctatccggagttgcagcagcagggccagagtcagaaccagcgcatcagctatgttgatctacgctatgactccggcgccgcagtaggctgggcaccggcaccgattgagccacaggacagacttgaaatcggcactgcgaaggtcgccgccctggttggggaaattctgcccgatggtatggtcaacattattggcgtcggcagctgcccgtcccgcggtatggacaaaggcggcgtgaacgatctggagtcggtggtgaagtgcgttcagcgcgccatcgaccaggcggaattgatggcagactgccagatttcgtcggtataccttgctttatcgggcaaacatattagttgtcagaacgaaatcgggatggttccgatttccgaagaggaagtcactcaggatgatgtggaaaacgtggtgcatacggcgaaatccgttcgcgtgcgcgacgaacatcgtattctgcatgtgattccacaggaatacgccatcgattatcaggaaggcatcaaaaatccggttggcctttccggcgtgcgtatgcaggccaaggtgcatctcatcacctgccacaacgatatggcaaaaaatatcgtgaaagccgttgaacgttgtggcctgaaagttgaccaactgatttttgccggactggcatccagtttttcggtgctgaccgaagatgaacgtgagctgggagtctgtgttgttgacatcggtggcggtacaatggatatcgcggtgtacaccggcggcgcgctgcgtcataccaaagtgattccctatgccgggaacgtggtgaccagcgacatcgcctatgcctttggcacaccgccaaccgacgccgaagcgattaaagtgcgtcatggttgtgcgctgggtttgatcgtaggcaaagacgaaaacgtcgaggtgccgagcgtgggtggacgtccgccgcgcagcctgcagcgccagacgctggcagaagtgattgagccgcgttacaccgaactgctgaatctggtgaacgacgagattctgcaactgcaggagcaactgcgccagcagggcgttaagcaccatctggcagccggtattgtgctgaccggcggtgcggcgcagattgaaggtctggcggcctgtgcacagcgggtgttccacacccaggtgcgcatcggtcagccgcttaacatcaccggcctgacggattatgcgcaggagccgtactactcgacggcggttggcctgctgcattacggcaaagagtcacacatgaacggtgatgcagaaacggaaaaacgtgcttcagtgggcaattggtttaaacgcatcaacagctggctgaagaaagagttttaa

SEQ ID NO: 76954 - DNA, 111 bp, Glycine max
  Peptide Sequence Number=SeqID_168639
atggcgcgcctccgtgttcagagccggctgcagctgatctcagccagcttgcgggcaatttgccgatgtgccggcgcctgcacaatcaccagatcgtcgccgacagcagcg

SEQ ID NO: 76955 - DNA, 174 bp, Glycine max
  Peptide Sequence Number=SeqID_168640
atggcttacgaacggggcggagatttcctggaagatgccaggaagatacttaacagggaagcgtttccccctggcggctccctcgtgcgctctcctgttctgccttcggtttaccggtgtcattccgctgttatggccgcgttgtctcattccacgcctgacactcagttccgg

SEQ ID NO: 76956 - DNA, 270 bp, Glycine max
  Peptide Sequence Number=SeqID_168641
atgtcggataatctagcaagagcttctagcgcaagggagtaccagatagagcttcaacaatcttccatgtcactcggaaggcagatcaaggtagatgaaccaataccagatgcttcaagccgtttggggattgacaatggaagttggtcattctcttcccttcctggttctatgtccggtatcaagcgagagagaatagcagaataccgatccgctacatatgaagcaaagccggccttgcctgttgaacttatctcatcccgggattga

SEQ ID NO: 76957 - DNA, 75 bp, Glycine max
  Peptide Sequence Number=SeqID_168642
atggaattggccgtatggatcaaacttagaatcgaaagcgatgctcttgccgcaagtaacaacaaggagaaatga

SEQ ID NO: 76958 - DNA, 226 bp, Glycine max
  Peptide Sequence Number=SeqID_168643
atggatgaaatagagaaggtgcaagagcagatgaaggccgacccggaggccttgaaagagcaaatggtaggcaaagatttgggaacccctcctgctatggctgaaaagggaaaggtggatcatctaaaggaaaggctcagggccattgaaggaggtgaagattatgcctttgctaacctagaagagttgttcctaatacccaaacatggtcattcccaagttcaag

SEQ ID NO: 76959 - DNA, 384 bp, Glycine max
  Peptide Sequence Number=SeqID_168644
ggcgcagaagacgacgttagtctctgcgtgctatcaggcttttcgtctttagacagcaaaaagaatgtttatacggataaccactcgggtatttccgcccgtcaacgtgactcaaatgtcagtatgacagatcttgtgagcgcggaagatgatgcttttcgtcttaacagaagcaaaaaggtttatacggataaccactcgagtatttccgcccgtcagcgtgactcaaatgtcaatatgacagatcttgtgagcgcggaagatgacgcttttcgtcttacagacagcaaaaagaatgtttatacggataaccactcgggtatttccgcccgtcaacgtgactcaaatgtcagtatgacagatcttgtgagcgcgaaagatgac

SEQ ID NO: 76960 - DNA, 87 bp, Glycine max
  Peptide Sequence Number=SeqID_168645
atggaggaatctggaatattcttcatggaagacgcacccatgagcctcgcctcgctcacctgcgaaagggaaattgtggaattgtga

SEQ ID NO: 76961 - DNA, 309 bp, Glycine max
  Peptide Sequence Number=SeqID_168646
atggccacaatgatggaggccaatatgagcatgaaggagataatggaggtcaatgtggctacattgctgagttggtggtatacccctgcaaaacactttggaaggccctcagtatcacccacaactgcaccccttgcattccacacccggttaaaaccctcatggtatggcagaaatgggaaagttggatcatctagaggaaaggctcagtccattgaaagaggcgtagattatgcctttgctagcctagaagagttgttcctagtacccaaacatggtcattcccaagttcaaggtgccagactttga

SEQ ID NO: 76962 - DNA, 905 bp, Glycine max
  Peptide Sequence Number=SeqID_168647
atggccaatcaaggagattgggtcccgtttatggatgtgttagctttgctaatttttggggtcgtcctctttccaaacgtggatggtttggtggacctagcagcaatcgacgctttccttgcataccaccatagcaaggaaagtccggtggtagctgtcttggcagatctatttgacacatttgaccgaaggtgcgaaaagagtggcacacggatcatctgttgcttgcccgccctctgtgtttggttggtttcgcacttgttccaagaagacactaggcatccatgtccgctcctgagccatcgctcgtgtactgaaaagaggagaatagattgggaccagcttttggccgggataggaggtagaacaatcagttggttcccccgatggaaggaaggaaaagaaggagtccttttctcatgtggaagatacccaaacattccgctggcatgggaaaccccgttaaggaaagatcaagagcttagaggtattcgtaatggcatcattggtgggtaccacgaatggctgaaagctcatatacgaggtttagattggctcgccaagttaaaagtcgtcagcgaagagagttttgaagcaccggaagaggacgaagaagtccaaactctcaaaagcgagttaggaaaggcaaaacttgccaaggagaagttcaagttggccgctacacacgttcggaaggagtgtgccgggttacgggaagagaatgcaattaccgcaagagcccttgaacaagaaaccaagagggctcgcaaggaagagtatggccggaacaaatttcgcggagctctatggggtagcaatagtgaactcaagttgcgaagggaagaaagagaccagtcgcgggcacatagcatggttctgaaagaggagttaattgcttgttcaag

SEQ ID NO: 76963 - DNA, 219 bp, Glycine max
  Peptide Sequence Number=SeqID_168648
atgagggatctttatgaggaagggttcataccaaattattattggtggataaaccacagtgaagagttatcacaatttcctcccgtagtgttgcaaggttcatactacgaaagtggtgagcatagggaagaattgaatccttatgagcaaatgatcatagatcatgctcgaccatcaattggccaatacatagaacaagagggtgtaattgagacataa

SEQ ID NO: 76964 - DNA, 1027 bp, Glycine max
  Peptide Sequence Number=SeqID_168649
atgcacacagctctggttgctggttgggccggttcgatggctctatatgaattagcagtttttgatccctctgaccctgttcttgacccaatgtggagacagggtatgttcgttatacctttcatgactcgtttaggaataaccaattcgtggggcggttggaatatcacaggagggactataacgaatccgggtatttggagttacgaaggggtggcttgttttggttttggcgcatttcatgtaacaggattgtatggtcctggaatatgggtgtccgatccttatggactaactggaaggatacaatccgtaatcccgcgtgggcgtggaagtgtgcgtccaccccaacgtctatataaaggattacggatgggaaatattgaaactgtcctttccagcagtattgctgctgtcttttttgcagcttttgtcgttgctggaactatgtggtatggttcagcaacaacccctattgaattattcggtcctactcgttatcaatgggatcagggatactttcagcaagaaatatatcgaagagttggtgctggactagccgaaaatcaaagtttatcagaagcttggtctaaaattcccgaaaaattagctttttatgattatatcggaaataatccagcaaaaggggggttatttagagcaggttcaatggacaatggagatggaatagccgtcggttggttaggacatcctgtctttagagataaagaggggcatgaactttttgtacgtcgtatgcctactttttttgaaacatttccggttgttttggtagatggggatggaattgttagggccgatgttccttttcgaagggcagaatctaaatatagtgtggaacaagtaggtgtaattgttgagttctatggtggcgagcttaatggagtcagttatagcgatcccgctactgtgaaaaaatatgctagacgtgctcaattgggtgaaatttttgaattagatcgtgctactttgaaatcagatggtgtttttcgtagcagtccgaggg

SEQ ID NO: 76965 - DNA, 1116 bp, Glycine max
  Peptide Sequence Number=SeqID_168650
atgataaatttccggacaacgagtgtcgccacggccctgtcgtgtccgaccagctttacgccgtcgcaggcgttccaggttcctgtgccgatccagaagccggcggtttccaccgacaatgtcgtgcaggtgcaatatcgcgaatgggaccgtcgacatgatcgccgtcacggcgaccgcatgtatcgcccgcgcccgccgcgtgacggctattataatggccaccgtggttaccgcgaccgccgtccgggttaccgttatcataacggctactggttcccgcttgccgctttcgccaccggcgccatcatcggcggcgcgattcagcaaccccgtccggcctatggcggtagccatgtatcctggtgtcagaatcgctggcgctcgtatcgtgcctacgacaacacctaccagcccaacagcggtccgcgtcgcatttgcgtatcgccttacagccggttcagccacacgtccctaggctgtagaagtatacgacaccgcccggacaaaggcggaatagaacaacagaaattcacgtcttacggcctgtcgaccgtcgtgaatggaggaagtcagatgaaaagctatgtgaatcctggctgtcggtctgcaatcgtggattcgtgcgcgcttcagcacgaaccaggcgagtgcaaccgaaatcacgatgaagatgctggccgacagcgtgccgccggtgccgacggtaaacggcagttcatccgtattcatgccgaagaaaccggtcaccagcgatggcggcagcaggaatgccgtcatcagcgacaggatataaaggtgccggttggtttcggacgagagtttggaatcgatttcttcgtgcagcagccttgcacgctcctgcagggcatagacgtcatgatcgacagcctcaaggcgccccatcaggccccgccgcatcagcgtcagcacggtgcgcagatgccggtgcaggcgaaccaccgtgcggcgcagcggggcgagccgccgccgttcgtcgcgtgtctcgctgtcatagacgagatcctcgatggcgttcagttcctccgtcgtctccatcaccagattgatgagcgagcgctggaattcggcgacgaggccttcgaacacatgtga

SEQ ID NO: 76966 - DNA, 161 bp, Glycine max
  Peptide Sequence Number=SeqID_168651
ttgaagaagtggggggacattgtcatgaaattggtggagtggcctatgggatatggatcaagttgaagaagtcagagaccttagtatggctggactttgtggagtgtcctaaggttcaagatgaaaaaatggaggagcttgacatggacttgatggagtag

SEQ ID NO: 76967 - DNA, 244 bp, Glycine max
  Peptide Sequence Number=SeqID_168652
atatccaattgtaagaccacctgcaatcatccaatttagagcagcttttgatgaggacatgaccaagagcaagggcaaggatccacttgaaggacttggaggacctatgacaagggctagagcaaggaaagccaaggaagctcttcaacaagtgctgtccatactatttgaatacaagcccaagtttcaaggagaaaagtccaaggttgtgagttgtatcatggcccaaatggaggaggactaa

SEQ ID NO: 76968 - DNA, 201 bp, Glycine max
  Peptide Sequence Number=SeqID_168653
atggtgaagaaaccaactcgcctgggcgagttcattgcttcagcactaagtttcagcttgcttgggcgagctgcctttgccccaagtgcccattttcttataaataggcgtgctagggaggctgagaaagggtttcaaggttcagaagttggggaaattgagagaagacagaaagaagaagaagaaagaagaggaaactaa

SEQ ID NO: 76969 - DNA, 372 bp, Glycine max
  Peptide Sequence Number=SeqID_168654
atggcgcctactaggcaccctttggaccccggagaagtccaacagagccctgggtttccggctttgatcacaagcctctgccagttctacggagtgcatgtcacccccagcaaggcggccaaccaccatggacaggtgcatatacatgagtgtctctaccagttcagcctcagccagcatgggcagggtttcgccccttttgtatgccctaccccggagcagtttggggctgaggtcgcatggcctggagactggcccgatgcccagacaggggaggagcctgcagaatcccccgatgagacggatgaaccccatatggacaaggatatgactgacctactcggtttcttgggagggagcggagccacatga

SEQ ID NO: 76970 - DNA, 749 bp, Glycine max
  Peptide Sequence Number=SeqID_168655
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttccattgcatttgcaagggtcagcccatgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 76971 - DNA, 489 bp, Glycine max
  Peptide Sequence Number=SeqID_168656
atggctgtgatggaaaaaggacatttcattaaaaaaaatagggagggggaatactcaggtgaccaacagttacattttcttttgtcacaggtagatgagaatagattcagtggatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 76972 - DNA, 897 bp, Glycine max
  Peptide Sequence Number=SeqID_168657
gtcttcaagctatggtcttgtcaagaatggagttcttatagagatgatgacatgaggaaggcaaactttgtgaaagagaagattgtgaatgatgattggtgggataagatagactacatcattgatttcacaagaccaatctatgacatgattcgggtttgtgaaaccgataggtcatgccttcacttggtgtatgagatgtgggattccatgattgagaagactgagaaattaccccagagtgccataactcaaactgatacagagaatgctgaacaagacgggaagggtaaggttccgaaagggaacacgggttggcctttgcttggagagacccttgagttcattgcttgtgactgcacctccaaccctgtcagcttcatggaaaagcacaagtctcttgtgctttgtcgccttgacttctgtgactggtctctctctctctcttctcacgctcacaccctccttcactcttcacacaatttcaaaatccctaatctatcctttatgttgcattcttctcacatgtgtgtgtttggcgttccgcatttggctgtgtgtgagatgaggaagaaaatcatagatccttcctctgggaagaagttttgttctctcgacgtgacgacgttgagatcggagagctacaaaactaatggatttgagtttcagcacgaggctgagtctattgcttttgatactgagtgtgtaacttctggaagttcctctggagaaggaattcatggttctcgaggactcgtggttccagcgaggttctggcaagagcataataaccgtatacggcgccaaacggaaactccgagttttgatattagttccattttagcgtatgatcacgaacaccagtgttattttaacttagtagataaaggttattaa

SEQ ID NO: 76973 - DNA, 1110 bp, Glycine max
  Peptide Sequence Number=SeqID_168658
atggttaagactagaggattagaccatgcgttaggtagggttggtgccaggggtctgggtaaaggaggggatggtgatgatattgacggtgctcccctgcgccaaaggccgaccgcatcggcacgcaggcgacgggtaccagtcattcttgacgatgatgtgcctgtggtacctgcagactcgcctgcggtaccagaggcagaggctgttgtagctggggatgagcccatggtagatgctgccgcacaggacactggtgcagagactaacacacaggataccggtgcagagactaacggggatgagcctgtgggatttcatggtggacccagggacctatcagtgcttacagagtatgctgaccatgttgcgggcagcgtatggtctggacaggaacgtcttgagttgaagttatgctcccatgggaggaaggtgcataacttgggtgggcctgttcctgtaattgagaacatggttactgggacaagattaagttctttgatcgctttccatcttcctgtgggggaggtgtcgatcacgctggacaacgtcgcgtctcttctctatttgcctatcgttggcacattccatgacttccagcctctgtgcaccgacgaggcggtggtgttgttggttgagttactgatggtctcagcagaggtggccatggccgagacaggccaatatggtggaccatatgcgttccatgacctcactcttgttgggcggtatgcatggggagctgctggcctcgtctatatgtacgatcagcttaatgatgccagtctcaacaccagccgacaacttgttggttacatcaccttgttacagtgttggatatacgagcactttccgtcaattgcggagtgcaatgctaatccggactatgacgaggtgtcaccacgtgcgtgtcggtggattgcgacgaagaagactgtgaagaaggtatctacagcgatgtacaagcagcgcttggatcgtctgaggatcccagatgtctgctggatgccatatgcggagcaccgacccgtgcaggactttcatccaattttgtgcttctcgggacagctccgctgggggcctgttgttgttagatatagatcggagagg

SEQ ID NO: 76974 - DNA, 1911 bp, Glycine max
  Peptide Sequence Number=SeqID_168659
atggaaccctggcttccccaagacgattttctcctaaaaaacgccattgagggcggagcgtcgttggaatcgctggcgaaaggagcggttcggttctcgcggcggttttccgttaccgaattgcgggatcggtggcaggcgctgctgtacgacccggacgtttccgccgcggcgagagctgcgatggcgaatttggagctgacaaagtacgggggaggcacggggaccggcgaaggtggtggtgggaagaagaggaactctgaaagcattcggaagcattattctgcaatgcagaaaagactgcgccggtgccggcacggtgtggcgggttccgatgcaaagaacgcgactgaagggtgtgatggtttttctttgcctgatatgcctgttaatgttgaaggtaaaagtcacggtttggaagggagagtgaatttgaaaggcgagtgtggcaatggtgtgctgagattaaatgctcctaatgctgtgttgagagatgatgccaagaacgatttgaaatgtctcttcaacttggcaaatgaggatgaggttgtctttatggatctagttaggaaggaggtgctggctgcggataaggataagcctagttatgataatgtcgattcgcttctgttgagttctccctgtgatgttcagggtgatgatgatggccgtgagccattaggtggcggttgtgctgatcaacattgtgtttctgagtctggaaacaatgctggatcatctggtgctgtgcaaactcctcatgctgaacaaagtgagggttttatgatctgtgttcttaacaccgaggacactgacatcccgagcaatgacactacagatatacccattttagttcctgagttggtgcctctaaaattccaaccaattgttgaagagttgggttgtttggagtctatcataaataataaaaaaagaaatgagtcggatggaagcctggagaaagaagttgttctttctcagtcttctgcagctttgcaaacagttcggcaggggttggtgcctaatgtgaattcaagccaccgacctcttgttcttggactgaaaagtgaaaatccagggagaaactcgatatctgcagtttctagacagaataacaatgtcaatgtcaacatcaactcaagacatagcagattagttcgtgcaactgtgatgcctgcctcagatggacatctgaaacaagaggaaacaaatgctccatcttctgtacatgcaaaagctgaggaacataaggctttatctaaatcagaagcaaaaccgttatctcttgatcatgaaggaggtgatattgaagatggcgacgataatgataatgatgatgaacttcctaacttttctgatgttgaggaaatgattcttgaaatggatttatctccaatggatcaagagacaaatgctagtagagaagtcttgcgatatcaacttgatgaaagtaagaggactataatgagattggagcaaagtgctcagtcctctatgggaagagcaatttcatcccagggtgcatttgccgtagtgtatgggcgcatccttgagaaatacattaaaacaagcaaggttatacttggtagagcaacaaatgatgtacatgttgatattgacttggggaaagaagggcaagtggctaccagaatatctagaagacaggctgtaataaagttggaagcagatggttctttcattattaaaaatcttggcaagagatgtatcttcttgaatggaaaagaaattgctacaggacaagtgcggggtcttagtgctggtagtttgatcgagaaaatgagaatgaaaagagatgaagataaaagaaaggcatctaccctgtatgcccgagatggggtatttaacaacagaaatggcgtcgaagttcgaatgttaaggattttaggatag

SEQ ID NO: 76975 - DNA, 237 bp, Glycine max
  Peptide Sequence Number=SeqID_168660
atgggtaaggttgagagtattggggtgggatgtgaaagcattttgcagttttgctttgctttttgtatggaggtttcaggagctggtagcaggaacaaggtgatatggggtggtcatagagctagggaagttcaagaattaatcttgggtgcttgggattacttgaaggagtggaccattgctagaagttgtgaggattcaaccacacaggttattgcaagatttaccaaactttaa

SEQ ID NO: 76976 - DNA, 163 bp, Glycine max
  Peptide Sequence Number=SeqID_168661
atggaggataatatgagaagcactgtgtttgtgtttgtgtttggggtgcttcttgtggttgttgtgatcgcgagtccttgttttgctgatgtcaaaaatgattttcatgagacaaagggtggcattgtcaactataccgctgaagtttctggtggtggtttgg

SEQ ID NO: 76977 - DNA, 987 bp, Glycine max
  Peptide Sequence Number=SeqID_168662
atggttagaggtttaggtcgtgctttaggcaaagttataggaagagccccggggagagaagataatcgtgattcagatgaagtttcccaacggcgaagacccacaacatccccacgtaggcaacgaaaagttgttacttttgttaaggatgctcctcatatggttgacgtagctaaagaggaatgtcctgaattgaagatatcctcccatggaaggaaggttcggaaatttgggaggtctgctgttgagattgaaggcaaatgtgaggctagacactggactatagcagctcgagcgtatctgctacatttgctaggttgcactctttttgctaataagagtgcaacacacgtgcatgtggtgttcttggatgcctttcgagacctcagtcagagtggaagttacgcatggggagctgccgccctatgttggatttatgagccttttccatctattgttgaggcttttatggatgtagactatgatgaaaggtcaccacgtgcctgccgctggacctctacgaaggcctctacaaatgcattaccagcgttgacgtatcacaagcgtttagatcgattgatgaatgcagatggttccattgttgtcatacaccgaccagagaaggttgtgcggaagtttaggtatgttcagacgattcctccacactttccgggttcaagattatgcttagaaaatattgacgacagatggatgcatttctttgactaccttacaccagtgagccagatttgtgttgttcctggacaatgtccaacggactacattgactggttctacttgatttcgcatccattcatgaggctgacacatcccggggatccactcagatatccacctatcgtgcaagatgagacatatgtcgaactagacatgcctcagtacccggtggcagttgcaactatggaggaagcacctgtgcatgcaccttctgatgtggagcagcctagacatacagtggcaatataa

SEQ ID NO: 76978 - DNA, 279 bp, Glycine max
  Peptide Sequence Number=SeqID_168663
atgacttacagaatccacaattgtaacactgatatgctgagacattgtgactcaaatcaaggactactagcaagtggtgaaggattgctgccttcggagcaacaaatcaagcagctgaaggaacttcaatctaagctatgggaaaaggctaatctccatgaatgtatcttgagacagaaagctagaagtatatgggttaaagagggggacaacaacaattcgtatttccacaaactaatcaattacagtaggaggagaaatgctatcagggtttgttga

SEQ ID NO: 76979 - DNA, 423 bp, Glycine max
  Peptide Sequence Number=SeqID_168664
atggtgcatctagctctaacagaactagtgtctcttgagcaatcaatcaaggaatatgaacgcaaagcagcaatggaggaagaattaagggctatggaagaaccacagatgagagccagccatattgatattacctcgcaacaaaaggtctattggagtgaaatgggtctacagagtgaagctaagaggatactaagatatgtgaaaggattttgggactatgggttctcaaaccatggcaaaaatgtttctggtgaaatatttggtaactatgactcagtgatgataaaattaacagaaagagtacagcaagattacgacaatgacttacaagctgctcacgactcgaaccttgcatgccaatcactgcaagacccacaattggctgactcaggtcgctttgatgctcagctaccaagctag

SEQ ID NO: 76980 - DNA, 1203 bp, Glycine max
  Peptide Sequence Number=SeqID_168665
atggacacaaaaggggcaatgtgtcacgaaaagcagcgggttttccggtgcaaaggacgagggaacgcagaatgctgtttcttcgacacgtggcatcgatctcagccgttgaaggaacatgggaagaagatcgcagcaccgtgtaatgtagtggttttgtcattatgccaagttaaacacgcaggcttcagacacaaaaggagaaactgctcagaactaaaaaaagagctcataaactctgcagaaaaatcagagagagaaagagaaagagatggaggagggcgaggaggcgataaccaagaagaaaacaacaaccaaagcagcgagattccaccagcggagaccctattctggtacagcaaaaacgacgacgtttcatcctatcaccgagggtttgagctatggaaccagcatcaggagcaccagcaccatcaccacgcgatgcatcatccacatgcgcgtccactcctgcagcgagatctttactcctccggagtgggacccagccgcggcggcatctccgatgatcactcgtcgtcgagatcggcggcgttcgtggcgatgcgcgcagccggggccgagggaggaggaataagctgtcaggattgcggcaaccaggccaaaaaagactgccctcacatgcggtgcaggacgtgctgcaagagccgcggctatgactgccaaacccatgtgaaaagcacatgggttccggcttctaaacgccgtgagcgccaacagcagctcatggcgttacatcagcaacagcaagaacaacaacaacagagagacatctccaagcggccgagggattctcgtttgtcctcgtcagggttagaggaagaagggcattttccttctgtggttagttctccagcggaattcagatgcgtgagggttagctgcgtggaggactctgatgatagatacgcataccaaaccgctgtgagcattggaggacatgtgttcaaaggaatcctctatgactatggtcctgagaatagtaacaacaacaacagtaataataatagtaataattacatggctggagaaacctctgctgttgctgcaacagctcagcccttgaaccttgctgctgctgcttcttcagctgcacttattgatccttcgtctttgtattcagctccggctaacgcattcatggctggtagtggtacgcaattcttccctcacacaagatcttga

SEQ ID NO: 76981 - DNA, 168 bp, Glycine max
  Peptide Sequence Number=SeqID_168666
atgagagagccattgataactcttctttctacacttaaaaagttgtttgatgatataggatcacatggaaccaaagttgtaatatacaatttgtggttgaatgatgaagggatatatgaattgagttttgatgatgatgctgaggtttgttttggaaatgcattttga

SEQ ID NO: 76982 - DNA, 201 bp, Glycine max
  Peptide Sequence Number=SeqID_168667
atgtgccagaaaggaatcgtgtgtggaagcacgtgtgacagtttccgagggtgctctgggcactgttgcggtcaccgaaggtgggataagatggtcagaggtcccacgtcaaaaaaggagcaacgatggctttgccaaacaatgacagagagcgtggcactgttcacagcggggctgtgtgcaagaagcgaaagggagtaa

SEQ ID NO: 76983 - DNA, 2547 bp, Glycine max
  Peptide Sequence Number=SeqID_168668
atggaaacaacctcgttttccaaattgttgttcttgttcttctgcttcttcgcttcgtgtttgtcttctcacgcttctgtcacctacgacagaaaggccattctcatcaatggacaaaggagaatcctcttctccgggtccatacattaccccagaagcacccctgatatgtgggaggatctgattctgaaggccaaagagggagggcttgatgtggttgaaacctacgtcttctggaacgttcatgagccttctcctggcaattacaatttcgaagggaggtatgatctggtgagattcgtgaagacaatacagaaagcagggctctacgctcatctccgcattggaccttatgtctgtgcagaatggaatttcggtggatttcctgtttggcttaagtatgttccggggataagctttagaacagacaatgaacctttcaagacggcgatgcaagggttcactgagaagattgtgggaatgatgaagagtgagcggctatttgagtctcagggtggccccatcatactctctcagattgagaatgaatatggggctcagagtaagttgcaaggagatgctggtcaaaactatgtgaattgggctgcaaaaatggctgtggagatgggaactggagtcccttgggtgatgtgcaaggaagatgatgcaccagatccagttataaacacttgtaatggcttctattgtgataagtttactccaaatagaccctataagcctatgatttggacagaagcttggagtggctggtttacagaatttggaggtccaattcacaaaagacctgtccaggatttggcatttgcagttgctcgatttataataagaggagggtcctttgtaaactactacatgtatcatggaggaaccaattttggacgaacagctggaggccctttcatcgctaccagctatgactatgatgctccactggatgaatatggtttgattaggcaaccaaaatatggtcatctaaaggaacttcatagggctatcaagatgtgtgagcgagctttggtttcaactgacccaattattacttcattgggggaatcccaacaggcacatgtatacactacggaatctggagattgtgctgcttttctctccaactatgattcaaaatcctctgctagagtgatgttcaacaatatgcactataacttgcctccttggtctgtcagcatcctcccagattgtagaaatgttgtcttcaatacagcaaaagttggagtgcaaacgtctcagatgcaaatgttgccaacaaatactcagttgttctcatgggaaagttttgatgaagatgtttattctgtggatgacagctcagcaatcatggctcctggtctcctggaacagataaatgtaacaaaggatgcaagtgattatctttggtatataactagcgttgatataggttcgtccgaatcctttctacgtggaggtgaactccccactctcattgttcagtctagaggccatgctgtgcatgttttcatcaatggtcaactttctggttctgcctatggaacaagggagtataggagattcatgtatactggcaaggtaaaccttcgtgctggaataaacagaatcgctctgctcagtgttgccattggacttcctaatgtgggagaacattttgagtcatggagcacaggaatccttggtccagttgcactccatggacttgaccagggaaaatgggacttgtcagggcagaaatggacttatcaggttgggttgaaaggagaggccatggatcttgcctctccaaatggtatctccagtgtcgcgtggatgcaatcagcaatagttgtacaaagaaatcaaccattgacatggcacaagactcatttcgatgctcccgaaggagacgaaccattggcattggatatggagggtatgggcaaaggtcaaatatggattaatggacagagtattggaagatactggactacttttgctaccggtaattgcaatgactgtaactatgctggctcatttagacctccaaagtgccaacttggttgtggccaaccaactcagagatggtaccatgtccctagatcttggttgaagccaactcagaatcttttggtaattttcgaggaacttggggggaatccttcaaaaatttcacttgtgaagagatcagtaagcagtgtttgtgctgatgtgtcagagtaccacccaaatattaagaactggcacattgagagctatggtaagtcagaagagttccatccgccgaaggttcacttgcattgcagccctggtcaaaccatctcttccattaaatttgccagctttggaactcctttgggtacttgtgggaactatgagcaaggagcttgccattccccagcatcttatgccatattagagaagagatgtataggaaaaccaagatgcacagtcactgtatcaaacagcaacttcgggcaagacccgtgtccaaaggtgttgaagcggttatcagttgaagctgtttgtgctccaactgctgcaaattggaggggttga

SEQ ID NO: 76984 - DNA, 279 bp, Glycine max
  Peptide Sequence Number=SeqID_168669
atggttgtacatggaacgtgggtgcatgcaattcaaagaggcataacaaatggattatcaagagtatcagagatcatccaaccaattgtcaaaacatacccaaccgtctccatcaagacgttgattgcagagatcaaaatgttcatgaattataccccatcctacaagaacacatggttagcaaagcaaagagcattggaaatgatttatggaaattgggaagaatcatatgttggatcaagtggcctcggaataattaataaggggaggttgaattaa

SEQ ID NO: 76985 - DNA, 393 bp, Glycine max
  Peptide Sequence Number=SeqID_168670
atggccccgaggaagcttgcctcaaagaggtccaggaaggataaggcggccgaaggaactagttccgctcccgagtatgacagtcaccgctttaggagcgctgtacatcagcagcgcttcgaagccatcaagggatggtcatttctccgggagcgacgcgtccagctcagggacgacgagtatactgatttccagaaggagatagatgctatcggccagctcctgggatatccgttagtgctggaagagggccaggagtgtgagtatgtccagaggaggaaccggtctgatggttcgatgaggaggccatcgcccagttgctatgtataccggggcaagattttgcccggactgctgccgggagacgggtgcggatcatgcgcaccaacatga

SEQ ID NO: 76986 - DNA, 462 bp, Glycine max
  Peptide Sequence Number=SeqID_168671
atggctactcagatgaatcaagctcagtcccaaaattctgacaaattgccttcacaaactgtgcagaatccgaaaaatgtgagtgccatcaccttgaggtctgccaaccaaattcaagtgcctccaccagtaggagcacctacacctgaacctgtcaagcttcattctacacctgaaaaagaggatgaaatagttgcacaaaagagaaagcttcctgatcatgagggagctaacaaaaattttcatgcagatggaccttcttctagtaattttgacttgcagcagccttctgtccctcttccatttccacctagagcaattccaaacaaaaagatggaagaagtggataaggagatcttgaatacctctgctagatggcatcaagcaaattccaagatatgccaagtttctaaaggagttgtgcacccacaaaaggaagctcaaaggcaatggaaggattag

SEQ ID NO: 76987 - DNA, 446 bp, Glycine max
  Peptide Sequence Number=SeqID_168672
atgaattgcgttttcgttcatgtgtcctccaccttcgagtttggagccatgcgtagtgattgcttagtgcaattctccattctcaacccttttcggagccccatgaattgcgttttcgttcatgcgtcctccaccttcgagtttggagctatgtttcatgattgtctaagtgcggaccctcaaggaaatcctccattctccacctatttttcggagccccatgaatgtcattgcctagcactgttcatgtgtcctcccttatccagcgcgaagcctctggctgttgtttctggaggaagcaaccttgctcacctgggcgagctgagctcgcctgggccagctgggccgaggcgcttccgtaacgtttccgtgagtaattacacgaagattctcgaccgttcttcaacattcatcgttcgttcttcgttttcttcagtcttcaacgg

SEQ ID NO: 76988 - DNA, 378 bp, Glycine max
  Peptide Sequence Number=SeqID_168673
atggtgcagttatggtggaaagacccggtggatcgttcggttctgcccaccaacctttttcggagccccatgaattgcgttttcgttcatgtgccctccaccttcgagtttggagctatgcgtagtgattgcttagtgcaattctccattctcaacccttttttggagcccatgaattgcgtttttgttcatgcgtcctccaccttcgagtttggagctatgcgtagtgattgcttagtgcaattctccattctcaatctttttcggagccccatgaattgcgttttcgttcatgtgtcctccaccttcgagtttggagctatgcgtagtgattgcttagtgcaattctccattctcaatcttttcggattcccatga

SEQ ID NO: 76989 - DNA, 327 bp, Glycine max
  Peptide Sequence Number=SeqID_168674
atggttttggcacctctacaacaaagctttcaatctctcccacgtcttacacagaggttcgtcagatccttggtgtcgcaacctacctttcggcgggaaggcgacgcgaggggctcaccgggtgcgtcttccaaaggaggaaaatggcgcgggagtcgccaccaacgtttatttggccgaaaacgtcagaaaaaccgaaggaaacccggtcatgaagaatattccagattcagggaggtgtatttacgtttggaggaagggcggacaaaaagcgggggctcttgctcctacgtaccctccatcgaagaggaaatcaaacctacgtag

SEQ ID NO: 76990 - DNA, 1081 bp, Glycine max
  Peptide Sequence Number=SeqID_168675
atgggatcaagtcaaacgccttcgcttaaaaagaagttctatcaagtcaaggttaagagcctaaggatcaccagtctaaaagagttagggcagttgatgggtcagctccagtggcaagcttttcgcaaagcttacggtaaaatctgggacctcgccatggtagaagtctctacagaggccattgcttccctcgcccagtattatgatcagccattgaggtgtttcacctttggggacttccagctatcacctatggtagaagaatttgaagagatcctaggatgtcctctagggggaaggagaccatacctcttctcagggttctatccctcattagctagaatttataagatagtccaaatctcggcgcaggaattagaccacagaaagcaagtcgaaaatggggtggttggaataccgagaaaatatttggaggaaaaagcaagaatcttggcaggtaaaggcgaatgggccccgttcatagacattctcgcactgttgatcttcggaggagtcctctttctgaatgtggatgggttggtggacctagcagcgatcgacgcttttctcgtctatcatgaccacaaggaaagcccggttgtcgctatgctagccaacctatatgacaccttcgaccgaagctctttatgtttggttggtttcgcacctttttcgtcaagaattaaggcatgcttgcccgctagaagtcactgttcatgcacagataaaggaggtgcaaattgggaccaactcttagcaaacaaagaaggagcgtctatcaactggttccctcgacggaaagaaggaagaatcagagttcttatttcgtgcggaggatttccgaatgttcccttgatggggacgaggggttgcatcagttataatctcgttcttgctataaggcaacttggctaccctatgagagggccaccactagaggaagagatcgcgcctgtcatttcacgaggtttcaataagaccaacgtggagacacttcagaaggtccgcaaggcatgggaggtggtgcgaaagaaggacaaggaacttaggggcagtaacaatgggctcatcggtggctacc

SEQ ID NO: 76991 - DNA, 294 bp, Glycine max
  Peptide Sequence Number=SeqID_168676
atgggaggcagagtcgtcatggttgctgtgcgttgttgtgccatcggtgccgttgttgttgcggaaaccttaggtgaccttcgcgattcatctgttggtgtggttgtgagagctgataaccgatcaaggatgacgtcaagcttggcggtatggttggagtcaggtgtaggggttctggcaggggaagaggaaggtaaaggcagccatgggaggcaaccatgggcagcaggtcggaccaaattgttaggaacaaaggctaagctacactatgctaactacactaacagatattag

SEQ ID NO: 76992 - DNA, 180 bp, Glycine max
  Peptide Sequence Number=SeqID_168677
atgccccctactaatcgagctttcatcaagaagtactgcgtccccaggcaggcgcagggcgaaacaccacagcagcctggggatggctggcagcgggcaacagacgcaccgccatcacctctagagttcacctcagctcatccacaaaaaggtaatggtaggacacacctaggaaattaa

SEQ ID NO: 76993 - DNA, 284 bp, Glycine max
  Peptide Sequence Number=SeqID_168678
gaagtaacaccataactgaacgcgctctaaggcacccttatcgaacccggtctaagactagagtcatgggtgatgtagacgaggtgcaagaacagatgaaggccgatatggtggccttgaaagaccaaatgacttccatgatggaagtcatgctaagcatgaaaagactgatagaaagtaatgtggccacgactatcgcagccagcgtcgctgccgaggcagaccctactcttccgtctgccatgaatcaagcacatcaacctgccccgaacatgaggggatga

SEQ ID NO: 76994 - DNA, 370 bp, Glycine max
  Peptide Sequence Number=SeqID_168679
gaagaatttgaggctagactatctcaagctaggtttgatgctgcatcaagtgttggtgaatcccaactcactcccttaaaccctcctgaagaacaaagacttaggagtcggtgttggattgcagctgcaagaccaaagcataagggacgccttcatggtactggagaccttgatcatacttacaaatgcggaagtgacagcttcatgcagcatatgcaaggatcttccagtcgcatcgtcttatccattgagggtgtgtttctccttctgcctgagttcgtgtttgtcacaaactgggccgcgcttccgtcactgcaaccacattgtcgagttggcgtttgtggagttcgtgtctgcgcttccatcgaag

SEQ ID NO: 76995 - DNA, 300 bp, Glycine max
  Peptide Sequence Number=SeqID_168680
atgaccaactactatccaccagaccttcctccttctattggagttcctcgaggcagccaaggagcagtgctgaagaaagttctccataggattgctgtgcagagctctaacttccttgacccaggaataaaattcccaccacaaaggcattattttatgacaagagaaaaaaaggtgggatgcagattcaacttgactttggcagaaggggcagatgtcattttgaaggacaatctgcctcctaataaggttttccttagatggaagcctatcccagagaagtctccaagcaaaagctag

SEQ ID NO: 76996 - DNA, 881 bp, Glycine max
  Peptide Sequence Number=SeqID_168681
aaaggattacaggtcgtcgctttcagaagactacacgtcctccccttcagagggctacacgtccccgccctcagaggactacacatcctacccttcagaggactagatgtgctcaccatcagagggatacactccctcgctttcagacaacttcatgccctccccttcagccgacaacacgtcctccccttaagagagctattagccctcgccatcaatggactacacgtccttgccttcattggactacacgtcctctcgttcagagagctacatgccctctccttcagaggaatactcgtcctcaccatcagaggacaacacgtcctcgccataagaggactacacatcgtcaccttcagaggactacacgtcctccccttcagaggactgcacgtactccctttctgaggactacacgtgctcaccttcagagggctacacatcttcgccttcataggacttcatgtcctcctgttaaatggactacacgacttcacgtccttaccatcagaggactacacgtcctcgccttcagaggactacatgacctcaccttcagagggctgcacgtcctcgccttcagaggactacatgacctcacctttagagggctacacgtcctcgccttcagaggactacacgtcctcgccttcagaggactacacatcctcgccttcagagggatagatgttctcaacttcagagatctgcacggttgcacatcttcgccttcagagcactacacgttctcccctttagagagctacacgccctcgccttcagaggactacacgtcctcaccttcagagaactacatgtccttgccttcagaggactacacgtcctcgcctttagaacactacacgtcctcaccttaa

SEQ ID NO: 76997 - DNA, 117 bp, Glycine max
  Peptide Sequence Number=SeqID_168682
atgacgcgcccagcgcgcgatctgaacgcgctaagcgcgagccctattctttcttccatctccagtcgtaagccctcaatggccatgagtgtggctaatcccctagctagggcctga

SEQ ID NO: 76998 - DNA, 426 bp, Glycine max
  Peptide Sequence Number=SeqID_168683
atgtcctcaactaatgagcctacaattaatagagaagggtattctgatcctggtgaccaactcatgcaatgtgcccactgtaatgcaaatatgtggtatgatgaaagaatctcaaaacgtgtaagaactacaaacccaagattcagcttatgctgtggaggtggcaaagttgaacttccattgttacaatatccacctaaatatctccacaaacttttgtatgatcatgatacatctgatagtaaaaattaccaacagaacataaggacatataacatgatgtttgctttcacttctactggtattaagttcgacaaatcaattaatcattcaagaggacctcctacaataagaattcaaggtcaaccatgtcacagaataggcaacatgttaccaatgcctgggaaagaacctaaatttgcataa

SEQ ID NO: 76999 - DNA, 192 bp, Glycine max
  Peptide Sequence Number=SeqID_168684
atggaacgagaggaaaagaggtttgtgtaccgtatctgttgttcctctgatgaaaacaatgatccagagggaatggaggaaggaattggcgtttactgtgacccggaatgccgttggctccgactcgaagtgcagggatgcattgtaatcgattacacaaatatggtaatcgattaccagagagcaacatag

SEQ ID NO: 77000 - DNA, 366 bp, Glycine max
  Peptide Sequence Number=SeqID_168685
atgaatattatggttagaatcagaggtttgggtcagactttaagcagggttataggaaaagcctcagtgagagaaattagtggtgatgcgaatgaaggccctcaacggcaaaggcccacagcatctgcacgtaggcaacgagaaactgcatttgttgctgaggatcctgaagaggcaactgctgatgatgtagttacagatgccgagggttttctaggtggaccctacgacatattagttttgatggactatgttcatcatatggcaatgatagtttggaatggagagttgtcctcctatggaaggaaggttgagaaatttggaaggcctgctccagcgattgaaggcttagtggttgtcacatga

SEQ ID NO: 77001 - DNA, 486 bp, Glycine max
  Peptide Sequence Number=SeqID_168686
atgggggcatacgcaaaagatgaggaactgttgatacatttcttccaagaaaatcttactggggtagctgttacctggggcacggatctttcaaagaatatgcccaaaggtggagagacctggcagctcaagtggcacctcaatgacggagaaaaaatgataacaatgatagtaagcacattaccagtattctactatgaaaagatggtgggctacacaccttcaagctttgctgatttagttttcaccgatgaaaggatcaaagtaggtatgaaaagaggcaaatttaatcatcttgcttggacgaatgagaaaactggggcaaatgaagagggtgagaatgaaggagaaacccatgctgtgactgccattcctatacgaccaagtttcccaccaacccaacaatgtcattactcagccaataacaacccttctccttacccaccacccagttatccacaaaggccatccctaaatcaactataa

SEQ ID NO: 77002 - DNA, 207 bp, Glycine max
  Peptide Sequence Number=SeqID_168687
atggtgaaagttggaacctcttacgtgccgatcaacgtctcattttcgccaaaagttggcccagggcttcccggtatcaacagggacaccaggatttatttattctgcgaagtgatcttccgtcacagctgtccctcctgttcagctactgacggggtgaagcgtaacggcaaaagcaccgcccataatacattactagtgacatga

SEQ ID NO: 77003 - DNA, 153 bp, Glycine max
  Peptide Sequence Number=SeqID_168688
atggataagagcttgaaggtaggggaagatgagtggagggagagggagagaaggagcacgaaattttgtgcctcaaatgagctatggttcatcccactagtccaagattctccactaagtgtgcttaggtgtcatgaggcatgtaaagcatga

SEQ ID NO: 77004 - DNA, 633 bp, Glycine max
  Peptide Sequence Number=SeqID_168689
atgggaaacttctcccaaaataattggagctgggatttgaaatggaggagacacctattcgagtatgaggagggagtagctgtgactttcatggaagagattagtgcctatcctattcagagacatctgaaagacaacttgctgtggaaagctgatcctagtgggctgtattctaccaggcttattaaggataggctccccactagagctaacctccatagaagaaatgtggacctgcaggagtatgtctgccctctttgtcatattgagcaggaggaggcaggccatcttttcttccactgcaatcagactattggcttgtggtgggaatccttgaggtggatccaggctattggagccctcccttcttctccagcaagtcatttcagtctattttgtgatgattttgttgtagggagaaaccattctagatggtgtgggtggtggattgccttaacttttgctatttggaagcataggaacttactgatttttcagggcatttcttctgtatcttccaaagtgatggatgatgccttattcctagcttggtcctggtctaaagctagagataaagactttaatatcccttttaaccattggtcttccaaccttatggaggcctttgcttaa

SEQ ID NO: 77005 - DNA, 219 bp, Glycine max
  Peptide Sequence Number=SeqID_168690
atggaacaaagccaccatagcccgttgataggttgccccgacgttcttgagcccaaaggacatcgccttatagcagaacatccctcacagggtgacgaaggtggtcttttgcatatcctctggcaccatctttatctaattgtagtcggagaaatcgtccatgaaggaaaacaaagcaaaattggtcgtattatccacgaggacatcgatgtgcggtag

SEQ ID NO: 77006 - DNA, 450 bp, Glycine max
  Peptide Sequence Number=SeqID_168691
atgttggaagagaagtttgttattattattgatgctagtagcaatgaagagaaagcccaatttaaagcttgggaaagatctgatagactcagcctaatgttaatgagaatgactgttgcaaacagtattaagacaactctccctaaaattgaaagtactaaaaagtttatgggattagtgggagagcgttctcaatcagctgataagtctgttgctgggacattaatggttcaggaagaaacgaggtttaagaatcaaggaagtcacttagttcattatgtaagccaccgagggaatcaaggagctagaaaaagatttatgaagaagcatgataaaggcaaaaggccattaaagatcaatggcggtcctgtgcaaatccagaaaaagcatcaaagagcaataattgtcaattttgtaggaaatcaggacatttctagaaggattgcctaa

SEQ ID NO: 77007 - DNA, 288 bp, Glycine max
  Peptide Sequence Number=SeqID_168692
atggactccattgatgaacaagatccaaggcctacaagcttcacatggagctacgtcattgacggatttggcatccttctgagctctggcgagattgttggccattttttagaaagtgaaggagtttcaaaggtagaagagaggttagggtttggaaatggtaactttgagatagtgaaggcattggatcttcttcatcaatggagtcctttgcttcttgaagatgaatggcaacggaatggagaaggaagaaagatgattggagacgccacttcaaggagaagatga

SEQ ID NO: 77008 - DNA, 483 bp, Glycine max
  Peptide Sequence Number=SeqID_168693
atgaaacaagaattgaagcaggccatcaaagttgagttaacccaaatgccattcattggcacattcattgcatggccgagacatattgtgaaacctatatcacatgaggattcaaagaatcttccaaacaaagtctatgaacctgttgaaagcttgagcatgggtgttggagatgatccattgggtgactttattaagaacttgtcagatgtttacccgaagcctgttgagttcttgtgggatgtgactaaatttaggatttcgaatagtacaaggttgggtcatggtttgatgtatggattccttgagcctcggcctatacataatgcaaaagatagatgtgttgaatgtcaactgtcataccctaatttcgtccggggaccatccgttgttgggatgcgacccttgtttgaccacttcgagattttcaaccgttcttcgacgttcttcgttcgttcttcgtcgttcttcggtcttcaaccg

SEQ ID NO: 77009 - DNA, 720 bp, Glycine max
  Peptide Sequence Number=SeqID_168694
atggcgagcaatccctcaagagcacagaagatagctaaaacttccaagaagaagatccccaagtatttggacttggaatgtttctctcaacaagggttcaactttccaaatctactggaagtacaaggattgtctaagctgctagtcaagattttctacacttgtgcacgtgctgaccttgaaggtaaccttctctctaatgttaatggagtagatatggtcattgatgctaccgtgtggaaggaagtagttggtctggacatgggtggagttcacaagttcgatgaaatgcccgatgggttcaacaagatgtggacttatagggagatgcttcttgactctgctaggaacttgaggaattgcttaggagttggtggaatgactgcaagagatagaatgttagtttacctcattacctacattcttactccgaggtcaagcaatcatgctcagatgctggagagtctctacatggttgattatgaatttccttatgttgtgtttgccccgagattcattgactacttcaatgttaatgttttaaatgagattatggactttaccaaagcatctagtgagattactgaaagacatctcaagaagcttggaatgaggtttgttgatcatgaatggataatgactagagaggcggtagttggaaacatagaacaggtggaagaagatgctgaagttgaagctccatcaatagagtccttttga

SEQ ID NO: 77010 - DNA, 1128 bp, Glycine max
  Peptide Sequence Number=SeqID_168695
atggcggtcaccggtggtcagtggtggtggaggaggagcttgggggtgttaggggagggtttaagggaagagaaggaggaagaaaatggctcatttatgctgctggacgtatttgtagcctgcaacactcgccaagctttaatgaggtcctttaatggtgattttccaccatggagatgcagcggcagacaaaggagaagaggtgagaggaggcgtgatccactagggaataagccatggaagaaggagcttcaccaccaagatgagccttggttaagaagcttggaaggatgcttcaatggaggaaaagaaagagggagagaaagagagaggaagtggaggtcgatctgtggtcatgctgggtctccaactcgcttgataacagtgaagcctcatctagagttttcctctcttgataatgcattgtcgctggtagtccctaccgccacaattcattgtcatcatcaaaaagtaatcatagtaaccaaaaagaatgaatgcactttacgacacccttaccgaacacgtgccaaggctagagtcatgagcgagatagaggaagttcaggaacagatgaaggccgacatggaggccacgaaagaccaaatgaccaccatgatggaggccatgataagcatgaggaaaatgatggaggtcaacgtggctgcagtcgccactacaagtgtcgccacagaggtagacccaactcacccatctggtgtgaatcaagtaagtcatccagtcctagatatggtaagtcagggaggcgaggcattaggaagtacaggtggcccccattttgcgcaagtccagagcaagcatcctttcacactgtatggcctgcctcccaactatgcaccacccaatgttgtacatgtgtcgatgaggacgttgaccactctactcctataccccttgagagacaacaacctcagtctgcgcatgcatatgtcactcaacccatgggggagacacatgaagtaccccgagacaacactctggcctacttctagccttacctcagatatgcaactgaaggacaagcatttggtggcctaccccagccgaacaccttggaagacccttagtatcgtccacaaccgcaactacaacccctacattttttga

SEQ ID NO: 77011 - DNA, 198 bp, Glycine max
  Peptide Sequence Number=SeqID_168696
atgatgttgtccatgatgatatcgggtccaagacagccaggaaataacattgatgtttatctagcacaaaggggagtgatacaatcctaccccgcaagggcattggatagaagactccaagaagattggaccagagatgcaagagaaggccctagggttctcatgagccttagggtagattttgggcccatgggctaa

SEQ ID NO: 77012 - DNA, 177 bp, Glycine max
  Peptide Sequence Number=SeqID_168697
atgggtcaccaatatcgtgccggtcccaaaaaaggatgggaagatggcaccgaaggatatggaaaagacaaccttcattactctatggggaaccttctgctacaaggtgatgtcatttgggctgaagaacgttggggcaatgtaccagcggatggtgatgttattcccatgacatga

SEQ ID NO: 77013 - DNA, 528 bp, Glycine max
  Peptide Sequence Number=SeqID_168698
atgccaagggaaggccaccgcagggggggatctagtgtagcccctcaagtggagattgagtttgacggacaccatttccaaagtgaggagcatcagcgtcatttcgaagtgattaaggattggtttttcctcaaagaaagatgggtccagctagaagaaggagagtacacagaattccaggtggaggttgccaagaggcagtggacccagctgacagagcccatggctaagtatgaccctaagatagtcatggagttctacgcaaacgcctggcccattgaagaaggagtcatggataagcgttcctgggtgcggggccaatggatcccatatgatgaagatgctatcaaccaattcctggggcatccattgatcttagaagagggacaaaggtttgaatacgctgaaagaagaagccaagtctcaggttttgatgaagaggccacaggccagctactgtgctccccaagacattattttgcatggagcgtgacagggaggcggtgtggatcatgtgcattagcatga

SEQ ID NO: 77014 - DNA, 108 bp, Glycine max
  Peptide Sequence Number=SeqID_168699
atggagaaagcatcacctgtcaatgatggaagaagttgttggacaagtggcctcagatatcttaacaatggggttgaattaagatatcacagactattccccaattaa

SEQ ID NO: 77015 - DNA, 162 bp, Glycine max
  Peptide Sequence Number=SeqID_168700
gattcctttgaggagcaggcgtcacaaggatccttcgtcccccatcgacagcaccctggacgtgtccgtgctgctggagccggtgtcaccatcatgaaatactttggatcagctccacggatgtcccacagctcttcctcgttgcctcctgaagaattgtag

SEQ ID NO: 77016 - DNA, 363 bp, Glycine max
  Peptide Sequence Number=SeqID_168701
atggctatgaagaaactctccacgaagaggtctagaagagacgccgcagcagaaggtgccaagcaccagcagcgtttcaaggccatcaaaggatggttgttccacagagagaggcatgtccaactcagggaggatgagtatacgaactttcaggaggagatagctcacagacgttggacgtcgctggtgactcccatggctaagtttgaccctgagatagtcctggagttctatgctaatgcttggcccacagaggagggagtgcgagacatgcgttcgtgggtgaggggtcagtggattccctttgacgtagatgccctcagccagttcctgggtgactcgctagttttggaggaaggctag

SEQ ID NO: 77017 - DNA, 399 bp, Glycine max
  Peptide Sequence Number=SeqID_168702
atgtctcaaaaactaaactatgttaggcaacatcaacaacaactcaaggttgacaaatacatcaatttaagtacctctaatgatcatcctcaaacacttggtagggataaaggaaagaaaatcatactgccaagtagttttgttggtggtcagaggtatatggagcaactctattttgatgggatgacaatttgtggacatcttggatttccagacttattcttaacattaacatgtaatccaacatggtcagaaatacaacgcaaagtcacacaatccaatctcacccctcataattgccctgatattatcacacgagttttcaaaataaaactcaatcaattgatgaatgatctaaaacatggcaatatctttggtaacattattggatgtaagtga

SEQ ID NO: 77018 - DNA, 261 bp, Glycine max
  Peptide Sequence Number=SeqID_168703
atggctgagtatgaggtcaaatcaaaggaaaagaaacttccaacagcttctttctccctccatgttgcttttcttccctcttcttctccaccattgttgcctcccttgaagctccaaattcctcttcatttttaccccaaatcgcaaggaaaagctattttcggagtcttggagcttacctctacttcgtggggctttaaatttcagaatgttgatagaaaactggtagagaggatggggagagttaacttagagttaaat

SEQ ID NO: 77019 - DNA, 597 bp, Glycine max
  Peptide Sequence Number=SeqID_168704
atgagtaacctagaggaagtgcaggaacatatgaaagtcgacatgtcggctttcaaagaacaaatgacttctatgatggaggccatgctagggatgaaacaactaatggagagtaacgcggccaccgccactgctactagcacggctgccgaggcagacccggctctcccgactgctgcgcaccatcccgttccaaacatggtgggacgagagagaagcacatcaggacatatcagcaacccccatccgggatacaaccgaggtgcttacccctacagtttaccacccaactacacaccaccagccatgcatgaagacatggatcatgtttcccccctcatcctcaaaggggagcctcctcggcatcctaacacggtccacgagaatcctcgagagcacgctcagggagacgttgactcctactccccgtttcccgctgaggggccggcgcccaacgcactacctcaacccaacatcaggggagagcctcgaaaccacctaacacagccaatgtttctgtccgtgggagggccacccttggcagtggaaggaaaggggaaactcaatctcatcaaagagagattgagggctgtttga

SEQ ID NO: 77020 - DNA, 363 bp, Glycine max
  Peptide Sequence Number=SeqID_168705
atggctagaacacgaggtttaggtcgtgccataggtagacttgtaggcagagatagacatgatgaccatgatgcagctgatgttcccgagaggcgtaggcctactgcctcagcccgtaggcaacgagttcatcagatgactacggagggacgtgatatggctgaggacgttgctgacatgactgacgatgtccctgatctggctgcggaggcacctgagatgcgtggggacatacagggtgttgatgatgctcaagggtcagatgctgatgatgctactgagggattccctggtgggccacgtgacccgtcagtactggcatcatttgtggaccatgttgcacatgctgtttggagtggacag

SEQ ID NO: 77021 - DNA, 327 bp, Glycine max
  Peptide Sequence Number=SeqID_168706
atgcatgctttgttagggtcattcaacagtggaaactggtctgactctaaagtccttgataatgcagggctgagttgtcgtgctttcacgaggaatcggggtgcgataagtcagttgaatagtttgtacacttgttcatattcacacttacttttacacactagacgcctatctgctgaaatagcttgccaaataacacaagttccccgagtgttcgatactcggttcttaccgttttatactacttgtgcaatccggtacacttgccggaagccgaacaagttctcggcgccattgccagggaacttccttttatttgggaagtaa

SEQ ID NO: 77022 - DNA, 654 bp, Glycine max
  Peptide Sequence Number=SeqID_168707
atgggggatcccatcagcagactctccttccctggtaggcgcattgtttttcactcaaaaagcatatgctggaatatttgtctctttgctaaagcatgtttgcattttagtggagaaaacaccgagactttttcaagtctcacaagttatccagaactacgtaggtctgaattcctcattggaggatacgtaggagcaagagcctcgcttttgtcgaccacaccgccttttgttgccatgactcaagagctgatacgcggagataccttatggttattcgcacccttttgtcatccagaggcagcgggcccgatgacaagcagagaccaagtttggtcattctgcacccatgatacgcggagataccttacggttatccgcacccctttgccattcagacacagtcgtgtccgatggcacgcagagaccaagtttggtcattctgcaccccatgatacgcggagataccttacggttatccgcacccctttgccattcagacacagtcgtgtccgatggcacgcagagaccaagtttggtcattctgcacccatgatacgcggagataccttacggttatccgcacccctttgccattcacacagtcgtgtgccgatgacgcagagaccaagtttggtcattctgcacccatga

SEQ ID NO: 77023 - DNA, 183 bp, Glycine max
  Peptide Sequence Number=SeqID_168708
atgttggtaactttggcagaaaggggcgtatctccatgggaccgccttgttgctttggtaagggaaagggacaggtttgctaccccagattggtcaagaatctcagggtttctgggaggccacatccctggtgaagtgtatcaccaaaggtttgagtttaacggggctttctttgtccgctga

SEQ ID NO: 77024 - DNA, 225 bp, Glycine max
  Peptide Sequence Number=SeqID_168709
atgcctcagagtacctccgtgatacgcgcaggtcgcatcggggttgtaccatctcgagaaaggagactagtagatccatccgggggtcaccactgccaactggttggcgattacgaatgggcaaactctggaagcttcttcatgggagggttcctcctcggattggaaattgggctaggattgaaatcgtcagcgggacgaggccttgtaggagccggggcttga

SEQ ID NO: 77025 - DNA, 186 bp, Glycine max
  Peptide Sequence Number=SeqID_168710
atggcttgcacccacattccggattcacaagcgattctagccagcccgcatcaattagaccttgcactttacgctttgaggtcatacagtgctcactggaattccccggggcttctccatgacaagcacacgttgcgttcgagtcgtatccttggaaaaatggaggttgtggcgttcctaaattaa

SEQ ID NO: 77026 - DNA, 424 bp, Glycine max
  Peptide Sequence Number=SeqID_168711
ttggcccaggcttcccggtatcaacagggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatcaatttggaggatcttcctgagaatgcgcgtaactatgttcgtcgtgtgagtgaattggttggcgttcgtatttctactttctcagtaggtcctg

SEQ ID NO: 77027 - DNA, 369 bp, Glycine max
  Peptide Sequence Number=SeqID_168712
atgaagacccccgacgaagcaatggacttaattgaaagcatggctgctagtgacattgccattttgagagaccgagcccacattcctactaagaagagcttatcggagctaacctcacaggacgatctattggcacaaaacaagttgctatccgagcaactagagacactaataaaagcactaagttgccaactctgcttcattctgcacaaacttcatattcttctattttgcaggttgcaagatgtacaatttatggtagagctcatgaatttggatgttgtatccctaatgaagagcaaattgcacatgaagtcaattatatggggaatcagcccagaggaaatttcaatacaagtggatttctag

SEQ ID NO: 77028 - DNA, 405 bp, Glycine max
  Peptide Sequence Number=SeqID_168713
atggatgtcaaagctgacgataactgtggatatcgtgcgattgtcactttattaggtatgggtgaagattcttggtccttagtgtgcaaccatttgcttaaagaacttggcaaatggtcagatgactatatcaagctctttggtggcacaaacacatttgaggaattaaggaggtccctacttgttgatgggttatccatggttactatggataactggatggatataaccaagatgggatatgtcattgcatcaaggtataatgctactccacatcagaaagggaatgtgccgatgctgctgctagtgccactgggacctcaaggatatgtgtctccacatatgtgtcatcctgcgtcacaggtggatgtctggccggatcagcaggttctgctggtgacatga

SEQ ID NO: 77029 - DNA, 258 bp, Glycine max
  Peptide Sequence Number=SeqID_168714
atggaggcaacgacattgttatggaaacaagattgtcaccgagcttcaaagatgcaaaacatggatgtagcactacagcttggcataagggtcgacggtaggccaatcactggtgcaacctactatgattgggaggaaatgtgtgaacaatatttgggtgttgttctgccaaagggagaagcaatagtaggctctgccattaagcttaagtggttgcaagataatatgccactgcttccctcggaatcgacacaataa

SEQ ID NO: 77030 - DNA, 474 bp, Glycine max
  Peptide Sequence Number=SeqID_168715
atggagaattgcactagcaatcactacgcatggctccaaatcgttggtggaggaatcaatcgggaaaataacaaagaccacatttcccagtcaagaggatccgcacttgacggtggaggacacatgaacagcgctaggcaatcaattcatggggctccgaataaaaggcgagaatggagaattgcactaggcaatcactacgcatggctccaactcgttggtggaggaatcaatcgggaaaataacaaagaccacatttcccagtcaagaggatccgcacttgacggtggaggacacatgaacagcgctaggcaatcaattcatggggctccgaataaaaggcgagaatggagaattgcactaggcaatcactacgcatggctccaaactcgttggtggaggaatcaatcggaaaataacaaagaccacatttcccagtcaagaggatcgcacttgacggtggaggacacatga

SEQ ID NO: 77031 - DNA, 1170 bp, Glycine max
  Peptide Sequence Number=SeqID_168716
atgactacacgttctcaccttcagagggctactcgccctcaccttcagaggactacacgtcctcgctttcagatgactacacgtcctcacctttacacgactacacgacctcgccttcagaggactacacatcctcgccttcagaggactacacgccctcgccttcagaggactacacgtcttcgccttgagagggctacacgccctcaccttcagaggactacacatcctcaccttcaaaggactacacgactacacgccctcgcctttagagggctacacaccctcgccttcaaaggactacacaccgtcgccttgagagggatacatgtcctcgccttcaaagaacggcacgtccttgcctttagtggattgaacgtcctcgtcttcagagggctgcacgtcctcacctccagagggctacatgccctcgccttcagaggactacacgccctcgccttcagaggacgacacgtcctcgcctttagaggactgcaagccctcgcctttagaggactatcgtccttgccttcagaggactacacgatagcacgtcctggccttcagaggactgcacgtcctcgtcttcagagggctacacatcctcaccttcagagggctacacgccctcgcctttatagggctacatgtcgtccattcagaggactacacgccctcgcctttggagggctacacgccctcgccttcagagcactacacgccctcgccttcatagggctacacgtcctcgcctacagaggacgggacgccctcgtcttcagagggctacacgtcctcgccttcatgggactacacgccctcgcctttagagggctacacgccctcgccttcagaggactacacaccctcgccttgagagggcttcatgtcttcgccatcataggagggtacgtccttgccttcaaaggactacacatcctcatcttcagagggctacacgttgtcaccttcagagggctacatgccctcgccttcagaggactacatgacctcgccttcagaggacgactcgtccttgcctttagaggactgcacgccctcgcctttagaggactacacgtccttgccttcagaggactacacgtcctcatcttcagagggctacacgtcctcaccttcagatggctacaccccatcgcctttaccagg

SEQ ID NO: 77032 - DNA, 144 bp, Glycine max
  Peptide Sequence Number=SeqID_168717
atgggggagggatgttgtacgcagtgcaaagaggctgtttccggattcgaacccatcaccaacaagtcaccaagacacaactttaccgctgcaccagggctcgccctctatcaaaaaatttacttcgaaggtccatctagttga

SEQ ID NO: 77033 - DNA, 441 bp, Glycine max
  Peptide Sequence Number=SeqID_168718
atggatgactcatcaaccattgaagaaagtgaggtaaattttgaatctgaagaagttttggaagcatttaatgaaatgcaagaagaagctcaaaggcttgctgttttaaacaaaaagctgaaaaatgatctaaaattgcatatcactaaattaacttcaacacaaagtgagctggatgaattgaggaaagaaaatgaaagacttgtttcaagctttatagccactggttgtgtttgtacctctacctctcttaatatggatgattacaagtctttgcaaactgagtttgaaaatttcaaaaaggatcactatgcagatcatatgaagttgcaaactgagcttttctatcttacatatctttttagaaaattaaacaaaggaaagaatgatcttaatcactctcttagtgtgcaaaagcatactagcgataagactggttag

SEQ ID NO: 77034 - DNA, 464 bp, Glycine max
  Peptide Sequence Number=SeqID_168719
gctgcacgagttctgtaccaagtccgggattgaagagttagtttgtgagtttttgggacttgagtcttttgtgagccaccttgatggtaccctaacatcaagtgttggacctatagttgatctctggtgtgtctttgacttaattgtaaacacaggagtgtgggggctgttagaccttgaactaacactattgagagtggatttcctccctggcttggagcccccagatgtaggcttcacttcttcaacgttcccacttgcactaatattattcaaagacccaagtagtagtagcatttgcatttccctcacgcacccaatgggtagagccatgagggcccctacagcactgattaataggctaactgccattcaaaggaaatttctttggggtggtagctttgcagggaagaagatagcttcggtagcttggagacagctgtctgcctctagagatttgggag

SEQ ID NO: 77035 - DNA, 189 bp, Glycine max
  Peptide Sequence Number=SeqID_168720
atggtgaaagttggaacctcttacgtgccgatcaacgtctcattttcgccaaaagttggcccagggcttcccggtatttattcggcgcaaagtgcgtcgggtgatgctgccaaacttactgatttagtgtatgatggtgtttttgaggtgctccaagtggcttctgtttctaatcaagctgtccctcct

SEQ ID NO: 77036 - DNA, 138 bp, Glycine max
  Peptide Sequence Number=SeqID_168721
atggcttcagtgaagggggttgaacgcatgggaggggatatcaatatggaagaaattaaaaattatattaaaatataccgatctcttttagacaattttttcccaaagagaatcccttgcacaattaagctggaataa

SEQ ID NO: 77037 - DNA, 1062 bp, Glycine max
  Peptide Sequence Number=SeqID_168722
actcgttggctagagcaagatcagtttgcaagaattggcacaaatgtttccaaggcttatcctatagccacaacaacctcttcatggttcttggctcttccaattcgcaaccatagaccatattgctacgctcataatccagtgatagataaatggcaccaactctctctaccaatcccatcaattcgaccaattggtccaatagggagcctcctcctcttaagggtcaccaattccacaaccctccaattgggtctttgcaaccccttcacgagagagtttaggcaccttccccggttgcatgttgcaagaaccaaccctgccgttggagtagttacaacctcggagtcatcgaatccaaaccgtgatgacgatgatgttcggtttccttcctttaaggtctacgtggctggtggcatgtccgaggcagcacaaggtggcggcgccacgtatgaaaccaaagtggagatgtatgactcgcggtttgacacgtggcggattgtggggtccacgcctgtcgagtttgccgttaggctcaccgtgtggacacccaatgagaacgtgtgcattggagaaacgttgtattgggtaacctcggccagagtctatagtgtcatgggatttgatgttggtagaaatagatggagggagttgggtgtgcctatggctgagaagctggaatttgccacgcttgttccgcggaatggggcattgggattggttggtggcacgtgtggtggaagtgcttgcatttgggagctaaatgaaggggacaaatggtgcttagtggataaggtgccacttgaattggggttgagattgttgggagagaagagaatttgggagagtgttaagtgtgtggggaatgaggatgctatttgtttgtatagggatattggatatgggatggtgatttgcaaaaaggtagtaggggaaataatgggtaggtgggaatgggtttgggttgatgggtgtggttacaccaaggggaaacaagtgcataattgtccaatcagaggggcacttgttcatccaagtcttgcctcctctcttatcttttaa

SEQ ID NO: 77038 - DNA, 288 bp, Glycine max
  Peptide Sequence Number=SeqID_168723
atgacagtagaggacaaccacgatctcatcattggggcgatggtgacaacgtggcatagggagagacttattggtggacttgcggagcagctagcagagcatgaaaaggaagagaataagaaagaggctaataattcccagagccagaaaaagaagctagagaggatgccaacagaagacatcaatgctagtgctgaggccttcatcaagaacttcagacaccatctgctacttcagaggctccaatccatagagaatcacaagctaatgcttgcaagggaaaagtag

SEQ ID NO: 77039 - DNA, 642 bp, Glycine max
  Peptide Sequence Number=SeqID_168724
atgcctagcttgcttatggaaacaaaattggtcatattggcgcaatccgccagacactgctctgagcctgtgagctttctatcaactactgtcatatccgtgtggtttggaacaatgttctgggaccttggaggcaaatactctagcagacaggacctatttaatgccatgggttcaatttataacgctgttctcttcgttggggtccaaaattctgcctcagtacaaccagtggtagccattgaaagaactgccttttatagagaaagagccgccggaatgtattctgccttgccttatgcacttgcacaagttataatagagctaccttatgtttttgtgcaagctaaatcatattctgtcattgtttatgccatgatgggatttgaatggactttgcacaagttcttttgttgtggcttctgcattttagggaatttggaacctcttttcaaggtttgtcattgcacgaccaggattcaattcaatggatgtctttatgatgatcctcccttttttattttcgattatgttgcctttttaaaacagaacattcctgtgtggtggaggtggtactattgggcatgtcccgtggcctgggtactatatacgggtcggttgcctcacagtttggggatataa

SEQ ID NO: 77040 - DNA, 459 bp, Glycine max
  Peptide Sequence Number=SeqID_168725
atggctgcgcaacctggtgagaaagcggcgatcattgcaaaacactgcaacaattgtttggagtatggcatatctgcgggagatactggtatgataatcgatttcctttcttgccatcccaaagtacttgtgaacgtcccttccgaatcttccgagggccagatggcctacgtttatcttgtccagattttgaaggttgtcaagagctgcgctgttttgaaaattatagactcttgggttcttggtaatgccgatctccactctcgggccctcaaagaattgcggaggcaggaaatactcgcccgagagcgacttcacctcgggcgctgctgcgtcaaggggaacaagaaggagcttcaagatgcagaggccgatcttcacaaggttcgccaccagaagaaagatctcttggaggagagagctgcgttacacattttaattacacattttagtacatga

SEQ ID NO: 77041 - DNA, 177 bp, Glycine max
  Peptide Sequence Number=SeqID_168726
atgagagcaacatcaagatctgagttcctccgcgcctctgtcgaagttccgcctcctcacacaccgtcacccccgcaaggtcacaaacccagtcatggcagaacattatggcccaacactacggcacttaacattgtgcctgatggagcgctaaagctttcttgtggtgttggatga

SEQ ID NO: 77042 - DNA, 1575 bp, Glycine max
  Peptide Sequence Number=SeqID_168727
atggtgaaggacaaattaaagaaacatgttctcactgctttcactcctaatggggattatgtggctattctgtctgccaatgaggtggccaagagtggaagccatcagatggagatcatgatattcgttattcttgtattgcatgtagtttcattgggaaaaagaaaagaacagggaacttgcttattagctcttggcacaatcgatggaagcgttctagctgttgatgtttccactggtgagagaaaattgactaccagccatcccggggggatttgtggactctcattcgcaaacaagggacgtcttcttcgcattgttggacataatggggtagcatacggggttaatactgaaacaggagagcttttaaaggaatttaaaatcacaaaaaagtctattacttctctggctttctcgaatgatgaaaaatatttagctattgtcagctctagaccacgggttataagctgggaaattggggaagagattctgaagttccctaatgatttgggaaatgtagagcacatttctatatcgagtgatgccaaaaatttagttacatcagattttgagggtcctacacttcccataagacatcctccattagttttggactgccacagtggttgcaataaagaagatgtagttgttttggcagttactggtagaggttcagcttatatatggaatttgagtgcttcctccaaagatcagatacagccaactaaattgactacggagactaaaatagttgaaacagacaaggaaaatggtgtaagttcaaagaaaaggcacaccttgattattgcatccagattacaaccagtagaggaaaataaacagatgaaagctcttgtgacttatggatctgtagatcatccacagtttagtatcttaaatattagcaattcaggggagaatatagtattatatgttggagatgagactgattctgttcagcagcatgacagtccttctggcaaagcaataccaatggaaagcaagaaagctaagaaaagacaggcaacatctgatcctgatcttccaaccacaactaacgaggtggatttagcatttaatgtagatcaacatgaggctgcaaaaggagtccttcttgatgatgatttgaacgagccaacaatgggagagaaacttgctagtctaagtgttctggatgggaacaaatcaaggagtgatacagagcaagaatcttctgtcccagcaaagcctccaagtgcagactctgtacatgttttgcttaagcaagcattaaatgctgatgatcgcacccttctgctagattgcttgtttacacaagatgagaagctgattgagtctagagtctccacttttaaatctgccatccaactctcaagttgtttagacacgcttcgcataggggctattgacgaggaggaagatgaaggtgaaatggtgccagttatctatgaggataaggatactgatgatgatgaagaatctgatgatgccatggaagataacacagatgaacaacaaccagaagaacagtttcatgctgccagatacattgatgcaaatgaagataggtga

SEQ ID NO: 77043 - DNA, 186 bp, Glycine max
  Peptide Sequence Number=SeqID_168728
atggcttattccgtagtgcatgacgtctcctctcacctcttctcctttatcttccactacatctccatgggactatcagcgacaatgcatcaccagaagaggaaaactctagatgaggcttcactgttatcaagcgagttaggaacccaacatgaccatagatcaacctccactccctatggctaa

SEQ ID NO: 77044 - DNA, 621 bp, Glycine max
  Peptide Sequence Number=SeqID_168729
atgtgcccggtggtcggttttggcccgtggctaggtcttggcaagccgttggttgaaattttgccccccggtcaacttcgtggtttttgcccgttgttggcttggctagggtcggcggtgctgggttatggccccgtgctaagtttcggattggttggccccctcctcccccccgtgatcagttttgttgccaggattttgccaactttggcttgcgccccgttggctaagtctgtgcctcggtggggagggacgaatcaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattgtgcgaatcaacggttcctctcgtactag

SEQ ID NO: 77045 - DNA, 836 bp, Glycine max
  Peptide Sequence Number=SeqID_168730
gggagggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattctcacgttccctattggtgggtgaacaatccaacacttggtgaattctgcttcacaatgataggaagagccgacatcgaaggatcaaaaagcaacgtcgctatgaacgcttggctgccacaagccagttatccctgtgggactaaaggatcgataggccacgctttcacggttcgtattcgtactggaaatcagaatcaaacgagcttttacccttttgttccacacgagatttctgttctcgttgagctcatcttaggacacctgcgttatcttttaacagatgtgccgccccagccaaactccccacctgacaatgtcttccgcccggatcgaccggccgaagccgaccttgggtccaaaaagaggggcagtgccccgcttccgattcacggaataaggtcttctttccccgctgattccgccaagcccgttcccttggctgtggtttcgctggatagtagacagggacagtgggaatctcgttaa

SEQ ID NO: 77046 - DNA, 249 bp, Glycine max
  Peptide Sequence Number=SeqID_168731
atggagcagcatttacggcatttggttcgccagcaggcggccaatcaccgggcacatagtctgggcttcgcttctttttcatgccctactccagaccagttcagggcagaggtcgcatggcccggggattggcccgaggcccaagcaggagaggcgcccccagaggctcccggcgatagagaggaggcccacgaggacgaggagatgaccaatttgcttgacttcttgggagggagtggagctacatga

SEQ ID NO: 77047 - DNA, 129 bp, Glycine max
  Peptide Sequence Number=SeqID_168732
atggaagcaaaagcacaaaaatggtggcctaaggggtgctcgcccaagcgagctaaccctgtacttttttttttgcaaagaaagtacgcgctctctattggtcagtgttcgcttactcgaaaaccctag

SEQ ID NO: 77048 - DNA, 240 bp, Glycine max
  Peptide Sequence Number=SeqID_168733
atgataacattcaagaatgagttcaagattgagtcaagaacacttcaaggatcaagagcaaatttgatttcaagaatcaagattcaagattcaagaatcaagaataatcaagatcaagattcaagactcaagattcaacaatcaagagaagacttaatcaagataaacgctctcgctaagccagcagattggcttagcgagaaggtgaaaaacaacacttttcaaagcttgcctaattaa

SEQ ID NO: 77049 - DNA, 1071 bp, Glycine max
  Peptide Sequence Number=SeqID_168734
gtcgactctagaggatcccatcacttcttccagcacgttctcgaggaaggtgacggtgctgtcttccacgttgaacaggttcgggaacacgccccattcgctgatcggcttcaacggcgtatcgatggtgcccagctccggatacgcagcaatcgcagcagtcgcgtggcccggcacatcgatttccggaatcacctggatgtgcagcttcgcggcataggcgatcacttcgcggatctggtcctgggtgtagaagccgcagtacggatgctcctggccgctgaccggatcaatgccgccgtcaccggccggcagccggcagctgcccacttcggtcagcttcgggtagcgcttgatctccatgcgccagccctggtcgtcggtcaggtgccagtggaaggtgttgagcttgtgcgcggccatcgcgtcgagcacgcgcttgatctcgtccaggctctggaagtgacgggcggagtcgagcatgaagccgcgccagctgaagcgcggcgcgtcctggatctgcactgcgggcagcacgccgttgctgccgccggtggcgagctgggcgagggtggtcgcgccgtagaacaggccggtttcgttgccagcctgcaccagcacgccctgtgcggtgctttccagcgtgtagccctcaccgctgtcgcggaaggtgggcacgatctggaagcggatgctgccggccttggcgctgactttgcccttggccagtgccaggcgcgggccaccgctgcgggccagcaggtcggcgaactggttggcgacgcgctgcgcggcttcgccttcggcctgcagcacggtatcggcgcgcacggtgatgccgctgccctggccgcgctgcacggtggccggggcgggaatcagcatcaggctgccggcgcgcagctgcgggccgggtgcttcagcggcaggcgtggggtcggcggcaagtgccggcagcgccggcaacggggcgagcaggctgcccagcagcactgcgctgcgcatccgggcgcgggaaggcttgaccatcggtacgactccttggaacggtgcgatgaacgctatacatga

SEQ ID NO: 77050 - DNA, 121 bp, Glycine max
  Peptide Sequence Number=SeqID_168735
atggcaggatgtggtagggatcagaaccgtgatgtcctggatcgcatcacagctgtgctggaaaccctagtgcaggaacgtgatgtggagccagcggagtatcgaggactcatggctttct

SEQ ID NO: 77051 - DNA, 414 bp, Glycine max
  Peptide Sequence Number=SeqID_168736
gggaggagcttgccacccagctcgcccaggcgagcaaggttgcttcctccagaagcaacatccttctggaggaagaatctggaaggcccaacggaggcatgatgttgttgttgaaagttttccctatcaaggagagttcaaataatgacccttctcaacgtcacgacgactctaatgctgctagtgaccatgtttacaacattctcactagtgacgttgcccttattgatggcgtagctcctcctgacactgtcttcgccacctctattggtgttcctaaggagaatgaggtagagttgcttctgcctgatcctccttataacattacaaacctgaacttggaggctactattttgcaagtcatagtgcctcgtcctttaatccctcctcctccacccaaaaaacctagtaaag

SEQ ID NO: 77052 - DNA, 486 bp, Glycine max
  Peptide Sequence Number=SeqID_168737
atggccaaagtgcttattgacaacggcttttcactcaatgtcatggccaaggctactttggacaagctgccttttaatgcatcacacctgaggccaagttccatggtagtgcggttgtaccgggatgcattagaagtggtaagcaatgcttacgtcgagtctcccccggtacaaccgtgcccatctggggctgcattgatggtagctcgggtaatgttgggacatggatacgagcctggaatgggttttggccagaacgacaatggcatggcgagtttggtagagtttacagggaaacgtggaaggttcgcactgggatataagcctacacgtgccgacgtgaggagcattgtcctagaaaggaagggaagaagcatgggccagccgcaaggactgcaagtgaaaaagggttcccttgtgtcacatcaacgagagctttgtcagcgcgggttggatgtgcgagggattggtcgccatgatacatga

SEQ ID NO: 77053 - DNA, 790 bp, Glycine max
  Peptide Sequence Number=SeqID_168738
atgtataaggctaagctagcactgctcgctaagccattgtttgaaataaaaatagcatccaagaagagaaagagcactgcttctagacctacaactcagtatgatacaaggcgattccaatctttggaagcttggaatagatacacgaacaacattctcggtcggaatatccttccggagagaaatgttaagatttatcatactgagttcgatgagttcaaagtggagttggagaggcgtaatctacacaaatgcctcaccaaactccaagatggaagcatagacgtggctgtggttaaggaattctatgctaatttatacagcccagaggtccaagcttcaaagcaagccagagtaagaggacacctgatcaatatagatgtagacaacctgaatgagtttcttcagactccagtggtattagaggaggggaaatctttacccacctactctagatgttgtaggttgaggtctaatcctcaggagattgaagtcaggctctatattccccgcaaggggtttgttctgaatgttgagggccaaccatggaaactccttagaaaggatatgactacactggcccagacatggagtgtcttctcttactccaacttagctcccacatcctacacctcagatttgaacatggatagagccaggttggtttatggcttggtaacccacatggatatgaacatcggcgccctgatcttaggtcaaatctcttctattgctcagagtaactcctctaagctcggattttcagccttgatcactaccttctgcagag

SEQ ID NO: 77054 - DNA, 165 bp, Glycine max
  Peptide Sequence Number=SeqID_168739
atggggtgtagcaacaaagatgatgacaaaggtgatgacaaaaagctcaaaggtcaatcaaagaatgtcaaggatcaagcttccaagaatcaagatcaagattcaagactcaacagaagacttaatcaagataagtatgaaaaggttttttcagaaactgagtag

SEQ ID NO: 77055 - DNA, 492 bp, Glycine max
  Peptide Sequence Number=SeqID_168740
gggaggtggttgccgcccagctcgcccaggcgagctcagctcgcccaggcgagccaggttgcttcctccaaaagcaacagccttctggaggaatattctggagggcccaagtgggcctgggtgctatttgcaccccaatttttactaatttcttttgatgtgagattgctgcaacctaccatacaacgggggtgcgaggcgaaaagaaaagcacgttcatctcctagggagaaaatgcgtggaatcgccactaatgtttattcgagaaaaacgttagaaaaaccaaaaagagatctgcagattttgaaaataagggtttggaagttgttcatgcatggaaaagtcgacaagggtgttgcccttgcccttacgtatcctcgggttatttacgaaactattgatcgattgaaatttactttacaagaagaaaagagattactgatgataaaagaaggagatgaagatgcacaaaacaacaaagagggcccctaa

SEQ ID NO: 77056 - DNA, 570 bp, Glycine max
  Peptide Sequence Number=SeqID_168741
gccctttgtggcgtcagtcagattgggaggtatgcctggggagtagctgcgctggtcaatatgtatgaccgcctcaacgatgcttctatcagcaccagccgacagcttggcggttacatcacgctgctgcagtgttggatatacgagtactttccctcagtcgcgaagtccattgctgatccggactacgacgaggattcaccgcgtgcttgtagatgtctattggatcccaaatggggagcaccgaccgatccgagacttccatatgatttcatgctatttcggtctcctacgctgggggtcgttgctgtgtattaccgactagagagggtcatgcgaaaatttggatacacccaaaccattcctgctccgcctgtcgattcatgggtgtcgtatgatgatttacatgataggtggatgcactattcggaccatatggttgcagcaggtgaggtgtgcgccgtgccagttgccactccggatccagacatagatatccgtccgatcacggagccaacagcaccgtcgacatctgcaaggtccgatgtggccgagccgagacatgcaatg

SEQ ID NO: 77057 - DNA, 255 bp, Glycine max
  Peptide Sequence Number=SeqID_168742
atgggatcaagtcaaatgccttcacttaaaaagaggttctatcaagtcaaggtcaagagcctagggatcaccagtctaagagagttagggcagttgatgggtcagctccagaggcaagcttttctcaaagattacagtaaaatctgggacctagccatggtagaagtctccacagaggccattgcctcccttgcccagtattatgatcacccgttgaggtgcttcaccaaaggggacttccagctatcacctatg

SEQ ID NO: 77058 - DNA, 642 bp, Glycine max
  Peptide Sequence Number=SeqID_168743
atggcgaacttaaaaagccacctacagacgctttacgcccaatcattccggataacgcttgcatcctctgtctacgcggctgctggcacagagttagccgatgcttattccccggataccgtcattgcttcttctccgggaaaagaagttcatgaccctcccagtgtggctgatcatcctctcggaccagctactgatcatcgccttggtaagctattgcctcaccaactagctaatcagacgcgagcccctcctcgggcggattcctccttttgctcctcagcctacggggtattagcagccgtttccagctgttgttcccctcccaagggtaggttcttacgcgttactcacccgtccgccactggaaacaccacttcccgtccgacttgcatgtacaaagctgattcggaattctcttccattccaaggcataacttgtatccaggcgcttcatattcgactggagttcgctcccagaaatatagcccccccacccctcgtgtaatcccacgagcctcttatccattctcaattattattcgatcacggcatacaaatagaaaaacttacattgggtttagggataatcaggctcgaactgataacttccaccacgtcaaggtgacactctaccgctga

SEQ ID NO: 77059 - DNA, 372 bp, Glycine max
  Peptide Sequence Number=SeqID_168744
atgactatgcaaaacatgcagtttcaacaagagaccagagcctccattcaaagcttaactaatcaaatgggacaattggctacgcagttaaatcaacaacagtcccagaattttgaccgattaccttctcaatctgtccaaaatcccaaaaatgtgagtgtcattgcattgaggtcgggaaagcagtgtcaaggacctcaaccagtagcatcttcctcatccgcaaatgaacctgcccaacttcactctactccagaaaaagatgatgacaaaaatttaacgaaagcagcatatccctcttccattccctccaagagcaatttccaacaaaaaaatggaagaggcagagaaggagatcttggaaacatttag

SEQ ID NO: 77060 - DNA, 558 bp, Glycine max
  Peptide Sequence Number=SeqID_168745
atgagcatccatgtggctcagttaatcgctgatgccatctatatttttgcaggtatggcgcctaccaggcaccctctggacccagataagtccaacagggccctgggatttcccgccttgatcacgggactctgccagtcgtttggcgtccccgtcacacctagcaaggtgattcggccgcccatcacccgagcttttatcgagaagtactgcacgcagagacaggtccagggtgatgtaccacaggccgcggacgcgccgccacctcatcaggctggcccagtcggattgtttgatacagagcagtatttgcggcatttggttcgccagcaggcggccaaccaccgggcacatagtcagggctttacttcttttccgtgccctactccggaccagttcagggcagaggtcgcgtggcctggggattggcctgaggcccaggcaggagaggcaccagcaggggcaccagcagaggctcccgatgaggcagatgaggcccgcgaggatgaagagatgacagatttacttgatttcttaggagggagcggagccgcatga

SEQ ID NO: 77061 - DNA, 234 bp, Glycine max
  Peptide Sequence Number=SeqID_168746
atgaccaccggtggccaccacaagctgccgttgcttaccgccagaccaccacacggagaggaacactttaatcagagcaaaatccttagaattcacctcaaggattcggtggagaacaagctcccaatcctttctttcatagtttcggaactctgtgtttggaccaacgaacgtgaacaagagaggtctttgagcgacgcagagaggagcttacgaagagctcatgataggtga

SEQ ID NO: 77062 - DNA, 432 bp, Glycine max
  Peptide Sequence Number=SeqID_168747
atgaaaaatacgatttcacgtcaaaattccacccaaacaaccctagaaactttttctccaccacccacaaccactgatggccaccatgagccaccgttgcttaccgccagaccacaacacagagaggaacactttaatcagagcaaaatcctcaaaatccacctcaaggatttggtggagaagaagctcccaatcctttcttttgtagtttctctaagattagataatgttaatgatgagactcaggttgatcaccatggggggaggggggagttgcctgtgtacgataggggaaaactgccaggaaaccacattacaaacgaaacctcaaagagagttgggcttcgtcctcaaaaggaaacaacaccagaaaaactagtcttccatagattcaaacagaaaacacaaatgaaacatgaagcagaaacgtaa

SEQ ID NO: 77063 - DNA, 270 bp, Glycine max
  Peptide Sequence Number=SeqID_168748
atggataaagagacttttgagttcattgactctgacaaaaaaatcaaaaagttggaagctaaagagaaaaagtcaaatccaaaaacttgtgcgtctagtaagaagaaggaacttgataatgaggaaactgaagaacctcttaagaggaaaagagtggacgaagtggaagccactactgaatctgatgaacctaaagctccattagctcaagtggtgcaacaaccaaagaggatcaaaaccttggagtcattgaacatctcattcccttaa

SEQ ID NO: 77064 - DNA, 768 bp, Glycine max
  Peptide Sequence Number=SeqID_168749
atggctaggttggataatgttggattggagcatcacagcattttggcgtttgagttcattcttttaagagtatggacggtgggagttggtgaggttcgtggaaaagtgaagcgaaacggtgaaggaggttgtcaagggaagggggggttattgggtctgggatgtgggttatctggtaaagaggagaaatgctatgagtctgggcataccctcatcgtgagtgcagaatggtctatggtcacaggacctaaaagttttaaccactgtacccctaagacgatgaaaagtatgtctgtggatcgtaacggggatgttaaggcacatagaggtgcaatccagcatggtgcaatcactaatcataacgcgcatcatggacgtcggggtggaaggaaggtggaggaagttagccaagcgggattggaggaagttgtgagtgatagtgccgtagatgcgaaacgagtggaaagaggagccggaggaatcgaggaggattcatcgtcttcatcatttgtgatgatggccaactcttccgtcgaaaggtgtttaatcgagggtttcgggtttggagggaaggtagtgctacgacctgcagaagggataggggttgaaacgcctgcacttcgcggtggagttcggggtagatcggagatgaaacaactcagcaaggagggtggagctaggctaactatgcggtttgcgaggcatttgaactcggtgagatactcattcacggagctgtgctgttggagcttgaataaagtgcactaa

SEQ ID NO: 77065 - DNA, 837 bp, Glycine max
  Peptide Sequence Number=SeqID_168750
atggctaccaaaggttggagctttgttggagcttcaatggtggagggaagaagaagagaatggcaacctgccatcaatcgcttagatacatggttcacagatgaaggaaagaagagtgactacaagctgatttatgctgtaaaaaatgtgagagtccccaagtatctagacttggagtggttttctcaacaagagttcaactttcccaatttgttggaagttcacaagctgacaaagctggtgcaaatgaaagggacattttatccaaaactagtcaaagtgttctacacttatgcacatgttgaccttaaaggtaacctcttctctactgttaatggagtagatatgatcattaatgctactgtgtggaaggaagttactggtctggacatgggtggagtccgtaagtttgatgaaactatagatggttacaacaagatgcagatctataggggaatgtttcttgatcctgacaaaatgctagtataccttatcacctacattctcacaccaaggtcaagcaatcatgctcaggtactagatgatgatctgcagattgtttatggtatgaaatcaggtatcaagatgaattgggttgatgtctttgatgagattgtggattttaccaaagcctctagtgagataactgaaagacatctcaagacacttggtataaggtatgttgatcatgaatggataatggctgtagagcctgctgctgggaacactgaagatgcgcgcttgccgcaaatcccaatcgagaggaaactcgctcagtgcgaggggttgcgctcagtgccaaaagtggatttctgcttagtgagacgagctcgctaa

SEQ ID NO: 77066 - DNA, 489 bp, Glycine max
  Peptide Sequence Number=SeqID_168751
cttggggggattgatggggacccggtgttgagaggaacgaggataagggctacgtgggagtacgtgagctcagttgaaggtggtgaggaagtggggaagggtgagacttcctacttttattcgttgaccacagagtggtacctggagatatgtcgcgggggtcaggagaccttagggacgtcagtgatatctggaatatggcctctggtaatcgattaccaagggcctagaaatgggatcaagaacgtgagaaggcttctgatcgtgatggcagcgcagttcatccatgaccgagtggagatggagtgcctagagggagcttgggagaccctcgaaggcaatgcgaggtgccgattctgtggcacgatccgactcacggctacttcgttggtacatccagaggaaccagcacgcacgcttcagcgcattgtggagtggatattacctacacctactccatatatatgcaactctctaaaaagtcactga

SEQ ID NO: 77067 - DNA, 1065 bp, Glycine max
  Peptide Sequence Number=SeqID_168752
atggatccagacatgttggcaaaggcaattgtggagcactactacagcacctttgacaccaaccagagcagtttagcgaatctgcatcaagaaggttccatgttgaccttcgaagggcagaagatccagggtgtttccagcatccagtgccaccactccatttccaccatcaactgccagccctccggcatcaacgtcagcatgcttgtctttgtcagcggcaacctccaactcgttggcgaacaacacatcctcaagttcaacgagctctccctagtggcatttggcttgaagcttaagttcatattgattaatggaagtctaatcacaaaatacactatctctaacgcagcgacaagtgtgaatttttcacttgcacagcttattcaggttatcattcttctttgcactagtggcaaaaatggtggaggatatgaagcatccaaatatgaagttattgcttttaatgggggaataatgttcctacacggtagaataaatagtgttcctatctcagtgatatcattcttaagacagttgggtgtaatctggaatgttttaggcgtttttgttcttatgatactcattccatctgttgcaacgaaaagggctagtctaaagtttgctttcactcatttcaatactaaaaatgaggatggaatcaaaagcaaacccaacatatttctcttgggactactaatgagtcaatataccttaattgggtatgatgcatcagctcatatgacagaggaaacaaagggtgctgatagaaatagaccaaaaggaatagccagcgaagttgggatatttattatagttggatggggttacatactaggcattagctttgccgttactaacatcccttactttttgagggaaagtaatgatgcagagaagataccgcaatggaattgggggcattatttgcttggtagttgtttctatggtttgacttcgatcactagcaattcaaggatggcttatgcattctctagagatagggtcatgccattgtcatcattgtggcacaaagtcaataagaagttatataaaaagtcataa

SEQ ID NO: 77068 - DNA, 273 bp, Glycine max
  Peptide Sequence Number=SeqID_168753
atggtaaatatcaccactgtcatgccttcatgggaagagggagagcacaaatttgtcacttccaaggacctcttccctatctggtgcatgagccacgaactacggtccaatgttgggagccataacagccagagcctcaaccgcaacaacagcctcaatgatactgtcagcggcattctccagtacatcacatggaggagagggctcaacatcaagagcagcctaagcaagccttcaatattacctccccagtgcactgccttgactagctag

SEQ ID NO: 77069 - DNA, 903 bp, Glycine max
  Peptide Sequence Number=SeqID_168754
atggcgcctaggaagttgagtttcccccaacacagttatcggacttcaaagaagccaaaaattgagcaacattcaaaacatttgaatgccaaaaaaatgcaacaaactaggggcagttcgtctggaaacatgaccaacaacaaccaaagccggatgtttcataggagtcgcacgacttccaataggggatacacacacactattcctaaggacatgccctgctgcttcaagccaattgtggacatgaatcttacatttgaggagacacagataatactattcatgtgtttgaaggttgcttacagccaactgtaccgcaccaggagtgtttggtgtatgccaccagcctttgcggtggacgtcattaatggaagtccagtggaaactctgattgaacattatggaaaggattggatgcctccattttcggacttgaagctcatttacattccgattattcaaaattcagcccattggtatctcatggtcatagacatgaatgacagaaacatttatcatctagattgtgacctcacaagtcaagctgcatatcaacgcaaagataccattaaaatcatggcgaatgtgatgcttagtgttctggaaattgtgtttccaacacaagaattcgttattggctttgatggaatggattgttgggatattattgaagctagaggaatcccaaattgtggatccagtgagaaatcaacattatgggtccttgaatggatgcaaatggaggagtcttttgtcagtcttttgtatggagtgctcgaagaaaaggccgttagaatgaaggtggcaatgatcttgctgttagggacacacaaccagtgcaggggagagttgattacaaatgcagagcgcaactggcatgactccatccatggcaaacactga

SEQ ID NO: 77070 - DNA, 276 bp, Glycine max
  Peptide Sequence Number=SeqID_168755
atggaatatctaagctctgattcccttgataaatcagaaaccagtgagaattcgtatttccaatcaattactactgaattccttaattcattgaaaacatccggtttgccaactcattctatcaaacttaaaattggaagtcctataatgctgttaagaaacctcgaccaaaatcaaggtctatgtaacggtactagattagtggtgacaaagatggcagaacatgtaattgcagctgaaattatctcagacaattccattgattttaaatactaa

SEQ ID NO: 77071 - DNA, 246 bp, Glycine max
  Peptide Sequence Number=SeqID_168756
atgacctcaccccagaagacacttcttaggagcttagggatcacctccgcctcacttacaaccttgaggacaaggttaatcttccataaggggaatgaggaaactgaagaacctcttaagaggaaaagagtggacgaagtggaagccactactaaatctgatgaacctaaagctccattagctcaagtggtgcaacaaccaaagaggatcaaaaccttggagtcattgaacatctcattcccttaa

SEQ ID NO: 77072 - DNA, 423 bp, Glycine max
  Peptide Sequence Number=SeqID_168757
atgaagaatggtgaaaccatttcagaacttgaaacaagattcatccatatagtaaatcacttgcttggtcttggaaaaacgtttgaagatgatgagttaaacatcaagattctcaactgtcttacaagaacttgggaatcgaaaatcacaatgatcaaggaatccaaggacttggcatctatgtggatggaagctctcttcggaaaatttcttgaatatgaacatgggttgattcgacaatctcatgtggaagatacaaaaaagaaaaggaaagggattgaactcaaggatgaatccttaaccattgaagaaactgaggtaaattctgaatttgaaaaacttttagaagcctttaatgaaatgcatgaggaaacacaaaggcttgctatttcgaacaataagctaagaagcgatctaaaatga

SEQ ID NO: 77073 - DNA, 228 bp, Glycine max
  Peptide Sequence Number=SeqID_168758
atgggaaaggctcttattgatttgggagccattattaacttaatgccattcatgttaattgcgagctgcatagttgatatggggagaaagaagttggagttgggctttgaagatcagaaaattgattttgatttatttgtcgaagacaagcctgctccagaacaaaatgtttgcttacaggtaatggaagtgggtaaggaggttctggaagtaagaaccaaaacgtga

SEQ ID NO: 77074 - DNA, 240 bp, Glycine max
  Peptide Sequence Number=SeqID_168759
ccatctgccccatctgatttgtcagactctaaatggaggctcttgtctcttgctcaaattgcatattctggatggtcatttgcctcactaactcctctaaggaaggttgaggaggggcctcagttgcttattgtctttgttgttgatgttgttgctgctgctacattggaggaggaacatatggcttgcttgaaccagaagcattttggaaaggagggacaggctgttgttgttgtgtag

SEQ ID NO: 77075 - DNA, 240 bp, Glycine max
  Peptide Sequence Number=SeqID_168760
atgactaaagcacgtcaaaagggggtacggaaagaaaatgaaggaggagcttgccaccccagctcgcccaggcgagctaggttgcttcctccagaaggcaccgccttctgggggaacttcctggaaggccccaacatgtctcggaacttcacgaattgcttaatgatgggtgccaagtacctcaaagtggtcatacgaggggcgcatcccaacaaatggatggtcctcggacgaaattag

SEQ ID NO: 77076 - DNA, 249 bp, Glycine max
  Peptide Sequence Number=SeqID_168761
atggcttcctatggttgtgagcttctcctagaagtggcatctccaatcatctttcttccttctccattaccctaccatgatcttaaagaagcaaaggactccatttatgaagaagatccaaggcctacaagctccacattgagctatatcatgtggtatcaagagcatcttcgtctaggttctatcatttttcagtcatactattcttgtgctgaacctttacatctaaattttattccaagatattga

SEQ ID NO: 77077 - DNA, 96 bp, Glycine max
  Peptide Sequence Number=SeqID_168762
atggcgaggacgtgtagtcgtctgaaggtgagggcatgtagccctctgcaggcgagggcttgcagccctctgaagattgactgtccttttgaatga

SEQ ID NO: 77078 - DNA, 726 bp, Glycine max
  Peptide Sequence Number=SeqID_168763
atggaacgtgtattggctgatgtacttagagatcaaaggaatttgggcaacaagggtgacggaggttggaaaaggtcagcattgaatgctgcagccgcagtgttgtctacaagcttcattgttaatgtcacatcatataatgtcaaaaaccgtatcaaattatggagatcgtggtatggtattgtaagtgacatccttgggcagagtggatttgattgggatggcactaagcacatgatcacagttgagaatgaaaatgcttggaatgaatattgcacttcgcataaatcggctaaaccatttcgattcaaggtgcttcaaatttgggatgatatagtggatttttgtgctaaagatagagccaccggtgctactgccatagatttagaagaaccaagctctaatacaagaggaaaaagacaaggttcgacttcttctggcacacatcctcacaagagaaagatgggagaaaaagaaggaatagcagcttctttggataaaatagccaattcttttaaccgaatggtagaaaaaatggatggtaaagttgatgatgaaaatattcaagaagtattacgtgaggcagctttgataccagatcttaatagacaacaatgggctaaagctattaaatggttagctgacgatccaaagcaattagctattgtgaaagcccttccaattcaccaaaagacagattatgttttaacacatcttggagaatga

SEQ ID NO: 77079 - DNA, 228 bp, Glycine max
  Peptide Sequence Number=SeqID_168764
atgatgacaaaggtgatgaacaaaaagctcaaaagatcaaagaacaactcaagtgaatcaaagaacatctcaagtgaatcaagaacaagtcaagagttcaagaatcaagaagaattcaagactcaagaaaaaagcctacaaacaagaatcaagattcaagattcaagatcaagattcaagactcaagattcaagaataaagaaaggactcaatcaagataagtattaa

SEQ ID NO: 77080 - DNA, 534 bp, Glycine max
  Peptide Sequence Number=SeqID_168765
atggctatttcatatatagttttaacttatacacaaaaagcggcaccaaaaacttcaagcaacatagccaaaccactcaacaagagaaatgtttatatcacaagaacaagccctccttcagtctatgaagcatacttcgagcattttgaaaaaggatttcaaactttttctaaaatcacgctcagagtaactaaggttgcgtggtattatgaggtaattagtatggtactcaacgacaaggtccaagagaggcaagattggacttctttaatctacgtagatatcgtcatagtgctgaagaagttagacaagtggttgaagcagaaggatgcaaaccttcaagaggatgttgatgattttatacttaatagtaaaatgagaggagagttaataactaagaccattagagctgtttttgaacctctcttgtcagctgagtttggtgaaggtatcatagatgaattattcttaagatatgcaaaattggttgcccaactcattgaggtggagacattggagcatactaatggatga

SEQ ID NO: 77081 - DNA, 450 bp, Glycine max
  Peptide Sequence Number=SeqID_168766
atgaatgaatctaggtgggaacaagagttaagtcctgacaatcgatatgaagaagaaagaactcctaatcttgaaagtgtgtttgagaaattcatggcataccatgctagctcaaaagccaatcaaaattcaatgaaaaatcatgaaattcattttggcaagagctactcaatagaaaactttcaagggggaccaaagttacaaccctactatcaaaatgaagcagaaagaggttccaatctggataatttgttgatgcaattcaagcaaacaactaaatcaactcaacgagaactccaaagtgtagaaatccaggttggtgagctggcagaagaagtgactcaatttatgtccagacgagaaaaatactttatagaggttgaagctcaagaggaaaaccatgtaaaagagcatgagttaaaagaaaaagatgaggagaaagatgagtaa

SEQ ID NO: 77082 - DNA, 309 bp, Glycine max
  Peptide Sequence Number=SeqID_168767
atgcggggttaccttatggttacccgcacctttgctcaacaaggggcaaacgagcccgttggcgcgcggagattaacatcgtcctcggcacctttttccgtcttgacccgtgagtcaagtgatatgcggggttaccatatggttacccgcacctttggtcaacaaggggcaaacgagcccgttggcgcgcggagactaacatcatcatctgcaccttttgtcgtcctgacccgtgaagtcagattacatgcagggttaccttatggttacccgtacctttcgtcaaccaggggtaaacgagcccgttga

SEQ ID NO: 77083 - DNA, 948 bp, Glycine max
  Peptide Sequence Number=SeqID_168768
agggctacaggccctcgccttctgaggactgcacgcccttgcctttcgaggactgcacgcccttgcctttcgaggactacacgtctttgccttcagaggaatacacgttgtcgtcttcaaagggctgcacgctctcactttcagaggactacacatcctcttcatcataggactacacgtcctcaccttcagagggctacacgccctcgccttgaggactacacgtcctcaccttcagaggactacacgtcctcgccatcagagggctacacggtctcaccttcagagggatccacgccttcgcctttagaggactacatgtcctcgccatcagagggcttcacgccctcgcctttagaggattacacgtcctcaccttcagaggaatacatcatcagagggttacatgccctcacctacagagggctggacgccctcaccttcagaggactacacgtcctcgccattagagggctgcacgccctcgtcttcagaggactacacgtcctcaccttcagagggctacacgccctcgtcttcggaggactacacgtcctcaccttcagagggctacacgccctcgccttcagagaactacacgtcatcgccttcagaggactacatgtcctcgccatcagagggatacatgccctcgccttcagaggacaagacgtcctcgtctttggaggactagacgtcctcgccttcagagggctccacaccctcaccttcagaggactacatttgctcgccttccgaggactgcacgccctcgcctttagaggactacacgccctcgccttcagaggactacacgtcctcgccttcagagggctgcacgctctcgccttcagagaactacacgtcctctccatgatagggctacaagtcctcaccttcagagggctacacgccctcggcgtgaggactacacgtccttacctttag

SEQ ID NO: 77084 - DNA, 471 bp, Glycine max
  Peptide Sequence Number=SeqID_168769
atgaccaatcatcaaactggatcgctacgatcaggtcagcatgacgctgctgctgatcatcgtggtggtgtcgctgctggatacgctatccggctggctgcgccgccgtgtggtagaaggagacgtaaaatgatcgccttagcgcccgacgtggcgaaactgaaacagcagcacgctgcactgtttgccgcgcaaaaccgttatctgcggcgcatcgcgctgattgcgctggcgctggtgctctactatctgttcttcttcagcgtgttcggcatcgactggcagcgctttgtcatcggctgccagcagcttggacgctatttcctgcgcatgttcgtctggcaggatttcgtcaactggccgtttggctactatttctcgcaggtcggcatcacgctggctatcgtgtttgccggcacgctcaccgccaccgtcatcgcgctgccggtctcctttcgggcggcgcgcaat

SEQ ID NO: 77085 - DNA, 360 bp, Glycine max
  Peptide Sequence Number=SeqID_168770
atggaagctttcttgtgggcttatatggtcatgttggagggcaagagatcttatatgctgagatttaagcattgttgtgcttgcacagcaaccgcaaccacaatttttcgactcaccctcattcatttgagtaataatatgcctttgtgttataacatgtatagcaatgagattgggcttatcaagaagttgatgcctttgtgtgaggtgcagcacactctccatgagggaaatcagtgcgcagacatgttagcaaaactgggagctaattctttgagtcctcttgatgctttgcatgatcccccagttgcaggcagatgcactgagggttgccttcccaaggctgtaattcacttttag

SEQ ID NO: 77086 - DNA, 243 bp, Glycine max
  Peptide Sequence Number=SeqID_168771
atgaaggcccaagtggagaaggacgaaggcccaagtggagaaggacgaagcccccgagtggagaaggatgaatttagaagcaaagactttgcctttgatgtttcgatgatgccatatgatcatgatgttttgatgccttatgaaaatgcgcttctcaagtttaattcaagaaaaaaattcaagaatacaagatacaacatcaagaagatctctagtgtttttaggaagggaattccaaattga

SEQ ID NO: 77087 - DNA, 261 bp, Glycine max
  Peptide Sequence Number=SeqID_168772
atggcgatacatttatacaaaacttctaccccaagcacacgcaatggagccgtagacagtcaagtaaaatccaatccacgaaatcatttgatctatggacagcatcgttgtggtaaaggccgtaatgccagaggaatcattaccgcagggcatagaggggggaggtttacggcgaaacctagaaatcgatcactgatccaattggagtacctctacaggatagacctcaacagaaaactgaagagtaacggcagcaagtga

SEQ ID NO: 77088 - DNA, 492 bp, Glycine max
  Peptide Sequence Number=SeqID_168773
atggcttcaaactcccagcaatttagtgccagaagtgatgctattgtcattagaggagtgcatgaagtggccacgaattcatcttcatcagtcgagactaagaagcttgaagactctgtggtttatgctcctctgtcgaccaccacacagacctttgcccttctgtgcaacaatctgaagcaattgaatagcctgaagcttatgctgcaaacatctacaacaaacctcctcaacctcagcaacaaaatcagccccaacagaacaattatgacctctccagcaacaggtacaatcccgggtggaggaatcatcccaaccttagatggtcgaatccttcacaacagcagcaacaacaacagccttattttcagaatgctgctggcccaagtagaccatacgttcctcctccaatccagtagcaaccacaataatagccccagaaacaacaaacagttgaggctcctccgcaaccttcccttgaagagcttgtga

SEQ ID NO: 77089 - DNA, 489 bp, Glycine max
  Peptide Sequence Number=SeqID_168774
cctgaagcttatgctgcaaacatctacaatagacctcctcaacctcaacaacaaaatcaaccacaacagaacaattatgacctctccagcaacagatacaatcccgaatggaggaatcaccctaatctcagatggtctagccctcagccacaacaacagcagcctgctccttccttccaaaatgctgccggtccaagtagaccatacgttcctcctccagtgcaacaacaacaacagcaacaacaacatcaacagagacaacaatccactactgaggcccctcctcaaccttcattggaagaattagtgaggcaaatgacaatacagaacatgcagtttcaacaggagactagagcctcaattcagagtgaatcttttactggtaattctgacttacagcagcagcatatccttcttccattccctccaagagcaatttccaacaaaaaaaatggaagaggcagagaaggatatcgtggaaacatttag

SEQ ID NO: 77090 - DNA, 489 bp, Glycine max
  Peptide Sequence Number=SeqID_168775
atgtctcttgctactttgtttggaaagttacaggaacatgaaatggaattgatgagattgaatcaacatgaggagaatgataagaaaaataaaggaattgctcttaaagcttcatcttcaacccaagaaggaagtgataaggaggattcaattgaaatagacgaagatgatgatcttagtctatttaaaagaatagagaaatctgaaaagaaagtctttaatgaaaagaaggctaagaaggcctacattacatgggatgacaatgatatggactcatctaaagattcagaaaatgaagttgtaaacctgagtctgatggccaagaattatgaaagcgatgaagaggtaacatcttctaataacaacttatccatcttatttgatgaattacaagatacatttgctgatttacataaagaatcagttaaacttgcaaaactggtttcatcttctaagaaaacaatttcaaatttagaaaaagaagtttaa

SEQ ID NO: 77091 - DNA, 560 bp, Glycine max
  Peptide Sequence Number=SeqID_168776
ccctgagcatctggcaggcggcgcggcacgaaaggcacgatcgacggccgtcccatgcgcgccaggataaaggttccggtggtcgtggcggcgttttccacggcgaagagcggcgcgaacacgctgctttgcggcccataatcgtgatccggcgcgtaccacaggatttcgccctgtttcaggttgcggatcatgcctttgatatctttacgatcgagcatgaatttattcgagcgcagccggccgcgggtctgtacccactccatcagcctgttgttgtgcgggcgatgcacgccgatgccggggttttgcatgccgaaaatgcgcgcgcccagttccagcgtcagaaaatgcagaccgatcagcagaacgcctttgccgccctgacgcgccagccgcatgttttccatgccgctcacctggaaccagcgggcgatgcgccagtcgggccagaaccaggccatgccgacttcgaacaggcccataccgacggactcaaaatttttgacgatcagcgcctcgcgctcggcggcgggcattgcggggaagcagagctctaa

SEQ ID NO: 77092 - DNA, 312 bp, Glycine max
  Peptide Sequence Number=SeqID_168777
atgcagtgggtcgagctacaaggcggcctgcaggccattttggacaaattccgtcaggggcagttcggcgatatcgtcggttcctggctcggcaatggcgaaaatcagccgattaccggcgatcacgtacagcaggcgttgggtagcgacgccatcaaccaactggctgaaaagctgggtatcgatccggctcaggcgtccagcaccattgcacagttcttgccaacggtcaccgatgccgcctcgccaaacggtgaagtgcagcaagacagcaacgagctgggcgacatggtcggtaaactgttcaaataa

SEQ ID NO: 77093 - DNA, 570 bp, Glycine max
  Peptide Sequence Number=SeqID_168778
atgaccggaaggatgcttgccggttcattggctcttgaaagccgcacccttcactatcttattgttcatattttacttccaagatcttcaaaccttgctcaggtttctgaagaagatcgtatagttatgtgggcttttcatactggccgacaaattggttgggcacatttagtccgatattgcatgcataaggcattgcaattaaatgctcctttaccatatccacatttagtcactcttttccttcaacatttcaacatccttcttgattttgaaccttatgttccaatcaagagatctttcttaatcggtgctgttgtggttgcatcatttggttaccgcaaagagcgtgatggctcttgggtaaaaaagggtactcaaccaaatgatgatgaaggacaattatcagttgaaggggactcttctctccttcaaagtattttagacaggttcgatggactccaaacatatgttggtgaaaggtttgaagcactggtgcacagcattccacaatgcctattttgggaaaagagccctagaagcaacgaagaggaacaacttgcgcattga

SEQ ID NO: 77094 - DNA, 228 bp, Glycine max
  Peptide Sequence Number=SeqID_168779
atgataacaaaagatgatgacaaaggtgatgacaaaaagctcaaaggtcaatcaaagaatgagttcaagatattcaagataaaatcaagaacacttcaagatttaagaggaaagttgatttcaagaatcaagatttcaagagatcaagattcaagactcaagattcaagaatcaatagaaggcttaatcaagataagtatgaaaaggtttttctcaaaaattgagtag

SEQ ID NO: 77095 - DNA, 120 bp, Glycine max
  Peptide Sequence Number=SeqID_168780
atggaggtggcgataaccaccggctatgttgccagtggcagtggcgagaagccactggttttacttgattttaacaacatggcttccaatgcaggatatctatggtgtagacgaaaataa

SEQ ID NO: 77096 - DNA, 845 bp, Glycine max
  Peptide Sequence Number=SeqID_168781
gactacacatccttaccttcaaaggactacagagcctcaccttcagagagctacacgccctcacctttagaggactacacgtcctcgccttcagagggctacacgctctcgccttaagaggactacacgtcctctgcttcagaggactacacatcctcgccttcagaggactacacgtcctcaccttcaaagggctacacgccctcactttcagaggactacacgtcatcaccttcagaggacaacacgtcctcaccttcagaggactacacgtcctcgccttcagaggactacatgtcctcaccttgagagggctacacgccctcaccttcagagcgctacacgttctcaccgtcagagggttgcatgacctcacctttagagggttgcacgccctctcctttagaggactacacgtcctcaccttcagagggttgcacgccctcgccttcagagggctccacatctccaccttcagagaactcaagggtgaccaattgtgcgagcacaaccagagagggaggctatcgcacaactactatgcatatcggggcaagattgcaccagtgccgttgcaaagagacgaacacccagtggacccaaagaagtccaacagggtcttggggtttctagctctgattatgggcctctgtcagttctatagagtgcccgtcgctcctagcaagacaggcgcagagcaagacaccatagcagcctggggatggccgacaacgggaaatagacgcaccgccgccacctccagagcccctcagctcatctacaaaggctggagcgttgcctacgacctgtggccgatcagcaggcgaccaagtccaaagccaaag

SEQ ID NO: 77097 - DNA, 390 bp, Glycine max
  Peptide Sequence Number=SeqID_168782
atggtaggttacacgccttcaagctttgcggatttggtcttcgccgatgaaaggattgaagtaaaaagaggcaaatttaatcatcctgcttggacgaatgagaaaactagggcaaatgaagaggatgagaaggagggagaaacccatgctgtgactgccattcctataaggccaagttccccaccagctcaacaccatcattactcagccaatatcagccattctcattacccaccacccatttatccacaaaggccatccctaaatcaacaacaaaacccacctaccacacaaccaatgctaaagcacaaaccaaaacaccaaccaagaaatgaattttgcagcgaaaaagcctgtagaattcaccccaattccggtgtcctatgctga

SEQ ID NO: 77098 - DNA, 564 bp, Glycine max
  Peptide Sequence Number=SeqID_168783
cacgtggcccaagatatctccgtggagggcttcgagggcatcgttaacaatattacggctaataaccacctcacctttgccgaggaggagatccctatcaaagggcagggacataatagggccatacatgtatccgtcaagtgtatggatcacattatggccaagctgcctattgggccaattgtggatccactcggttggggtggtcccttcgacactccatcaaaagctgaagttcgtggtagagggacgcttagtcatcgtttcaggggaggaggatattctaggcatggtaatgagcccgaaatgggcttgggaaagaatagtgatggcatggccaacttggtggaaatcaaggaaaatcgcaggaagtttgggctaggctataagcccatgtgggctgatatgagaagaagtgccctagaaaggagaaacaggggaatgggctcacaactaaggctgcaagtgggagaggcccctccatgtcacatcaacaagagcttcataagtgcgggcttgaggcgtaaagagcaagtcgccaaggtacacgatgaagctccctaa

SEQ ID NO: 77099 - DNA, 396 bp, Glycine max
  Peptide Sequence Number=SeqID_168784
atgaaggctgacatgtcggctctgaaagatcaaatggcttccatgatggaagccatgctaagcatgagaagattaatagaaagtaacgcagccacggctactgccgctagcatcgtcgctgaggcagattcggctcttccgtctgcaacaaatctagcacatcaacttgcctcggatatggaccttcccttgaatttcacaccacctaccatgaacgagaacatggaccatgccgttccctttaccttcgaagggcagcctccccagcctgtagggggcgcctgcgaagagcctcgggagcgtaccttaggggacattgacttatacccccttttcaccactgagggaccgacacccaatgccttgcctcaacctaatatcgcaggagtctcttaa

SEQ ID NO: 77100 - DNA, 381 bp, Glycine max
  Peptide Sequence Number=SeqID_168785
atggaagaggaggcaggacacatgttcttccattgcagcaaagttatacctatttggtgggaaacattatcctgggtgaagaagtctacagccttaccgtatgatccaagacatcatttcctacaccatgaatctatattgaatgaggggactagggataatagatggaagtgttggtggttggcggtgacatggacaatttggcagcaaaggaacaagacgatattctccaatgaatcaaatgaatcttttgacagcaacaaagttatggaagacgcagcttttctgttatggacatggctgaggcatttggagaaagatttctcaatgcatttcaatcaatggacttgtaatcttagagcaggaattttgtatcagtaa

SEQ ID NO: 77101 - DNA, 288 bp, Glycine max
  Peptide Sequence Number=SeqID_168786
atggcctcctatgaaacaaagaaatccattgatgaagaagatcctaggcctacaagctccaatggagcttacatcattttagaatacttaactttccaagacggttcaataaccgtcgttgtagaggggtttggaaaggtgagaaagcaacgagatgggaagctacttggaaagggttcaagcaagagtttgaacctaacttcattgcaaaatgaggttcgtgttggtgtgcttagagctagtggctacagtggttctgacgtaagctacatggcacaatctttctaa

SEQ ID NO: 77102 - DNA, 651 bp, Glycine max
  Peptide Sequence Number=SeqID_168787
atgatcgtagtagtcgctctcacaggctactctctattttcagctgtgattgttgctatgccatgcccttccactatgcctcgtgcttggactttctttttgcttgatcaggaagtaaatttacctgttgaagaacttccttcagagcttcctgagcctgtcctgggcattaactttgctagggatggcatgcaggaaaaagactggttatctttagttgttgttcatagtgatacatggctacttgcccttgccttttacttcggagccagatttggatttgataaaactcacaggaatagactattcagtatgatcaatgaactaccaacaatatttgaagttgttactagtgcagcaaagaaacaagttaaagagaagtcttcggtttcaaacaacagtggcagcaaatctaaatctaggtctaacttgtatgatttcatttcttggaagcaccaatttagaatttatccagatctagagttgaccttaggtcttcctatgcatactgatttcaatgttctcataattgttttacagtcacaagtttctggtctccaagtgatcaaagatgggaaatgtattgcagtacctgttattcccaatgcatttgttatcaacctgggagatcaaattcagagaaaaggctag

SEQ ID NO: 77103 - DNA, 618 bp, Glycine max
  Peptide Sequence Number=SeqID_168788
atgacgctgatcaatccaataaggctcacagaactcgtcaatctggtgccaaaaccaacaagaagaagactaagaagaagcaaaagtagaatctcgatgacgtcggaggtgaggatccgaggaaaaaaaaccctaaggcatttgccttttcttcctccaacaaagccaagcgcttgcaatcacacatcgtcgagaaagagcaacgccgcctccacgctcccgtcatcgaccgctcctacgacgagcttgctccctacgtgctcgtcgtgcatagccctcctcagttggatcgtgctcaagaatacatcaacgaggctgaaaagcttgagcctaacattgtctgtgcttttcttaagaagtgtgtgcgagtttgagatgattaagaaaataaacaaaggaacttatggtgttgtctacaaggctagggataagaagacaggagaactagtagcattgaagaaggtgatgaacatagagagggatggatttccaatgtcatccttgagagaaataaacattctcttgtcttttaatcacccctccattgtgaatgttgaagaagtagttgttgatgattttgatggtactttttatggtaatggagcacatgaagtatga

SEQ ID NO: 77104 - DNA, 1644 bp, Glycine max
  Peptide Sequence Number=SeqID_168789
atggaggacgtagtgcggtggctaatcaagagtagtcttgagttggtcgatacgcgatactacactcaaacgagactttcctacgaacattgttggaccgggagtagtcccgtaatccgacaatattcggaagtggtcaatgactttgggaacttggtagaacccgtgatacagacaagttttgttgtaaacatcgtaggaatgaacttcacaaagaggaacactcagaagtataacttcaaggacccggatttgacaaatttaaggaagctaggatctttggtagttagtccggacgacttccgaaaacgctacgggaatttgctcagcatcctcaagacaaacgttgaagaggggatccttaataccttggtccagttctatgaccctctctatcactgtttcacgttcccagattaccagcttgtccccactttggaagaatactcctacctagtcggcttaccggtgtctgacaagttacctttcagtggcctcgaaccaactcctaaacctttaactatcgccgcagccctccacctcaaaacttccgacataaccagtaaccttactaccaaaggaggcttccaaggcctaactcccagtttcctctaccaaaaagcctacacctttgccgaagccaccagtaccggtgccttcgaagccacccttgccctactcatctatggccttatactcttccctaacatcgacgatttcatcgacattaacacaatccaaattttcatatccggaaaccctgtccccaccttacttgcagacacctaccattccattcaccacagaacacaaaagaaatgcggagttatcacttgttgtgcacctttgctatacaagtggtttactttacatttaccccaaacccaccttttcaagactaatccagagaaaacccgttggcctcagagaatcatgtccctcactccaattgatatcctttggtaccaaccagctagtaacattggagtaatcatcgacagttgtggagagtttcccaatgtacccctcatcagtacacgtgggggaatcacttacaaccccactcttgccagacgccagtttggataccccatgaaggaaaaacctaacaacctctccttaaccggtgaattctacctcaaccacgaggaccatgcaggcatgagattgagatttgtgcgagcctggcacactgttcgtaggcttgataggaatcagttaggaagaaggacgggttttgtacatggatcctatactcagtgggtcatcgacagagcttcgattcttggtttaccctaccccctacccaggcacgtatcctcaaccgttccatcaccatccttacctgtgccctttgataacaaagaggaatgcaatgagcagttgattcaaatgcggcttgaaagggatacttggaagaaaaaataccaggagctcgagcgtgagaatgagaccttgaagggaaagctggcgcagaaagatcatgagcttttcgttcagaatcagaggataattgagaaagatgacttacttcgtcgaaaggacgctttgctcagacaggattccaagaggaggaggaggtttatggattcgctctctagtgcacatccggatttcgaggatccatctactccgggagtttga

SEQ ID NO: 77105 - DNA, 489 bp, Glycine max
  Peptide Sequence Number=SeqID_168790
atggcgcccaccaaactctttgtctctctcactttagttctcagtctctcacactcactcacctcacggtgctacaactcccactctttttctcggcctctcactctcactctccttgccgagccattagtggcggagaaggaagggatctggatggtgctcacggaaactttggaggacgctaaggcacgacatctggcagcagttcttgtctgggtcattatgaaggaacctctcacagaagttcacatgccaggcctcgctggatccgcggtggaacaaccagcgcttcaacatcggcaactcctcttcatggcctgccacgatgacgccaagggagtcagggatttgctcaatgaaggcttgcggcgagatctacatccttggaagagggttttcggtgaatctacgattcttagaatcagtttggctatggcagtggaagataagtggtgcatggtgatcgaaggtcgtggtttcgctgcttga

SEQ ID NO: 77106 - DNA, 255 bp, Glycine max
  Peptide Sequence Number=SeqID_168791
atgactctacaatttgttgatggttctaaaaagaaagcactatggaaagaagtaaacatgacaataaaggaggaccagcaagttccaatcattctaggaatatcctttatgagaaccgctcatgtaaccattgatgttcgtaaaggagtctacacacttagagagggcaagaaacatatgttctactacattcaaggcattgaagattttcccaatgaatcggctcaccaacaacaccatcatgcaacaccttga

SEQ ID NO: 77107 - DNA, 444 bp, Glycine max
  Peptide Sequence Number=SeqID_168792
atggcttccatggaagaaaagattaaaattggaggaggaatgattgttggtgctcaaactcttgctgctgagatgaaactgttgaaagaaatgcaagagcattctggggtcagaaagactttgaattcagagttatggcatgcttgtgcaaggcctcttgtgtcattaccccaagttgggagccttgtgttttacttccctcagggacatagtgagcaggtggaagcttctactagaagaacaacaacgtcacatattccaaactaccccaatcttccatatcagttgatgtgtcaagttcaaaatgccatacttcatcttcctttccaatatttgtacagggaggataaacttttagagcatgccaaagctcttaaagtaaataccggaattgaacctgatatagaacttggtccagtgatcagcaagcagatttgtttatga

SEQ ID NO: 77108 - DNA, 345 bp, Glycine max
  Peptide Sequence Number=SeqID_168793
atgagtaagggctgggatcctggctctgctaacgcagggtgtactggtaaaagctctcatttagctacacatgtcccctatgattggccgcctgttggtcgaccaaatgttgcatatatgcgtgcatctggagctcaatcctctacacgtgagccaagatggactctaaggatggaggctgatgtagaggtggtggtggtgcatctgcggctagctgctgatggtcctattaatgggaggctagataagctttgtgggtgtaaccggcaccccatagaactggcagagacccgtgatcaaggccagaaatcccagtgctctattggacttctccgggtccactag

SEQ ID NO: 77109 - DNA, 180 bp, Glycine max
  Peptide Sequence Number=SeqID_168794
atggataccaaggaagcacttggaggagaaggcggaagctctggccaacttgctgattttgagccgctcgctaagccaattctctggcatagcgagccattcgctaagcgcaacagttcatggctaagcgccatgactgacgctaagccagaagtcaccgacgcacaggattttggttag

SEQ ID NO: 77110 - DNA, 2148 bp, Glycine max
  Peptide Sequence Number=SeqID_168795
atggatccgaacgtcattgagattccacctccgactacaaacaataacaacacttgtaattcaattaaacaaaaagaggccatttttcatcatgaggtgatcaacacagacaaagacaatgattctaccaagttaatattatttggtcagaaagttggcaaggggaaagcgattcagaccacccatcaaaacatggaagtgtgtgaggatgtgataggtaaatctagatggacttatggtcatagttctagttctgagagctcaaatgatgaagaagatgatgacaattgctttgattttttttcaaaagattatatgacatctcagtcttcattgtcactagagcctactattaaggaccctcctggagtacaatactctcaaactcccctgagtaagaagaaatcaaatggctcacaacaaaggaggcggaagttaaagttgccatgggaaatggggtcatctaaatcttttgagagtgagaagaagcctaacatttgttattcttctaaccataaatttgtaaacaattttgaggccaagaaactgccgcttgcaggtggaacaccacattggggactgccacctgcagatggggcactggattggggattgttgtttgttggtggggcactagaatgggaattttcacatgtgggtggaataccatattggggactgctacctgcaggtgctgtaagcgggactccgcttgagacaccacaatggggactgtcacctgcagggggtggaacaccaaaatggagattgtcgcatgtaggtggaacaccacattggggactacaacctgcagggagtagggcaccaaaatggggattatcgcatataggtggaacatcacattggggactgccacctgcaggtggtataggtgggactcctcttgagacaccacaatggggactgccgcctgtagggggtggaacatcagaatggggattgtcgcatgtaggtggaacaccacattggggactacaacctgtaaggagtggggcaccagaatggggattaccgcatataggtggaacatcacattggggactgccacctgctgggggtgggacacaaaaatgggaattatcacatgtaggtggaacacaacattggggactgttacatgcaagtggtgtaggcgggacaccacctgcaggtggggcaccagaatggggattgtcacatataagtggaacaccacattggggactgtcacctacaagtggtgtaggcgggacaccgcttgcgggtggggcaccaaattggggacaagctggagtttcaatgatgacagtttacaatccatatcattcaaattttgttggaccttcatatcatcatccaggatctgaatctattaatcagatgtggtcgacgaatgcttataatttgcaggcattccctaattataattattattatccatatgattataattatacagctccctttgctcatcattttcatgtccctcctgggccattgattcataactcttgggtttataattctgtgggagatggaaataatgaggcaactgccaataataccgttgctacaatatctgatgaagctagaggggaaattctgaggaaatttcaaagctttaaacaatttgacgttattgaagacgtttcagaccatcactttgttcatgccaactcttccatggaacagcattcaaagcattgggctaaaagaatccagggagagtggaagtcattggagaaggatttaccagattcaatatttgtcagagtttatgaatcgagaatagatcttctaagggccgtgattattggagcaaagggaacaccttatcatgatggccttttcttttttgatgttttcttctcgagtggctatccgcatgtacctccagttctggtctctatacagggtctaatcttggttgcgaagcctttctttaatgagcctgaatatgcacatttaagcaattcgcaatatggtgaaattagttctttgaagtacaatgaggacacattcatcctatcattgaggacaatgatatacataatgagaaggcctccaaagaatttcaaggactttgttgctgggaactttgcagccgagctcatgatattctggtggcatgcaaggcatacattgatg

SEQ ID NO: 77111 - DNA, 387 bp, Glycine max
  Peptide Sequence Number=SeqID_168796
atgggatgcaaatcaagaggtatcaaactttgtggggcacttgctccagctggaatgattgttgcatggacctctaaatgccttcctaattatcaaagagagaagtatgttgtagtaacaattgttgattgccgcacgcttcttgatccagtccttcccagtaaccatgctggatgtgtcctgcgtcttaatcttgaaatttatactaaggataaggaatctgagttctcaatgttagttgatcgtgccactggtggagccagcatcaaagatggtgaggtggaattgatgcttcatagtattaacacaatgtttactactcaaggcgtattctccatgatgatagtcgaggtgttggggaaccacttgatgaacaagtttgcgtga

SEQ ID NO: 77112 - DNA, 2055 bp, Glycine max
  Peptide Sequence Number=SeqID_168797
atggaagtgtgtgaggatgtgatgggtaaatctagatggacttatggtcatagttctagttctgagagctcaaatgatgaagaaaatgatgacaattgctttgattttttttcaaaagattatatgacatctcagccttcattttcattagagcctactattaaggacccttctggagtacaatactctcaaactcccctgagtaagaagaaatcaaatggctcacaacaaaggaggcggaagttaaagttgccatgggaaatggggtcatctaaatcttttgagagtgagaagaagcctaacatttgttattcttctaaccatgaatttgtaaacaattttgaggccaagaaactgccgcttgcaggtggaacaccacattggggactgccacctgcagatggggcaccggataagggattgttgtttgttggtggggcaccagaatgggaattttcacatgtgggtggaataccatattggggactgcttcctgcaggtggtgcaagcgggactccgcttgagacaccacaatggggactgtcgcctgcagggggcggaacaccaaaatggagattgtcgcatgtaggtggaacaccacattggggactacaacctgcagggagtagggcaccaaaatggggattatcgcatataggtggaagatcacattggggactaccacctgcaggtggtataggtgggactcctcttgagacaccacaatggggactaccgcctgcagggggtggaacatcagaatggggattgtcgcatgtaggtggaacaccacattggggactacaacctgtaaggagtggggcaccagaatggggattaccgcatataggtggaacatcacattggggactgccacctgctgggggtgggacaccaaaatgggaattatcacatgtaggtggaacacaacattggggactgttacatgcaagtggtgtagacgggacaccacctgcaggtggggcaccagaatggggattgtcacatataagtggaacaccacattggggactgtcacctgcaagtggtgtaggcgggacaccgcttgcagctccctttgctcatcattttcatgtcccacctgggccattgattcataactcttgggtttataattctgtgggagatggaaataatgaggcaactgccaataatactattgctacaatatctgatgaagctagaggggaaattttgaggaaatttcgaagctttaaacaatttgacgttattgaagacgtttcagaccatcactttgttcatgccaactcttccatggaacagcattgggctaaaagaatccagggagagtggaagtcattggagaaggatttaccagattcaatatttgtcagagtttatgaatcgagaatagatcttctaagggccgtgattattggagcagagggaacaccttatcatgatggccttttcttttttgatgttttcttcccgagtggctattcgcatgtacctccaggtctaatcttggttgcgaagcctttctttaatgagcctggatatgcacatttaagcaattcacaatatggtgaaattagttctttgaagtacaatgaggacacattcatcctatcattgaggacaatgatatacataatgagaaggcctccaaagaatttcaaggactttgttgctgggaacttttgcagccgagctcatgatattctggtggcatgcaaggcatacattgatggtgctcaagttggttgtgtggtcaaaggtggggcacaagatgttgatcaaggtggcagtagcagctcagtccagtttaggacatctttagctgcatttgtgaatatgcttgttaatgagtttacacaagttggagctaaggattgtgacaaagtctttccattaactgctgtgggaaattcgtccaatgaaatgctaaaaacagtgggaaatccatccggtgtaaagctgacagcagtgggaaatatgtcaggtgaaatggtggcagcagtgggaaatgcgtccgatgaaatgcttgttgctgctgcagcaattccttga

SEQ ID NO: 77113 - DNA, 303 bp, Glycine max
  Peptide Sequence Number=SeqID_168798
atgcatggctacctattctatatacatatacacaacaagtgttcaacgcgggtttcacatcatctaggcgcaaagaaaaccatcatggtgcaacacccaccaaatgctggcccaaaggggatcttcatccaacatgctctcattttcatgtactctcacactcaaaaattcaagcttgggtccctaggcctaagtcttattctagcttctacaaactgctcacatactgaaaaatggaagcccatatgcatcaattcattccataagcagaatttctcaaaaatcatgcgcaaatgtcattga

SEQ ID NO: 77114 - DNA, 459 bp, Glycine max
  Peptide Sequence Number=SeqID_168799
atgctaagcgcaactatcacgctaagcacgttcatcttctctgttgagttatctgttgaactcgctaagcgcggttatgcactaactaaatggcttcccgtaagagaaaagcaccagcttcagtgtcccaggctaggtatgaatttgagggtgcgagggcacctaattaaatttgatgctgacaccctcaacaccttccggaagacaccagtggtcatagaggaaggggagagcttgcccgcctactctaggtttgctaatatgacgactgatcctcaagagcttgcagcttgtctatgtatccctaggaggggatttgagctgaatgcagacgggctgcctctaaagatcttaaggaagaagctgactactctggcccagacctttctatccttttcaaacttagccccaacatcccacacttctgacattactctggatagggctaagttgatatag

SEQ ID NO: 77115 - DNA, 378 bp, Glycine max
  Peptide Sequence Number=SeqID_168800
atgccgtctcttgtgacggacgtgtggggtgataataccttccccgtgcgtaaatacaactcccgaacctttcacttaagtgttggttgcgattccgcgtgtattcctttcatggaacacgcacccgcgagtcacgcgtcgctatcccaccgaagggtagggatcccgcccgcaagacactcagtggacccggagaagtccaacagggtcctggggttgccagctctgattatgggcctctgtcagttctacggagtgcctgtcactcccagcaaggtcatcaagccccctactaaccgagctttcatcaagaagtactgcgcccccaggcaggcgcagggcgagacaccacagcagcctgcggatggccggctgtag

SEQ ID NO: 77116 - DNA, 210 bp, Glycine max
  Peptide Sequence Number=SeqID_168801
atgggtaaagtggaggaggtacaagagaagttgaaggccgacatgcaggctatgaaagagcaaatggccacgatgatggaggccatgatgagcatgaggaagataatggaagccaatgcagttgtagttgccgctaccagcactgttgctaaggtgaaatcgatgcccccatctggcctcaaccaaatgaatcatccaacctcagctatg

SEQ ID NO: 77117 - DNA, 333 bp, Glycine max
  Peptide Sequence Number=SeqID_168802
aggactacacgtcctccccttgaagactacacgtcctctccttcagaggactacacgtcctcaccttcagagggctacacgccctcgcctatagaggactacacatcttcgccttcagaggactacatgtcctccccttcagaggactacacgccttccccatcagagggctacacgccctcaccttcagaggactacacgtcctcaccttcagaggttgcacgccctcgccatcatagggctacatgctctcaccttcagaggactacacgtcctcaccttcatagggctgcacgccctcgccctcatagggctacacgccctcacctttag

SEQ ID NO: 77118 - DNA, 310 bp, Glycine max
  Peptide Sequence Number=SeqID_168803
gattcctgaacacaagggatgggttgtccctatgtggttcagactttgtaatggattttacaaagatagtggaaatctcaagccacaaggtccaacactcataggtggtaaaaataagctcaaagttgacaaatgcttcacaactcctggaatggcacctaatcttggaaagcttgtaggcctaggatcttcttcatcaatggattcctttgcttcttggaagataaatggcagcggaatggagaaggaagagagagagaagatgccacttcaaggagaagataagtctagaagaagctcaccaccatag

SEQ ID NO: 77119 - DNA, 305 bp, Glycine max
  Peptide Sequence Number=SeqID_168804
atggctagatccaatctcctggtccctgtggatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 77120 - DNA, 471 bp, Glycine max
  Peptide Sequence Number=SeqID_168805
atgaccaggtccactgactgcgcggcgagtaaactcaggccgtcgagtccgtcgcccgcttcgaacgtgctggctccgaggccagttaacaatgtgtccagcaatgaacggaaaacgacctcatcttcgacaatgagtatctttttgccgattagcggtttttccattctctccccctgcgtaccagatatttcaatagtggttcataaaacgccgttgcgcctttcagaattggctgaagtcacaacccccgtgaatgaacaactgattatctgctacggaccagcggtaatagttcatccatttttttctccacggcggccttgcctgccgcaatggcctcttcagcccgatgaaagtccagcgttgaaatctgcggacaaaaaggctgaatcagcacatccggcggatcgcctgccatacggttacgtttcaggcgattttccaatacctggattgacgttgacataa

SEQ ID NO: 77121 - DNA, 1464 bp, Glycine max
  Peptide Sequence Number=SeqID_168806
atgctgatggaaaaagagaccgtagaagcttaccacctgaccggcgtgagccacgactgcggtaacaaactgggttatatgcaagcttttgttgaagtatggcgtgcgtcatccggtgctgggcaaagatttcgctcagtggctcgacggcgttgcaggcaacaaaaagctgcggtgttggccgaagtcggacatgacgttctctgtattgatgtcgacgaaaagaaagtcgaaaacctgaaaaagggcatcatcccaatttttgaaccgggcctgacgccgctggttatgtcgaactatgaagcggggcgtctgaaattcagcaccaacgcagaagagggcgtaaaccatggcgtaatgcagtttattgctgtgggcacgccgccggatgaggatggctctgccgacctgaaatatgtgactgcggttgcgcgtactattgcgcagcacatgaacgatcacaaagtcgtcatcgacaaatctaccgtaccggtaggcaccgctgaccgcgtgcgcgcggtgatgagcgaaacgctgaagcagcgtgacgccaatattgcgttcgatgtggtctccaacccggagttcctgaaagagggtgccgcagttaacgattgcatgcgtccggaacgtatcgtggtgggcaccgacaatgatgaagtggtcgaactgctgcgtgaactgtacgagccgtttaaccgtaatcacgatcgcatgattctgatggatatccgcagtgcagagctgaccaaatatgcagctaactgcatgctggcaaccaaaatcagcttcatgaacgagatttccaaccttgcggaacgcctgggtgctgacgtggaaaaagtacgtcagggcatcggttctgattcacgcatcggttatcactttatttatccgggctgtggttacggcggttcctgcttcccgaaagacgtgcaggcgctgattcgcactgcagagtcaatcggctacaccccgcgcctgttgcaggcggtagaagacgtcaacgattcgcagaagaacaagctgccgacgtttattaaacgtcactttggcgacgatctgcgtggcaagacgtttgcgctgtggggtctggcgttcaaaccgaacaccgacgatatgcgtgaagcctcaagccgcgtgctgatggaagcactgtggcaggcgggcgcaacggtgcaggcgtttgatccggaagcgatggaagaagcccagcgcatctacggccatcgtgacgatctgaagctgtgcggcactaaagaagctgcgctgcagggcgctgatggtctggtgatctgcaccgagtggcagaacttccgtgctccggatttcgacgtgattaaatcctcgttaaaacaacccgtgatttttgatggtcgtaacctgtatgatccggagcgtatcagcaaacgcggtttcgtttattatgcaatcggccgcggagcgtctattcaaattgtgtaa

SEQ ID NO: 77122 - DNA, 402 bp, Glycine max
  Peptide Sequence Number=SeqID_168807
atgacgttaaatctccgcgtgtcaacgggcttgtcggccgcgattgacgaagggcgcagaagacgacacgcaaaaaagaatgtttatacggataaccactcgggtatttccgcccgtcagcgtgactcaaatgtcaatatgacagatctttgtcaacgggcttgtcggtcgcgattgacgaagggcgcagaagacgacgttagtctctgcgtgctatcaggcttttcgtctttcagacagcaaaaagaagtttatacggataaccactcgggtatctccgcccgtcagcgtgactcaaaagtcagtatgacagatcttgtgagcgcggaagatgacgtaaatctccgcgtgtcaacgggcttgtcggcctcgattgacaaagggcgcaggagacgacgttaa

SEQ ID NO: 77123 - DNA, 376 bp, Glycine max
  Peptide Sequence Number=SeqID_168808
atgcatgccaatcaggccgcagtcacaatacagctgatgggggggcttgcggttgcggattgctgcgtagggcatgtgtattcgacagctcaatatcagtctgctgcaatcgatgcagggattgcccaagcggcggatcggcttggctacggcggtgtgctggtgccttctggccgctcttgcgaagatgcttgggtgatttcttcggcactgatcaatgaaaccaaccagctcaagtttttagttgccacccggcctgggtttatttcaccggtggtgtcggcacgtatggcttcgactttggatcgcatttcaggcggacgtttgctgattaatgtggtggcgggtggtgatccggctgagcagcaagcagaag

SEQ ID NO: 77124 - DNA, 90 bp, Glycine max
  Peptide Sequence Number=SeqID_168809
atggctgaatatgaagcatgcgctctgggcgtccaggcagcaattgacttcaacgtcaagctactcaatgtgtacggagactcggtgctg

SEQ ID NO: 77125 - DNA, 228 bp, Glycine max
  Peptide Sequence Number=SeqID_168810
atgtccaagttgccagcaccagcgattttttttcaagcatggcatattgattgccttgggcttactttcaaccttcctatgtatgttgaactcactaaggtgagaggagtgacgagtataggtgtaggaaaaaagaatttatcagaagagacactgggactaggaaatgtgggtgtcccttcaagctttgttgcaagccagtggttggaggagaaggctggatggtga

SEQ ID NO: 77126 - DNA, 549 bp, Glycine max
  Peptide Sequence Number=SeqID_168811
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggagaagggcaatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 77127 - DNA, 54 bp, Glycine max
  Peptide Sequence Number=SeqID_168812
atggccgaccggcaggcgaccaagtccaaagccaaaggtagcaagataccttag

SEQ ID NO: 77128 - DNA, 153 bp, Glycine max
  Peptide Sequence Number=SeqID_168813
atgggggaggtggttgccacccagctcgcccaggcgagctcagctcacccagacgagctagattgcttaacgatgggtgtcaagttcctcgaagcggtcaagcgaaggttgcatgccatcaaacaatggtccccggacgaaattagggtatga

SEQ ID NO: 77129 - DNA, 621 bp, Glycine max
  Peptide Sequence Number=SeqID_168814
atgcaatatttattgcagcgcattccgccggcctttgcggatgccgtgtctgatcagttgattcacggccagatgactttaaaagccgccgacgcatgccaggtgcattggcaattaaccctaccagcggcagatatcgcggaagcacaagccttgttgcaggccgaaccagccaaacagatcatgctggctgcgcagggctaccagatacccgaacaagggagtgtagaggcggattttgcagtggatccggcaacgttgcagcccaggcaccaggagattttacaaactgcaccattgggaaagctgcgggccagtgttgaactgatgtatgccctgctgacacaagccaggaccagcggcgggcaagctgcacaaacgccctggacgcaggcagagctgcaatcagcccaagtgagctgccagcaacaattccgggcggatgacagtgaaaaggcatgcgcttgctacagccatgggctggcagaaaaatactcggcaagacaggtgaaatataatcgctacctgatgaccaatccttatgcttttgcgaccggcaatggtggagatttcaagcaactggacaaatcgttgcaagcgacttgcggactcgccatctag

SEQ ID NO: 77130 - DNA, 1955 bp, Glycine max
  Peptide Sequence Number=SeqID_168815
atgcaatccagttatttcggtaagccgcgttcctcctccaagttgtgggccattggtcattggtttggcccttatgcaccgctgattgtcatgtttatcagcgggctggtgttcctctcactgacacgcctgggattggtggtgtggaaatgggaacgggtacaagccacgggagagctgtgtcagattttgctgcaaggggttcgagttgatgtgatccagctcggtttgctggccattatccccgtcttgttatccccggtgctggccacccgcaagtttttcaacgtatggcgcggttttacgttctggtgggtgttgctgtcactggtgctactggtgtttcttgaagctgccacgccgggatttattctcgagtatgacgtgcggccaaaccgtatttttgttgaatacctcaagtatccgcacgaggtgtttggcatgctgtggcaaggcttcaagccggagctgttttttggtttgctgatgaccatgattgcgtttgcaatggtggctagattactcaagccctggcgggaggccgaggcaaaatgggccagtccggccgtgtggctggtgtggccgctgatactggtgttaacggtatttggcattcgctccacgctcacgcatcgtcctgccaatcctgcactgtttgccattacacaagacagcatggtcaacagcctgatcctgaactccacttattcggtgttttacgccgcttacagcttgcagcatgaagccaagtctagcgcgatttatggcaagctgccgcgcgaaaaaatctttgccttaactggcgcaaaagacggtgacattcctacgctgacgaccctggtgccgtccgtcaaacgtgataaaccgcttaacctggtgatcctgctgcaagaaagtttgggcgcaggctttgtagagtcactgggtggcaaaccggtgacacctaacctggagaagttaaaagacgagggtatctggtttacccatttgtatgccacgggtacgcgttcggtacgtgggattgaagcggtggtgacaggatttcagccaacgccatccgatagcacggtcaagctggatttaagccagaaaaacttttttacgcttgcggctttgttatctaaacgtggttacctgaccgagtttatttatggtggtgaatcgcattttgacaatatgcgcagttttttcatgggcaatggtttccagcaaatcaccgaccagcccgatttcaagaacccggtgttcgttgccagctggggcgcctcggatgaagacttgctcaataaaacgcatgaccaactcatggcgcaccatgccagtggcaagccattttttaccctggcattcagctcgtctaaccatgccccgtttgaattcccggatgggcggatcacactatatgaacagcccaaggcgactgacaacaatgcagtgaagtatgccgactatgcgatcggtgagttcattaaaaaagccaaggccagcccgtactggaacgacaccgtatttttgattgtcgcggaccacgatatccgtgtccgtggcgattcactggtgccaattgagcatttccatattccggccctgattttgggtggtgcggtacagccgaaaacggtggatgcgattgccagccagattgacttgccggttaccgtattgtcattgatgggcatagaagcccagcacccgatgaccgggcatgatttgtccaatctgggtgcagattatcgtggccgcgccatgatgcagtacaactataacttcggctggatgcagcagatgggaacgggtgttgcggaaaacgaggtcgtggtattgcgtgaaggtaaaccgcctgcatttgggcactatgatccggtcagcaaacaattgcaaaatacaccagcccctgcagatgccaatgatttggcggagcgtgccttggccaacagcctgttaccggctttgtt

SEQ ID NO: 77131 - DNA, 1269 bp, Glycine max
  Peptide Sequence Number=SeqID_168816
gatccccgttctgaaggcaagccaaaaggcgtggtacacagccataaaagcatcttggccaatacgcaccagatcctggccatgctggacttcagcccgtcggataaattcatgatggccttgccattgttccatgcctttggttttacaggcgccttgttacctttattaaacggtatcccgctgttactgttcccgtctcctttgcaatacaagctgattccagaagtgatttatgacaaggggtgtacagtctttttctctaccagcacctttctgagcaattacgccaagtatgcgcacccttatgacttttataaattgcgcgtggtgtttgccggagccgaaaagctgaacgaagaagtccgcaaaatctatcacgaaaaatttgggatccgcattcttgaaggatatggcaccactgagtgtgcgccggtgctggcggccaacacgccgatggcaaaccgtaatggtagcgtcggccagtttttcccggggattcaatataaattgacgccggtgccggggattgaaaaaggtgggctattgcatgtcaaaggggacaacatcatgcaaggctattacctgttcgacaatcctggtgtgctcgtagcgcctcaggatggctggtatgaaaccggcgatgtggtcgaggtggatgctgaaggatttatccacatcaagggacgggtcaagcgctttgcaaaagtcgcgggtgaaatggtgtcgctggaggtggtggagaaaatagccagcactgcagcccctgaccaacagcacgcagcaactacagtagcagacgccagccgtggagaaagcatcgtgctatttacgaccgatagcaaactcaagcgtgaagacttgcaaattgtggccaaaaatctcgggtcgccagaaattgccatcgcccggaaaattattgtcgtcgaacagattccagtattaggcaccggtaaaaccgattatggcctgggcgctttcaacgacaatgtgtttaaaaccgcattgattacgcaggtggcatttaatacggccagcctcacccagctggatggagcgacgttggcgacgttgctgccgggtttgtttatcctgccgtttttcctgttctcagcctcggccgggcagctggcggataaatatgaaaagtcacaaattatccgcctacctgatgatgctggctttagccttgtttttaatgggcgtgcattcgaccttgtttgggccggtgaaatattcttatttgccccagcatttacagccaaatga

SEQ ID NO: 77132 - DNA, 479 bp, Glycine max
  Peptide Sequence Number=SeqID_168817
atgtcggtggctccttccttcctttcgcttggagggagctgcgaccttggtgaaatgtatcaccaaaggtttaggctttctaagaccttcctcatctgcggattgcatgcatatatgttgctcttcacccccctcattgctgacttccagctggccttggtctatcatctgtcaacagataaaccttctgggggtcgtcacgtccttcagaggtttggacctgcgcggcctaccctactcgacagcattaacagctccccctccatgattggaaagtgggttgcgttagggttataccactttgggaaaggaggctggtggatccttccgggagatatcacagccatctggttggtgatgagggatggcaagaggggaaagttccttatcgcgttggaaccgatgccaaagtgggcatttccggctgggagtcgtcggcgcgagctgagaagctcgggtgatgctgcgcatattgatag

SEQ ID NO: 77133 - DNA, 258 bp, Glycine max
  Peptide Sequence Number=SeqID_168818
atgcattgtgtaatcgattacatggttatgggtacatcctttgtggtacaagtagagggtacatctacttgggttgttgtaactgagaacaagagagggtacatctcttgtggatcagttcaagtggagggtacatccacttggttgttcaaagagaacaagggagggtacatcccttgtggatctttgcttgtaaaggattttacaaggttgaaaagaaatctcaagaaccggtggttgcttggggactggatgtag

SEQ ID NO: 77134 - DNA, 216 bp, Glycine max
  Peptide Sequence Number=SeqID_168819
atgactaaagcacgtcaaaagggggaaaatgggggagatgcttgccacccagctcgcccaagcgagcaaggtgacttcctccagaagcaaccgccttttggagggcccaagtgggtctggtttctatttgcacccccatttctgcttggtgattcttttttcataaagttacggaaacttacgaatttcgtaacgatacctgttttcttttcgtaa

SEQ ID NO: 77135 - DNA, 171 bp, Glycine max
  Peptide Sequence Number=SeqID_168820
atgcggaaattgattaaggtaaggatggaaaataaggtggttaatttcgtgggtgaaagttctcgttttgtggttcttggcataaaatggatgaatgggatgaacaagggtgaagatgaaaggaaggaaagaatcactctttccagcgagggcaacacacaaaggttgtga

SEQ ID NO: 77136 - DNA, 208 bp, Glycine max
  Peptide Sequence Number=SeqID_168821
aagcgctactaggaggcaacctagaattggctacaaagaagctccctgcaaagtagtccaagaagggcaccatcgaagaggattccaatgtggcccccacaagctgacacaggctttgacaaacactgattccagagcatggaacatcaatagcatttcgaggccatcaaaggatggttattcctcagacagagacatgggcagctga

SEQ ID NO: 77137 - DNA, 219 bp, Glycine max
  Peptide Sequence Number=SeqID_168822
atggttgaaggctcagacgcaaaggctaactttgctcccgaagctaaagatttcaagtggttcactttcactttgaatggaagtcaagagcttccaagactgttagccaaagcaaaggcaatggcggacgtgtactcagctcctgaggaagttcatgggcttttcgattattgtcagcatatgatcgagttgatgtcccatataattaggaactgctga

SEQ ID NO: 77138 - DNA, 439 bp, Glycine max
  Peptide Sequence Number=SeqID_168823
atgaacttgaaattaaaattttttaagctcgccattttaagtctggctattacatcagttccttgtgcttacgcaattacgccggcgcaaccaaataaaattttgcacgttgcctatgaagccccagatgatggcttcgatatggttaaaaccaccaatttctatagtgctaatattgctgaggcaatttttgagcctttactcaaatatgactatctggcacgtccattacagttagctccctatacagtagagagtctgcctaaagtggaacaagacggtaaagtttatacttttaaaattaagccaggtatctattttaccaatgatcccgcttttaaaggtaaacgccgtgagctagtagccgaagactacgtctatacaattaaacggattctagatcctaaaaatagagcaccgtctgtttcattcattgatg

SEQ ID NO: 77139 - DNA, 399 bp, Glycine max
  Peptide Sequence Number=SeqID_168824
atgtcatcgggcttgccgcctcgggataacaaaatgtgcagaagacgatgtaagtctctgcgcgtcaacgggctcatttgcccctggttgactaaagatgtggataaccatacggagacgacgttagtctctgcgcgtcaacaggctcgttcgcccctggtgacaaaagatgcggataaccatacggagacgacgttagtctctgcgtgtcaacaggctttaagtctgacagatagcaaaagagtgtgtgcgggttaccgtataaggcatctccgcgtgccaacggactcacgggtcacgatagcgaaaggtggggcggtcaacaaaagcgaggcttttgctcctacgtatcctcaatttgtgataaggaactcagacctacgtagttctttcttgtga

SEQ ID NO: 77140 - DNA, 408 bp, Glycine max
  Peptide Sequence Number=SeqID_168825
atgaccaagagcaagggcaaggatccacttgaaggacttggaggacctatgacaagggctagagcaaggaaagccaaggaagctcttcaaaaagtgttgtccatactatttgaatacaagcccaagtttcaaggagaaaagtccaagggcccaattggcaacctaggcatcagccttttgggagaccaaatggtggctgacttgttggctgttggggtgattcaagaacaccctggctgtatcaaaggactttcacaacctttgtgtgttgccctcgctggaaagagtgattctttccttcctttcatcttcacccttgttctttcaaaccacaattccagaaaatccacctctgcccagaattatctcgtggccataactcccattttacgcactcaaattaagtga

SEQ ID NO: 77141 - DNA, 474 bp, Glycine max
  Peptide Sequence Number=SeqID_168826
atgaagctatttggtggcccaggcgagccagatactagcctgggcgagatggagtctagaaaaatcaagaaaaagacccttttgcccccttacttgcttatggaagttggttggggtaagagtgttaatacgtcagtatgtgcaattggctgctacttcatgaccatccacattgaatttagtataattcaccaccgcccgcctccgctttccatgccaaccatgcaaccaagcctcacagccttgtcggctccgcttcctatgcctgctctttatctccccgatcttgatcgcgttcgtgccgccactttctttgacaacctcttcaacattgttctttgttatggccatgtagcagcacctcatgacaaaccttgggaaaatagagacatgactttgtttgagatgggacctgagtcctatagggctaccatggtcgcacgcaagcgccaaccagctacctttgtactatga

SEQ ID NO: 77142 - DNA, 390 bp, Glycine max
  Peptide Sequence Number=SeqID_168827
atgggtgcatattctagagacgagaagttattgatgcatttcttccaagatagtttggccggagtggcggtcatttgcaagcctcgcatggtacccaccaatacgcacaacatcaccgagttttttggcccgtgccggaagcttttcctgctcaccgctcgtccagccaaggacgtccgtgtcagcacaaagagggaccctcagactttggctccagcccaacctcacctagccggtaatgccaaccctggcatgggctccaacatgggaagaaaccctccaacaaagaaggctccggagttcgccccgatcccaatgtcatacggggacctcttgccatcactaattgccaaccaattggcagtggtgatgctgggaaatatctactag

SEQ ID NO: 77143 - DNA, 156 bp, Glycine max
  Peptide Sequence Number=SeqID_168828
atggtcaataccgcgctgaatgtaagacaaagagaaaccaaggttgtaggcaatggccttaggcctaagttgtattctgaaaagtttgggcatgccacattgccctcgttcccttgctattcatgcctaaacacgtgtccaccaagtgctcgttga

SEQ ID NO: 77144 - DNA, 511 bp, Glycine max
  Peptide Sequence Number=SeqID_168829
atgcctaactccctatcatggtggaaccgtgatgcaatcctcctaagaaggggacccattgctagagccatcactaggagactccaagaagattgggccagggatgcaggagaaggccctagggttctcatgagccttaggggagggtaccccataagtttagggtaccctagtaatgtaggatttttcagcccttgtattttagggcacctagacaagactccattgatgaagaagatccaaggcctacaagctctacacggagctacattaaaccatcactttcaacgcgaatcaaaaagggcaaataacaggactgggccaaaatcatgggccaaagcatttgtctccaagggagaaaacgagcggagtcgccaccaacgtttattcgaggaaaatgttagaaaaatcaaaaagataaagggtgtttcccttgctcctacgtatcctcagattgattttaactgcgaacaaaagtcgtttaaggcgttggaccttgaaacgatctcag

SEQ ID NO: 77145 - DNA, 1230 bp, Glycine max
  Peptide Sequence Number=SeqID_168830
atggattgctctagattcgcttctggaaagagtcgtaggccattgttaccagactttgcttgtaaagtggcaattcccggtaaactaactttccaaatgtttttttcacaggagatggctccgaagaagctttccacgaagaggtccagaaaggaccccactggagaaagctccagcgctgcctcgggttttgaccggcaccgatttcagagtgctgagcatcaacagcgctttgaggccatcaagggatggtcattccatagagagagaagggtccagcttagggaggacgagtaccctgatttccaggaagaggtaactcgtaggcgctgggcaccacttgtgacccccatggctaaattcaacccagagatagtcatggaattctatgctaacgcctggcccaccgaggaaggggttcaggatatgcgcttgtgggtgaggggatttctcctggaccgctgtaggaaaacaggtgtggatcatgcacaccagtatgaccaccctgactcagatatggatgacgttgctgctaagcaacatcctgcccagcgatcacaacttcgacctccccctaccgaagtgtcagctggtgtatgccatactggcacggatgagaacggcgcctatgaggcaccctttggacctggagaagtccaacagggccctgggttttacggggtgtctgtcgctcccagcaaggtcatcggccgcctatcaccagagccttcatcgagaagtactgcaccccaaggcaggcatagggtgaggcaccacatcaacttggagaggatcagcagcaggcaacagacgcaccgccaccaccttcggagtccacctcagcttacctgcagaggttggagcactatatacgacatgtggccagccaacaagcgtccaaccaccggggataggtgcggctgcatgagtattttcaccagtacaccctcagctagcagggctagggttccaccccttacatatgtcctacttcggagcagtttagggctacggtcgcatggcttggagactggcccgatactcagacaggggcaggacctgcagggacccccggagatgcggatggagcctaggaagatgaggatatggctaacttgctcgacttcctgggagggagcggagccacatgaccgagatcgccagacctgtgatttctcctcatctaacattactgctttcagttattttgttatttccattgtgacctaa

SEQ ID NO: 77146 - DNA, 1170 bp, Glycine max
  Peptide Sequence Number=SeqID_168831
atggtgatcgcggatgtttctggttggcatgttttggagagcgaaacgaggttcaacagtagaaggatagagtccacgcaaacgctgagaacatggaatagggaagatatatatgccaccttccatcgtcagaatctggaagctccaagcactgtagatggttcacgacggggaagatctgcaacaatggtcttttggccagatttgcccattttcattgtcatattcatcaatggtggagttgatggcgatgtcacagtcgcactcatccggggcagggtcgctcttattgtattttctatgaacgttgttgctgaaggtgacgaggttgaaggagggcgggttatagtaagagcctttgggataaaagttagtggtgatgcggatgaagcccctcgacggcgaaggctgacagcatttgcacgtaggcaatgggtagctgcacctgttgctaaggatgttgagcatgtggatcatgtagctgatgaggtccatgaccagcctcaggaggcagttgttgatgatgtagttattgatgcccagggttttccaggcgagccccacgatacatcaattttgatggactatgaacgtcctgagttgaagttgtcctcccatcaaaggaaggtagagaaatttgaaaggcctggtctacagattgaaggcatagcgatttctattgctcttggacagtgtgcattggaatacacagagtggttgtacttcatatctcaccccttcatgagtccaacacagcctagggatcctcctagatatccacctgtggttcacgacgatacatttactaaaccaggttctcctcagcagtcggtcaccacagctgctatgccacaaccacaaccacctacacttgctaatgtagatattcctcaaaatgcagtgtcttgccaagcaatagcagaaaggttggaacgcttgatcaacctaagggtagacactgaaggaacaaaagcatacactgtgaccgaggagtgcctaagaatctccaggggtgtgactgtgcaagagaataaccctaatagagcaaccagaagaagagctctagagagcactagaaacaccaccacagctaacggagaatgcttgagcgaatacattgaggtaaggtatgagttactcacgcttgaggattataatgaacatgtgtag

SEQ ID NO: 77147 - DNA, 300 bp, Glycine max
  Peptide Sequence Number=SeqID_168832
atgtttagactgttgagattggaaaacagttatgaaagaagcacttcatccatcatgttttcggggaaagtgattttgaggaaggaaaccacttctatagattctttgaccacgaaccgcttatctccaaatgctttaacttccgtgtgtgtggataggcttaccaagattatgtgtgccattcttgagtcttatgcttctgaagacaggcgacatgttgattatgtggccattagcaaatgtgaagaatttcgaagatttagagaactcgatggcaaggatacagggaactgggtctaa

SEQ ID NO: 77148 - DNA, 505 bp, Glycine max
  Peptide Sequence Number=SeqID_168833
gctgccgtcccttgggacggacgtgtggggtgctaataccttccccgtgcgtaaatacaactcccgaacctttcacttaaaagttcgtagatcgcgtcttttccggtttttccgacatttttctcaaataaacgttggtggcgactccgctcgtattcctttcgtggaacacgcatcccgcgagtcacgcatcgccctcccgccgaagggtacttttggtgtagtggtgcttgagattgtaagtggacataaggttgtggattttaggcaacctaaggtgctattggtaaacaaggttgatgaattggaggtgagaaaaaggccacttgaggcattagcagatatgggactaaatggagagtacaatttgaaggagttaatgagattggtaggaaatgcaagtagccatgatttgaaggaaagaaggaatgggtttgggctagaggtgctagttttttgtgcatcgtactcagagattggtttagtggagtggttgattggttaa

SEQ ID NO: 77149 - DNA, 381 bp, Glycine max
  Peptide Sequence Number=SeqID_168834
atggagggtaagaacatgagcaaggtgatcaaattggtgaatgagatagccagcatctccgagtacaagcctccggtgaagaagcagtactgcaacttggcacggaggctgaagctttcaaccccgatgttcgaggagattagggacatgaaaaaagatgcgcttcccgaggacacttccaacgccgtcctcaccttcaaggaagctctccaatccgctagggaactcctcaaatttggaagcgaaggcagcaagctttacttggtaatgacttgtaggccaaggtcagatcttttaatgaatcttccaactctgcgcaaacttgacagcatgcttcttgttagtgtaggatcttactttcattgtgtgctagtagagtag

SEQ ID NO: 77150 - DNA, 201 bp, Glycine max
  Peptide Sequence Number=SeqID_168835
atgtctagtgttgtttacaaggactgggttttcactgatcaagcattgcccaatgatcttgtcaagagaagattcctccagaaggctgttgcttctggaggaagcaaccctgctcgcctgggcgagctgggcggcaagcatctcccctattttgctataaataggggaggaagtgaagaagaaaaaggttctgccccttag

SEQ ID NO: 77151 - DNA, 261 bp, Glycine max
  Peptide Sequence Number=SeqID_168836
atgacccttcgctcagcgaatatgcacagctcatccttcttccagattcttcctcgcactcagttgagatgtgttgcgctcagcggatggctcgctaagccagaagattggcttagcgagaggaaccactattttttttccacaatcattatgggtgttttcttgaatggtcgggtgatggactatgttaaggcatttgattatgttgatcgcttagctagtgaacatctccatggagttgtgtttgcatatagtgcatga

SEQ ID NO: 77152 - DNA, 589 bp, Glycine max
  Peptide Sequence Number=SeqID_168837
agggtacatctacttgggtttgactgagaacaagagagggtacatctcttgtggatcagttctagtggagggtacatccactaggttcaaagagaacaagggaggggccctggggtttccagcattgatcacgggcctctgtcagtccttcggggttcccgtcacacctagtaaggtgatccgaccgccgatcacccgggccttcattgagaagtattgcacgcctaggcaggcgcagggtgatgcaccacaggtcgcagacgcaccgccactgcctcatcaggctgatcctgctgggtcattaggcatgaagcggtatctacaacacttggttcgcctgcaggcggccaaccacgtggggcaggtgcagatacatgagtgtctctaccagcttagcctcagtcaacagggccagggtttcattccttttgcgtgccctactccagataagtttaggactgaggtcgcatggcccgaggcccaggcaggggaggcgcctgcagaggctcccagcgatgcagaggaggcccgcatgaatgaggagatgacagatttgctcggtttcttgggagggagcggagccacatga

SEQ ID NO: 77153 - DNA, 264 bp, Glycine max
  Peptide Sequence Number=SeqID_168838
atggaagcttggggggctgctattcctactgtttccatgagcaatggggttcttgaggggtgctcgcccaggcgagctaaccctgtgcatttttttttgaagaaaatacgcgctctctatgggtcggtgttcgcttactcaaaacccttagggatactaggctgcctcctagtagcgcttctcgatcctccggagctggacgcgggacaacgatctgttgatcacgggcctagcgtttattcgtgcccgtccccgagtacttga

SEQ ID NO: 77154 - DNA, 555 bp, Glycine max
  Peptide Sequence Number=SeqID_168839
atgcccaattcactccctttatcatatacatttgctataccatttccaaaaaaggaactcaaacaacacaataagtcaaaaacctcgtctaacctgagagagccacctgtggaattaataaagagcctgatatccttagtggggtcttgggcatccaacagtagcaactggctcatgatagcatcaaccacaaagtcgtcgatgctgctcctgaggaacacaatcctctccctcagcaacagtcccatcacctcaccctccatgcctctcgtcgtcgtcgaaggtgtttggggcatagagagcttgaagggattggcacacaccttgtggggggttttggagggtttaggggtgaagaaagaggaggaaacgaggaacttagggtttggaaaaagcattggttttagggcagtggaagaacgaagagaagaatggcattgcagaaaaacgacggaggagaaaaagaacaaagcggagcaacgagagtgtttatcaaatgaatcgaattcattttatcttaatagacgagagagagtgtgcaacatctgcagttag

SEQ ID NO: 77155 - DNA, 288 bp, Glycine max
  Peptide Sequence Number=SeqID_168840
atggcggattttcgtggcggattttcgaaaaaacgccaccgaatagcggtggcgtggcgggtttgggatggcagcgccatagcggccgccatagccatggcggtcgtggcgcgaccctcccacgcagctgtgattcagaacagccttccaactaaaatcgaacctcccctgcgtccctcccgcacccagccgcagccgcgacacctgcagtccgcacgcgcacgcagccgcgagcctgcgacaccccttacacgaagacgaaggtctcgcaagaacgggtcagcctga

SEQ ID NO: 77156 - DNA, 216 bp, Glycine max
  Peptide Sequence Number=SeqID_168841
atggaggggagacatatgttgcatagtgtggtgattgctaatgaggttgtggatgaggcaataagcccaatagacaagttcttccctcaaagaggacttagacaaaggggtcctttagaatttttgcgttctgttaagaatttgttattatttcctggtcaggttgccttgtgtaaccaaatattggatgctgtaattgttgcgaatcagttatga

SEQ ID NO: 77157 - DNA, 183 bp, Glycine max
  Peptide Sequence Number=SeqID_168842
atgatgcaatactaccccctaaggatattggatagaaaactccaagaggattgggctagagctgctgaagaagaccctagggttctcatgaaccttaggtggatgacgcctcctctcacctcttctcctttatcctccactgcaactccatggatcaaaatcaccattgaaggaccttattga

SEQ ID NO: 77158 - DNA, 252 bp, Glycine max
  Peptide Sequence Number=SeqID_168843
atggcaaagggagactgcaattgtcttggtcgaaagatattggagtcttcggccaaggccgctgtcgcaacctacccttcggcgggagggcgacgcgtgactcgcgggaagcgtgttccacgaaaggaatacgcgcggagtcgccaccaacgtttatttgaggaaaacgtcggaaaaaccggaaaagacgcgatctacgaacttttaagtgaaaggttcgggagttgtatttacgcacggggaaggtattag

SEQ ID NO: 77159 - DNA, 354 bp, Glycine max
  Peptide Sequence Number=SeqID_168844
atggacccggaggagcccaacagggccctggggtttccagctctggttatgagcctctatcagtcctataggatgcccatccctcaagcaaggtcatgccaccgtgaaatagggatcgcgctcgcaagacacccaatggacccggagaagtccaacagggaatattgcaatctccctttgccatctggagacaatcaactccgatggcactctccctttgtcatccagacacaatcaagtttgacggcatgtagagacaaatatggtcatctgcggccttcgccgaagactccaatgtctttcgaccaagactattgcagtctccctttgccattcgaagataatcaactctga

SEQ ID NO: 77160 - DNA, 160 bp, Glycine max
  Peptide Sequence Number=SeqID_168845
atgggggagacacatgaaattccctaccacaatctagccaacttcgagccttgcctcggatatgccactgaagggcaagcagttggtggtatacccttgcaaaacactttagagggccctcagtatcacccacaaccacacctcttgcattctacagcgg

SEQ ID NO: 77161 - DNA, 231 bp, Glycine max
  Peptide Sequence Number=SeqID_168846
atgggtgcgctttccaaaggaggaaagatgcgcgaagtcgccaccaacgtttatatgtggaaaacgtcggaaaaaccgaaggaaaccggtcaaaacgaaaattctaagttcgggagttgtatttacgtcgacaaaagcggggctattgctcctatgtaccctccatcgaagaggaaatcagacctacgtagttctttcttaagagtgaatcaagcgattctttttacttga

SEQ ID NO: 77162 - DNA, 849 bp, Glycine max
  Peptide Sequence Number=SeqID_168847
atgtcctcgactttagagggctacacacctcgccttcagagggctacacgcccttgccttcagaggactacatgtcctcgccttcagagggctgcacgccctcgccttcagaggaccacacgtcctcaccttcagaggactacacgtcctcgccttcagagggctgcacgccctcgtcttcagaggaccacacatcctcaccttcagaggactacacgtccttgccttcagcgggctacacgccctcgccttcagaggactacatgtcctcgccttcagagggcttcacgtcctcgcctgcagaggactacacgtccttgccttcagagggcttcacgtcctcgccttcagaggactacacatcctcaccttcagagggctacacatcctcaccttcagaggactgcgcgtcctcaccttcagaggaatctaggtcctcgccttcagagagctacacatcctcgctttcagaggctccacatccgcaccttcagagaactcaagggagatgagtacggatcatgcgcaccaccacaactccgatctccccctgccaaagtgtcagttggtctgtgtcgtcatgacatatggatcacacccacaagacacccagtggaccctgagaagtccaacagggccctgggatttccagctctggttacgggcctctggatcgtacccataagacatccagtggacccggagaagtccaacagggccttggggtttccagctctggttacaggcctctgtcaatcctatagggtgcccgtcacccccagcaaggtcatcagacctctaatcaccagacccttcgtcaaaaagtactacgcccctaggcaggcatag

SEQ ID NO: 77163 - DNA, 514 bp, Glycine max
  Peptide Sequence Number=SeqID_168848
gatgaacgctggcggcatgccttacacatgcaagtcggacgggaagtggtgtttccagtggcggacggccacactgggactgagacacggcccagactcctacgggaggcagcagtggggaattttccgcaatgggcgaaagcctgacggagcaatgccgcgtgaaggtagaaggcctacggcatcggctaactctgtgccagcagccgcggtaagacagaggatgcaagcgttatccggaatgattgggcgtaaagcgtctgtaggtggctttttaagttcgccgtcaaatcccagggctcaaccctggacaggcggggggaaactaccaagctggagtacggtaggggcagagggaattttccggtggagcggtgaaatgcgtagagatcggaaagaacacccaacggcgaaagcactctgctgggccgacactgacactgagaggacgaaagctaggggagcgatgggattagataccccagtagtcctagccgtaaacgatggatactag

SEQ ID NO: 77164 - DNA, 66 bp, Glycine max
  Peptide Sequence Number=SeqID_168849
atgggcaaaggttgggttagagctgctgaagaaggccccggccctagggttcttatgaacctcagg

SEQ ID NO: 77165 - DNA, 1461 bp, Glycine max
  Peptide Sequence Number=SeqID_168850
tacacgccctcaccttcagaggactacacgtcctcgcctttagagggctacacgtcctcaccattagagggctacacgccctcaccttcaaaagacaacacgtcctccccttcaggaggctacatgtcgtcgccttcatagggctacacgccttccccttcagaggactacacgtcctcaccttcagaaggctacacgctcacgcctttagaggactacacgtcctcgccttcagagggctacacgccctcgcctttagaggactacacgtcctccccttcagagggctacgcgccctcgccttcagcggactacacgtcctcgccatcagaggactacgcgtcctcaccatcagaggactacacgtccttgccttaagagcgttgcacgccctcaccttcagaggactacacgtcttcgccttcagaggactacacatcctcacctttggaggactacacgtcctcaccatcagaggacaacacgtcctcactttcagagggctacacgctcacccctctagaggactacacgtcctcgcctttatagggctacacgcccttgccttcagaggactacagctcctcaccatcagagggctacatgccctcgccttcagaggactacaggtcctcgtcttcagaggactacacgacctcgccttcagaggactaaacgtcctcgccataagaggactacacgtcctcgccttcagagggttgcacgccctcgccttcaaaggactacacgtcttcgccttcaaaggactgcacatccttaacttcagaggactacatgtcctcaccttcagaggactacacgtcctaaccttcagaggactacacgtcctcgccttcagagagctacacgtcctcgtcttcagagggcaacacgccctcgcctttagaggactacacgtcctcaccttcagaaggctacacgccctcaccttcaaaggactacaaatcctcaccttcagatggctacacgccctcgccttcagaggactttacatccttaccttcagagggctacatgtcctcgcctttagagggctacacaccctcgccttaagaggactacacgtcctcacctttagagaggtacacaccctcaccggcagaggaccacgtgtcctccccttcaggtggctacacgccctcaccttcagaggactacatgtcctcgcctttagagggctacacgccctcgcctttagagggctacacgccttcaccttcagaggactgcgcgtcctcacctttagggggttgcacgacttcgtcttcagaggactacacgtcctcaccttcaaaagactacacgtcctcgtctttagagggctacacatcctcgtcttcaaagggcgacactccctcgcctttagaggactacacatcctcgcctttagaggactacacgccctcgccttcagagggctacacgccctcacctcaaaga

SEQ ID NO: 77166 - DNA, 296 bp, Glycine max
  Peptide Sequence Number=SeqID_168851
ttacggaaacccacggattgcccaaagacacctcttttcgacttctgccacattacggaatttcatggattgcgcaagcctgcttcctttagaatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 77167 - DNA, 438 bp, Glycine max
  Peptide Sequence Number=SeqID_168852
atgcccgggaattcggccattacggccgggggcaccaagaagaaccctgcccgcacctgccgtgacctgaagatgtgtcaccccgactggaagagcggtgagtactggattgaccctgaccagggctgcaaccaggatgccatcaaggtctactgcaacatggagaatggtgagacctgtgtctacccatcacagtctgatgttcccaagaagagctggtacacaagcaagaacatcaaggagaagaaacatgtctggtttggagaggctatgattgatggcttccagttcgagtatggcagtgagggctccaagcctgaggatgtcaacatccaacttaccttcctgcgccttatgtccactgaggcttcccagaacattacatatcactgcaagaaacagcatttcctacatggatcaggccacaggcaaccttaa

SEQ ID NO: 77168 - DNA, 206 bp, Glycine max
  Peptide Sequence Number=SeqID_168853
gtgttttgatgacaacaaaagatgatgacaaaggtgatgaacaaaaagatcaaagatcaaaaaacatctcaagtgaatcaagaacaagtcaagagttcaagaatcaagaagaattcaagactcaagaagaaagcctacaatcaagattcaagattcaagatctcaagaatcaagatcaagattcaagactcaagattcaagaatga

SEQ ID NO: 77169 - DNA, 726 bp, Glycine max
  Peptide Sequence Number=SeqID_168854
cggctcgggcaccgttccgggcacgaacacgccatccttcacgtaggcggccagagtcatgtccagcgcgagcatgccgtcgcgcttgaggtccatcagttccggttcgaccatcgcgccgtgcagcacgcccagtacggtggcgtgcagcatgcgcgcggcgatcttcgggtccgctccttcgcgcagctggcccaggtcccgggcccggcgaagcgcacgctccatccggtccagcgcatcgcggaatccggcctgctgcatttcggtcagcaccttggtgtcggcggaggcatcgctgcgcagcatgatctccatggtcttgcgcaggcgctcatcctcggacagctcgatgaacgagtggatcatcaccgcgcgcaggtcgtgtaccggcgtgtcgcgctgctcggtggaggtgcgttccagttcctgcatgaagggcaggtgcacgcgctcgacgatggcggccagcacctcgctcttgttcttgaagtgccagtagaccgcgccacgggtatagccggcgcgggcgccgatcatctccagcgtggtacgggccacgccgtgttcatggaaacaggcttcggcggcgtcaaggatgccttcccgggttgcctgggtgtcctctttggtcttgcgggccatggatgggccgttgccggctgcttctccccgccggtgagcgttgacatgctggcgcgttcggcctgtatcagcgcgttttga

SEQ ID NO: 77170 - DNA, 261 bp, Glycine max
  Peptide Sequence Number=SeqID_168855
atggatcaagctggcgaggaaaggaagttgcaactgagtgagttagatgaaatccgcctagaagcctacgagaatgccaagttctacaaagaaaagaccaagaagcttggactcatgagtgttgagatcaaaagcgactccacaaacaagagcttcaaggtcaacggacatcgacttaagccattcctcacgaacccttctttagtggacgtagtggtggaagagacttccttactcccccctactcttcctcccccatga

SEQ ID NO: 77171 - DNA, 183 bp, Glycine max
  Peptide Sequence Number=SeqID_168856
atggaaaggatccagaagtccacttctagtgataattcccaagggactatcagcaacaatgcattactaaaagaggaaactctagatgaggcttcactgtcattaagtgagttggacacccagcatgaccatagatcgacctccactccttatggctcacatagacccgggtatatggcctaa

SEQ ID NO: 77172 - DNA, 639 bp, Glycine max
  Peptide Sequence Number=SeqID_168857
atggtcattgatacacgtggtgcacaagataagaaagcttgcactcaatgtagatgtgaccatatgaatctcccgaaggacttttataatgtcacaagggatatacataaccaaaaattgactacaaattataaaggaggtctcttttgttgtcaggacaacttacaatgcaagcaaatagagggttttcaaggtccaaggagaatggtttccttaagatacaaaattagttgggttgattggaacatataccaaataccaattaaggcagagtataccattccagcaactggtggtggtggtgattctcctcatgtccaaaaagaaaacatcccaatggaaaaaggaggttatctaatttatggcactgctcatatgcattcaggtgttgtaaatgcaactttatatggacaggatggaaggactttatgtacatcaacaccaaaatatgggacaggaaaagaggctggaaatgagaaagcttatctcattggaatgtctatttgttatccacaaccgggtccaatcaagattcatgatggtgaaattttgactctagaatctagatataaaaatgagtttcgtactggagctatgggacatttctacatctatttagcagaggaactaccacaatga

SEQ ID NO: 77173 - DNA, 324 bp, Glycine max
  Peptide Sequence Number=SeqID_168858
atgcacacacgaagtttcacaaatccacaattccttaaaataggcctaactcacaaaaatagtccccagtggagtctccaactgttgcaacgtgcccttttgcgggcgtgcgaggcgaggctcacgggtgcgctttccaaaggaggaaagagcgcggagtcgccaccaacgtttatttgtggaaaacgtcagaaaaaccgaaggaaaccagtcaaaatgaaaattctaagttcgggagttgtatttacgtttgaggaaggtcgacaaaagcggggcttttgctcctacgtaccctctgtcaaagaggaaatcagacctacgtag

SEQ ID NO: 77174 - DNA, 189 bp, Glycine max
  Peptide Sequence Number=SeqID_168859
atgaaccggcaagcaatctgccggtcatttccgcctggtcagtgcagaccattcggcgggcatcatgacttgaaaaatcaaatttctagtcatcaacaatggtgccctcaaaagagattaaggaactacccagaatttttaaatttgaataaaagacatgaactagttcagatagttgggaagttttaa

SEQ ID NO: 77175 - DNA, 243 bp, Glycine max
  Peptide Sequence Number=SeqID_168860
gttctactaaaaggagacatcattttgaaattccggtcacgccaatgtgaacgtggttcagtgaagatttcgcaccgattaaattgttcttctctgtgcggtgatccgacggcaagcaaaagcggctcgtggcagtcactggtggtcagtgttgtggaggagaagcttgggggtgttgggggagggtttaggggaagagaaggaggaagaagatggtttttttatgctgttggacgtatttga

SEQ ID NO: 77176 - DNA, 327 bp, Glycine max
  Peptide Sequence Number=SeqID_168861
atggagaaagatttcctcactagactcttcaccccttacttcgtcttcactttcactagaggaaaggcaagaagtagtctcctcttgactactataaatgtcttgacccttcataatcatggttttctttgtggggcattgagaggcaatgtgacctctcccaagacatttgaagcatttaatgttcctagtcctttcttgggactagtcttagggggtggatttctctatggtcttacccttatcttccttggttttgaaggtgcaacccccaaagttccttggcttggtccttccttgataagagtgaaagccataagattttga

SEQ ID NO: 77177 - DNA, 550 bp, Glycine max
  Peptide Sequence Number=SeqID_168862
ggcgaattggagctcccccgcggtgcggccgctctagaactagtggatcccccgggctgcaggaattcgataagaatgccttaaccttctgggaatgcatttcagcaggctttagccttattttacccagcccctatttaagatggagttgctctggttcaagcacctctgacactcttactgccttaaaagggatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacagggatatatttccggcttcctcgctcactgactcgctacgctcggtcgttcgactgcggcgagcggaaattggcttacgaacgggcggagatttcctggaagatgccaggaagatacttaacagggaa

SEQ ID NO: 77178 - DNA, 309 bp, Glycine max
  Peptide Sequence Number=SeqID_168863
atgttgtggaagcttgggaggattgatggggacccggtgttgagagaaacgaggatatgggctacgtgggagtacgtgagctcagttggaggtgggcaacaggggatggtgggtttatgcgcacattgtggatgtggaaaaacttgttgtgcaccatcgcccgaccgccacctagtaccacatgtgatggagtggtacctggagatatgtcgcgggggtcaggagaccttggggacgtcaggtggggtgctattgcccaaaaccaagcttgaccaatcccgacccaacccgggcatagtcggtcagtga

SEQ ID NO: 77179 - DNA, 237 bp, Glycine max
  Peptide Sequence Number=SeqID_168864
atggggctccggataagattcgttggtggaggatgcacgaacaacgctaggcaatcaattcgtggggctccgaactcgatggcaatcaatttgtggggctccggactcgatggcggaggatgcatgaatggcaatcaattcatggggctccggataagattcgttggcgaaggatgcacaaacagcgctaggcaatcaattcgtggggctccggactcgatggtggaggatgcatga

SEQ ID NO: 77180 - DNA, 84 bp, Glycine max
  Peptide Sequence Number=SeqID_168865
atgatggtggcccgggtgatgttggggcacggctacgagcccggaatgggtatgggcaagaacaacggcggtaggaccagcctg

SEQ ID NO: 77181 - DNA, 276 bp, Glycine max
  Peptide Sequence Number=SeqID_168866
atggtggcacctccagactctattccttcagtagagcagtttaatgagatgaagacagatcaaacacaagaagctgcaaccacttatgagaaatctcttgaggccacttctgagccttcaaaaccagtggcagatatagcttcacttcagcaggaagcagacccttccactcctaaggatcagactacgccagtcctatctccgaacacttctcctacagctacccctgtgcttcacgtaacagacgaggaggatgttcagacacaggatacttag

SEQ ID NO: 77182 - DNA, 174 bp, Glycine max
  Peptide Sequence Number=SeqID_168867
atggagaaatctgaaaagaagctgaagaaggcctacatcacatgggatgacaatgatatggaatcatctgaggattcagaaaatgaagtgataaacctgtgtctaatggctaaaagttatgaaagtgatgaagagagaatcaatcaaacttgcaaagttagtttcatcttctaa

SEQ ID NO: 77183 - DNA, 150 bp, Glycine max
  Peptide Sequence Number=SeqID_168868
atggaagatgcacccgtgagcctcgccgcgctcgcccacaaaagggtagcacccacgggtttgagcaaaaaggggccctacacccgggttcatggaaatctaaggagtggaggtggatctatggtcatgctaggtctccgacttgcttga

SEQ ID NO: 77184 - DNA, 480 bp, Glycine max
  Peptide Sequence Number=SeqID_168869
atggcttattccctagtggatggcgcctcctctcacctcttctcctttgtcttccgctacatctccatgatggcctccaggaagcgtaagagcattggggcaaggccaactactcagtatgatactagacggttccattcgcttgatgcttggaaccgttatacagataacattttgggaaggagcattttgccagagagaaaggttgagatataccacatagagtttgatgacttcaagacagagttggagaggcgtaatcttcacaaacgcctcaccaacttggctgatgggactattgatgtttctttggtgaaagaattttatgcaaatctctacagctctgaggatccatcaccaaagcaagccagagttagaggccacttggtgaagatagatgccgacaacctcaacacatttctagagactcttgtagtcctagaggagggggagacattacccatctactctaggtactaa

SEQ ID NO: 77185 - DNA, 261 bp, Glycine max
  Peptide Sequence Number=SeqID_168870
atgggggtgcaaatagcacccaggcccatttgggccctccagaaggcggttgcttctggaggaagcaaccctgctcgcctgggcgagctgggcggcaaccacctcccctattttgctataaataggggaggaaatgaagaaggaagggccgaggcgcttccgaaacgtttccgtaacgttttccgtgaggaatctcgcaaaggtttgaaccgttcttcgacgttcttcattcgttcttcatcgttcttcgatcttcaacgg

SEQ ID NO: 77186 - DNA, 3504 bp, Glycine max
  Peptide Sequence Number=SeqID_168871
atggcgaaacacgtcatgtcatcatcatgtcctaagaagtacgatattttcatcagcttcagaggtgaggacatccgcaccacgttcattggccatcttcgttctgctctctctggacccaacatcaaagcatacgcggatgaccatgaccttcaaaaaggacaagagatttggccgtcactgtgccaagcaatccaggactcacactttgccatcgtggtattctccgaaaactatgctgagtcaaaatggtgcttgaaagaactggtgcaaatactgcactgcagaaaaactcagggattggtagtcataccagtcttctaccaagtagatccatcccacataaggaagtgtactggcacttacggggaagcaatcgcaaaacacaaagacaaccaatccgtccaagactggaaagctgctctcactgaagctgccaatatatctggatgggacactcgtagccgtgacaacaagaatgagtctcaactaatagagaaaattgtgctagatgtatccgagaagttgaggtccccttttaaactaaaagaagtagaagactttgttcaaattgaaaaacattgtggagaagtaaaactgttgctgtccaaaaaccaagatcagttacaaaagaatgttcatgtaattggaatttggggtatgggagggattggcaagacaactattgccaaagccttgttttctcaactctttccacaatatgatgctgtctgcttcttaccaaatgttagagaggaatcacaaaggatgggactaacatctttgtgtgataagcttctttctaagctacttaaggaaggccatcatgaatataatcttgcaggatctgaagaccttacgaggaggctcggcaataaaaaagttttgattgtacttgatgatgtggatagtttcagtcaattagatacgttgtatcaaccatgtaaatatgtaggtccaggtagtaaacttattataacaacaagagataggcatttgcttagaagaagagttgatgtcacacatgtctatgaggtcaagacatggagcattgctgaatctctagagctttttagtgtacatgccttcaatgaaagacgtcctaaaaagggatacgaggatctctcaaacagggcggtaaactgtgcaaggggagttccattagctttagaagttttgggttctaatctttattccagaactacagaattctgggatgatgaattgaacaaacttgagaactatcggaatgacaatattcaagatgtcttacaagtgagctatgatggattagacgacctagagaaggaaatatttctagacattgcattctttttcaaaggtgaacataaaaaagatgtcgtaagaatactagatgcttgtgatttctaccctactaggggattaaaggtcctcgaagataaagctcttataactatttcacattctgggatgatagaaatgcatgacttgatagaagaaatgggtttgaatatagttcgtggagaaagtaaagatcccagaaaccgtagtcgattgagtgatataaaagaagtttctgatgtacttgcaaataaaaagggaagtgatttaattgaagggataaaattagatttgtcttccattgaggatttacacttgaatgctgacacactcaacatgatgactaatttaagaattcttagattatacgttccttcaggtaagatatcaagaaatgtgcaccattctggtgtccctagtaaattgtctggtaaattgagatacctcgagtggaatggattccatttgaagtctcttccagtaactttttgtgctaagatgcttgttgagattcgaatgccgcacagccatgttacagaactttggcagggggtgcaggatgttgcgaatttagtgcgaattgacttaagtgaatgcaagcacttgaagaatcttccagatttgtctaaggcgtcaaaacttaaatgggtgaatctttctggttgtgaaagtttgtgtgatattcatccatctcttttttcttttgacacacttgaaactttgatgctggatggatgcaaaaagctcaagggtcttaaaagtgagaaacatttaacatctttgaggaagatcagtgtcgatggctgcactagtctcaaggaattctccttgtcatcggattcaatcacaagcttggatttaagcagcacaagaattggaatgttagactctacatttgagcgtctaacaagtcttgagtcactcagtgtacacggtttgagatatggtaatataccggatgagatattttccctaaaagatcttcgggagcttaagatttgtaattctagagtagcaattgacaaagagaagctacatgtgttatttgatgggtcaagatatctacgtctactacacttgaaggattgttgtaacttgtgtgagctccctgacaacatcggtggcttatcaaaattaaatgagctaagactagatggtagctgtgtgaagacattgccagctagcatcgagcatctcagaaaactgaaaactctgtccttagagaattgtagggagcttgggagtctaccaaagcttccaccatttatcacagagtttaatgccgcgaactgctggtcattgactacagtatcctctttaaactcttctgcattgggattgaaagggaagggcaaattcatttcattcaagaattgtggttggctggatgaaccttcacttcattgcattatggagggtgccctcgaattaaccgagcttgcgtcgtgtcaaaatgagattgtaaaaatcgtagatgaagccaacaccaaaaattgtaataataaatctgtgaaggtctgtttcccaggaagcaaagtcccaagccagttcaaacatcgaacaacagactcctcaatcactattggtcttccatgttaccgtaatggccgtgtgggattaactttgtgtgtggttctttcacgctcccgggttgctgctaaaatctggtgtcagtgctacttggcagatggcactaagttggaacccgccactacgtggtatcatgaagctgtcacggagttgaattctgatcatgtttttatttggtgtgattcaagcctgtttaacagcattttcgaatcgggtacaccattggttttctttgagttctttgttacaaatgataaggggaaacgcgtgaccatcgacaccccagagtgtggggtctgcgtaatgtttgattcaaaagccttaatggaagctgaagatgataacattgaaattgtgaccattacccgtcagtgtcgggcctgcctaatatttgaagcagaaaattttgtgcgcatttcttcacggtcagtggatgccgcggcatctggttttggtttggaatcaaaggcaactgaaacatatgatatgatgggaacgattgcaatgacaaacaacaatcatgagccagatttgagtgaacattgttcttgttcttgggactacttatttggtatggagtttactacttaa

SEQ ID NO: 77187 - DNA, 1002 bp, Glycine max
  Peptide Sequence Number=SeqID_168872
atggcaagagccgtttcctcttcctgcgcgcgcctcacaatgcgcctcttctccaccaccaccaccaccaccaccaccaccgctgcgttcgccgttacattacccaaaccctcgtcactctcagtctcaacgcgtcgattcctcttccctctctcccatgccatcgtccctccctccacccgcgtcgccggaatccggtgccgtgtcaaccgcgccggcgactcagcgtactcgccgctgaactcagcttcgtcatcgtcgtcgtcgttcagcgaccggcctcccacggagatggcgccgctctttcccggctgcgactacaaccactggctcatcgtcatggaccatcccggcggcgagggagccaccaagcaacagatgatcgattgctacatccaaaccctcgccaaggttctcggaagcgaggaggaagctaagaagaagatttacaatgtttcatgtgagaggtactttggtttcgggtgcgaaattgatgaagagacttctaataagctcgaagggttgcctggagttctgtttgtgctaccggattcgtatgttgatccagagaacaaggactatggcgctgaattatttgtgaatggagagatcgttcagagatcacctgaaagacagagaagggtggaaccacagccacaaaggcatcaagacagaccaagatacaatgatagaacaagtggacaaggagaggagaaatctaaaattgtatttagtgaacatgatgttggattgtctgacattgaaaataggttgcctgggcattgtttctggtattgcgaacgatgttggattcagattgtctgcggcaaaaggcttactgcagacactcaaaacctaacattgttttctgcttcaggaaagacgacaaaaaagaatgttatgaagccgaatgaagtgggcaacagaaaaactaaaagaaagccatatgatctagacgacattcagcttgatgcgctctcgcttgggaaattgaagttttga

SEQ ID NO: 77188 - DNA, 406 bp, Glycine max
  Peptide Sequence Number=SeqID_168873
atggaacaaattgaagaaagccatatccaagctagcctcccaaccaactccatgtcaccaccaaaactagacgaactcattcaccgcattattgtgttggacgccctctcaataccactcacccacacctccatcttcttcctctacaaagacattcctcacacacgcactctaatattgactctaccgttgcctccgccacccatgcttactctgctgcccatgccaacttcgcctccacaccccacactcataccgaaacaccccgcacccttatcggctctgtttaccagcagagatgacactattggaaaggttgtggcaccatttcaccctaccttacctctcgagagcggtaacaacatccactgtgatacccgtcttccccttaacgggcttagtatag

SEQ ID NO: 77189 - DNA, 2001 bp, Glycine max
  Peptide Sequence Number=SeqID_168874
atggcacaactgtccaatggaacttcaagtaccactttgatctcaaagagtggcactacttcaatcccacatcgagcaagtttgcccaacccatttgatcttaccgatgatcagatccttgacattgtttatctggctcacctcaatgatgatgaaacttgcgacaccgataaactttacaaccttgtctccaacattgtcctgcggagtcaatccccgatttccgcagccagtttcaaaccagatttccttacactgaagctgatttcttgccagatgatatccacacgtagtgctgcgcattgcgtgcaccaaacaacaatgtggattcttcaacacctgaaatgctactcctgggatgcgaaggcactgatagccatagctgctttgtctttggagtacggaagtttcgttcaccttactcagtttcaaacaaacgacgtgctcggaaactcgttgaggcagctgaatcaagttcagaacaggaatgcctctgctgttggcgaacttgtcatgtacgtagtacaagtgtttcaacacattaacgagtgggccacgtatgctgctgatggctatgatccagaggacgtgcctgacttgacagaagcctttcaagccatccttgttgttgtatactggtcaattgcttccactgttgcttccaccggcaatctcatcggtgtatcgaactataaattatcagaatatacattcaggctttccactgctgttaacaagttgacaatgcatcttacgaaagtcaaagagcaaatagccaatgtacgagattacattaccatcaggaacatctttgacaggccgaaagatattgtggaccttttgaaggctctgatctacccccaacaaaagggagctgagaatcccaagatatttgaagggaccaacctagtaacaaagggcattgaagtgttcaggcagaaacatgtgttgctcttcatctcgggtctcgacagcattgaagatgagatttcgctattgaattcaatatatgaaagattgcaagaggatccaagagaagcaaaaggtttcaagaaagaagatttcaagattttatggatccccattgtggtgaagtggagccaaagcagtagggaacaattcaaagctttgaagagtggcaccaaattttacgcagtggaatacttctttgagttaccagggctcaagataataaaagacacagaaagattgaattatgagattcagcctattgccccgttgttcagctctaaaggtaccctattgaatggaaatgccctggaagtgatctttgaatggggcatagaggccttccctttcaggaaaattgatggtgatgaacttactcagaaatggaagtggctttgggatttaatcctaaaagcaacaccaggattgcaggtaaaggagaacagatacatttttatctatggaggtgccaacaatacgtgggtgcagaacttcacacaagagttgtcaaagataaaaatgaaccagagtatccagcgtgcagatatcataatagagaactatcaactggggaaggggaagggtgaactcaacaacagtgttccaagtttctggattggcgtggaaaggaagaagcagaacaagaagcaccaagaggcagtggactgcgagattcagaagattgtaaagtgcttattctgcctcaaaagggacccacaagggtgggccattctcagcaaaggacacaacattaagcatctttgtcatggccaggctgtttatcagactgtggcagagtttcaaaactggaaagagaaagtgttcgagagagaagggtttgacattgccttcaaagagtactatgatgccaaggagaaagagatatctgatactcaaccatgtgaggactacacttcagcttcaagtgtcattgctaccatagcatgcccaaatcccacgtgtggtcgtgtcatggaggtgtcttctgttaactacaagtgctgccatcgtgatgatgctttgaactgttga

SEQ ID NO: 77190 - DNA, 219 bp, Glycine max
  Peptide Sequence Number=SeqID_168875
atgaatgcaaggagaagagaatatatgcttggtgtgcttccaaagagaagaatactgatgcggcatgtgaagtcgcaagggaaatcaggatacggcggcgtataccaccacacccgaccacagcattcagtcaacggcgtaagacatgattcaggccctccgcgccggcgagcacccctccatcgcgtgatggatagcaatggctgctcccctgaatga

SEQ ID NO: 77191 - DNA, 420 bp, Glycine max
  Peptide Sequence Number=SeqID_168876
atggatggtccaaaaaggagaattttgaaaggcgagaataacagcaccgtggtgaagaaaaaatgtgaaattgcttgtgagattgaaactgccggtggggatattaagctgggccccaccgcggttctggaagcgctacatgtaccgaatcgccctccgaaacgatttggtgttggatgttttcccgtctccgacgccgccgaaatcctcgatcgacaagacgaccttccttggtggaacatcgcgaaagaagccagcgcaggagaagatgaaggcttggttattatgtggcagggagggtttggaggaaaggattggggtgcagcgtcatacatgggtttggaggggaggagtggggtgcggcgcgggagccttatgcctgagattgaaaccactgaagctagggttagtagtaaatga

SEQ ID NO: 77192 - DNA, 3072 bp, Glycine max
  Peptide Sequence Number=SeqID_168877
atggcgaaacaaggcatgttgtcatcattgtgtcctagaaagtaccaagtttttattagcttcaggggtgaggatgtccgcaccagcttcattagccatcttcgttctgctctctcccgggacaacatcaaagcatacatggatgaccacaaccttcaaaaaggagacgagctttggccctcattgtgccaagcaattcaggattcagagcttgccatcgtcgtattctccgaacactatgctgcttcaaagtggtgcttgaatgagctggtggaaatactgcactgcagaaaatctcagggcctggcagtgatacccgtgttctacgaagtggatccatcacacataaggaagtatgatggcacttgcggtgaagcaatctcaaaatacgagacatattttggtgacaaagacaatgaatccatccaaaagtggaaagctgctctcgctgaagccgcccatatatctggatgggactctcatagccgtgaatacaagaatgactctcaactgatagagaaaatcgtggtagatgtatccgagaagttgagccaggggaccccttttaaactaaaagtagaagactttgttcaaattgaaaaacattgtggagaagtcaaattgttgctgtccaaaaaccaagatcagttacaaaagaatgttcatgtaattggaatttggggcatgggagggattggcaagacaactattgccaaagccttgttttctcaactctttccgcaatatgatgctgtctgcttcttaccaaatgttagagaggaatcaagaagaattggactaacatctttacgtcataagctactttctgacctacttaaggaaggtcatcatgagaggaggctcagcaataaaaaagttttgattgtacttgatgatgtggatagctttgatcaattagatgagttgtgtgaaccatgtaactatgtaggtccagatagtaaagttattataacaacaagaaataggcacttacttagaggaagagttgatgacagacatgtctatgaggtcaagacatggagctttgccgaatctctagagctttttagtttgcatgccttcaatgaaagacgtcctaaaaagggatacgaggatctctcaaacagggcggtgaactgtgcaaggggagttccattagctttaaaagttttgggttctaatctttattccagaagtataaaattctgggacggtgaattgagcaaacttgagaactatcggaatgacagtattcaagatgtgttacaagtgagctatgatggattacatgacctagagaagaaaatatttctagatattgcatttttttttaaaggtgaacataaagatgatgtcataagaatactagatgcctgtgatttctacgctaccagtggcatagaggtccttgaagacaaagctcttgtgactctttcaaattctgggatgatacaaatgcatgacttgatacaagaaatgggtttgaatatagttcgtgggggcagtgaagatccccgaaaccgtagtcgattgcgcgatatagaagaagtttcagatgtacttgaaaataaaaatggaagtgatttaattgaagggataaaattagatttgtcttcgattgaggatttacacttgaatgctgacacattcgacaggatgactaatttaagaattctaagattatacgtcccttctggtaagagatcaggaaacgtgcaccattctggcgtccttagtaaattgtctagtaaattgaggtatcttgagtggaatggatgtcgtttgaagtctcttccaaaatctttttgtggtaagatgcttgttgagatttgcatgccacacagccatgttacagaactttggcagggggtgcaggatcttgcaaatttagtgcgaattgacttaagtgaatgcaagcacttgaagaatgtcccagacttgtccaaggcgtcaaaacttaaatgggtgaatctttctggttgtgaaagtctgtgtgatattcatccatctgttttctctcttgacacactagaaacttcgacactggatggctgcaaaaatgtcaagagccttaaaagtgagaaacatttaagatctctgaaggagatcagtgtcattggctgcactagtctgaaggaattctgggtgtcatcggattcaatcaaaggcttggatttaagcagcacagggattgaaatgttggactcttcaatcgggcgtctaacaaagctccggtcactcaatgtagagggtttgagacatggtaatcttccaaatgagttattctccctaaaatgtcttcgggagcttaggatttgcaattgtagactagcaattgacaaagagaagctacatgtgttattcgacggctcaagatctctaagagtactacacttgaaggattgttgcaacctgagtgagctccctgaaaacatttggggcttatcaaaattacatgagctaagactagatggtagccgtgtgaagacactgccaactaccatcaagcatctcaagagactgaacactctgtcattaaagaattgtaggatgcttgagagtctgccaaagcttcccccgaatgtcctagagtttatcgccacgaactgcagatcgttaaggacagtgtcaatatcaactttagcagattttgcattgaggacagggaagggcataatcgtttcattgcagaattgtagtaatttattggaatcaccttctctccactgcattatggaggatgctcacttagcaaccaagagtatagtgcttaaaaatatgtttttgaaagagttgtttcgaggcacaaacaccagaattgataactatgactatgtgaaaaggcagttcaaatatcaaacaacaccatactccttagtcattgttgatcttccttcttcaaaatcagactttgtgggatttgttagaaatgatatgcttctttcaccctcccaagaaatgaagaacctttgtgttggcggtgttaaaatctggtgtcagtgctacatggtagatgatgcgaggttgggacccccgcaaccacatggcatcacgaagctgtcattgggttga

SEQ ID NO: 77193 - DNA, 285 bp, Glycine max
  Peptide Sequence Number=SeqID_168878
atgatgacaacaaaagatgatgacaaaattgatgaacaaaaagctcaagtgaatcaaagaacatccatctcaagattcaagattcaagttcaagaatcaagaataattcaagactcaagaagaaagcctacaaacaaagattcaagatctcaagaatcaagatcaagattcaagatctcaagaatcaagatcaagattcaagaatcaagaatcaagactcaagatttcaagaatcaagatcaagattcaagaatgaagaaaagactcaatcaagataagtattaa

SEQ ID NO: 77194 - DNA, 228 bp, Glycine max
  Peptide Sequence Number=SeqID_168879
atgttggtggcgactctgcgcattttcctcctttggagacgcacccgtgagcctcacctcgctcgcccgcaaaaggataggttgcgacagttggcgactccactggggactgtttttgtgaggtctccgacttgcttgataatagtgaaacctcgtctagagctttctctctatataatgtattgtcgttggtattccataccgccgcaatattattatcttgagtga

SEQ ID NO: 77195 - DNA, 171 bp, Glycine max
  Peptide Sequence Number=SeqID_168880
agtccaaagaaggtcaacttggttgctgctctggttcgtggtatgcttgttaaagatgcatcgatgcagttggaatcgacaataaaacgagcagcaaaaactgtatatcaggtagtaacactagggaattctgatctcaaattgtccacggctatgcagcgaaattcttga

SEQ ID NO: 77196 - DNA, 220 bp, Glycine max
  Peptide Sequence Number=SeqID_168881
ggctttctccagaggagccctggtgcttaccaacatggatggtgaagagttaccttcacccgggcaggatcatcttgagctaccttctggggtgaggacaaaacatggacagcagaaaccaatcaaggaatggatgcaagtggggatagggtcacgatcgactgatcgttgccctctctctgcgctagacaagcagagaacgtcgctgcaaggcagcccc

SEQ ID NO: 77197 - DNA, 477 bp, Glycine max
  Peptide Sequence Number=SeqID_168882
cccggtcattaacttggcttacatcaggaagaactgttggaatcctaaggatctaacagtttctatccgaagggctacgagggtgaaggcgaggccagctgagttcccttccacatctgcaactccttactccagcatccacttcagcagccccttcagtcccagctcagatttacaggtggtggcacctccaggatctattcattccattgagaaatttctagagagggtagcctggcctgggacccaaccttctcttctatcctggctcagattgcgagaggtcacatcagatccacccacaccagtggtggacctatcttcacctcagcatgcagcagacccctccactcctatactcgagataccagaggacccaaccactccagtcctgactctgaacacttctcctccagctattccagtacttcatttgacagataaggaggatgttcagacacaagacacacatgacca

SEQ ID NO: 77198 - DNA, 648 bp, Glycine max
  Peptide Sequence Number=SeqID_168883
atgagaaccctagggctcttctgcatctatggcccaatcttcttagagtctcctagccatggctctggtgatgggtcccctccttgggaggattgcatcaacagtttttctaaaatgggctctaaacaaatcactttcaaagagggtgcatctctaaatcgacctactttgtttgagggagaacatttttcattttggcaaaaaagaatggaaatgtttattcattcaattgatcctgatgcatggaattctatttttaaaggtccattcataccaactaaagacttaaatggtgaattggtacctaaagaatgggatgagatgaaagatgacgagaaaagaaaagtgcaagatgataaaaaagctaaagacattttaacttttggtgaaaaattgcgaaggagatatggaaaatgcttgaagtcactcatgaatgtagaagcaaggcttcatgatgaatgtgattcaaagatgatgacaaaggtgatgaacaaaaagctcaaagatcaaagaacaactaaagtgaatcaaagaacaattcaagagttcaagaatcaagaagaattcaagactcaaggagaaagcctagaatcaagaatcaagattcaagattcaagatctcaagaatcaagatcaagattcaagtga

SEQ ID NO: 77199 - DNA, 1157 bp, Glycine max
  Peptide Sequence Number=SeqID_168884
atggcatttcagttttcagcaggggatcggcctgcgcgggcgctggctcctgacccgcccggggacgctgatgatgacgcggctgtgctcctgtccattcatgcacagcacgatggactggttggtgccggcattgcggccgtcgggccggaaccggatgtcgggccgatgatcgctggtgcgcaggtcgacatgacgccggcgtgccctgtgcacgcggagttcccttgcggcgccggtcgcgctgttggccggttcgacctgcacccgccagccctggctccatgcctggtcacatctcatgccatccgacgaaccgcagaccgtcacacggcggcgttcggtgatggcggcgttgcgtgccatcgacaggctggcgaccagttcggcgcgcagcgtttccgcctggaagtgccgcagcctcgatcagatggaggccgcggtggagccgggcagggcgaagatgaagggacatgcctccagcctcgttccgtgctcgcgcattcaccatcggccaacgccgcggctgcctgcccggaaacccctcagccggccgtcaccgcttgccccgtatactcacccttcccgggaactggcaacaccatgagcgaccgttttgaactcgtctcgccgtattcgccggcgggcgaccagcctgatgccatcgcaaagctgaccagcaactttgaagcgggcatcgccaagcagaccctgctgggcgtcaccggctcgggcaagacctacaccatcgccaacgtcatccagaacgtgcagaagccgacgctgatcatggcgccgaacaagacgctggcggcgcagctgtatggcgagttcaaggcgttcttcccgcacaacgcggtggagtatttcgtcagctattacgactactaccagccggaagcctacgtgccgtcgtcggacaccttcatcgagaaggacagttcgatcaacgagcacatcgagcagatgcgactggcggcgaccaagaccctgctgtcgcgcccggacgcgatcgtggtggcgacggtatctgcgatctacggcctgggcgcgccggaagactacctgtcgttgcgcctgatcctgtccaagggcgagcgcatcgaccagcgcgatctgatcaaccacctcacccagctgcagtacacgcgcaacga

SEQ ID NO: 77200 - DNA, 546 bp, Glycine max
  Peptide Sequence Number=SeqID_168885
atgctaatctccccctacagatgtatcggttgggatcgcgcccagaagacgcccagtgggcccgaagaagtccaacagggccctggggtttccagctctggttacgggcctctgttagtcctacagggtgcccgttcccccagcgaggaatcgcacccacaaagacacccagtggacccggagaagtccaacagggccctggggtttccagctctggttacgggcctctgtagtcctacagggtgcacgttccccccggcaaggtcacgtcatcatagggatcgcgcctgcaagacccaaagaaatccaacagggtcttggagttgtcaagctttaattacgggtctctgtcagttctacggagtgcctgtcacctccagcaggggcatcaggccccttactaatcgagctttcatcaagaagtactacgtccccaggcaggcgcagggcgaaacaccacagcagcctggggatggccagcagcgggcaacagacgcatcgccatcacctctagagttcagctcagctcatccacaaaaaggttag

SEQ ID NO: 77201 - DNA, 373 bp, Glycine max
  Peptide Sequence Number=SeqID_168886
atgttggtgcgcgtgatccgcactcgtctctttgcagctgcacgggtgaaatcttgccccggtatgcatagtagctgtgtgatagcctccctctctggttgtgctcgcacagttggccgtcctccaatatcagggggtggcccaggaaccgtgtggatgtcgagcacactgaaaatgaggacacatagccctctaaaggtgagggcgtgcatccctctcaaggcgaggaggtgtagtcctctggaggtgagggcgtgtagccctctcaaggcgaggacatgtagtcctctggaggtgagggcgtgcagccctctgatggtgaggacgtgtagtcctctcaaggcgaggacgtgtagtcctctcaacggtgagg

SEQ ID NO: 77202 - DNA, 102 bp, Glycine max
  Peptide Sequence Number=SeqID_168887
atgagtgagataggaaggtttggaggtttgggaatggaggtactgcgcaaggaggaaggggctgcgcaggagattctgaaaacgccattttttctagtgtaa

SEQ ID NO: 77203 - DNA, 309 bp, Glycine max
  Peptide Sequence Number=SeqID_168888
atgaccataatttgtctctgcatgtcatcgggctcaccgcctctagatgacaaaagagcacataatgaccatcatttgtctctgtgtgccatcggacacaatcgcatctggatggcaaaaggtgtgtggaatgaccataatttgtctccgcatgtcatcgggctcaccgcctctgggacaaaagggcgcagaatgaccataatttgtctctgcgtgccatcagacacgattgtctctgaatggcgaaaaggtgtgcgaaatgaccataatttgtctctgcatttcatcgggctcaccgcctctggatga

SEQ ID NO: 77204 - DNA, 225 bp, Glycine max
  Peptide Sequence Number=SeqID_168889
atggcactcacatttttgggatctggacagattgagaagtcatttgcctcacaagttcttcaagggaaggttgtggaggagcctcaactgtttgttgtttatggggctgttgttgttgttattgttggattggtggaggaacgtagggtctgcttgggccagcaatattctgaaaataaggatgttattgttgttgctactgctgtgaaggatttgaccatctaa

SEQ ID NO: 77205 - DNA, 185 bp, Glycine max
  Peptide Sequence Number=SeqID_168890
atgggggtgcaaatagcacccaggcccacttgggccctccggaacattcctccagaaggcgccgaggcgcttccgaaacgtttccgtaacgtttccgtaacgttttccgtgaggaatttcgcaaagatttcaaccgttcttcgacgttcttcattcgttcttcatcgttcttcgatcttcaacgg

SEQ ID NO: 77206 - DNA, 288 bp, Glycine max
  Peptide Sequence Number=SeqID_168891
atgccaagcacctcacaaggaccaaagaaaggtcgcatgtcatcaagcaaaggtccccggacgaaattagggtatgacagtgtccaagcagaggacacaatgggagttaggggcagtggtaacggaggggcaaaagcgaagggggtggaaggcgccactgaggaggaagaggtcgaggaagaggaagaagagaaaggtaaacaaaagcatgatgatgggcttgaggaagagggaaaggaggatgaacttcacaaagaaggcgattatggatggaaaggatcaagatga

SEQ ID NO: 77207 - DNA, 438 bp, Glycine max
  Peptide Sequence Number=SeqID_168892
atggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctgggcggctccctcgtgcgctctcctgttcctgcctttcggtttaccggtgtcattccgctgttatggccgcgtttgtctcattccacgcctgacactcagttccggggtaggcagttcgctccaagctggactgtatgcacgaaccccccgttcagtccgaccgctgcgccttatccggtaactatcgtcttgagtccaaccccggaaagacatgcaaaagcaccactggcagcagccactggtaattga

SEQ ID NO: 77208 - DNA, 1161 bp, Glycine max
  misc_feature (1119)..(1119): n is a, c, g, or t
  Peptide Sequence Number=SeqID_168893
atgagcaagctgctgttaattgatgatgatgttgaattagccaatatgctgaaggagttcctgacgcaggaaggctttaccgtgaccactgcccacgacggactgacgggcgaacaatatgtgttggctgggaaattcgacctggtcattctggatgtgatgatgcctggccaagacggcttgcagaccttgcgtaatgtcagacagcattctgatattcccgtactcatgctgaccgccaaggatgataatgaggggcgcattgaaggcttggaaggtggcgctgacgattacgttcagaaaccctgtttgccaagagagctggttgcccggattcgtgcgattttgcgtcgccaaacggcagatatgcctaaagggaatgatatcgtggtgggccagttggtggtgtctagcgagcgcaggaaggttttttgggccgacaagccgattgtgtttaccagcacagagttcagcctgattgaaattctggccaagcatgccggcaccatcgtcagtaaagaagatttgtctgtcaaagccttggggcgtcccttggtcaaatatgaccgcagtattgatgtgcatttgagtagtattcgtcaaaaaatatctgaggtatctggcggcgtgaatgtgatacaaaccatttaccgagttgcattgttcttggcgctcatttccactgttattacggttggtaatattgtccagtgggagttgaaccagaaagcgcttcaccatagtgagctttcacagccttgcaccgccccggcaacctgcccacctcctgttgttgaaaatcatcatgaaacccgcttaggtacctggcgggttttaaattacgctcagttattactccattttccgctgtctgcgcttttattttgcattctctccagcgctatttttgccggcatcctggcctggtcaatctcgcatcccgtcaagctcttgcttgaccacctgaaaaatgcggcaaagggagatttgctgattggcgtcagtcccaagattacggctagccatgacgagttttcagagttgggcgaggcattggatctgatgacgcttcgtattgataatatgatcaaaagccaatccaaaatgctgcatcatgtntcccatgagttacgctctccacttgccagaatccagatggct

SEQ ID NO: 77209 - DNA, 513 bp, Glycine max
  Peptide Sequence Number=SeqID_168894
atgatggtagacaccttgccggtgttttactatgagaaattaatgggctacatgccctccagcttcgcagacttggtattcgccggagaaagaatcgaagtgggcttgaagagagggaagttcgattacgtctcctccacaggtaccaacgctaggaggaatggagcaactggggcaaagaggaaggaaggagatacctatgccgtcacttcagcgcccgcacggaccaagccgtcgcagatctcccatggtacccatcagtatgcgcaacatcacccgagcttcttagctcgcgcaggggactcctccaactcagcacccgtacaaacttgggtgcctacgcccatccagagggagaccccccaagctacggctccaaccccgacttgcccggccagcaatgcccactttggtgtcggtcccaacacgataaggaactttcccccgaggccaacattcaccccgatcccaatgatgtacgaagacctcttgccatccttcgttgctaactag

SEQ ID NO: 77210 - DNA, 455 bp, Glycine max
  Peptide Sequence Number=SeqID_168895
atggtgaaagttggaacctcttacgtgccgatcaacgtctcattttcgccaaaaagttggcccagggcttcccggtatcaacagggacaccaggatttatttattctgcgaagtgatcttccgtcacagtggcttctgtttctatcagctgtccctcctgttcagctactgacggggtggtgcgtaacggcaaaagcacccccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgataaaagggaacgtaaaaatcaaagtcacgtttgcacattcgattaaaggctgccgtcccttgggacggac

SEQ ID NO: 77211 - DNA, 222 bp, Glycine max
  Peptide Sequence Number=SeqID_168896
atggctcaactgatttttgatgccatccactatttgcatggatcgcgcccacaagacacccagtggactcggatgagcccaatagggccctggggtttccagctctggttactggcttctgtcagtcctacaaggtgcccgtcccccctagcaaggtcatgccatcgtgacatagggattgcgcccgcaagacacccaatggacccagagaagtccaacagg

SEQ ID NO: 77212 - DNA, 147 bp, Glycine max
  Peptide Sequence Number=SeqID_168897
atgttgatgcccaatccgcccatttgggccctccagaagattcctccagaaggcggttgcttctggaggaagcaaccctgctcgcctgggcgagctgagctcgcctgggcgagctgggcggcaagcatctcccctattttgctataa

SEQ ID NO: 77213 - DNA, 389 bp, Glycine max
  Peptide Sequence Number=SeqID_168898
atgaaggaaaacaaagtgaaattcgatgtattatctacgaggacatcgatgtgcgacagagggaaattgtcattggcttcatcctcctcagcttttgctttaccggggaacacttgggatttagaggctcatctctcgattctcccgagcaattatcctttccagctctgggggaagccttatatcttcgtctttttcatcctccgtccgactcacttcttgctcgaaatcgacggtcgggtccccggtattagtaccttcacgggactcatcgtcggatctgtatcgtataagcgcgttcctccacccgctaattccctagttggaagccgggagggcatggctgtaccaaagtcgatctcctcggggagttctcatcgcatattgcg

SEQ ID NO: 77214 - DNA, 860 bp, Glycine max
  Peptide Sequence Number=SeqID_168899
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatgattgccatcgtagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 77215 - DNA, 303 bp, Glycine max
  Peptide Sequence Number=SeqID_168900
atggatcaagctagtgaggaaagaaagttgcaactgcgagagttagatgagatctacctagaagcctacgagaatgccaagttctacaaagaaaagtccaagaagttccatgatagcatgataattaagaaggacttcatgcattcatcaagttcagaaaatctctttaacaatgcatcgacctcatgtatcaaagttaagtccccccaagaattactcattttgtctctagtactcaataacatttccaacgcacatgattggacctcaagggtattgagccaaacatattgctatatctaa

SEQ ID NO: 77216 - DNA, 319 bp, Glycine max
  Peptide Sequence Number=SeqID_168901
gggaaaggaggaaaataggggaaaagaggaaggtggttgccgcccagctcgcccaggcgagctgggttgcttccaccagaaggcaccgccttctgttggaacatcctggaaggcccaagtgaatgtcgcgaaactttgcggattgcctaacgatgggtgtcaagttcctctaagcggtcatgcaaagtctttcatgaggaggaatacttgtacttgggagcatgtcactcagtttggaactcccttgagactcaggttgatcaccataggggaggagttgtctgtgaacgatagggtaacctcgacacttgctgcttaa

SEQ ID NO: 77217 - DNA, 399 bp, Glycine max
  Peptide Sequence Number=SeqID_168902
atggaagaccaagatctggaaatgattcttttagcctctcttcctccttcctacgagaatttttatttgattcttctaaaaggcagaagaagaacacaggcaaaggtagcaagaagagcaaagttgatcctaaaaacttctacaattactgtaaaaaaattgggtcattggaagcaagactgtccaaagaaagattatgttgttgctcttgttcagaataactcctcatcgaaaagggatttggttttggctattggtgaacaactacaacaaaattttaaacagtgggtgttagacttaggttgttcttatcatatgtgtccatacagacattgttttgtgacatatgagaagaagtctagtggtaacgtccacatcggtaatgatgctccttgttag

SEQ ID NO: 77218 - DNA, 492 bp, Glycine max
  Peptide Sequence Number=SeqID_168903
atgatgcatgaaatggaagaaagatttgttcaaatagagcaaaagcttgcaaaggttgatgcactttcatacatggtggaggctatttctaatcagcttcatcagctaacgtgcaaaaggtattatgcctccatcaatcttggacatggctacagagaaaggcaccaccatacatgccatcaagatcgccttaaagatttgatgtttttgcaacagcatggcaccttggcagaatttaataatgcatttgatgtgatttcttgtaaacttcacttatccgaagactatcttgtcgatgcttatttggctgaaataaagcttcgacaacatgataagagaaaaatggctaccaagaacatgagttacatggctcctagaagcagtgatacaacagaaagtacccaagataactggaagtccagcaagaatgcattagtagaaagtgaatcccagccaaaagagaagtcagtaaatcacaatcaacttctttga

SEQ ID NO: 77219 - DNA, 282 bp, Glycine max
  Peptide Sequence Number=SeqID_168904
atggtggccccggcagcaacgatggttgctgactacatggtcaaactcaccagagagacgaacacaatggtggtagtggatgttgttgaatcagactggagagaaatatggcgcaccgtgaggttgccggagaaaatggtcaccggcacagacggtggtttatggcgacaaaagaagcaagcaacaatgaactgtggcggagagacaacaaagtgggatcatacctgctttgctaccatgttaaaatcatggactacaatactgaactacagaagtgcttga

SEQ ID NO: 77220 - DNA, 351 bp, Glycine max
  Peptide Sequence Number=SeqID_168905
atgcctgcctcttgcagagcttcaaagataaaccttcttgaggatgacaacaagtccctgtatgacattggtattggggtgaacttcggaagcttctttactggagggtttctccctgcattggagttcatgccaggattggcatcgccggggctccttgtgatgggttggacgccctttgctggacgggcgccaagttgggggagttcccggcgcgggccgaaaagctcgggtggtgttgagtatactagtgagtattatgaggggtttgctggaattccggccaagcaggagccgaggggagacatagtcaaacttccctctatcgcatttaccaccggtccctcatga

SEQ ID NO: 77221 - DNA, 210 bp, Glycine max
  Peptide Sequence Number=SeqID_168906
atgggatttgcggtttttccagccttgagtcatcattgtcgcaacatgcccttttgcgggcgagcgaaggcgaggctcacgagtgcgctttccaaaggaggaaagatgcgcggagtcgccaccaacgtttatttggggaaaacgtcgggaaaaccgaaggaaaccggtcaaaatgaaaattctaagttcgggagttgtatttacgcttga

SEQ ID NO: 77222 - DNA, 106 bp, Glycine max
  Peptide Sequence Number=SeqID_168907
atgccaatgtcatcacatcggctcggcggctcctcaccagaacttcacttcctgcaccctgccactgtcattctgctcccacgaacaatgttcgtgatcatcacag

SEQ ID NO: 77223 - DNA, 1746 bp, Glycine max
  Peptide Sequence Number=SeqID_168908
atggagttatcttttacacaaggtcgatggaactatgaaagatggggtggatttgattcaatatcaagccacaatgcaaagcctccaggtgttgaattgtgggcagtttttgatgtccctctacatcaggttgatgcttcttggaaaaatttaacccattcactatcaggcctcttttgtgcttcaatcaacttcctggagtcttctacctcttattctgatcctgaatgggcatttcaatcagctttgggcagtttaagatatggtacactgccacgtgaagctgtgtgcactgagaatcttaccccctggttgaagctccttccttgtcgagataaagctggactctcttccttaatggatagaccatctatttacaaaagcttttaccactctcagcagttgcacttgacaatgtccacagatccttcagatgggtcaagatcaggaattattctagaacaaacacttacagttgtactccagcctaatgatcagaaagctggtatgagccatctcagtaaaacaaagatacaaccaagctggtccctgagttcaatatttggaagaaaaatcagtggaagatgtgttcttgccaagttgagtaatgtctaccttcatgctgagagaagtctagtcaatcaacttgagaatctccagaagaatactgttaaatttgctgctaatgacacaggtcttgaagattttagaaggaatgctgggtttgaattgtctgttactcctgaaagggtgcatgcagaactggaaaagagctcctcaattctgtatgaatatccaatcaaagaatacactgacactgaacaatttgatttaggcttaacatgggtgcatccaattgtttggtccagcccacatgcacctttatatgccagtagatttttgatgggaagtggaaatgaaaggggtgctattgcaatatccttgaaatcgacagaaatgacccagggactagttgcagcctataatgttgaagagaggtgtaagttgcaagttaatgttctccaaattgtgccttggtatgttaaggtatattatcatactttgcaattattagttgatgaaaggcctcaagcactcacagattttgttgagataatgcgtgtttcgccttctgaagacaaagtatcacctggggtgatggagctggtcctccaatttccttgtgaaatgaagtcagctgtattgagtatagagtttgataagggctttttgcacattgatgaataccctccagatgctaatcaaggatttgacattccatcagcaataataagctttcctgacttccatgctggtttgcaattttctgataaatctcaaagcaagtcaccactattgtctaaattacaggaaaggagccctgttctctcttacacagaagttttacttgtacccttgacgactcctgatttcagtatgccatacaatgtcatcacaattacatgcacagtttttgccttgtattttggatctttgctaaatgttctccgaagacgagttggagaggaggaaagacttttgaaaaacaaagatgcaaacaaaacagtgttttttcgtcgagaactagctaaactatctgccaagcttagaggcagaccattggaattgactctgccctgtccatcatcatcttcgtcatcatcatcctttgttagtcctaaattgattcttagagtactactggttgcaggaattgccgttgtatggcaatactattcacaatga

SEQ ID NO: 77224 - DNA, 196 bp, Glycine max
  Peptide Sequence Number=SeqID_168909
atgtttaacggcggagaagctgttatatcaactgatggaccaaggccggttcaaaatcagttaagggaacaagggagacaacacgtgtgcatgcagtcaacggacagagaaagccctgctaaacccaagcctttggtgatacacttcaccaaggatgtggcctcccagaaaccccgaggttctcgacctatctcgg

SEQ ID NO: 77225 - DNA, 348 bp, Glycine max
  Peptide Sequence Number=SeqID_168910
atgtcccttgtgtgggaaactagagtggttaaaggatttaagcatttctgaggggatgcttaggcactttaatttcatccatggtcatgtgcttgatggtgcccatgggaaaatagagtggttaaaggatttaagcatttctgaggggatgcttaggcactttaatttcatccatggtcatgtgcttgatggtgctctcgttcatacgtcgtatgttgtgtatgttcatgggggggttccttatgcggaggaatacttgtacaagggggtgtgtcactcggtttggaactcccttgagactcaggctgatcaccgtgggggagggggggagcttccttgcgcaacagg

SEQ ID NO: 77226 - DNA, 438 bp, Glycine max
  Peptide Sequence Number=SeqID_168911
atggggtcatttccaaattatttccaacatggggcagttatttacgtgaaaaccatgcatgcaggacccaaaccgccagaaccagtggcgagtttggtgtccttgagcaaattgccagcaccaatggcgatacgtgcatgcagagaggaaaccgccagtccaaatggcgatatgcttagcgctttgggaaccgccagtcaaactagcgagttccatggatgtgtagctgcaggctacgtcctgccatggcagtgtagctgggtcagtgcaggcgaaaccgctagtaccattggcggtttgccttgcacagggattgccaagaaactgctattaccattggcgggttgcttggggtgtgctttgtttcactcttggtgcacgatttctctcctcttcatattacgtgagttctctgtgcttggtttagttagaatgtga

SEQ ID NO: 77227 - DNA, 1092 bp, Glycine max
  Peptide Sequence Number=SeqID_168912
atgcacgggctcatactgctatttgaatattaccaacacatgagcaaagtaatgaaagagaggctgcacaataaagagagtaatgcattgagccatgttcgagacaaacatgttttgaaatggttgaagaagctaatgcttggtgattttgaagtggtcgaattcgaagaaaaatggaaagagatggttgctacgtttgaattggaagacaatacttggattgctgaactagtggttgtggcagattattcgtcaatatacgggaatgaagttttgcaaacaactcttcgatctcttgagcggtctggtgatgaattgtttacaaaggagatgtttaaaatttttcagtcgtatctatgtaggactattaagctaagagtcgttgattgcaaagagatggtcacattttcagtttacacggttgtgaagtattgtagtggaagtgtttggcgtgtgtcatattgcccatcaacggttgactttacatgtacttgtatgagaatgcaatccattggtcttccatgcgatcacatattggccatgttggtttctttaaattttatgaagttgccaagtagtttggttttgaataagtggtccaaagttgccacaaaacagatgaaagacaaatatccgaattccacaacgtattgggattcgcaattgatggccatgtatgccactttggttgaagtttctagacaagtttgtgtagccgcataccgtgatgaagaggagtatgacaaaatgttgcatttcctatccaatgaggctagaaggctgaagtcgaagcaaaacagcgaacattgtgctgatgataatcagttgcagcaacaagatgtaaaggatgcggacaggtcggaatggatgaatgtggcagacaaagaagaatccaaaagtgtggccaatgtggtggaattggccacatcaagcgttcttgcaccaaccgtcctcgaaatggaaatggttgtatttcatccaccgaacaaagtaacagtaatgatgacaatttcttttttcttaatgtttgacagaatgcagcagtcgcaaacacagacatttgttggtggtagtagccgtgttggtccgtaa

SEQ ID NO: 77228 - DNA, 621 bp, Glycine max
  Peptide Sequence Number=SeqID_168913
atggagtttatttctatctcagaccatactcctctagttgtcaccactgagttggtagtgcctagagatgtctggaagcaaaatattcatggctgtagcatgttcaaggtctgtaagaaattgaaagctcttaaagctcccttgaagaatctttttaagcaggagttcagcaacatctccaaccgagtagagctagctgaggctgaatataacagtgtgcttaattctctaaagcaaaatcctcaagatccttcccttcttgctctggcaaaccgcactagagggcagaccattatgcttagaaaagcagagtctatgaaatttgctcagctcatcaaaaacaaatatctcctgcaggctgataaatgctccaaattctttcatgctttaattaagcgcaacagacacagtcgatttattgctgccataaggctagaggatgggcataacacttcctcccaagatgaaattgcccttgcttttgtgaatcactttaggaatttgtttagtgctcatgagctgacccaaactccatccatttcgatctgcaacaggggtcctaaaaaagaaaagaaaaaaaaaagaatgttgtgtgccagctttgtcctccatccgaactga

SEQ ID NO: 77229 - DNA, 178 bp, Glycine max
  Peptide Sequence Number=SeqID_168914
atgaatgaagatcaatggatgtatgacagtataatgactgaagaagttgacatggatgatgaaaatgaacaagaatgtggtgtgtttgctactcgagatgattttttgcagtgggctcgatcagttgctcatgaaaacggatttgtggtggtcattataaggtcagacacaaacactg

SEQ ID NO: 77230 - DNA, 594 bp, Glycine max
  Peptide Sequence Number=SeqID_168915
atggggaagaacaagggtcgtcaatcgcactcagttgcaaagcaaattatggtgaagggtactacctccggttcaggtaaatcccaaacatctgctacttctggtctggctggttgcttggatgttgtccaagcaaatcagaatgcttatactgcttcacaggataaccttgtaggcaaggtgctcgtaaaaaaaacagggacaagttctgcaaaaactgatgatgtcgcacaccaagtgtttgataatttgtcggaatgcagtgctgaatctgaatcttccccagagttagacgacaataaggctcccactccttgggttaatctattcaaagataacagaagtccttccaaaggttttggaatgaagttctcccctccaccctttgatgatgaagtgctgttggaagaaacagatttgcaacccctggaagaggcttggggacatagccttattggctatgtggctggtcgattcccaggaaagaaagctctgctggattgttgccaaaaatggggagtcaagttttcatactcagctcatgaaagtggttggctggtgttcaaatttgagtctgaggacgatctgaaccaa

SEQ ID NO: 77231 - DNA, 246 bp, Glycine max
  Peptide Sequence Number=SeqID_168916
atgtaccgacaaaagccacaagatgcaaatgatgagtctaaagtggtggttgtgtcggttgattgggacggtgagtctgaactcatggttgtctcggtctcggttgagtgggacgacgagtgttttctgttgttgggtggcagttcagtgttttttttccgtaacttaatgggtaacgaatggggcgtggatgtaaaagaagatgagtggtcaggagaagtgcgggagtcacaacgaatttcgtga

SEQ ID NO: 77232 - DNA, 324 bp, Glycine max
  Peptide Sequence Number=SeqID_168917
atggaaaggagttcgtcatcgtacacctctgaggcccgaagtcgcgtgttttgtccgtgtaacatagaggctccactagtgacatcgtggactgaggaaaatccagggaggcgtttttatggttgtggtctatacaagtggcttgatccaattggcaacaatcgtcaaaagaagatcattgtaggcttgatgaaggaggttgatgaattgaagttgagggaaaagggtttgcaaagcaggattagtgacatgaagatgaaggaaaaatgtttatggattgtattggttgtttgttggcttaagcattttatgaacaccacttga

SEQ ID NO: 77233 - DNA, 438 bp, Glycine max
  Peptide Sequence Number=SeqID_168918
atgcctagacagaccaagggtactaatgttgttggacccaaaaagttttgggtagcaaaatcttatattattcccattgaagatatccttggtaggaaaaggtcaaggttagagctggtacttggacaatggctgctcatggcacatgatgagagaaaggaaaagctatttcctttggaagcatgggcaaagaaaagatttttctcagtcaagtcaacctatgcattagcttgtaactctcaatatgctcttgagataaaattgttcaagttgattcacaagtggtgtggaccgaagaggattagaagttccctctggaaacttgccaatgaaagcattttaaccaatgctaagaggctgagtgttagacaaatggcctcaattatcttaagaaggaatgaattaattttcactaacaaacttttaacccccttctaa

SEQ ID NO: 77234 - DNA, 144 bp, Glycine max
  Peptide Sequence Number=SeqID_168919
atgcaagttggttttaatccttctatacagatctggcttgaatccggacaattacacttacaatgctttatggaggcactgtctgaatctgggagattagaggaagccgagaagatgttttactcgatggaggactatgtttaa

SEQ ID NO: 77235 - DNA, 1680 bp, Glycine max
  Peptide Sequence Number=SeqID_168920
atggattctgttctccccgatacttccactaatgccattgcctcttctacacccacttcacaccctcattcccaaccctcactcccacaaaccctcttagtccccaaacccgaacccttctgggatacccacatcgaaacctccgacgaactcgacctctactccgagttcaatcgcgtcactgagctctttcacttcgccttcggagccaccaacgttgtcgaccctttcggagccaccaatgttgcatgccccgaacagactccgctggttcctgttcctcaggagctcgattcagcggcccagcccgacccgaattcgccctccgaggacgtcttgcgagcgatcgttccggtaccgccggagcagcaggacggcgcggtggccaccgccaccgtgccgaggcggaagcagagccggcagaaggagctggtgagagtgatggatctgtctccgagggacgaggctcatttgcgcgagaccgtgaggaggacaaggctcatatacgactcgctgcgagtgttgacctccgtggaggaggagaagcgagtcgcctcagtggcagcggcggcggtggcagcagcagcagcagtgacaacactagagggctgtctgccggtggatggctccaccggcaagttgcggcgtctccggggagacctgcgggctgccagcctgatgagagagcgtggactgtggctgaaccgtgacaagaggatcgtcggggcgatccccggaattatggttggggatttgttcctttttcggatggagttgtgtgtggttggattgcacggtcagatacaggctggaatagattttcttcctgcaagcatgagttccactggagaacctattgctaccagtgtcattgtttctggtggctatgaggatgacatggatgatggtgaggttatagtttacactggccatggagggcaggagaagaattcctccaggcagatctctcatcagaagttggagtcagggaaccttgcattggagaggagtatgcattatggtgttgaggtaagggttatccgtgggatgaagtatgaggggagtgctgctgggtctggtaaggtgtatgtgtatgatggggtgtataggattgttgattgctggtttgatgtggggaggtcgggttttggggtttataagtttaagctttggaggattgaggggcaggctaagatgggtagtgctattttgaaggaagctaggaatgttaggaggagtgagctggatttgaatcccacatctgctgatatggctaacaggaaggagaatgttgcagttcggctttttaatgactttgatgatgatcggggtcctctttgctatgaatatcttgtgaggacttgttttccgaagtttgtgtttcatcagagtgggaaagctactggctgtgactgtgtggatggttgtggtgatggatgcttttgtgctatgaaaaatgggggtgagtttccttacactctgcaggggcatcttgtgagagggaagcctttgatttttgaatgtggcccattttgctcctgtcctcctcattgtcgcaatcgtgttgcgcagaaggggctgaaatataggttggaagtgtttaggtctaagcagacatcttggggagtaaggggttgttttgaccagggagcaagctcaactcttaacaatgaatggtga

SEQ ID NO: 77236 - DNA, 174 bp, Glycine max
  Peptide Sequence Number=SeqID_168921
atgtgtggagtcgccaccaatgtttattcgaggaaaacatcgaaaaaaccggaaaggtgtggtgtacgaactttgagggtgaaaggttcgggagttatatttacgcacggggaagggtgtttcccttgctcctacgtattcctcaattgtgatgaggaaatcagacctacatag

SEQ ID NO: 77237 - DNA, 282 bp, Glycine max
  Peptide Sequence Number=SeqID_168922
atgtcagtgaaaaacctcgtcgggtgcctaggaggagaccagtcagggtcacgctattttgcaaagaatgctccaaccatatgggatcaacataggcttaaaggagcactcaaatcgggtgtatttacccccaaggcctacactctgaagagtctgttagggcctctccctcctgattcaggtccaacctgtcatatcctaatttcattcggggatcattatttgttggcatgcgaccttcgcttgaccgcctcaaaatgtttaacacccatcgttatgtaa

SEQ ID NO: 77238 - DNA, 237 bp, Glycine max
  Peptide Sequence Number=SeqID_168923
atggcatggaatttccttttcaaaggcaagaaatggctccgaggaagctttccacaaagagatataggaaggacgctgtggccgaagggactagcaccgctcccgagttcgatagccatcatttcagaagcgctgagcaccagcagcattttgaagccatcaagggatggtccttccaccgagagagacgcgtccagctcagggacgacgagtatacagatttccaggaggagatag

SEQ ID NO: 77239 - DNA, 435 bp, Glycine max
  Peptide Sequence Number=SeqID_168924
atgggtgacctagaggaagtacaggaacagacgaaggccaacatgtcggctttgaaagaacaaatggctttcaagatggatgtcatgctgggaatgaaacaactaatggagagtaacgcggccactgccgccactgttagttcggctgccgaagcagacccaactctcccaactgccgcgcaccaccctattctgaacatggtgggacgagagagaagaacaccggggcacatcagcaacccccatccggggtacaaccgaggagcttacccctacgatttaccaactaattacacaccaccagtcatacgtgacgacgcgggtcacgttcctcccctcatccttgaaggggagcctcctcgacattcagacgaggtccacgaggatcatcgagagcatgctcacggagatgccgactcctactccccgtttccc

SEQ ID NO: 77240 - DNA, 836 bp, Glycine max
  Peptide Sequence Number=SeqID_168925
atgaggttctatcaagtcaaggtcaagagcctaaggaccaccaatctaaaggagttagggcagttaatgggtcagctccagcggcaagcttttcgcaaagcttacggtaaaatctgggacttagccatgctatcacctatggtagaagaatttgaagagatcctaggatgccctctagggggaaggaaccctacctcttctcagggcgaatgggccccattcatagacattctcgcgttgttgatcttcggaggagtcctctttccaaatgtggatgggttggtcgcctatcataaccacaaggaaagcccggttgtcgctatgttagccgacctatatgacaccttcgaccgaagatgtgagaagagcagtcaccgttcatggacagagaaaggaggcgcaaattgggaccaactcttagcaaacaaagaagaagcatctaccaactggttccctcgatggaaagaaggaagaaccggagttcttatttcatgcagaggatttctgaatgttcccatgatggggatgaggggggcaccactagaggaagagatcgcgcctatcatttcacgaggtttcaataagaccaacgtggagacgcttcagaaggtccgcaaggcatgggagatggtgcgaaagaaggacaaagaactcaggggcagtaacaatgggcctatcgatggctaccgtaagtggttgagagcccacgtgctaggtttggattggctcccgagtttgagaaccacaaaaagggaggaagttgaggcaccggatgaagacgaagaggtgcaggcccttagggcagaactcaagcaagcccaaacagtcaaagaaag

SEQ ID NO: 77241 - DNA, 213 bp, Glycine max
  Peptide Sequence Number=SeqID_168926
atggcacgcagtgtgtccgcttcatgcccctattcaagggacctatatgagagggagctaacaaggcttttagtgataattcccaaggtggttatatctctcttgatggtctctagaggtatcattctcttcgaaaaacatattgcagcagtagggactactagcaacaatatgttatcaaagagaaaaactctagatgagggttcactgtaa

SEQ ID NO: 77242 - DNA, 549 bp, Glycine max
  Peptide Sequence Number=SeqID_168927
atggatggtaaggcttttgcttggcaaaggcattacatgcagaatgtgaatagcaaacacaagacgtggcaacagattttgcaagatgcaggcagtcgatttgacattggtgcattcgatgacccggtggcaaaacttgtgagactgaagcaagaagattccttgattgagtatcttgagaggtttgacacacttttggctcgtattgctatatcagaagagttggcattgagcttctttctctctggtttgactgttgaattggagaaatctgtcagggttcatagaccttcttcaattcaggaagctgtcaaaatagccagacttcaagataaggttcttcacgagatgaccaagaaattttctccaacaaaactgattcaagcagattcacaagccaagtattcaagaaactggtttgttccatcacaacatcatagaacgattccaattacaactttgcatcagcaaaagactcaaaacccaacacagccaacacatccaatcgattctaaggtatctactgccaacaataattctaggaagtag

SEQ ID NO: 77243 - DNA, 427 bp, Glycine max
  Peptide Sequence Number=SeqID_168928
atgggatcaaatcaaacacctctgcttaagagaagattctatcaagtcaaaatcaaaagcttagaggtcaccagtttgcgagaattggggcagttgatgggtcagctccaacgtcaagccttctgcaagacctatgggaagatttgggacctagctatgctagtactgactgtggaagaacttgaagaaatcctaggatgtccattgggaggaagaaagccatatctctttttggggttctatccctccatggcaagagtagccaagggaaagacgaagacattggcagatcaaggggaatgggcctcgtttattgatgccttcgcactattgatatttggtgtcgtcctttttccaaatatggagggattagtggacctagccgcaatggatgccttccttgctatcaccatagcaaggaaagccg

SEQ ID NO: 77244 - DNA, 570 bp, Glycine max
  Peptide Sequence Number=SeqID_168929
atgaaaagagaaaaacatgtctcctatagtagtcataactcttgcaagagcctaagtgaagaacttcgtgactattatgaaggaaggcataggtcacatcttagacctcactcccataggagagaaaatgaaagaaagcctcaagaggttaacattaaactcccatacttccatgggaaggacaatgtagaggccaatttagattgggaaataagggtagagcaacagcttaaaaggaagtctacttcaaaatcttatggctctcactcttatccaaagaaagaccaaggtcaaggaatcttagggggacacattacttctcaatgccccaccaagaaaaccatgattatgaggggccaagacatttatagtagccaagatgaggctactacttcaccttcctctagtaaaagtgaagaagcaaaaggggaagaatctagtgaagagatctacccccaagaagaaggacaaccattaatggttaaggaggagtgtaaggagacacttgttagcattgccacatctcttaggcttgagtttattcctcaagtaaagggagttgttggatga

SEQ ID NO: 77245 - DNA, 273 bp, Glycine max
  Peptide Sequence Number=SeqID_168930
atggatgggttggtggatctagcagcgatcgacgcttttcttgcctattgtgaccatagggaaagcccggttgtcgctatgctagccgacctatatgacaccttcgaccgaagatggacaaggggttgcatcagttacaatcctgttcttgctataaggcaacttggctaccctatgagaagggcaccgctagaggaagagctcgtgcctgtcatttcacgaggtttcaataagaccaacggggagacacttcaaaaggtccgcaaggcatag

SEQ ID NO: 77246 - DNA, 395 bp, Glycine max
  Peptide Sequence Number=SeqID_168931
ggaccgaaaaatccagggctagaagatctgaggccccatcttcatcagctgcccctgctccctctacatcaactccctctacttctgctctttccttaccactagcagctccaattcttccaggtccctctactcagagcttagagccttccttgtctatgctacatagcctgcatcagggccagctcctgatcatgcagagtttgcaggatgtggtccagcaatggccagttatgagtgtggaggaatttcttcagaaggtggcctggccaggagtccagccttctcatttgggagggggtgaggcctctatagctcaagagcctcagtcggaccaggaggatgacattctagaagcctcaaagcccactccacctgagcctttcattttttag

SEQ ID NO: 77247 - DNA, 129 bp, Glycine max
  Peptide Sequence Number=SeqID_168932
atggttagtcttaacatttcattggcagcggaatggaaaaggaagaaagatgattggagacaccacttcaaggagaagataagtcaagaagaagctcaccaccataggaagtcatggataagagcttga

SEQ ID NO: 77248 - DNA, 278 bp, Glycine max
  Peptide Sequence Number=SeqID_168933
gggtcacgcccgcaagacacccagtggacccagagaagtccaacagggtcctagggtctctagctctgattatgggcctctgtcagttctacgaagtgtttgtcgctcccagcaaggtcatcaggccccccactaaccgaactttcatcaagaagtactgcacccccaagcaggtgcagggcgtgacaccacagcagcccgaggttggccggcagcgcgcaataggcgcaccgcctccacctctagagttcacctctgttcatccacaaaaaggttag

SEQ ID NO: 77249 - DNA, 135 bp, Glycine max
  Peptide Sequence Number=SeqID_168934
gggcaggatcgtcttgagctaccttctggggtggggacagaatatggacagcagaaaccaatcaaggtacttaggaacggatgcaagtggggatggagtcacgaccgactgatcgttgctctttctctacgctaa

SEQ ID NO: 77250 - DNA, 233 bp, Glycine max
  Peptide Sequence Number=SeqID_168935
atgggatgttacaggcatgaaggatgttcctcatatgagggattccccagtggaccacgcgacccatcgattttgaccgattttgctgagcatgccgcacacagcatctggagtggacaggaacgacccgatccgaagttggtctcccacggtagaaaagtagataaaattgggagaccaacgcctgagatcgaagggttgattgctgacaccggattgagtccactgatcag

SEQ ID NO: 77251 - DNA, 357 bp, Glycine max
  Peptide Sequence Number=SeqID_168936
atggatgagaagtccataacaacccaagagtttgaatatggtgaaactgttgttccctcacagccagcaaagtttgagcaacttgaccaatttgttttatgggatcctgtggctttaacatcagttcatgcagagttactcgccatctatcatgatttgaagatagctagagacaaaggaattggaagattgatctgcgaatcagattcgaagcttgctttggacttgatcactggagaaatcaacttgtttcatcaatatttccctaccatcttgttgatccattcgttgaagcagatggattgggaggtgacctttgtgcacgtgtactgtgaagggaacaagtgtgcagattga

SEQ ID NO: 77252 - DNA, 279 bp, Glycine max
  Peptide Sequence Number=SeqID_168937
atgacagggattcaatcagacatccgagtaaaaagttattgccgtttgaattggttcagagcttcaacattcaatttcgagcgtctcgatatattacgggactcaatcagacatccgaagcttcaacattcaatttcgagcgtctcgttatatgctaaaggactcaatcagacatcaccgagtaaaaagatattgtcaccgtttgaattggctcagagcttcaacattcaatttcgagcgtctcgatatatgacgggactcaatcagacatccgagtaa

SEQ ID NO: 77253 - DNA, 247 bp, Glycine max
  Peptide Sequence Number=SeqID_168938
atggctaggacacaaggtttagatcgtgctatagttgatgttcccgagaggcgtagacctactgcattagcccgtaggcaacgggttcatcagatgactgcggatgcacctgatatggctgaggatgttcctgacatggctgaggatgtccctgatatggctgaggatgcacctaagatgactgcgaacgtacagggtgatgatggtgctgagaggtcacatgttgatgatgctgagggattcccag

SEQ ID NO: 77254 - DNA, 393 bp, Glycine max
  Peptide Sequence Number=SeqID_168939
atgtcgaatcataagagtactgagtcagcactaaagaaccttgaagtacagatgggacaattggccaagcagatagatgacaagtcatcaaataactttggagcaaatacggaaaataatccaaaggaggaatggaaggctgtgatgaccaggagtaaaaggaaattggaaataaccatgccctttggtgaagctctgcagcagattccactctactctaaatttttgaaagatatgttgacaaggaagcacagggaccacccgttgttgggatgcgaccctcgtttgaccacttcgaggtacttggcacccatcattaggcgattcgtgaagttccgtgacatgccggaagtcaagagaaagcattgtagcacaatccgtgaaattccgtga

SEQ ID NO: 77255 - DNA, 1017 bp, Glycine max
  Peptide Sequence Number=SeqID_168940
atgaccggccctctcgatgagtcgatctcttgctttctcataaggttggacccttgggtactagtacctatcaccttcagaggactgtacgccctcaccgtcagaggactacacgtcctcgccttcagaggacttcacgtcctcaccttcagagggctacacgcctttgccttcataggactagacgtcctcaaattcagaggactacacgtccttgccatcagaggactgcacgtcctcgcctttaaagggctatatgccctcaccttcagaggactacacgtcctcaccttcagagggcttcacgccctcacctttagagggctacaccccctcatcttcagaggactacacgtcctcaccttaagagggctgcacgccctcgccttcagaggaccaaacatcctcatcttcagaggaccaaacatcctcatcttcagaggactacacgtcctcatcttcacagggctacgtgtcctcgccatcagaggactccatatccacaccatcagagaactcaagtttctttttatcagtttctgggccacccctgatattggagggcgaccaactgtgcaagcacagccagagagggaggctatcacgcagctactatgcataccggggcaagatttcacccgtaccgctgcgaagagacaagtgtggatcatgcgcaccaacatgaccactcttacacaaatatggatgatgttgctacttagcaaacatttcgtccagcgaccgcaatgccgatctccccctgcgaaagtatcgggattgcgcccacaagacacccaacagacccggagaagcccaacagggccctggggtgtccagctctggttacgagcctctgttagtcctacagggtgcccgttccccccagcaagggatcgcgcccgcaagacacccagtggacccggagaagtccaacagggtcctggggtttccagctctgattacgagcctctggcgagacaccacagtagcattgcgatggccggtagcggccaatag

SEQ ID NO: 77256 - DNA, 174 bp, Glycine max
  Peptide Sequence Number=SeqID_168941
atgatgataacaaaagatgttcaagaagaaatcaagaacaaattcaagactcaagaggaaaagttgaagaacacttcaagattcaagaagaaggatgaattcaagaatcaagattcaaggatcaagcttcaagaatcaagatcaagattcaagattcaagattcaagaatctag

SEQ ID NO: 77257 - DNA, 411 bp, Glycine max
  misc_feature (363)..(363): n is a, c, g, or t
  Peptide Sequence Number=SeqID_168942
atgttaagaaggaatagagccgagaggagaagaaaattactgcaagacaggacagtagcttccattctagaggaagaagctcatttttctgattctacatcatctgactcaccatcatcaaggaaatccgtgacatatttactagaagctgttatcatggctgatgaacaccagcaaagggttacccttgaggactactcaaacagttcagtaccgcaattctttaccagcatcgcacgtccggaagggaacttattccaaggattactaaatgagggcccctatgcacatttggcaacattcattgaaatttgtaatactgtaaagattgcaggcatgccagatgaagccatcagactcaanctattttcattttccttggcaggagaagaaaagaggtggctccattaa

SEQ ID NO: 77258 - DNA, 900 bp, Glycine max
  Peptide Sequence Number=SeqID_168943
atggttatcacaaccttcaacggaaccggcgttggatttggtttcggcataggttgcggtttcggtataggatggggtttcggaggtggaggctgtggcgttggagtaggacttggttgggggtttggtgctgcctttggtagcaagtatcggtcctcacgggtcacatttcaaggagtggattttgataggaaggagaaagttaacagcacggagttgtcaaaacccagcaccgaagttagagaagcctgtggagatagcaattgtgacttccgagtttcgattattgtcctttcaaatcgtagcactacagttctggttgcagctctcatttcttggataatggttgcacttggtaaacagtttgatatgcacgcttcgtttggtgcaagagaaataagcggaaatagagatgagataggaaatggtgtatttgatgttatatttagatcatgttttagggtctcgtctcatgttgagtcgaagatggttagcaaacttttaatggtcggtcggttatcgagtgatagcatcaaaaaatccgaccgacaggcaatggaaggggtgttggacgtgacaaagttcttggaggaacacccgggaggagaagaggtgattctagaggtagctgggaaggatgcgaccaaagagtttgacgttattggacacagcaaagcagcacaaaatatggtcctaaagtaccaagtgggtgtcctccaaggtgccacagttcaagaggtagacttgaaggatgttgtggacaaggaatccaacaccaaagagatgagtgccttcgtgatcaaagagggtgcaaggtctaagtcccttgctttttacgagttctttgttccacttcttgtagctggtctatattttggttaccgatgcctcacttattag

SEQ ID NO: 77259 - DNA, 654 bp, Glycine max
  Peptide Sequence Number=SeqID_168944
atggctggtccaaggaaggaagggaaattttattgcaaacttacatgggctgaaaaagttggtagcattgatgatgacttatttattgatgtggtgatggtcttcctctatgataaagattccccgaggcagcaaaaaagaaaaagcatgagctgcaatggttgccgagtcctccgcaaaagatgcagcgagaggtgcagcctgagatcctccctgaactggatcgattgtccgcatgcacaggcccatgcaactctcttcctggctaagttcttcggccgtagcgacctcatgtttttcatctcctccgtcccactaaacaacagacccgcgctctttcagtctcttctgtttgaagcgtgcggacggaccgttaatcccgttaacggtgccgtcggactcctgctgagcggtaactggcacgtgtgccaggccgccgtccacacggtgctcgccggaggcgttctccggccgctgtcggaggttgtggcgccatcagaaagcatgttctctcatcagttccagtctctggcgtcagattctttgaagagaagcagcgatgcaacagcaccggttatgtcgaccatggtttctggagaatcagagatttgcagcagcgacgatgggaaaaagcttttgaatctgttcgtctag

SEQ ID NO: 77260 - DNA, 1050 bp, Glycine max
  Peptide Sequence Number=SeqID_168945
atggcgtcgagttttgatcgatgggaaaaagatcctttctttaacgccgcggaagaagttcaggaatctgcagacaggatggaatctacgtatagaacatggattcatgcaatgagagatgcgtccagcccatggaactgtgatgaactccgccgagatctacaaactacccttggcactgctaaatggcagttagaggaatttgaacgggcagctaggtcaagttatagcaaagtttcaagtgaggatgcgagaaataggcaccgggattttattcatgccatcggtggcaagattaagaaagttgaacattcgttacaagaatctgttcattcaggcagcaaggcgtctctgccttggatgcgtctagatgaaggagaacgagatgagcttgcgtcgtttctttctggaataccggctgctgggggcaaaggtctcattgaatgtgttggcagagactgtgaaagtctgcaaactaattattcaagcaatttacttgtttcatctgggtggggttcatccgaagcagcaccggagaagtcacatgggcatcgcagggcagctagtgctgatgctgacattggtaattggaaaatcactgtttctgacgatgtgcaacaatcgagttcctccaatggttcttctggtcctactcctatgcataaggtagccagtctctctggattttttggttccatggaaaccatctctaagttgaagtggcctaagaatggctatagaaagctgaaagctgttaatccttgtgaagaagtggataaggcactgctagcaccagctggattgaatgggggcatcaaagcatactatgaaagaagtaagagttgccttgacaatggtgatgaatgttatgataagcaactccaggggtggtatggggctctccataggcagcttcaaagatctcaataccaaatgcaatacaatcggccagttcaaatggctgtatgggctgttattctcctttgctttattggtaggctcctgatcttagtttgtgtcagtgtgtctgctgaaatgcgtgcactttga

SEQ ID NO: 77261 - DNA, 1106 bp, Glycine max
  Peptide Sequence Number=SeqID_168946
tttcaatcacacttcgttatggttattacggcgattcatgcatcctgcttggccctgcctcgtcccgtttgatgaagaccagttctgtttttgtgaagcagcttcaagtgtcaaacgaggacaataatcaagttattctccatgccttcaacgaggagcccgagttaagctcccaaactaattggacagtgtcaaatttcttccttgttgaagcgtataaaagcaagggctccaccatccgtatgaggtgggaagcacacactactagtagtttggatcagctacatgggatggtgatcaaaggagaaaagaagtttgaactactacagcctaaacaaacgagcttcctcaatgcaattgctcttcgcaagactgttaatggtaaagaagctgaatacaatgttgaggaagataatatataccacattggggttctaaacatgaattccaggaacataatattgactatgaaagttaatgttttggcaaaggtatatgataccaccaaaggcaagaagatgtgctctactgcaaatggattctgtagactcagttttgtcttccctaatactcagtatgttattcttacggcaactggcaaagttgatgggggatcgtatgttgaaatttcttttctggctcgtgtgttgacctacatattacttttaggagctcttatgattgttatttatctggttctgaagttccttgaagtccatgaaggtggtgatcagaatagtcatgcggcagtcgacgtcacatacagaacaagtaatgtagttgcaaggcaaaccgaaactcagcccttgatgcaagtggagacaaatcgattgacatatggaacaaatgcaaaagatgatgaagaagaagattcaggagcatccagtagctcttcagaggagttatatgatgaaaaattgtgttgcatttgttatgatgaacaacgcagtagcttctttgttccttgtggacattgtgccacttgctatgactgtgcacagaggattttagatgaggagagcatagtgtgtcctatatgccgaaggcttattcacaaagggaatgagttactaatactatggcttgggcagagttcatctaattaa

SEQ ID NO: 77262 - DNA, 150 bp, Glycine max
  Peptide Sequence Number=SeqID_168947
atgggagggttagtgggaaagcaaggatggatgatgggtaatggggcagacgacaaagagagaaatgaatgcgtttcgattctttggccttctcttcatgttcctattcgccttctcttcattcttactaccggggaatcaatcaattga

SEQ ID NO: 77263 - DNA, 549 bp, Glycine max
  Peptide Sequence Number=SeqID_168948
atgtcatgctctcataaaaaaaatggcatgttctctgctggcttctatgccgttggccaaaacgcatattcctttgccgtttggttctccgaaccctacggccaaactcgaaacgcaaccgttgtatggatggcgaaccgtgaccagcccgtgaacggcaaggactcaaagatttcgctacttcgcaacggcaatctcgccttaaacgacgttgacgagtccctcgtttggtacacaaacaccgcttcactgtcctcctctgtgcgtctatttttcgacaacaccggcaacctccttttgcatgaaacgcaggctactggtgtcgttttgtggcaaagctttgatttccctacagatacccttttacctcaacaagtgttcacgagacactcgaaacttgtctcttctagaagtgagaccaacatgtcctctggtttctacgccttgttcttcgacaacgacaacatttttcgtcttctttacgatggccctgaagtttctggcctttactggccagatccttggttggcatcttggaatgctggatga

SEQ ID NO: 77264 - DNA, 907 bp, Glycine max
  Peptide Sequence Number=SeqID_168949
atgccttgcttgttattgttggtatttctgattcaatcatgggcagtgaaggcacaacaagtctacgataggaacatattcatattagcggggcagagcaacatggctggtcggggcggcgtgctgaacaacaccggcacggggatcgccacgtgggacggcgtggttccaccccagtcccgtcccaacccctcagtcttgaagctggacgcgcacttaacgtgggtggaggcccgtgagccactggacgcggacatcgattctaggaagacaaatggtgttgggccaggaatggcatttgcgaactcggtgttggagaagcacccagattttggtctgattggtttggtcccttgcgcgattggaggcagcaacataagcgagtgggaacgcggaaaagagctttactttcagatgataaagagggccaaggcatcgttgcgtgacggtggcaccattcgtgcattgctatggtaccaaggagaaaccgatacagtgaatttacacgatgctcaatcgtatcaaagaagagttcacaagttcttcttggacgttcgtgatgatctacagtctccgttgcttccaataatccaggtagctttggcatctggatcaggccctcacatagagatagtaagacaagctcagctgggcattgaccttctaaacctgagaactgtggacgctcatggtttgccccttcagcccgatgggctgcatctttcaaccccggcccaggctcatcttgggcagatgatggctaatgcattccttcagttcgtaccctcttcaaatgaggaggatgctactagaacgaagaaggacatgggagacgcagtaacagaagcagtggaggagaatgttttcactgtgcggaggtggtttggggtgggtgatggtcgtagag

SEQ ID NO: 77265 - DNA, 2121 bp, Glycine max
  Peptide Sequence Number=SeqID_168950
atggggaaagcagtaagcattgatgagattcccgatgagtgtttgggttgtattttccagttattttcccccggcgagcgcaagatgttctccctcgtatgtagccgctggctgaagatcgaaggacagacctatcagcgtctgtccctgaccgcggatggtctactgtcaatcccatgtactttctctcgcttttcttccctcaccgaactcactctaataaattcccttagtaagagcattggggacgaagctctcaccctccttactcaccgctgctgccctaatctcaccttcttcactctccactcttctattcactcagacgcttgcttggagaatttcgccatgaaccacaagggtttgaagaagttttcggccgtgtcttgcattttcacatacaaaggcttgaaagcattcatggatcattgcgtctctctggaagaactccgcctcaagtatcttaactcaaaccccaatattgccaacgccgacgaggatgggtttgtaacgtcgtcatcgctcaaagccctttatttggagggcgttgatttttctatcttaaaagcgatttcaaaacgttccagcttagaagttttgcatcttgagatgattggcatgtgcagtgacgaaggacttgttgcagttttggagggttgcaaccttttaagagaacttcgtatccgtagaagctattgttgggaggccaaccttatgggtgataaagttttgatagccattgttgaatgttgtcctaaccttcaggagttggttctcgatgggttgaatcccagcaccaaagcgagtttggaaatgttggcattcaaatgccggagtataggccgattggcgttgcgcggaaaaagctcgattagctatagcgacttagcttccatattggccaaactgtttcagtccgatggatacatgcaatctgcagacgctatgggttttttcggtgtgaggaagggaacagaagacaatactgagagagtatcgcgtttcttatttgtcccatcccctagggttcatatatctaacccagaattgcaatattccaacataatcaccagaattgacgacatccccgacaactgcttggcttctattttccagttatttccccctgtcgaccacaagaacttctccctcgtttgtcgccgctgcctcaaggttcaaggacagacccatcaccgtctctgcctcacccttccctactcaaaattcctcgcatctatttttactcgtttcgattccgttaccgaactcactctccaatgtcttaatctcatgagcatgtgcgatggaaatctagtcgtcatttcagacctctgccctaatctctcgtacgttggcttggaggtcttagccaggagttgcgagcgtttaaagaagttctcttgtacatcttgcacttttggactcaacgccattgacgcactcatacatcattgcagttctctggaagaactctccatggagcattcaagtgtcaaaaccgacggagctgaatttgtaaatttctatcctttaattcgcgccaagaatttgactactgtgaagattgttcagtcctctgttgaggagtactgggataggttttttcattcgttggcaagccaggtcacgagcttgctggaagttcgcctcgatgggttcggagttagcgataatggtttgaaagcaatttcaaaatttcctaatttagaaactcttcatctcgtgaagacccctaagtgcaccgacgcagggctcgttgaagttgcggagggatgcaacaagagtttaagaaaacttggtattgaagagtcccttcaaaagggccccaacaaaataggtaacaatggtttgagagcagttgctaagtgttgtgctaatcttcaagaattggttctcattggtatgaatccaagcaaagcgaatttggaaattttggtatccaattgccagagtctaaagcatttggggttgtggggaagcaataagtttggcgacactgagatacgctgcattgcgggaaaatgtgtggcgttgaaggaactccacgtcgagggttgcccccgtgtttctgatcgtgacatggagacgttggctgctaagagtgaaggttttcaagtgtaa

SEQ ID NO: 77266 - DNA, 198 bp, Glycine max
  Peptide Sequence Number=SeqID_168951
atgtcggcgtggaaggtgagcaaatatatggattgtgatggtggtgatataggaaggaggaagagagaagtgaaaaaggaggaatggaagatgggtgatgaaataacccaatttccaacggtaatgggattgagcctacgctggtatagccccacactgccagttgtagctagatatccatttatatcgattgattga

SEQ ID NO: 77267 - DNA, 198 bp, Glycine max
  Peptide Sequence Number=SeqID_168952
ttcagacatgatatcgaaattcccaacggtgagaatgctcggaattctgttgcgaacatgatactcaaatttcacgacgatccaacggtgaacgggttcgagatcgtcatttttctgagactggatgaccgaacatggggcttagattttatgatatcggagactttcaacgaaggtgccatggatagcaaaacgtga

SEQ ID NO: 77268 - DNA, 1386 bp, Glycine max
  Peptide Sequence Number=SeqID_168953
atgggtgagaaaaatgttatctcttggaataccatgattggtgcctatggccaaaatggttttgaggacaaggcagtgttgtgctttaaagagatgctgaaggaaggtttgctacccagtccagtgacaatgatgaaacttatgtcagctgatgcagttgcagaaactgtccattgctatattatcaaatgtggcttcaccagtgatgcttctgttcaagggttcactgatatggcgaaattgatttacgaatattatcccacaaaagacctgatttcattaactgggataatctctagctattctgaaaaaggcgaggtagaatctgtggttcagggttttatccaaactgtgcagttagacataaaaccagatgcagttgccttgattagagtccttcatggaattagtgatccttctcattttgctattggatgtgctttccatggttatggattgaagagtgggctgaataatgattgcttagttgcaaatgggttaataagcacgtattcaagatttgatgagatacaagctgctttgtctttgttttttgacaggagagaaaaaccattgatcacttggaattctgtgatatctggctgtgttcaggctggaaattcaagtgatgccatggagttgttcttccaaatgaacatgtgtggacaaaaaccagatgcaattactatcactagtctactatcggggtgttgccagcttgggtacttgcagattggagagacacttcatggttatatccttagaaacaatttgaaagtggaagattttacagtaactgctctaatagatatgtatactaagtgtggaagattagattatgctgaaaaggtattttatagcatcaatgatccgagggcgagccctggtgcagcagtaaagttgtgccttggtgacttgttggtcatgggttcgaatccggaaacagcctctttgcatatgcaaggtttatatggacttgaacacaaagctttcagttgtttttctaaactacaagaacaaggactagaacctgataaaatcactttcttgggagttttagcagcttgcacccatggaggacttgtctatgcaggaatggaatactttcgtatcatgagagaagagtatggtttgatgccaactttgcagcattatgcttgcctagttggcctcttgggtcgggcagggttgttcaaggaagcaattgatattattaacaacatggaaattcggcctgattctgctgtctgggtagcattgctaagtgcttgttggattcaacaggaagtaaagcttggccaaaaatttgtttttattgaattacaaaaacggtggattttatgtattaatgtcaaatctttatgcgattgttgggaggtgggatga

SEQ ID NO: 77269 - DNA, 1206 bp, Glycine max
  Peptide Sequence Number=SeqID_168954
atgaatttcaagagctttggaaacgaggccggcggcggcggagggagacaggcggggaacttctcgctgacgcggcagccgtcggtgtactcgctgacgttcgacgagttcatgaacagcatgggaggttcggggaaggactttgggtccatgaacatggacgagttgctgaagaacatctggaccgcggaggaggttcagacaatggcgtcggcgggagtggccgccgatgacggcggcgccggcgtcagccatttgcagcggcaggggtcgctgacgttgccgcggaccctaagccagaagaccgttgatgaggtttggaaggacatttcgaaagaccacggtgggcccaacttggcccagacgcagagggagcccacgctgggagaggtgacgttggaggagtttttggtcagagctggtgttgttagagaagatgccaaaccaaacgaaagcgttttcgtagatctgtctcgcgttgggaataatagtggtttggggttggggtttcagcagaggaacaaggttgctgctgctaccggtttgatgggtaaccggttgaacaatgatccgctggtgggtcttcagccttctgctaacttgcctttgaatgttaatggggtgagaacatccaatcagcagccacagatgcagagtccacagtctcagcatcagcatcagcatcagcatcagcaacaacagcagcagatatttcctaaacagagtgctatgtcttatgcagctgctcagatgcctcagggaatggtgaggggtggggttgtggggcttggtgatcagggtttgagtgtgcaaggtggagggattggtatggttgggttggcacctgggtctgttcatgtagctactggctctcctgctgctaaccagctgtcctctggtgataggattgggaagagcaatggcgattcctcgtctgtgtcgccggttccttatgtctttaatggcagtctgcgaggaaggaagaacgggggagctgtggagaaggtgattgagaggaggcagagaaggatgataaagaatagagagtcagctgccaggtcgcgggctcgcaaacaggcttataccatggaattagaagcagaagttgctaagttaaaagaggagaaccaagaacttcagaaaaaacaggtaactttggctattgccacatgtgacatacagatgcaggcactcacatgtacatga

SEQ ID NO: 77270 - DNA, 891 bp, Glycine max
  Peptide Sequence Number=SeqID_168955
atggccgtagcaataggtagaagcttctccattcagccccgctctttcttcaacagcaagagcttagatagagcttcaccagctggaagattatcgtggcttgggcatgctgctgctgctgccactccatattataggcaaacttgtgtagcggcgcaacattttaatgaagataataactacatgcttttcagtctggctggagattttggatttgacccacttgggcttgcggaggatccggcaagcttaaggtggtatgtgcaggcagagctggttcattgtcgctttgcaatgcttggggtcttcggaattctggtgacagatctacttcgcgtcacaggaattaacaagataccagtttggtttgaagctggtgcagtaaagtacgactttgccaatacaaagacactcttccttgttcaactacttctgatggggtttgtggaaacaaaaaggtacatggattttgttagtcctggatctcaagctaaagaggggtctttctttggattggaagcttcactgaaaggcttagagccaggggtggagtcgaccatgaagatccaccacccacacctgctcgacttcaccgcgccataccaccgcacgaccaaaacccacgcacaaaaccaccgcaccgccgcagatctgcgacctttcccaaatcacaaccaatctgcttcatcacccatacccatctcgcctgcaatcggactaactgccctcactgcgccctcaacatctcacgctccctctgttgccgtcgctcctccggcgcagtctcgcttccgcaacagtcgctcctccgcacagtacatgtcagagagtggcagaggtgccatgggagactccgggagggagagtgcagagaagaagggagggaggtaa

SEQ ID NO: 77271 - DNA, 561 bp, Glycine max
  Peptide Sequence Number=SeqID_168956
atgttcatgactgaagcaataccatcaaggtcaactagcacatcttcagacacaaagcaaaggtgttgctcagatagtacgttttcaggtactaacctggggaggaagttgcgagggaacatgccaagaaaccaaatagggcttcaagtcatgaggctcgcagcagaacacgagggaacaccttcgcaagtgatggcggtgagtcagagtcgtgagggagaggaccgtcgcaagggtgagagtaagagtgaagtgccacagagagagagagaatggatgacatatatccccggcactactacaaaagcaaatttctacgacagctattctaagacgtttcgaaacgaacacgttgcaaagtcaaagcatattttcgacttcagtcgagtcttggcggaatcacttttaggtccgattcctcatcccaaacaatacaataacccaacccaagcgattcgattcaataacacaacacgcacattggattcctcgtcccaaaccctaatccccaatttcgattccaattccaacgagatcccaagtaacacagcagagccctaa

SEQ ID NO: 77272 - DNA, 117 bp, Glycine max
  Peptide Sequence Number=SeqID_168957
atgggaggcaattgggaatgggaaggggttgtggaggatggggaagagaggccgccaatggaggtgggagaaggaaaggggatcggaagaggagacgcaggtaaggtaccagtatag

SEQ ID NO: 77273 - DNA, 1275 bp, Glycine max
  Peptide Sequence Number=SeqID_168958
atggcgagagggaagtgggtttgttcctacaagaaaaccactctcttagtttgcttcttcaacattgccgttgctctctacgctcttcactctctctattcttctctttatatctactccggtaacgtttcccgcaacgttgcgttgtatagcccagatcagattcggaaaatggaactgtcaatccaaatccgcggggaatttaaacctgtggagttaattaagtgggctttagaaggggaattttcgagtgaaactgtggcagttgagttgccccggcatttgaaacagaacataattgatgagatcttgcagagactaaggagcttgaatttcagtagaacagatattgctaaggaacgaggggtttataaggttttgggctctccaactacaacaactaacttttgtggtgtggctctccaagattttgatcaattggaattagagccttttgccatgtctctcagctgcaaactagcagcacgagcatgctgggatgttaggatccaattgcaaggtatgggacttgaattgcacattggaagtatgggaattctggtgaggagtttatataaggctttgggctctccaactacaacaactagcttatgtggtgtggctctcctaagggggcttgaattgtttggttgtttgggatgcaaatcaacagctgaaaatgtcttggttgctttggaagtagttgagagttggcgcaaagaaaaactggaagaggtcaagtcggctcttgtgaaggggacttccaattcaaccattccccatgaagaagctggtatgctagtaagagctttggagtctaattgggctgtgctctgtgaagagattggactctggatacctgctcaagtttcaaatgaagaacatgacgacaaacctgagggtgcagaggagtttgaggacgagatccttcctggcagacctgtttcacccgagtgccatgctgaactgcacacagattatgatggtgctgcagtaagatggggtcttaccttccacaaagatagtgcggctgattgctgtcaggcttgtttggatcatgcgaaacatgccaaagaaggggaaaagaaatgcaatatatgggtttattgcccatctgagtttggagaaatgaactggggagcagagaattttcccaatggtcatttaggacttggttttggtcaaaatgaggtttttgacagactcacctcagacctccgtgccaaggattttccaccaaggtcgggtctaacaccgaggaaatgtgacttttaa

SEQ ID NO: 77274 - DNA, 1086 bp, Glycine max
  Peptide Sequence Number=SeqID_168959
atgcaaccaacatcgaacggctctgactcgaaagcgacggagcagcggacgccgccgcctcagccagtggccgtgccgccgcagtggatgccgatgcaatacccggcggcggcgatggtaatgcagcaccacatgatgccgcctcagcattacgcgccgccgcagccctacatggcctaccaccagtaccagcagcaggtgccgcaagcgcaccacctgggatccagcgccgagaacaagaccgtttgggtcggcgatttgcatcactggatggacgaaaattatctccaccgctgttttgcttccaccggcgagatttcctccattaaggttattcgcaataagcagactggtctatcagagggttatggatttgtggaattctattcacatggcacagctgataaagttttgcagaattatgctgggatattgatgcctaacaccgagcaaccgttccgcctgaactgggcaacatttagcacaggagacaagcgttcagataatgttcctgatctttctatttttgtaggagatttagctgcagatgttacagatagcatgttgcatgaaacttttactaatagatacccatctgttaaagctgcaaaagttgtttttgatgccaatactggccgttcaaagggttatggtttcgtcaggtttggagacgataatgagaggtctcaggctatgactgaaatgaatggtgtttactgttctagcagacctatgcgtattggtgctgcaactcctaggaaaacgtctggctatcaacaaggaagtcagtcaaatggcacatccagccaatctgaagctgattctacaaacacaactatatttgttggaggacttgaccctaatgttacagctgaagatcttaagcaaccattctcccagtatggtgagatagtctctgtcaaaatacctgttggaaaaggatgtggttttgtacaatttgcaaacagaaataatgctgaagaggcattgcagaagctaaatgggacaacgattggcaagcaaatggttcgtctttcatggggccgcagtccagcaaataagcaggtgtactccctccactcttaa

SEQ ID NO: 77275 - DNA, 2076 bp, Glycine max
  Peptide Sequence Number=SeqID_168960
atgaatagtgggaggataagaaagaacttaaatggaaagcgcattatggttcatcatgatgacatgcgcctcagccccctttggttgaagccttccacacaagttactgtgcctgcttccattttaggatgtacttcagaatgctttttagatgagaagaagttgacaattgagtttccactttccagtggccgatatattcatgcagttgcagcagatttagaagaagtgcaaaagatgaacaccagcgtcaggccgaggctgcagcataggaaagctccaactccaacgacagtgtcacatgaaaagcgtgagagttctcaatctcatccaaagctatggcttcagtttttaatgatcaatgatcccagaaattctgaaaatttgattctaacctctaaagccttgaatgaaaaggcagagatgcggggaagctcgcgagggggagcaaataatgctgttaagggtggaaaaacttcaagcaaagacagaaaactggctttgcaacaagatgtggacaggttgaagaagaagcttaagcgagaggagaacatccacagagcattggagagagctttcaacaggcctttgggagctttgcctcgtcttcctccatatctccctccttatacactaggacttctggctgaggtggcagtgctggaagaagaaattgttaggcttgaagagcaggttgtacattttaggcaggacttgtaccaggaagctgtctacatgtcatcctctaagatgaaactcgagcaatcagcaagagtgaacaatgcaagcccaaatagtagtcccaaactgggtaaattgaagtccctatcccagacaatggatgatgctgcaacatctgaaactaggcctacaacaacgcttccaaaggatagacatggaaaagagaaccaatcatgtactaattctttcaagagcaacaagcaatccacatgtaaaggccaaactacaaaatcgccaattaagaaacttcccattgacaataaatcactgcagaaacgtcgcgatcctccaaagaagcagcaagaactaaggctaaaggaccagccaattgcggaagtaagaaatctacgtgaaaatccacaaggggatgaaagtccaaatataatctctgaaaatattcttaagtgcttatcaagcattatcttgagaatgagtgctgcaaagaatttggattctacagctgatgtaccacccttaagaactccaaaatctaaaaattgtgtagaaggaattgagttttgggatccttatagtatctgtttggaatttggaaagagggatattggtccatacaagcaattacgttcaattgaaactaaatcattcgatccaaaacgaactgcgaagtctttgtttttactgcatcggttgaagcttcttctgagaaaactagcctgtgtcaacattgagaacctcaaccaccaggagaagcttgccttctggatcaacatctacaattcatgtatgatgaatgcgtacatagaaaatggtataccagagagtcctgaaatggttgctgcgctgatgcagaaggcaacaataaatgtgggtggacacttgctaagtgcaacaactatagaacattgcattttaagacttccttatcactggaaatttaaaattataagcttcttacagctaaattctaaacagacattatcaaagggagggaaaaatcatgaaacttatggactggaattgtcagaacccctagtgacatttgctctatcctgtggaacttggtcctctcctgctgtgagaatttacacagcatctcaggttgagaacgaacttgaaatggcaaaaagagaatatttacaggctgcagttggaatttcgatatcaaagtttcttatcccgaagttgctggattggtatttactggactttgcaaaagacttggaatcattgctggattggatatgcctccaactaccaagtgatgtggggaaagaagccattaagttccttgagaaaagaaaaaccggccccctctcacaatttgtacatattatgccatatgagttcaattttagatacttgctatgcacatag

SEQ ID NO: 77276 - DNA, 357 bp, Glycine max
  Peptide Sequence Number=SeqID_168961
atgccaatgtaccaacaacaagaacaacctcctccaatgatcagtgtgacacaacaatcatcacatgagtccattggtcccttgattggagttctggtcgttgtaattgttttgggcgtaattgctgttatgattggaaggctttgttcaggaagaagaatcatggggcatggccaatacgatgttgaaagctgggcagagagaaagtgttcatcttgcattgatggcagaattaacctctcacttcccacaagagtcagtgagtcaagcaactcagttcctgcaacacccatccacgcttgtcaagaaaccaagcgaccagaacaatcttctcagacatcgccacctaacctttga

SEQ ID NO: 77277 - DNA, 282 bp, Glycine max
  Peptide Sequence Number=SeqID_168962
atgatgacatgtaaaggagctttccttcaatggcgatgtgcaaaggaaggagatggaaggacgagctcattgtcatcatgggtgaaagaggtgtcattgtggaatgagtatgcttgtgagggaggtgtcatcatgggtgttgtggttgtgattagtctaagagaggtgttaggcactgagggggatgttgctgggattggttacagtcatgtggttatgggcactaggtttcaagggagactgaggactgttcaaggagaatcacgagaagatgtgacatga

SEQ ID NO: 77278 - DNA, 192 bp, Glycine max
  Peptide Sequence Number=SeqID_168963
atgagaaagagtctaacatcgtatgagacagtgattgttgtgacttccgagagtaatacacagtgcaaatggtatgagaatgaagaaaatagttacaagccaacattctaccgcaagaaaacattcttgaaatttaaagaaacagcattgcagcagcaaaaagaaacagatgaccctggatcaaaactctag

SEQ ID NO: 77279 - DNA, 354 bp, Glycine max
  Peptide Sequence Number=SeqID_168964
atggctaacgatggagacaaatctgattccaatagctcttactctcttcaccatttcgatcatcctgaaatggtctcatcagcacatggcaatggagcatctccaccagctgctcccaaggaaaataatgtcaatttttcttcaggattatccgcacccaagttgataattgatagtggtgcaacaaatcacataacttcctctccatctctacttgtcaacagtaaaaaaaaacaattctttaccaccaatttttatgccaaatggagatcaagctccaattatttctactggaaatttacctttgagtcctattatttctttgaagaatgtacttggggtaccatcttgtaa

SEQ ID NO: 77280 - DNA, 576 bp, Glycine max
  Peptide Sequence Number=SeqID_168965
atggaacttcagaccctttgttgcgctcttccctctcaaccacttcactcttccaatcatcgtattctatcatcaccagcgtttggaatccgcgctccattcacaaatcaaagacaaagatttcacttcggaaacgcctcaaaatgtatgggtgctgcattttccggtttaaaatgggtgattaaagagccttcacttttgggattgagcaaattccagaggcttcttgtacattcttctgattccaatttaaacggtggcttggaagttcatccaaaacaaagttctagtgtgcccgttactacatttaacggggcggaaccgtttcatggtaaatcaggttccgtctctttttgtggcctgacacaccaatctgtagaagaagggaaattggaatcttccccctttgaaggaaagggtggctctttcttatgggtcttagctcctgctgcgttcatagcgtctttgattttgccacagttttttgttgacaatgtggttgaagctttccttaataatgtgattttaataggtatggaatggatacaactttgtgctttctcttactgtctttga

SEQ ID NO: 77281 - DNA, 711 bp, Glycine max
  Peptide Sequence Number=SeqID_168966
atgtcaaagaactctgacattttatgtgaaaagaaattcttagacaaaagcacaaaagatgttgaaaaaatgacaatgtctcatgctattgcattccccttgcattttgctgtatttctggaggttattggtggtgtggatgtaggcttaaatattgtgactatattctctcacgaggtcctgttctacattggactagcgacattcttgcatgtgactgattgtgtccagaggccgtatttgcagtacagctcaaaaagatggggtcttattactggcctcagaggatacctattctctgctttcttcaccatgggtttgaagattattgctcctctcattcttttgtttgtgacatggtcagcaattcgcattgcagcatttgttgctataactccatttttagttggctgtgttgcacaaattgcatttgagaaagctttggacaatcgtgggtcatcttgctggcctctagtcccggttatatttgaggtatacagactatatcagcttacaaaagctgctaattttgccgagaagttgttattctctatgaaggggcttcctgcgggccctgaattggtagaacgaagtggagctttgttcgcaatgttaatcaccttccaagtactggggattgtgtgcctttggtcattgatgacatttcttttgaggctattcccttctagacctgtagcagatcattactga

SEQ ID NO: 77282 - DNA, 798 bp, Glycine max
  Peptide Sequence Number=SeqID_168967
atggcaagtgggtttggggaatcaacagggagatcacccccaagcccttcctacttcaacaacaataataacaatgatgctgccaattttgaatgcaacatttgctttgaattagcgcaagacccgataattactttgtgtggtcatcttttctgctggccctgtctttacaaatggcttcactttcactcacaatcacgagaatgcccggtgtgcaaggccctcgtggaggaggagaagctggttcccttgtatgggagaggaaagtcgtcgactgatccaagatcaaaatctattccgggcgataacatcccgcatcgtccggctggtcagaggcctgaaactgctcctccacctgaaacaaatcattttcatcaacatgggtttggatttatgggtggcttggggggatttgcgccaccgccgatggcaacaacaagatttgggaattttgcattgtccgcagcttttggtggttttataccatccttattcaactttcagttgcatgggtttcatgatgctgccatgtatgggggaggggctggttttcctcatggatttgccaatacatttcatggtgtccatgctcatggattccctctgcgcacccatcaagggcaacaagattattatttgaagaagcttcttctatttgttgttttgttggatacaatctctagcattcttttctttgtgatagctttgtggttcccatggtatccatgtgcaaaagatataaagcatgaaagcaatgcacccattgttaggaataaggatctgggtaccggtccgtag

SEQ ID NO: 77283 - DNA, 1596 bp, Glycine max
  Peptide Sequence Number=SeqID_168968
atggagctaaccgttcggtgcacctcatgcgcgctgtccagatttcattgcaaacttcgattcgccgtggttgttttcgagattatattgatattggcatgggtggaggcccacaatgcaaagccccaggaacaccaacttcaatggggaggcttggagaggaatactgagaatattgcctctcactcttgcatacacgaccagattcttgatcagaggaagcgacctggtcgcaaggtgtattcaattaccccacaggtttatgagcctgttcgcttgaaacaccttcagcataaaggtaggacattacttgatgtgccaacatcatcaaggcctcaagaggatgcaaagaagcctattaggatatatctaaattatgatgctgttggtcactcccctgacagggattgtcgagcaattggcaatattgtcaaacttggggagcctccaatgacttctcctggttttccttcttgcgacccccatggtaatcctccaatcttaggtgattgttggtataactgcacttctgaagatatctccggagatgacaaaaaacgtcgccttcgtaaggcattaggtcagacagctgactggtttaggagagcattggctgttgagcctgtcaaggggaacctgcggttaagtggatattctgcttgtggacaagatggaggtgtgcaacttcctcgtggatatattgaggagggtgtctctgatgccgacttggttcttttggtgactacaagacctacaactggaagtacacttgcctgggcggtggcatgtgaacgagatcaatggggtcgtgctatagctggacatgttaatgttgcgcctcgccatttgactgctgaggcagagactttgctttcagccactctgatacatgaggttatgcatgttcttggttttgatccacatgcctttgctcattttagagatgaaaggaaaagacggcgtaatcaggttactgaacaagttatggatgaaaagcttggacgaatggtaacacgtgtggtgcttcctcgtgttgtcatgcattctcgatatcattatgcggctttctcaggaaatttttctggtttagagctggaagatggtggaggacgtggcacatcagggtctcactgggaaaaaaggcttcttatgaatgagattatgactggttctgtggatacaaaatctgttgtttcaaaaatgacattagctctattagaagatagtggatggtacaaggccaattatagtatggcagaccatcttgattggggtcgcaaccaaggtactgagtttgttacctccccttgcaatctatggaagggagcctatcgttgcaacacaacactgttttctggttgtacatataacagggaggcagagggatactgccccatcctaacttatagtggagatctccctcagtgggctcggtattttccacaagctaataagggtggacaatcctcattggctgattattgcacttactttgttgcttactctgatggttcgtgtacagacactaacagtgcacgagcacctgacagaatgctaggtgaagtcagaggaagtaactctaggtcagatttgtga

SEQ ID NO: 77284 - DNA, 501 bp, Glycine max
  Peptide Sequence Number=SeqID_168969
atggcatgcgcatctactacgagctcaaagtgtgacagaaactatgactggttcttcgccctcctgaaagactggaatggtggtgacatcgacagtgctggtggtgataatggcgataacaatggtgaaatggtggtgatgcacaacgacaaccatgataacaacaatggagacgaaagaatggtggcaaaggcaaaatataatgacaatggtgatggtggtggaatgatagagacaatagtggtggtggtagtggaatgggctgaggaggaagaaatgttgatgtttcttcaatctcaccaggataccaaaccttggagaaataagaggattgaagagtttgagagggacaatatgggcaaaagtgaggatgaattggtgcctttatcaaaggaacaggagcctgagctggagaatgatggtggttgtggtggtgatatcctaattgaccacatttgtaatatcttacgacaggcctccaacattatctcttgtcaatga

SEQ ID NO: 77285 - DNA, 474 bp, Glycine max
  Peptide Sequence Number=SeqID_168970
atggcgagaaagaaatactttcacgatgagacctgctttgataaattgctcatgccgttaagaaggctgccaccattgacaacgatgggaaacaacgtcgaggaagatgaagcagaaccaaacgaaaggagaaagcgaatttgggaccctctcctgctttggctaaccgggggtcctggttgctctgctttctctggccttgtctttgaaataggtaatgaatgccaaactagaatttctactgataatcatcacgtggaccagaaattttatgctaacttactcggacatactttgatttattttggaggagttgcatgtccactgacatttaaaaatgaggaatacaacgggagcttacctaatttgaccttgaagccacaatcatggacaaaggttgagcttgcctggaaatttttggatgaattagatcatatattaatcgatgacattgatttcatttgttgcagctaa

SEQ ID NO: 77286 - DNA, 642 bp, Glycine max
  Peptide Sequence Number=SeqID_168971
atggatatatcaagttcacaatacaatagtgctggtgaatctggctggacacattacttggatcattcctctctttctgaaagttatttccagatgagaggtgggatagaagaccatggaggaaagggagcaagagtggaggaagaggaagaagatttgtctatgatctctgatgcttcatctggtcctcaacattaccatgaagatgatggtcaacactactgtgtaaattggtatccttctacttctcactacaccaaagaatcagaaaagaagaagaacaacaacaagaaggccaaagaatatggtaacaatcaacatccttcacctcttgatgacactgccagttcccctgttcttaactgtcccaaggcaagtcaaaaagctattaagaaagccagtttctcagggaatggagcagtggaaaatgcactagattttcccccatgtttctcgggaacaaaaataaagaaaaagtctaaattccagaagcacttcagtttctttgagcgttctcttggtggaaaacaagcttcagaggaaccagcttttgcttctgctgtggaaagaaagactaggtctaggggatgtcagagtagatgctgttcaatgacaaagagaactcctttgattcttttctag

SEQ ID NO: 77287 - DNA, 600 bp, Glycine max
  Peptide Sequence Number=SeqID_168972
atggcatcacaattaacgttgcagttgcagttgcagagcagagggttggtgcctgatctggtacgatttggcgcttttctaaaacatgttttcgcattgcctagtctcgcctttaagaaacaaatttcatgtataagaaaaaagaaaaaaagaaacaaatttcaaaacacgggaaattttaagaattcggaacagctatctgaagttctgaacagaaggaggacaaaagggtacatagagagagacacggaagacatgttaggcatcctcagacctgggtatcaaactacaatcgaagtatcatcaagcttgtcccgcttcatgaatcatgagcagcagtggaaaggttgtcaaacaatgcatcaatccgtcccaattttaacattggaaggcaatttgaaccctgcacctccccttttgaatctttcacctcctgattttttaatatccccaaattacacttttcatattataccttttctgatttttgtgttgactcccccattgatttctttcaacttcacaactccagagaggttggctcgacatgcaggggtgtttcataatagtaaaacaaagcttctgaaatacttattctga

SEQ ID NO: 77288 - DNA, 381 bp, Glycine max
  Peptide Sequence Number=SeqID_168973
atggggaacgtaaacggacacccgaaattcatcgagtgggacccagttgcacagaagtctgtacctgctgccgtcggtgttggccagccgttggatttcgcaagagatgataaaattggaatctcagcggcaagagaagaagaagaagaaaagcagacatgccctcacaacgtgtgtcctgttacctgggaacaaaagctttccaaccaatataccacgttgccatcaggacttgaaaggcttatgcagcctgagacgcttgtttcaactttcaaggagataatttgtaatcagattctagggaggtgttgcaaagagacacgtaatgagtatgatgaaggtgacatcggggaacataagaggaagatggttgtgcagtag

SEQ ID NO: 77289 - DNA, 1503 bp, Glycine max
  Peptide Sequence Number=SeqID_168974
atggagcggttttattcttctcaacgagagagcattcttttagggtatagtaatgacaataataattctctaattcaagggtcgaacttggaggttgatttcaccgacgtgtttggggggccgccgcggcggtcgtcggtgaatgaagtgcggcagagtgtgggtgagtttagtgaagaggaaagaggttggtgtaggtggccgccggagcgtgagaaaccggtgtttggggaggatagtggaaaccggagacgtaatcacagcgacttcttcgatgacatattcggaggggaggaatcagcgagcgtgtgttccacgccaaagaagcgcgttggggacgctttcgcgttgtcccgagtatccagccctctgcctcctgcggctgatcccgtttttggctctctccctgcaaccttcaggagtaggaacctcctcaacaacatcaacgatggcattgttgcttcaaatggattaaaaccttaccgacaaagtcttttatcacaggagttttcaaactcgagcacatttgataaaacagacaaaggaagcattatgaaacaagacatatctattagtgaagttttgcctagtgctagtaatggccagttccatttctcaatatacaaatgggcaagtaaaggggtgccaatggtgatgcctcttaggacagagagaaactcaaggaataaagataaggctaaacttgagagatgctcaggtgctaaggaatggatagtcagtgaaattaccacacagaatcctatagaatacaatagaaaacaagattccaatcagattgtagaacaaatagtttctgccaaaactcaattagatacatcaaccagccctcaaactgttagtaaagatgttcctgctagttctatctcacgtgacactagagaagtagaatcaagtattcgttctacaagtgataagaagcttgagcccaaaccattacagtttctgttcaaagaaagtgataagaaacaagataatgatgagatgattacaagggagagagaagaaaacaggatgatgaaaagcacaaaaaagtcgtctgctgtttttgatgttaccgtgaatccaatgaaacaagaagaaaaggcagttcccttgagagatgtaggacgtagcaaagccacttcccagggttcggtaagcttaggcgaaaatttggggaaaggcctagtgaaaggaaaggtcaaagaatttgctcgaattttcaaccaagaagctgtaaataaacccaaagttgactccaaatctcaacctcagggttctacatacaagaagagagatgctttaaggacaaagaatgaagtggaagctggtccagaacaacccaagaaggataactccgtcacagagaccaccaacatctctgctaataatttgtttcatcaagatgatatatcagaaccagaaattcctgatatatcatttaccgttattggagataaagacgagtccttccctgggagtttcatggtattccattactaa

SEQ ID NO: 77290 - DNA, 498 bp, Glycine max
  Peptide Sequence Number=SeqID_168975
atgagaaagagagggagccatgaatatgatggtgattctggaaacaccaacagcaagaggcacttgttgttatggatcttagctgcggttatcctcattgctctttggtccatgtttgctggctccgtcaccctcaaatggtccttgagcaacaacgatgacttggattctaccattcttgaagacctcgatgtgctggaagtggaagagagagagaaggtggtgaggcacatgtgggatttgtacagtcacacgaacacgaagtccgttggattacccaagttttggtgggaagcttttgaagctgcttaccagcaattggtgagtgatgtccctgccgtccgagacgccgccgtttcagaaattgccaagatgtctctgcgatctcttcctattcaaattcaatcacactcggttttctcttttcatgatgagcatgtgcagagcatcacggcttcaagaaaaataaagcaagcaaagagtaggacaggacagtga

SEQ ID NO: 77291 - DNA, 1422 bp, Glycine max
  Peptide Sequence Number=SeqID_168976
atgacggaacctcagaatccttcaccattgacacattctccagcgttagaaatcacacctcaaccactgctacctcccaaaaggaaacgaagcctccctggaatgccagatccagatgctgaagtgattgctttgtcaccgaagacgctgttggcgacgaaccgtttcgtgtgcgagatctgcaacaaaggcttccagcgcgaccagaacctacagcttcaccggcgtggccacaacttgccgtggaagctgcggcagcgagggagcacagagccgcggaagaaagcttacgtgtgtcccgaaccttcctgcgtccaccacaaccccgcaagggcgctcggcgacctcaccggcatcaagaagcacttctgcagaaaacacggtgagaaaaagtggcaatgcgaacgctgttctaagaaatacgccgtacactccgattggaaggctcatatgaaaacttgcggcagcagagaataccgatgcgactgcggaaccttgttctctaggagggatagtttcatcacgcacagagcattttgcgatgtcttagcgcaagagagcgcgagggcccaggcccaggcccaaggccaaggtggtagcaatagcaaagtggttgaggcttcttcgccgcctacgcctccacttactccctccgcgtctgtggtgcctccaactttgtccattcagagctcagaaattccggaaaacccatcaacgaagctgtcaccgacgtctccaaacgcaacagcgtgtttcgtgacaagcagcagcagcaccccttccaattcgactacttgcaccactgtttttgctagtgtgttggcaccgtccccaacaacaccatcaactccacaatcaccatcaaattcaacttcctctttcaccaacctcatctcaaacttggctcgctcgcagaaccccaataccattatgagagaatccacgtccctctccctctccacaccactctatctctccaacaatgaccctcttcattacactgcatcaccccaacctgcactatctgccactgcactactccagaaggcagcgcaaatgggtgcttcaaatgcatcccttcttcgtggcctaggcttagcaacaacaacatcatcatcatcatccttcggtaaagacgagggttttaacattaatgcaaccacaacactacaatggaacggacaagtgaagcaagagaatcatccagtggtggataaccttgggcttgggcttctctgtgggagtggaagtgtgccagatgtgatgatggccccttctaccccatttgtgggccagcccatgacccgtgatcttcttggtctgagcatcggtggcggaggaagcaggggtggtctctctgctttactcacttcttttggaggaaactttgattcacccggtgaaggaggagttcaccggtag

SEQ ID NO: 77292 - DNA, 1380 bp, Glycine max
  Peptide Sequence Number=SeqID_168977
atggcggcggagataccgtgctgtggaacaaagttttcactgtacgttttggtgatcataggtttggtctgcttcgcgggactaatggctggtctcactctcggactcatgtctttgggactcgtcgacctcgaagttctcatcaaatctggtcgtcctcaggatcgcatccacgcttcgaaaatttatccggttgttaagaaccagcatcttctgctttgcacgcttttaattggaaactccttagccatggaggctcttcccatttttcttgattcactggtgcatcccgctgcggcaatcttgatttcggtcacgctcatcctcatgtttggagagatattgccccaagcaatttgtacaagatatggattgacggttggagccacgctggctccacttgttcgggttcttcttatagttttcttcccgctttcttatcctatcagcaaggttcttgattggatgttgggtaaaggacatgctgcccttttaaagagggcagagctcaagacttttgtgaattttcatggaaatgaggctggtaaaggaggagatttaactcatgacgagacaaccatcataactggtgcacttgacttgacagaaaagactgcaaaagatgccatgactcccatatcaaaggcattttcccttgatctggatgcaactctaaatttgtgggttaaaaatctctttatggttgattcaaaggctgcagttcccctaagaaaaatgctcatcagaaaaattcctcgtgtttcagagaacatgcctctgtacgatatactgaacgaatttcagaagggtcacagtcatattgcagttgtgtatagggacctaaatgataaaaatgaagccccaaaaaaagttaaagatggggaactacttgatcttaaggacaagcgtaagaataaaggagagaagacatccttggataaaggtgagaaattggagtcgcattattctttgactacagatggtgctcagcaagcaaagaaaagtccaccagcaactcctgcttttaaaaagcgacatagaggttgttcatattgcatcctggaccttgataattctcccctgccagtgtttcctcccaatgaagtggttgttggtgttattacaatggaggatgtcattgaagagcttcttcaggaggagatactagatgaaactgatgaatatgtcaatatccataacaagataaaagttaacatgaatgcttctaaggagaaggctcctgatgcaaatatgttgctgccttcacaagcagttcaaggacacacaccaactaattcaatttctacagctacttctgcaacgggctcacctaccacaattgatctaatctcagaaagtgagtcactaaggaatcgataa

SEQ ID NO: 77293 - DNA, 2166 bp, Glycine max
  Peptide Sequence Number=SeqID_168978
atggagagcgacgacgacttcgagcttttgcctccttctcccgtccaagaacgaaagctcaagcgtttgaagaaagcagctagggttcccgaaccttctcaccctcctatctctcctcccaatttttccgtatcgggaaacggcgaagaacacttgacggagccaaacggcgaatctgggcccgaatttgaaactttgaccccaagcccaagcccaagcccgagcccgagcccgaacccgaaccctcaatctgacactccgaaaggtgtaaccgtcgacgacgatggtttgggcgcgaagagggttctggattttgattccttcggtgaggaactagggaaggttgtagaggagactgaagaagttagagatctgaagacctacgaagaaatcagggatttgaatactgatgaagtagagaggaaacgacgaggtttagatgacttgccagagaagaacgagaagaagaagagaatcaatgacgacggtgacagcagcgagaagaagcctaaagtatctgccaccaataagagaaaggccgagaaggaacgacgagatactctgaaacagcttcaagcggagtctcagagacttcttcgagaaactagagatgcggcttttaaacctgctcctctggttcagaagccaatttcttcgatattggagaaaattcggcagcggaaattggagattttaaagaaatctgctgataatgtagaaaaggctgaaccggaagaaacaccagcttcttgccatgcagccactaaatgtaatttgggcacgtcacatattggtgaagaatctaatgatgctgcagctaattctaactctgagagcattccttctcccatggccaaggattcagaatctgagcatgcatttcgagctcctattggtgatactcaggaactctacactgattctgaaagaagcgatactaaagatgaggctgtaaatgacaagtctaacaacccttcagaagaagtgtttgccccgtcaatgcttgcaatgaacttgaaacttgattctgctcctcctgatgatgacgtctcttccaatgaggaggaggaggacaatgacaaggagaacatagagccacacgtacatgtatcagttgacttgactttatcaccagatggtgaccctgttagggcttttgttgatgaagaagctgaagaggaagatgacagtgataatgacctacagcgtttccaagatgatgaaggtgaagatgatgatgatattgaggaagatgacatgattgcaactcaatatgaagaaaagccagatgatagagaaaagcgtgagcaactccaccagcagtggcatgagcaacgggatgcagctggagtggataatctacgtcagaaattctatggtggttcaaaattgaatgaaacaccatcaactgaagaggaagatgaggaaagcagagaaactgaaaatgatgatgaagttgaagaatacgcagcaccatcagaaagtctgaagaccactctgaaaaaggtgaagcagatgatcccacagatgttttcagataaagatgataaatatgtatcatctgatgatgaagaaactgaggacaagctagctagacaatccctctattataaaactgaagagaaagctaaattcttttcaccagctgaggacgaaaatagcagggaagttttcagtctcataaagaaattaaacgtgcctgataccaagagaaaaggaaaaactacttccatctttgctatgccaagcattggacagaacataaatatatcatcaaagtcatcttttgttggaagggcttcagatcgttttatgcctacttctcaaaagcagggatcatgcaaggtccgatcatatatatttgggcgagatgacagcaacagcaggagttcaatattgatctcagaggattctttagatacgattcaaacggagagtcaaccaccaaaagcggcttctgccaagtttcaaagaaatacgcagaacaaaaacaccaccatgaattctgcatctaaggagtcaaatgtgtcgcttttggatatattaaggaagtcttcacatcatgcagatcacagtttccagaatgccaacgttcaaccaaagacatcaatatttgatgcattcaagttaatgaagaagccaaccaaggcggaggcaagagtttga

SEQ ID NO: 77294 - DNA, 327 bp, Glycine max
  Peptide Sequence Number=SeqID_168979
atgggttggacacgggaagagaatagacgttttgaggatgctcttgcggttcatgggcctaatgaccctaatcggtggcaacatgtagccaacgccgtgggtggaaaatccgtacaagaggtgaaaatgcactatgagatcctccaggaagatgtcattcgaatagagcgtgatcaaatcccacttcccagctacagaggtgctgctatcaacatcaacgcaagacagaatattgacaatgagcaaagttttatagctttcacgatgatcacaacgtcatgtcctcggatatacatgctatttctggttagcttacagagtaattaa

SEQ ID NO: 77295 - DNA, 201 bp, Glycine max
  Peptide Sequence Number=SeqID_168980
atggctgagggcagtgagcatgccggtgccggtggccgtggcggcggcaactcacagtctcaagtgattcaagttcctgaacctgaaccacacccagtgatggagcaattacctgatgttcactattgcattaacagtcctcctccttggcgtcagtatcttattgtttttctttttatggcaaaacaaattgaaaactag

SEQ ID NO: 77296 - DNA, 1704 bp, Glycine max
  Peptide Sequence Number=SeqID_168981
atggctgtcaacaacaacaagcttgttctgttaacattcgccatatgccgtttaatagtaactgtgggattaacggtggtcccggagctgctcgatgtgggactccagggtcgtctcagcgtggacacgttggaactggaggcggcttcggtggatttcgggaggctgagtcgaggggagccttcggagctccgttgccatacctctcgtcctgtgcctttgatctcctctgttgtacgtgccaccgtgacctcctctgcagtgccgccacgtcggagtcacctaatccctaaacgagcagcacgtcctgcgcgattcccgccgtgggcttcccctcactttcgaagtgttgtgtctgctattcaggaagccggtgaggcctatctcgttgggctgttcgaggatacccacctcacgaagagagagagcgggataaagaagaataaagcagaattagggttttatatcgcgcatagtgtggtagcagcagctgagcttgtttccgttgccgcttcacccaccgtagcaaccatgatcattcccgagaagaaccgtaaagagatatgcaaatacctcttccaaggtgattcggcagtgaccgtgatggataccgtggtggtccacgcaggcctcatttttcaggatgtggctagggtggtgaaggcggcgttcgagtctccgttcgccgtgtcagcgagggggcacgggcattcgataaacgggcaagccatgataaaagagaagaaaggagtggtgattgaaatgggaaaaagtgatagtggtgaggatggtagtagtattagagtgagtgagaaaggaatgtatgtggacgtgtggggtgggaagttgtggatagatgttttgagtgcaacattggagtatgggctggctcccatgtcttggaccgattacttgtatttgtctgtgggtggaaccctatccaacgctggaattagtggacaaaccttcaatcacggtcctcagatcaccaatgtttatgagctcgatgtcgttacaggaaagggtgagctggtgacatgttcagaagatcgtaactcggagttgttccatgctgttctaggtggtcttggacaatttggaatcatcacaagggctagaattgctctcgaaccagctcctcacagagagtatctgatatctctgcatgggaaagcagcaagggagagattcgactatgtggagggtttcgtgatagttgatgaagggctgatcaataattggaggtcttcgttcttttcagctagtaacccagttaaaatcacttccctcaacgctgacggaggtgttttgtactgcttggagattaccaaaaattacgaccaaggaaacgcagattctgttgatgaggaaatacaagctctattgaaaaagttaaattttataccaacatcggttttcacaacggacttgccttacgtggattttctggatcgtgtacataaggcagagctgaagcttagatccaagggtttatgggatgtacctcatccgtggctcaacctttttgttccaaaatcaaggataggggacttcgacaagggtgtgttcaagggcattcttggaaataagacaagtggacctatcctcatataccctatgaacaaaaacaagcatgcacatatctcctcatatataaaccacatgtctgctgctgatagcctcatatcgactgtcagtgtttag

SEQ ID NO: 77297 - DNA, 576 bp, Glycine max
  Peptide Sequence Number=SeqID_168982
atggaaagtttggatggatatacggtttgcaaagaatattcccttacacagctccttgacgtcaaggagctttttgacaaccccaaagtggcagtatctcgagccacggccgtctgggttcgggacgtcgatgatgtttccgtcgaggtccgtcatctttgtagagtgcttcgagtaattcggcttgccgagctccacgatgtggtgtttccagtgggatttttcattgatgagcttgttgatctcgttgttgagatcgcagaggtggtgctcgctaagaccctcgttctagatctcagtaacttttcggccgatctcctgtatgatctattgtcgccacttgttgcatcgattaggcgttcttgttacgagccatcttccgataaagaaaccctaacaacaaggtgttcggggatagcaccaccttgtgcggctgcaggttgggtggtgggtgtgtgtgttggtatttttttgttggatgtcgtgatcgacggtggcaacactggttggacagcggtggtggtagtttccaatggaggaagggaagaaggagatgatgtagtaataacgtgttag

SEQ ID NO: 77298 - DNA, 1446 bp, Glycine max
  Peptide Sequence Number=SeqID_168983
atggcacgtaggctacggttgtttaaggaacaaatgacgaaagcaggtgtatctccctcaatgtggtcaacaagagacgatcattttgatctggaacatttggaggttaaacttgaagaacttgaagctgagctcctcgagattaatgcaaataatgagaagttgcagcacacttacaatgagctattagagtataagcttgttctagagaaggttggtgagcttttctcttcagcaaaaaataaggctgtagctcaccagaaagagcttgaatttcagacaactgttgaagggtctattgacagtccattattattggaacaagaggagacgacaacaaagcaaattaagctggggtttattggtggacttgttcatagggaaaaatcaattcctttcgaaagaattatatttcgtgctgctaggggaaatctgtttctcaaacagggtgtgattgaacatcctgttcttgatcctttgtcaggagagatgaatgagttcttctctgttccatttgaactatttggaccatctgcctatggatgtcgtgatccttcatgtagggatgcttctacaacaggtttcataaaagtgcgtagcacttatccatttggcgtggatcctaaatgccatggtactcggagtgaactgccatttcttaattctttgaagatgaagatgtcaattctgctgggggctgacctgtatcatctgatgatatacacgttcctaagcccaactgatgatttgggtgaaaaccagcttttcgttggtcaaaagctccttcaactcgtgttactactgttggcagttgttgctgtgccatggatgctactaccaaagccctttctcctgaagaagcaacatcaagaaaggcatcaaggccaatcttacgatttgctctgcggcaccgatgacactcttgaatcagaatcacaaagtattgcccatgaccatgacgagtttgacttcagcgaggaatacaatttaggctttttgataaacttgcaattggtggatggcaagaacttgggacatgctaggtgcacccagcaacattgttggtgcacccagcaattagaaaaaccttcttctggagaagttaccggaagaagttcttccgaaccttcttctggaaacttttcggaagaaggttcttctggaaaaaggttcttccgcctagctcattcggagttgtccagtgttttctatgacaaagttctgcttctggcctgggggtataataacactattgttcttattattggcatttttgtttttatctgtgcaactgttggtgtgttactgttaatggaaagtccaagtgctttcttacatgctttgagacttcactgggtagagtaccagaacaaattttatgagggagatggttacaagttcttcccgttttcatttacattactcacggatgaggatgaactgtaa

SEQ ID NO: 77299 - DNA, 1137 bp, Glycine max
  Peptide Sequence Number=SeqID_168984
atggcaacccaagcttcacgatccgagattgaggttgtggtagacacgaccacctccaacgataacaacaatgaggaaccaacctcgttgtccttaacgtcgtccctgaattctatactaacaaaattccatgcaggttacttcagaataagcctctccctcggtggccaagctttgttgtggaagacactgatcgaatcatcatcatcaccaacacacgacacaagcgccgctctacgacgcgttctttgcacgcttccttccgcagcagctattcttgcactgtggtcgttggctctctttgctctcgtgttgctctctcttctttacctcctacggtgcttgttttactttaagatggtaaaggcggagttcttgcatcccgtaggggttaactacctcttcgctccgtggatttcgtggcttctattgcttcaatcggcgccattcgtggcgccaacaacagcaacctacttggttctgtggtgggtgttcgcggtgccggtggtggtgctggacgtgaagatctacgggcagtggttcacgaaggggaagaggtttttgtcgacggtggcgaatccgaccagccagatgtcggtgatagggaacttggtcggggcacaagctgcggcgaacatgggttggaaagagagtgcagtatgcttgttttcgctggggatggtgcattacttggtgctgtttgttacgctctatcagcgcttgtccggtggagatcgccttccggtgttgttgaggccagttttcttcttgttctttgcagcacctagtgtggcaagcttggcttgggaatccattgttggcacctttgatactgcttccaagatgctcttctttctctccctattcctcttcacgtcactggccaaccctgttcaggagatctatgagaaggttcaatgttgcttggtgggcttattcctttcctattacagcacttgctctggtttcagcggattatgcacaggaagtcaaaggaacattttcgcacatcctaatgctctttctgttagccctttcagttcttgtctcccttgctctaacgttgttctgctgctcaactctaagatgcttctaccagataacgatcctattattgcaagcttgctcattagttaa

SEQ ID NO: 77300 - DNA, 2502 bp, Glycine max
  Peptide Sequence Number=SeqID_168985
atgggagctctcacttcattcgcctcttggattcccgaggacgatcttcttctcaagaacgccgttgaggctggtgcttcattagaatcgcttgcgaaaggtgcagtgcagttttctcgaaaatatagtcttaaagagatacaggatcggtggtattctctcctctatgatcctgtcatttctgctgaagccgcggccggtatgacaaactttgagctttcggcttcgcctctcccatcaaagttctataggtttggacacttgaaagaacggaaagttgtttctgctacaagaaagtccgagagtgttcgcaatttgtattatgccaggtgcaaaagaatccgcaatagcatgttaacttccatggacttaagttttctagttgattcggaaaatggtaactatgcagtgcatgggagtgatcctttatctggaaactgcatgcctgaaggtggaacttctaatcatttttcaagtcttgatcctgctcagtatgcttttcctgaaaatttgatggatgataatgttgcttctgatagagttgctgctggtgtgttttgccatggagttgacaatgcagttgaagagaatttccctgtcgagctaaagagtgtacttaaggaagaacctcagatttttgaagacaatgtgcctttggatggagttgttgaggatttggatgttcctaatgaattggctatagatgggtggattggagacgatggtttagagagaatgcctttgtccacattggatcatatcaacaatgaccctggaaatatgtgtcctgagtttgatgaaaacaatgtatttgattcagagttagagtgtggaacatcatttaacttatcttcacttcatgaaatgccagtctggaggacagatgagagcattcaagaacacaatttgccatgtgatggttttaatgatcctattgcttgtggggatgcttatttggaagaactgtccaattctctcctccacttcagtagcgaggaagaacagattctgatggatgttgatggagatgaagggattgacaagtcttactttgatggtctgacttcactactacaaaattctacaaatgatattaattcagatcagatctctaaaaaggatgaaacagagtcgttaatggcctcacaggcacatgttataaatcagtcagtttcatgtcacaaagaattggatgacaactcggggtcaagctctcgtggtttacaagtagttcacaaattagagttccaaatgtcatcttctgtctcgactacagacccccaatttcctgaactaattaatgaaagtatgccctgttcaataaacaccgagcaccaagaaattccagaaaatgatgacgtttttctaccatttgatgtgcctcctgtcatatttcccccttcatctaaattaattttcaaagtatccaataaaccaatttcttcatctgttattaagcatagagctagtgaaagaggtaaaactttgatgcatgtagaaaagaaaaaccctgcagcaccttatgtatcttttcagatgatggaatctccttgcttcccaggacctgttggtggttctaaggtaaaatgtgagttgcctgctaatcatgcagcacacacagtgtctaggagttctgttattgtttctggtggcttaggtggaaatgatgctgcaaacacaacagatgctcttttgcatgcaaataaaaaggaagaagctaccagcatttgcttggcaaaggatccaagcaatcatgtggcaaattccttcatgaagaaatcagctgctgattctaaagacttcagaaatcatccccaacctaatggttctagcatgaaaaatgaacaagatttacccttgccacttcaagatcaccagttgcaacgtgctgaactgggatcctcagatgttcttgagtcagagctggtggcaaatcctccagcattagatgaggaagagcaatatatagagagtgacgatgagcttccttcttattctgacgtagaggcaatggtacttgatatggacctggatcctcatgatcaccaggattcttattataatgaggaagtatcaagatatcaacatgtggaaagtaagagagctatcatgaggctggaacaaggttcccattcttgtattcaaagagccattgattcacatggagcatttgccattttgtacagtcgccactcaaagcattatattaagaaacccgaggttttacttggacgagcaactgaaagtgttcctgtggacattgacttgggcaaaggagggcatggcaatgcaatatctcgacgtcaggcaattataaagatggctaaagatggcacattctacatcaaaaactttggcaagagttcaatccttgtaaatagcaaagaagtgcacactggtcagtctcaaagactgcattccaattgtctggttgaggaaatgtttgtttctctctctcttcctgataaaaacaaaggttctgctgatgcatgcaacctttag

SEQ ID NO: 77301 - DNA, 930 bp, Glycine max
  Peptide Sequence Number=SeqID_168986
atgaatgacactactcctactgccgattctccaagttgtggccatgggcagaaaactagaagccaagatgatgtctgtgaaattatggagagctcagcaaggtttgaacaaccttttggaggaggcgacccttatcggttacgacaagaaaatgacagttctttatgcacaattcaaggcagggctatgatgctcgccaccatgaagcaatggagtctatggttgcttttttctgtaatgaattcagtgagtaaagaaggtgccaaggaagaagaatctgtaggttctgaaaccagctgggataaatggaagcgtggaggtatcataggagtagctgctgtaactggacgaaccataatggttataactggtggcttgactgccccagctattgcgcatggattgggtgcattggctcctacactaggaggcattgttcctgccattggtggtggatttgctgctgcagcaactgctacaggatctgctggtggatctgtggttgttgctgcatcgtttggagacaactcaaagatcttggtgaaaccgggaaatattgctaggaagggagaacgaatgcccatcaacttaagtaaatccaaaccagcaggtgtagaagccattggagaaaataggggaggcgagatcatagcaggaagcgttgccgaaaaggacgtcgtacgcactggcgaaaggcacgccagaaaaaagggtgttaggccagaaacgtcactgggaagtcgccaaaacactgctggtggctggccaaaaaatgatgtagagttcgttgcaaaatcagtggtgaccgaaaaagtcactggaaaaggagcagcaagtagaagggtccactggaatgcagaaaacaaagggaagaagttcgtcggaaaaggtgcggcgaatatgaatataaagttccatcaggaacaatag

SEQ ID NO: 77302 - DNA, 360 bp, Glycine max
  Peptide Sequence Number=SeqID_168987
atgtttttaaaccttcgggaagccaaaaaagaagagcattccagaaagaaaaaagaagtacgggaagcaacatgtgaggtacagaaaacaatagcctcttttaaaccactccctccttccgtttccgtccgcctcaccgccgtagcagcatctccggcgtcctctccgtcttacccgacagaaaagaaaatcctccactctcaaaaattccgagaccgaccctctccgcaaagagcacgtgacattcccattgttccgctgcttaaatttcatgactttttgagttcaagttcgtgggtctgctgttcgttgatttcgtggcttgttactgcaatttcaagcacgagttgcagcccttaa

SEQ ID NO: 77303 - DNA, 489 bp, Glycine max
  Peptide Sequence Number=SeqID_168988
atggcaataatatcggtacctctttgtcttctgctcagcaactataactcttttgaaggagttctttactgcaggccacactttgaccaactgttcaaaagaactggtagtcttgacaaaagcttcgaagggacaccaaaaattgctaaaccagaaaaaaccggggaagagaaacctgcagcaaccaaagtctcaagtatgtttggtggaactagagataaatgtgcgggttgtcagaaaacagtgtatcccactgaaaaggttaccgtgaatggaactccttatcacaagagttgtttcaaatgcactcatggagggtgtgttattagtccctccaactacattgcacacgaaggcaaactctactgcaagcaccaccacatccaactgatcaaggagaagggcaatttaagccaacttgaaggtgaccatgagaagagtacagaggaagagaaaatcaacggtgaagtggttgcagctgagacatga

SEQ ID NO: 77304 - DNA, 3207 bp, Glycine max
  Peptide Sequence Number=SeqID_168989
ggaaatgaaaatctcatgaccaaatcaaatgtgaattacacttccattgagaagctgcttagcaataataggtttgctagtcagctgttggaatcaacaccaaagaacaaacctatccatttcaagtgtgatccttctaaatccgattctgcttggaaatggttggaaaggtggatgtcagtatcatcaaaagatattgcagagtgcaaagaaattagttctctgatagagcaatcaagggaaagcaaagatagcactcccatgtttcaattcgaaatgggtattccatctgaaccttttccccaagcagttgactcgaagctcactgttgaagattcacttctgccatctgaggatgaagaaaagttgattacttgtgatgctgatgactttgagtttcaagcaagctactccacatcatctattgtaaaagatgacttggtacaggttcctcctgaagaaaaaattgcatatgatgccaaagttgcctcagacgatgctgattccttccaaaacgaaaaatcagcatcagatgcaagtgccccatcagagcttaattctattcataaggggcctgaaattgccccaccatcagagcttaattctgttcataaggggcctgaaattgccccaccatcagagcataattctcttcagaaggggactgacattgccccaccatcagagcataattctcttcagaaggggactgacattgccccaccatcagagcataattctcttcagaaggggactgacattgccccaccatcagagcataattctcttcagaaggggactgacattgccccaccattagagcataactctcttcataagggacctgaaactgccccaccatcagagcttaactcttttaatcagaagcctgaaattgatggtgagcagggcaaacaatccatgaaaagatttgcctcagaccaactagaggctgaaggaaagaaacctgtaaatggttcaagaaaggtcagtaatcctgcatttattgctgcacagtcaaaattcgaagagctgagctcaatagaaaattcaggtaggacaagcagtttgtcctaccaagattcagctgttgaatcacaaggagacacctcttctgttggcaatgatactgcatatagatcaaaagagtttgcatttgaaaatcctgctgcttatctttctaggtttgctggttctgaatgtggcactgaactctctatttcttccactcttgattcacctgacatatcagagcctggcgctatggaaaatgaacgagatgccaaagatttaatggaagggattggtaatcttgagaacactataaaccatgatgatgaggccaatgacaatgtttcacgtgtcatcccagcttctaacctagctacttctgttttggataagtcagagattgttgatgacattagtgccaatttgggtcactcagtggtagctgtggactctgaagagcctgctattaagactgagaaaaatgcacctgacctgcagagagagctgccagagtctgttctgcaagatttaagatcatctccagaagcttcacctagaagccatttaactgtccctgaatcacaaggaacgccttcaagtgaagtgtctgtgaaacctaaagatagcactatcaacaagactagatctggcaataaacgtcggagcctatcattgagtaacaaatcacctacaaatccaaatcatgattcaggctcgaaagacagtagggagcaactgcctaaagatcagcagaatggaaagaggcgcaattcctttggctcagtaaagcctgataacattgatcaagaatctagagataatagtactaacaacaattctctaccccatttcatgcaagctacagaatctgctagggccaaggttaatgcaaataactctccaagatcaagtccagatgtacatgaaggagatatcgaagttaagaagagacattccttacctggtgccactggtaggcaagtttctccacgcatccaacgatcaacatctaaggcacagcagagtgcaaaaggaaacaatgtacatcctcctcaagaggaatctccttcacaggttgggttaaattctcaagataacctccaagcaaaaacatcattgtcgttgcgtccaggtggagcaggttctgatgacattctgcctcctggatttgagggaactcatgcttcaagtcagtttgagattaagccatcccagataccagttattaagtggattactcctcaaaagattgttctaaatgtcacatggcgggtagtgtctggggaagaaagcaaagaagcagaggatcaatgtcagagggagatgagagtactggaagctatttatcctcgcatatcttccattcctctaaacccttctgtttcaatggatgttgaagagttccattgcattgatggtcaaactactttgataccaataacgccagttgaagatgaagatgcagcagcagaaacattatcgtattccttggaaccatttcatgtttcccaatctcttcaattagcttctggtgttctgaaggattcaaactctgctacaagtatgcagttagcttgtggtcttgcatctgatgtagctgttgctgcatctgttgctttaactaaccttgtgaagagcaatgaacatggaaattttgttgaccatgaattacttaataatattctcaacaatccagaagtgattgagaagttggttggagattatggagctattaataattcacaatatgtacataatgcggggtcatccttggcggctttttcaaatcctcctattcctattcaaggacaaaccactacaccttcatcggttgttttttcaactacttcttcctatactccccctattggaggtcaggcggaacctgttactacccaatggcctcctaggcctgcagtgagttcagctattgtttcttctcccattgaggtccctcctgcaagagatgtaaactactataagagcttaattcaacaacatggaggacataaagaaacacttccatactccagtaaacgtcagattcctcaggcagcaacaaactatgagacaacctcctacaatcatagagttctagaggatgtcggaatggagctaactgtgcctaccagcatgatgcatcatttcagccacggggtaatactgtgtcagggatacaaagttcaaagaggatga

SEQ ID NO: 77305 - DNA, 348 bp, Glycine max
  Peptide Sequence Number=SeqID_168990
atgacggtgctgctgttgttaatgaacggttatttggcgaggagagttgttccagagcgcggcaatgatgcatcaatgcattcaagcttaagcctttgtatattggaaggagaacttcttcaaacgagccttgtagttcctggagaatgcctccaatgcagcgtctgtgagatcggactcgagattagggcagcgctgagaaatgtggctaaaagcattttctttggagacttctcagagaatggtctcatgctagaagaaagagcaataacattccctccctccccgctcaacaagttcacggaacatgggagccccctccactgggatatatcacctgcaatgtag

SEQ ID NO: 77306 - DNA, 222 bp, Glycine max
  Peptide Sequence Number=SeqID_168991
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttagctgaaaagcatagagcccatttagtggaagcatacgccatcaacggatga

SEQ ID NO: 77307 - DNA, 1635 bp, Glycine max
  Peptide Sequence Number=SeqID_168992
atgggagaaaaatcgaggtccaaaggagggtgctgcggttggtttatcgcgtttatcattctggctctcgtcgtcggtgccattgtttttaccgttaagaagaaatttagtcactccggttccgataagcctgctccggttcccggtccccctggcgccgttgaccaaaaatattccactgcactcaaaactgcgatgcaattcttcgatattcagaaatctgggaagttagttgacaacaaaatatcttggagagggaattcggctcttaaggatgggagccaagcgaagttggatctaacaaaagggatgtacgatgctggggataacatgaagtttggttttcccatggcttttacggcgacggtgctgtcgtggtccattctggaatatggagatcagatggatcacgttggccagttagacgctgcgcaagattcgctcaagtggatcactgattatctcatcaatgctcacccttctgagaatgttctctatattcaggtgggtgatcctgttgcagatcacaagtgttgggaaaaaccagaagccattactgaggaacgaccactcatacaagtgaatgcatcttgtcctggatcagacgttgcagctgaaactgcagcagccatggcctcagcatctttggtctttaaaaagactgatcctacatattcaagcactctactcaagcatgcaaaacagttgtttacttttgctgacaagaatagaggttcctatagtgagaatatacccgaagtccagacatattataactcaactggatatggtgatgagcttttatgggcagctagttggctctatcatgctacgggtgatgattcttaccttcagtttgtgactggccaagatggagaagactatgctcaatggggaagcccaacctggttcagttgggataacaagcttgctggaactcaggcaaaggacatttcgaattcatatagctctgggctccatagttacaggaaaactgctgaggctgtaatgtgtggtcttcttccggattctccaacagccacaaaaagcagaacagatgcactcatctcctccacatgcttttctgatgcttccactctaaagtccatcctcctcaatgacatccgacaggaagatggtcttatatgggtgagccaatggaactctttgcaacatcctgttgcatccgcattcttagctgctgtttacagtgactatatgctaacatcgcagacaccaaaactaaaatgtggttcagattcctttaccccatcagatcttcgagactttgccaaatctcaggctgattacgtattgggcaagaatcctatgcatatgagttttctggtgggctatggagataaataccctcaatttgtgcatcataggggtgcttcaattcctgctgatgcaaaaactggctgcaaggatggcttccagtggcttgagtcatctgatcctaatcccaatgtagctactggagcacttgttggtggacccttcttaaatgagactttcattgattccaggaacaattccatgcaaacagaaccaagcacgtacaacagtgctgtcatagtcggtctcttatcaagtttagttaccacgtcttctgccgttcaatcctttacctaa

SEQ ID NO: 77308 - DNA, 801 bp, Glycine max
  Peptide Sequence Number=SeqID_168993
atgatgaaacaggggagtgggtcgtgtacgatgagggagaacgaggttgctgaaatcctcgttaacctcccaagtcttatatgggaattcgagtgtggctgtggaatcctacaaccttcgtggggttgcaagagaaagagatctgcgattggcgttgatccaaaagcacggcaagcttcaagtcctgccacccctctctccttctctcccagtgagtccgatgaaaacccctccacactcataagaacaagaacaagaaacgtttctctcaaaaggaagagagaacactatgtcaagattctacaagatttgaccaaacataacgatttgatccgtggggagataaagaatgtgaagcgtcacaatgaaaaactgaaggagtacaatttgaagttgaaagcaagaaaacaagagcgaagtcatggcccaagtcaaggtggtctggtacacaagcaaccacaacagcaattccaattttccggcatggcgcatcatccaccgttgatattgaatcagacggctgggccagcccaaataagaggcggcgagggcgttgttggtcctgctcacgcaacgacgtcgttaggtagtaatgatgtgggcccaattggaattcccgatctgaacctgccacttgatgagtccatgaccatgacaatggagttttgtgatataaatgtgagtttggccaataaggatctgagtaggaccatggcagctcaggcccgccagaatatgcttcaaaaatacaggttcaagaatccaattggaattagtaaaccccgttactcttgtagatga

SEQ ID NO: 77309 - DNA, 462 bp, Glycine max
  Peptide Sequence Number=SeqID_168994
atgactagggacaatccagatgatttacaaccctttgatcctgaaagagatagaacctttcatagattagtttggcatagtgtgcatcctgatcattctgtgcattttaagcattttgagtattctattgctggtgattctgaatattctgattttgaacattcgactactaattttcatactgagaacatggttcaacctccacctcgtgagaggactcttagggagatggctgcacctgatttcacttatgaaagcttgtgcaatcaatatcatcatgagggtgttccatatgttctcaagaatggactaatacatttcctgcccaagtttcatggtcttgcagcccctgatgtccaggaagatcatatctttctaaaaggcttttcctcattctttggagggagtggcaaaagattggcagtattaccttgctcccagatccatctccagttgggatga

SEQ ID NO: 77310 - DNA, 477 bp, Glycine max
  Peptide Sequence Number=SeqID_168995
aagtggttcttccggaaaaattccggaagaaccacttcttccggaaatctcaaaggtcatccggaagaacccttcttccggaagaacacttcttccggaatactttcggaagaactacttcttccggaaagtttccggaagaggtgttccgggagacttccggaagaagtgttcttccggaagacgtttggttgcttccggaagaacacttcttccggaatgtttccggaagtttcggaagaactcctaacgggtcttccgaaagcctccactgtgagccccctttccccatttttttcggcgtcttctactctcgtcttctaccctaagcaatggggagttagggagactaacctcgaaggctcgtttgcggagaagaagaagaagcttggctcgcggtgtcacggaggagtagcaggaattggaagaagaaaagaagcaggaaatggtcttccgggaagaggagcgcgtttttaa

SEQ ID NO: 77311 - DNA, 102 bp, Glycine max
  Peptide Sequence Number=SeqID_168996
atgaagagctctataggcaggagtgtcccagacgcctacctttactgggagatgaagattcagcatgcattctcctacaatgattatcctgaagagcaaaag

SEQ ID NO: 77312 - DNA, 249 bp, Glycine max
  Peptide Sequence Number=SeqID_168997
atgatgataacaaaagatgatgacaaaggtgatgacaaaaagctcaaagaagaaatcaagagcaaattcaagactcaagaggaaaagttgaagaacacttcaagattcaagaagaaggatgaattcaagaatcaagattcaaggatcaagcttcaagaatcaagatcaagattcaagattcaagattcaagattcaagacaagacttaatcaagataagtatgaaaagcatttttcaaaatctgagtag

SEQ ID NO: 77313 - DNA, 429 bp, Glycine max
  Peptide Sequence Number=SeqID_168998
atggcttccatgatggatgccatgctaggaatgagacaactaatggagaataacgcgaccaccgccgccgctgttagttcagctgccgaagcagacccaactctcccagctactgcgcaccaccctatcccaaacgtgtcatacgtgacgacgcgggtcatgtccctccccccatccttgaaggggaaccttctcggcagccggacgaggtccacgaggatcgtcgagaacatgctcagggagacatcgattccaactccccgttccccgccaagggaccagcacccaacgcgctaccgcagaccaacctcacggcagaacctcgaaaccgcccgacacagccaatctttttgtccgcagggggccacccctggcagcagaagaaaaggggaaactcgatctcatcgaagagtgattgagggccattga

SEQ ID NO: 77314 - DNA, 282 bp, Glycine max
  Peptide Sequence Number=SeqID_168999
atggcatcagaaatcagtttgaaccatatgcatacttacctatgtcgggacaacacagaccaactgatacttccacaggaggagatcggcattgcggtcgctgggcagaatgttgctaaggagcaacatcatccatatctattggcacgggtgaaatcttgccccagtatgcatagtagctccacggcagcctcctcgtctggttgtgctcgcacagttggtcaccctccaacatcagggggtggcccaggaactgataaaaggaaactactggccccttaa

SEQ ID NO: 77315 - DNA, 537 bp, Glycine max
  Peptide Sequence Number=SeqID_169000
atgtgggccatcattgaccaatataaggagaagctaagtctagcggcaacctatgaacaaaggctagaggacgagtacacgaaggcagtaaacaccataactaaacacgctttaaggaacccctatcaaacttgttccaaaactagagtcatgggtgacatagaagaggtgcaagaacaaatgaaggccgatatggaggccttgaaggatcaagtggcttccgtgatggaagccatgttaagcatgaagagaatgatggaaagcaacccgaccgcagttgccgtcgccagcaccgccgctgaggcggatccaacccatccctctgccataaaccaagcgaaccaacccatcccggacgtggtgggacaaggaggagaggtgttgggcaatactagtggtccacacatggggtataataggaatgcttacccttatggcttaccccccaattatacgccacccaccatgcacatgcctaatgataatgttaatcatgccatcccgttacctttgagagtcaacaaccccagcttgtag

SEQ ID NO: 77316 - DNA, 828 bp, Glycine max
  Peptide Sequence Number=SeqID_169001
atggagggtagagttaacctagggttaaaaagtgagaatggtagggatatgagtgaaaaacttggagggattgatgggaacccggtgttgagaggaacgaggataaggggctacgtgggatcgacttgcaccatcgtccgatcgccacctagtaccacatatgacagagaggtacctggagatatgtcgcaggggtcaggagaccttggggacgcgagctcctggcagtcaaccgataaaagaacaaagaccacaaagcaaggaggcttgtgtggtggctggccagctatggatcttgagcttaaaaatgaagacaggaagttaagatggtctctggtaatcgattaccaagggcttagaaatggagacagtatgttgaggaggcctctgattgcgatgacagcgcaattaatccatgaccgagtggagatggagtgcctagagggagtttgggagaccctcgaaggcaatgcgaggtgccgatttcgtggcacgattcaactcacggctacttcattggtacatccagaggaacctgcacgcacgcttcagcgcactgtggagtggatattacctacacctactccatatcgactagtggagcctgtccaagtgatagaggtgccgtcatctaaggaagaccttgaggaggacccagaggagttacctcctgagcctgctgtggatgccattgactttccagagggtgatgaggacccacttcctgatgtggattctctagaggacgtcatgtcagcatctgaggcagactctacggaggagagcggccctggagggatagtgactagtggagactctttatcatag

SEQ ID NO: 77317 - DNA, 120 bp, Glycine max
  Peptide Sequence Number=SeqID_169002
atgggacctatgactaggagtaggaccaaacagtcagtggataccctccaacaaatggtagcaggcatacttagcaaggcccaagtggagaaacacgaaggcccaagtggagaaggatga

SEQ ID NO: 77318 - DNA, 570 bp, Glycine max
  Peptide Sequence Number=SeqID_169003
atgcttgtgcaacaaggaatggcaaaaagaggcaaggcaaaacctagatacctcaatgatctaaatccttgtggggagtacgctttgggagtagttgcactagcatatctttataaccaactatcatatgcaaacttttatgacaacaagctgatcggaggctatatgacactactcatggcatgggtgtttgagcatttgcaaaccattccatattgtgagaagccaaagacttctgatcataagaaatcacttgctgctaggtggaagccgcttaggggtagtggcacgactaatttgaccagagccatcagaactctcgaggacaagacatactactttggctacatcaaagttgggatagacatgtgtccatatctccctaagagggttttgagtcaattcgggtactataagggattccttttttgccactctccatcctatatgagaatcataatggcacatgagggtctttgttcgctcttcggcaaacctaataggaatgtgtaccgagtcacgcaatgttcttatgctgaaaaattacccaaaccaagatcccttgagtga

SEQ ID NO: 77319 - DNA, 207 bp, Glycine max
  Peptide Sequence Number=SeqID_169004
atggaagcatcaagaaagctcatccatactcaccctccaccagctatacctaggagtccacaagctcctgcactttggtacacccccaatgatgaggatggtggtcatgatgcttttcgcccaacgtgtcgtggtcatagccctggtctgctttttgtctgtattcgaaagttgcttgcattactattagagtgttttggaccttaa

SEQ ID NO: 77320 - DNA, 990 bp, Glycine max
  Peptide Sequence Number=SeqID_169005
atgaggattgatcctcaagagtttgctgcccgtctctgcatccctggtaggggttttgttctgaatgcagagggtcgtccttggaagcttctaaggaaagatctcaccactctttcacagacatggagtgtcctcacttacagcaacctgactctcacttcctacacctctgatcttaatatggacagagccaggttggtttaccacttagtcataggcatggacatgaacatcgaagccataatctcaggtcaaatttctaacattgcccagagtaactcctctaggcttggatttctagccttgatcagtgctctatgcagagctagaggagttacctctaacagtctgaacccgacaattaacttggcctacattaagaaaaattgttggaatgtggatgatctgatagttaacttcagaggagccaggaagagcctacaggtggtagctcctctagggtccattctgtcagtagaacagttcattgagaaggtatcctggcctggaactgtatcttcttctatgagagagagtgagggccccagcgctcaggctaccatccctagagcttttgatttttcaggtgcaggagtagagatgaggcctgatgaggcagtttttcttgagccaattgtgctagttatacatgagattgttgaagcaggtgagtcacaattgagacaggaggctgctactcttgagaggacaccacagaccccagaagatccacccgcaccagggatggagctatcttttgctcagcaggtagcagatcctcctacaccagtacataagagactagttgacccttctactcccattttagagataccagaggaccctaccgcaccggccctgacactgaacactactcctccagccacacctgagcttcagttttcagatgaggatgggggacggattactactcctccggggacgccagtgttacattttgataacgaggagcaggatcgtgataaatga

SEQ ID NO: 77321 - DNA, 228 bp, Glycine max
  Peptide Sequence Number=SeqID_169006
atggtctttccagctgactttgtggtcatggatgtggatgaagaccatgaggttcgcatcattttgggatgcccctttatgttaaccgcaagctatgtagttgacatgggaagaaagaaactggaaatgggttttgaagatcagaggatcaattttgatctatttgaagaaaacaagtctgtaccagatcagaatgtctgcttgcaagtgatggagggtgataaggag

SEQ ID NO: 77322 - DNA, 282 bp, Glycine max
  Peptide Sequence Number=SeqID_169007
atgaccggccctctcaatgagtcagtctcatgctttctcataagggtggacccttgggtactagaacctattgcctttaaaggagtacacgtcctcgccttcagagggctacacgccctcgcctttagaggactacatgtcctctcctttagaggactacacatcctcgccatcagagggttgcacgccctcaccttcagaggactacacgtcttcaccttcggaggactatacgtcctcgccttgagagggctgcacaccctcaccttcagaggactacac

SEQ ID NO: 77323 - DNA, 177 bp, Glycine max
  Peptide Sequence Number=SeqID_169008
atggatacctcagagccctacactagggcaatgagagacaccgtgcatgagcctcaagcaaacctagaggcaaatcaaaatttctcacccggagtagagcctaacccaaaagatacaagcaacgctctaaaggttcttactcaatgtaaccctcaaacaccctttgagcctttctaa

SEQ ID NO: 77324 - DNA, 273 bp, Glycine max
  Peptide Sequence Number=SeqID_169009
atgacggcacgtggggcagaagcaaaaaccatcacgttaacctttcttgtcctccttattctgcaacacaactttggctcaatggcagcatcaaggaagaacattcacattcacccaccacatgctatacctaggagtccacaacctccttcagttcattggtacacccccaatgatgatgaaaatgatggtggtggtggtgatgctttccgcccaacgagtcctggtcatagcccaggtgtagggcatcaaacaccaccgtctaaagcatag

SEQ ID NO: 77325 - DNA, 303 bp, Glycine max
  Peptide Sequence Number=SeqID_169010
atgaagacattatcaaaaacaaaatacctcgaaggattgaagaagatgaatggggaagaaaggatatcacaagaagccagtacaaaacaaaaaggattcaagagacacgaaatcatagtgacggtgcctcgaaatcaaatgtctcctccttttaaagaggaagcatactctttggcccgagggcttgacaagccacatcgacctgtcgatgtcacttcacctttcgatgttactacacctgacattggacaaacactcgtccatgcttgggggcttaacaaacttgtgacccttactggttaa

SEQ ID NO: 77326 - DNA, 288 bp, Glycine max
  Peptide Sequence Number=SeqID_169011
atgaaaaacaccatcgttgtcaatcgtaaaatcacaacatcatatgcaccaaacaacatcctccgtgttaactcatgcccccaacgtgacagagcaggtgacaaactagatctagttccttttgaaatctatgttttggatcaaaaatcccatctcccctccttggtgaccctttacaattctcacttctcttcatctatgctttctccttcatttgcagctgttggagctccaccatatatcaccatcatcgctatgggttgtcattggagaatgaaaatgaaatga

SEQ ID NO: 77327 - DNA, 144 bp, Glycine max
  Peptide Sequence Number=SeqID_169012
atgcggaaagaaagaaaaaatgcgcagtgcacgactttggtgagggagaggatgcagcgaaccgaagcgctaagcgagctagagagacgtttggtttctcaaagcggttcgcttagcggaacttcgcacttagcccaagtttga

SEQ ID NO: 77328 - DNA, 372 bp, Glycine max
  Peptide Sequence Number=SeqID_169013
atggactggggaaagagcagcgagagaagaaagagtcaagagtggggtcagagagatagagggagagaagatgccgaggatgcaggatttaatgatgccattgctgaggatcgaactgatcagtttgtgaacacgctacagccagagttagaagcccttgagaataagaaggacgattttattggtgactttagcaagatgggtttgttacattctgattatgattttatcttgacatatgtgttaattaggcaagtttctgaagtgctgattttgatctgctcgctaagtcaatctgccgccttagcgagccatccgctgagtgcaccactcttgaggctgagcgccaggaagaatttggaagaaggatga

SEQ ID NO: 77329 - DNA, 462 bp, Glycine max
  Peptide Sequence Number=SeqID_169014
atgactaggggaaatccaagtgatttacaaccctttgatcctgaaatagatagaacctttcatagattagttaggcatagtgtgcatcctggtcattctgtgcattgtgagcatttcgagcattctcttgagggtgattctgaatattttgattttgagcattccactactaatttttatacggaaaacatggctcaacctcctcctcgtgggcggactcttagggagatggctgcacctgatttcacttatgaaagcttgtgcattcaatatcctgataagggtgttccatatgttctcaagactggactaatacatttgctgcccaagtttcatggtcttgcagccgccggatgtccaagaatatcatatctttctaaaggcttttcctcattttctggagggagtggcaaaagattggctatactaccttgcccccaagtctattttcagttgggatga

SEQ ID NO: 77330 - DNA, 498 bp, Glycine max
  Peptide Sequence Number=SeqID_169015
atggattttctgctttggtttcttggagtaaaacttgactgcgtgtttggtgaggacttggatttggatgaaataatatttctattagagtttttcaatggccttgagcaccccattgttttttctctgttgcctggagtcagtgcaacaccactaatggctaactcgattagtagtctagttaacacataccgagtaacaggagatgattgggatgaatggtcagcaatcttagctcactttaatgtagcaagaggaaaaggtttaaagggaaaatcatggcctgatttggacatgctaccatttggatggctaactgatccagctccatgtggagcttgtaggccttggatcttcttcatcaatggagtcctttacttcttgaagatcatggaagcggaatggagaaggaagaaagatgattggagatcctacttcaaggagaagatgagtcaagaagaagctcaccaccataggaagccatggataagagattga

SEQ ID NO: 77331 - DNA, 504 bp, Glycine max
  Peptide Sequence Number=SeqID_169016
atgagttatttactatggaggaaggcgaatgagtatgatgagttgccttcatctcaagaaagattcaaaaggtgtggaagaacaagagtgggtccagatggaagaacttctccaagaagaattagaattagaacaaagaagaggtatgatctttggaacgaatgtgcacaagctcacaaagatcataaggacttaaagataagtaaacatggtctttggataaagtgtgagaatcaaaaaaagtatgcaaaattcttaaatgacaagcttttaaagaataaagatttaaagggtcaacctcaagatgttgaaaatcttaatgaggagattgatactttaaagacaactatagtcaaatttgttagaggaactgaatgtcttgacaaattgttaagatatagcaaatgtcatatggacaaatttggtcataggttcgaagggaagtatatgttcatgatgaggatactattgtttgttatttctatggcaaagtctggcatatga

SEQ ID NO: 77332 - DNA, 144 bp, Glycine max
  Peptide Sequence Number=SeqID_169017
atggataagagcttgaaggtagggaaagatgagtggagggagaaagacaaaaggagtacaaaattttgtgtctcaaaagagggggtaggattgcaccacatcttgaggatgagggcacttggcggtggtggatacctgacgtga

SEQ ID NO: 77333 - DNA, 237 bp, Glycine max
  Peptide Sequence Number=SeqID_169018
atgtcacaaaactttacggattacgcaaccatcccctctttggcttctagaatgttatggaactttacggattgcgcaataatgtttcctttcgactcccgacatgtcgcggaacttcacggattgcttaacgatgggtgtcaagttcctcgaagcggtcaagcgaaggttgcatgccatcaaacaaatggttatcatttactacttgtaattcgcgttgctgtggaagctctttga

SEQ ID NO: 77334 - DNA, 154 bp, Glycine max
  Peptide Sequence Number=SeqID_169019
agattggaacacatcatcgaaagtatcccaaaaggtatgtgttcggttctgtgcaagaaagaaaagaactacctatataagcatgaagtttagccgcttcaagaagctgggacttggctttgatatgcttatgaaggatagggacacaggctag

SEQ ID NO: 77335 - DNA, 210 bp, Glycine max
  Peptide Sequence Number=SeqID_169020
atggcttcctatggtgtggcatctccattcatctttctccttctccattccgctgcaatcagacctcaagaagcaaaggaatccattgatgaagaagatccaaggcctacaagctccacatggagctacattatgtggtatgaagagcctcttcatctaggtgatgttcttttgcttcctctatctttttgttcggtcaattcactttaa

SEQ ID NO: 77336 - DNA, 963 bp, Glycine max
  Peptide Sequence Number=SeqID_169021
atggcgagaatagccaaggtagtcaaaatctcagcggaagaattggaccgagcaaaacaaaatagaaatggggtagttggaataccaaggaagcacttggaggagaaggcgaaggcattggcggatgaaggtgaatgggcttcgttcattgatgtctcggcgttattggtatttggagtcgttctctttccaaatgtggatggactagtggacctagcgacgatcgatgccttccttgcttatcaccatagcaaggaaagtccggtcgttcctgttttggccaatgcctatgacacatttgaccggagatgcgagaagagcggcgcaaggattgtctgttacacacctgctctttatgggttctcaaatgtacccttgatgggaacgaggggtagtatcaattataatcccgtccttgccataagagaacttggctatcccatgagaggagcaccgtcagaagaaattatcacacatttcatcgcacgaggtttcagtgaccccaatgcgaggatacttcaaggagtccacaaagcgtggggcacgatgcaaataaaagataaggagcttaggggaagcaacaacgggatcgtcggtggctatcacaagtggctgaaggcttggacacaagagttagattgggtcccgaagctaaagacctcaaatgaggaagaggctgaaacccctgaggagagtgaggaggttcaagccttaaaggtgaaacttgaaagggcacaagcggtcaaggaaaagttcaagacaatgaccatcaagagagaccagccaagtgtcgaaggcatgatattggaaatcaagttgaaggcttaccaaaggtcaaagaggagtttgtccgaacaattgagcaagacggaagagaacatgtgggcaatcattgaccaatacaaagaaaagctaagtctagctgcaacctatgaacaaaggatagaaggcgagtatgcgaag

SEQ ID NO: 77337 - DNA, 285 bp, Glycine max
  Peptide Sequence Number=SeqID_169022
atgtcagtctttgtatgctatcaggcctttcgtcttacagatagcaaaaagaatgtttatacggataaccactcgggtatttctgtccgtcagcgtgactcaaatgtcagtatgacagatcatgtgagcgcggaagatgacgtaaatctccgcgtgtcaacgggcttgtcggccgcgattgacgaaggatacagaagacgacatcttgtgtgcgcggaagatgacgtaaatctccgcgtgtcaacgggcttgtcggccgcgattgaccaaggatgcagaagatga

SEQ ID NO: 77338 - DNA, 258 bp, Glycine max
  Peptide Sequence Number=SeqID_169023
ttcaatgaaatcgtgataccggattcgttaaccgttggatcgtcttcaaattttgtctggatatccctaagatatgtttttggtctcccgctaagcgaaaaaggtgtgttaagcgtaattccaaccgaggggaattgctctgagcggcccaaagctgcgctaagcccaattccaatcgagaggaagtgcgctgagcgcccagagggtgcgctaagcctaaatccttgcgctaagtgcaagaagtgggcttcggcttag

SEQ ID NO: 77339 - DNA, 258 bp, Glycine max
  Peptide Sequence Number=SeqID_169024
atggagaagatgaggggtatgaagaggatgggccaggatggaggaatgagaggtataggaagagaagaagtcatagaagatatggaggtaggcaaagagaggaagggattgatggaggatcagattgagaagtcccaagaggccaccatgtcaaggtttttgcatggtctcaatagggagatccaagacattgtagagtcgcaccagtatgcctctttggaggatctcattcatcaagctatcaaggtggaacaacaa

SEQ ID NO: 77340 - DNA, 225 bp, Glycine max
  Peptide Sequence Number=SeqID_169025
atgaagaaacaacaatggaggagaaggattgcatcatcccctccaccttggaaaaccaagaaaaccatgattatgaggggccaagacatttatagtagccaagatgaggctactacttcacctttctctagtgaaagtgaagaagcaaaaggggaagaatctagtgaagaaatctacccccaagaagaaggacaacctttaatggttaaggaggagtgtaaggag

SEQ ID NO: 77341 - DNA, 554 bp, Glycine max
  Peptide Sequence Number=SeqID_169026
gagatcctcatggactgccaccttcaagaggcatagaacatcaagttgatctcctccctggagcttcattgcctaacaagccaacttacaacaacaagccccaagagactcagcataaggatgcacaggtcaaagttgagtatgtgaaaagattgtatgatgaagtagggaatgatgagaatcctgaaattggccaaatacaggctaaaggcccaagtggagaagggcgaaggcccaagtggagaaggataaagcccccgagtaatccttgtggcgtctaccctgacttatcttccttcaccggaagtggcatcatccaaacctccatagcctgtatcaaacgatccgctcctactcaggttcacatcaagtcgcttccacgacaaataacttcctcttctcaatgtcaagaaggaattgcgtctagtcaatctaagaaagatttggatctatggcaagagggccttgatgatgaaaatgatcaaggtggttgggagatggaggcgtatagtctcagtttgtcgaaggctttgttcaaactgttgaacaattaa

SEQ ID NO: 77342 - DNA, 180 bp, Glycine max
  Peptide Sequence Number=SeqID_169027
atgtggcggagcattgacattgtccgtgaacgcttgacatttatggcacttccttacatggatgcagcaatcgctttccatggtgagccagtaataacccgctctcaggatcttcctagccatagcatgcccattggcgtgcgttccaaacgaaccctcgtggacttcctcgatcatgtg

SEQ ID NO: 77343 - DNA, 1325 bp, Glycine max
  Peptide Sequence Number=SeqID_169028
atcatcacctactcacgattttccgcgtgccagtgcgtgatgtcattggtggtttggcgttaattctgtataagtattcatcggggatcttttcgaatacaacgttgattcggctgataatcatccataaggacagggatatgaaaataacgcattcaggctataaaaccggcgccgccaccttattggcggtgatgctcgcactggcattaacggggtgtgccaagagcactgtccccagccaaaccgttccggcgaataaaggggtcgatgatcttttcgccaaccttggtgaaccaaagacgcctgtgccgggaaaagagaaagaacagtattttgcccagttgctggccgtgattcaaagccatttgaaagatgcagaagcctactcaggcagaagttgtacattgcgcatcaagctggcgccggatggtctgctgatcagcgttcgggctgaacaaggggagccgcaactttgccaggccgcgataaaggcaatcgtcaatgcgcgtttgcctaagccgccaacggccgcggtttacgaagcggtcaacaacggcactcttcacggcatatgttgccaatacctaccgatacatcattgcgctcacgcgctcgcttcgatctttaaaaccgttgctgcgcatcgtgaccacgtaatagcggtagtggtgtttctgcgcgtactcgcgcaccagctcttcggcaaacaggccgctgaaggtgacggtggtgacgaaggtcagccctttcacttcgtaggtgctgatctcttgcggagtgccgatatacggcggcgggaacacggttttgtggaactggcagcccgccagcagcagggtaaacagcagggcggcggagatttgcgcggttccgccgtcatccatacgaatgaggggttaaatatgcttgtgcgccttgctgcggaaaccgatgccgcagccctgatcgccctggacagcgttgctcagaatgcgccgcagcgcgcggcgcaaatccgcgcctggtgcgcgcagggcatctgttttcttgccgaggaacagggcatggtgatgggctatggggtgctgcactatcacttcttcggctgcggctttatcgagatgttgatggtcggcgagcgctatcgccgccggggcgtcgggcaggcgctgattgcggcgttgaagtcccattgccggcaaccgaagctgttcacctccaccaatcgctccaacctgccgatgcagcggctgctgctgaacgccgggtttgtcgccagcggccggattgacaatctcgatgacggcgatccggagcaggtcttttttatcccggcgcgctga

SEQ ID NO: 77344 - DNA, 456 bp, Glycine max
  Peptide Sequence Number=SeqID_169029
atggccccaaggaagcttgcctcaaagagatccaggaaggataaagtggctgaagggaccagttccgctctcgaatatgacagccaccgttttaggagcgctgagcaccagcagcgcttcgaggccatcaagggatggtcatttctccgggagcgacgcgtccagctcagggacgacgagtataccgacttccaggaggagatagttcgccggtggtgggcatcactgtggatcccgttcgatgcggatgctctcagccagttcctgggataccctttagtgctggaggagggccaggaatgcgagtatggccagaggaggaaccggtccgacaggtttgatgaggaggccatcacccagttgctatgtataccggggcaggattttgcccggactgttgctggaagacgggtgcggatcatgcgcaccaacatgaccaccctgactcagatctag

SEQ ID NO: 77345 - DNA, 347 bp, Glycine max
  Peptide Sequence Number=SeqID_169030
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggataaatattctctagtgagcacgacagagacgggggcatggatcacaccccttccagcgggggatgaagatagggaaaaaaactccaataatgaggatcaagaatggaaaccagggattagttggggggtggggagcaaggagtactcccctcttccctattcccgccctacccg

SEQ ID NO: 77346 - DNA, 375 bp, Glycine max
  Peptide Sequence Number=SeqID_169031
atgtgggtgttgtggttacgtcatgggtgtctccctcctttttcttttccctatctgttccagtcctcctattgccgacacttgttgaagtggtgtaatcgaatttgccccttcttaggcctacttcgattctttcgcttgcaaatactagatccacaaaacttgagggcatgtatcccaccatcttctcatagtagaacacggcgagcatcggctaagtgcaacactcagtggctaagcacgaggaagaatccagaagaagatgagctgtacaggttcgttgagtgcacctcaccaggtcatcaagcgcactgcttcagctcatccgctaagcgagagaagtgcgctaagccgaaattcactgatgtgcgctaa

SEQ ID NO: 77347 - DNA, 162 bp, Glycine max
  Peptide Sequence Number=SeqID_169032
atgtcaaatgaagaattgaagttgcaggatccacgatgtcggatacaatgtcctgacatcctgcccgagaatactgaagttgctgtacaatgcaagataaaaataaaagtcaagtgcagaagtgaagctgcaggatccacgatgtcggacacgatgtcctga

SEQ ID NO: 77348 - DNA, 129 bp, Glycine max
  Peptide Sequence Number=SeqID_169033
atggatatgagcttgaaggtagaagaagatgagtggaggaagagggagagaaggagcacaaaattttgtgcctcaaatgagcccactaatccaagatcaagtccaagattctccactaagtgtgcttag

SEQ ID NO: 77349 - DNA, 496 bp, Glycine max
  Peptide Sequence Number=SeqID_169034
atggtggaagaatttgaagagatcctaggatgtcctctagggggaaggaaaccatacctcttctcagggttctacccctcattggccagaatttctaaaaaagtccaaatctcggcgcaggaattagaccgccaaaggcaagtcgaaaatggggtggtcggaataccgagaaaatatttggaggtaaaagcaagaatcttggcagataaaggcgagtggaccccattcatagatattctcacactattgattttcgagggagtcctctttccaaatgtggatgggttggtggacctggcagcgatcgacgtattactcgcctatcataaccacaaggaaagtccggttgtcgctatgctagccgacctatatgacaccttcgaccgacgatgtgaagaaagcaatgcaaggattgtatgctgtactccagctctctatgtggggctggtttcacacctttttctccaagaaggtaggcccgtctatccgctacaag

SEQ ID NO: 77350 - DNA, 368 bp, Glycine max
  Peptide Sequence Number=SeqID_169035
ggtgatgcaccacaggccgcagacgcaccgccaccacctcatcaggctgctcctgctgggtcattaggcatgaagtggtatctacaacacttggttcgccaacaggcggccaaccaccgggggcaggtgcagatacatgagtgtctctaccagctcagcctcagtcagcagggccaaggtttcgctccttttgcgtgccctactccagatcagtttagggctgaggtcacatggcccggagattggcccgaggcccaggcaggggaggcgtctgcaggagctcccgacgatgcagaggaggcccgcatggatgaggagatgacagacttgcttggcttcttgggaggaagcggagccacgtggccgag

SEQ ID NO: 77351 - DNA, 105 bp, Glycine max
  Peptide Sequence Number=SeqID_169036
atgtcgttgaactccacggatttcctaacgatgggtgtcaagtaccttgaagcggtcaagcaaaggttgcatgccaccaaacaatggtccccggacgaaattagg

SEQ ID NO: 77352 - DNA, 329 bp, Glycine max
  Peptide Sequence Number=SeqID_169037
tctggagctgtgttccatgattgcctaagagaggaccctcaaggcaatcctccattctcatccttttctggagccacatggatgttcttgcttagggctgttcatgtgtcctccactctcgagtttggagctgcgtttaatgattgcctaagtgcggaccctcaaggcaatcctccatactccacctttgttcggagtaccatgaatatcggttccttcgccaagtataaggaaaaagaagaagtggagatgagagtcgtcatcacgaagagggcaggacggacgaaatcagtgtcttatctttgctttcctcttatcttcgatgagag

SEQ ID NO: 77353 - DNA, 138 bp, Glycine max
  Peptide Sequence Number=SeqID_169038
atggagtttggagtttttcttgaagaagcctctgcatgcacgagaatcagacccaggcttgaagcttttgcatgtttaggaagttctagagagagaaagagatgcgagttcgaagcgaaagccattctgagaacttga

SEQ ID NO: 77354 - DNA, 480 bp, Glycine max
  Peptide Sequence Number=SeqID_169039
atgagttcagcacagaaagcttggattgtggcaactagtgttggagttgtggaggccttgaaggaccagggcatctgcaggtggaactatgctttaagatcagctcagaaacaagtcaaaagccacgttggatctttgtcacaggcaaagaagcttccctcttctgctatggtttctacttcttgcggattaaaggggcagaagcagtcagaggagtccttaaggactgtcatattggtacaaactcaattttcaagcaataaacgagataaggaattcttttcacgacctcgcgctaagcgcatacttctgggcttagcgattatgacagtgatcaccgagtatgacgacgatcatgcgcttagcgcgagatgcgctagtacgtctttgggcttcttcgtggatcttccgctaagcttgagcgggtcgctaagtcaaacaagcgctaagtctgtcttcccgccaccattgtttgtgtga

SEQ ID NO: 77355 - DNA, 1455 bp, Glycine max
  Peptide Sequence Number=SeqID_169040
atggcttctcatcaattcctcgacaacttcataattcccgatcacattctcgtaccgggctcctccgactccgatgttgaaaatgtcggtgacgtgcctcactgtccggtccttgttttcgtcaactccaagagtggcggtcaactcggcggacatctcctcaaaacatatcgcgatcttcttaatcccaaacaggtttttgatttgggggaacatgctcctgacaaggttctcagaacagtgtatgctaatttggaaggcctcaacgtacggggttatcagtttgctgacaagatcaaggagagattgaagttaattgttgcagggggtgatggaacagcaggttggcttcttggagttgtttgtgatctcaaattatctcatcctccaccaatagccacggtccctttgggcacagggaataatctaccttttgcatttggttggggaaagaagaacccagcgacagatcaaagatccattgaggcatttttagatcaagtcatgaaggctacaaaaatgaaaatagacaactggcacattctcatgagaatgagagctcctaaagaaggtccctgtgatcctattccaccacttgagctaccacattctttgcatgccttccatcgtgtatctgaatcagatgaatttaatatggaaggttgccacacatttcgtggggggttttggaattatttcagtatgggaatggatgctcaagtgtcttacgcatttcattcagaacgaaagaagaatcctgaaaaattcaaaaaccagttaattaatcagactacttatgctaagcttggatgctcacaaggatggttttttgcttctatgtcgcatcctgccgacaggaacatagcacaactagcgaaagtaaaattcatgaaaagacatggtgaatggcaagacctagacatacctcccagcatccggtcaattgtatgtctcaacttgcctagcttttctggcggattcaatccatggggtacaccaaataggaggaagcagagtgacagagatttgacaccaccatttgttgatgatggccttctagaaattgttggttttagaaatgcatggcatggacttgttttacttgctccaaaaggacatggaactcgtcttgctcaggcacatagaatccagtttgagtttcgcaaaggtgcagcagatcatacattcatgaggattgatggggaaccttggaagcaacctcttccagttgatgatgatactgttatggttgagatttctcaccatggccaggttaacatgctatccactcataattgcaagtctaaaagtgtgtatgatccttcatcaccacaccatgaggatgaggaagacgacagtgatgaagaagactctgtagcagaggaatttcggaagtttggagcagctgatacatttagaatcccagatgaggttgatgtttctcatcttagttag

SEQ ID NO: 77356 - DNA, 330 bp, Glycine max
  Peptide Sequence Number=SeqID_169041
atggtgatgacgatgctggttgtagtgcttcactggtgtggtctagattttgatcgaggccgatgttgctgtaattgcgacacaaatgcggtggaacgtcaacggtattatgagatttttacatttgtcaagtggatgcaattgaaactagttatcaccattcagttagttttaaaaatgtctaaatctcaacagttttccacctccatttgttggaaccctcctcgtaacagtcagtataaactatactgtgatggttcggtcaagcttaattcaagccaagcagttgctgatgatggggtctttcgagaccacaagggttctgtttaa

SEQ ID NO: 77357 - DNA, 876 bp, Glycine max
  Peptide Sequence Number=SeqID_169042
atggccactgttacttcttctttctctttctccactctcactcaatcttcttcgccgaggaacctctccacactctcttccaattcaccaacttttcgcatccgcgttggtttctcctgtcactatgttggagttcgagcttccaattccgcttccaaaatagtcgttcgatgctcctctgccgtcgcagaacctccaactgtttctgagacaaagttaaattttctcaaggcatataagcggccaattcctagtatctacaacaccgtgctgcaggagctcattgtccagcaacatttaatgagatacaagagatcgtatcgctatgacgccgtatttgcccttggctttgtcactgtatatgagcaactcatggaagggtatccaagtgatgaggaccgagatgccatcttccaagcatacattcaggcattgaaagaagatcctgaacaatacagagtagatgcaaagaaattggaagagtgggctcgggcccaaaaccccacttcactagtagatttttcatctagagaaggagaagttgagggtatattaaaggatatcgcagaaagagcaggaggaaagggggatttcagttatagtcgtttctttgcaataggcctctttcgtcttcttgagttagcaaatgcaatggaaccaacaattttggaaaagctctgtgcagttttgaatgtcgacaaaagaagtgtggatcgggacttggatgtctatcgtaacttgctttctaagttggtccaagctaaagagcttctaaaggaatatgttgacagggagaagaagaaaagagaagaaagggctgaaccacaaaagtctaatgaggccattacacaacaacagcaattttctagcctttag

SEQ ID NO: 77358 - DNA, 1473 bp, Glycine max
  Peptide Sequence Number=SeqID_169043
atggagaacaatgagcctccaaggcgtcttgagggaaaatatgctgcaatggtagtttgctggcttcttggcaacggatgccttttcgcgtggaacagtatgctgactatagaagattactatgttcacttgtttccgaaataccacccctcaagggtgcttactcttgtatatcagccatttgcagttggaacactagcaatactggcttacaaagaggacaggatcaatacaaggataagaaacctatttggatatacccttttcttcataagcactttgtcgatcttaattggtaaggctgcgtacaacatccctcccccataccttcgcatagcgaagagcctctgggcaatgggtggtgcatttggaatagcagatgctcatacgcaaggtggaatggtgggagacctgtcctacatgcttccagaattcattcagtctttccttgctggtttggctgcatcaggtgtactaacgtctgctttgaggttaattacaaaagcagcatttgagaaaactaagaacggtcttcgcaaaggagccattatgttctttgccatatcaacattctttgagcttctttgtgttcttctctattcgtttgtgttccctaaattagcaattgtgaagtactaccgctcaaaagcagcatctgaaggatccaaaactgtttcagctgaccttgctgcaggtggcatccagatcccatctggaggagccaatcaatatgaaaaagaaatagatcgcaaaggaaataagaaactgttgttggaaaacattgattatgcacttgatttgttcctaatatatgcacttacactttcaattttccctggattcttatcagaagatactggatcacacagtttgggcacctggtatgcacttgttttaattgcaatgtacaatgtgtgtgatctgattggaagatacattccactcttgaaattcctgaaggtggagtcccggaaaaagctcacaacagcaattgttagtcgcttgttatttgtgccagcattttattttactgcaaagtatggcacacagggctggatgataatgttgacttgttttttggggttatccaatggttacttcactgtttgtgttctcacttcagcacccaaaggttataagggaccagaacaaaatgccttgggaaatttgttggtgttgtttcttcttggaggaatctttgcagggggtgttttgcaagtgccaatgacgaaacatcctatttcgccaggactagcaacgacactgaggagtttcgccagcaccactagtgacacagctgtagttgtgtcaggttcacgtgtccagtgtgtttcgccatgggctggcggcaccatgcatgagtgtgttttgccaaaactgacacagtgctatgtcgctggtggtgctagcggaaccctctgtaccgctgctggtcctggtgaaatagggtgtttcatgacgaaacacccttaa

SEQ ID NO: 77359 - DNA, 48 bp, Glycine max
  Peptide Sequence Number=SeqID_169044
atggagcagctaaaggaaaaggctcagggcaatcaagttatagtggag

SEQ ID NO: 77360 - DNA, 1434 bp, Glycine max
  Peptide Sequence Number=SeqID_169045
atgaggaaaaatgtcggttctcattcaggaaggatgtttagtgataggaagtggattctccccttttttgcaagtttgattatatctatgagtctagttctgacagccattcttggattacttagttctgatggcgggggagaacagtcaccgtttgaaatcatttccttcaagagatcagaggattcaagtggatattttgtggaatcagatatacaaaggtccttaaatgttagtgtggtgaagagggaggcaccgaggtttgcatatcttatttcaggcaccaagggtgatagccgtaggatgatgagaacactagaagctgtgtaccacccaaggaatcaatacatcttgcatttagatcttgaggcgccgccacgggaaaggttggaattggcaaatgcagtgaaagctgatccaatatttcgtgaggtggagaatgtgcgtgttatgtctcaatcaaatttggtaacttataagggtcctacaatgattgcttgtaccctccaagctattgcaatattattgaaggaaagttcagagtgggactggtttattaacctcagtgcctcagattatcctcttatgacacaggatggaagtcctacattgcctgacctcaattctcgggttgcagcttatatatctgttggacaacttcacttggtgcctattggttttaagctgaaatctaacggggatggatctctatgtaacattgtaacatcattcgatttgcttcatgttttctcaaatctgtcaagaaatatcaatttcattgaacacacacgcattgctggttggaaactgaaccaaagagcaagacccatcattattgaccctgctctttacttatcaaagaaatctgatttagcattgactactcaacgaagaacacttccgacgtcttttaaactgtttactggctcagcttgggttgtactgactcggtcctttgtggagtattgtatatggggatgggataactttccacggactatgctaatgtattacacaaattttatctcctcgccagagggatattttcacactgtcgtttgtaacactgaggaattccgtcacacggcggtaaaccatgatcttcactacattgcttgggacactcctccaaagcagcatcccatctctttaactatgaaggactttgacaaaatggttaaaagcaaggcactcttcgcgcgcaaatttgcaaaggaggatcctgtgctagacaagattgacaaagaacttctggggcgcacacatagattttcacctggtgcatggtgtgatgggaacacagatggtggggcagacccttgttctgttcgtggcaatgatacaatgtttaggtcaggacctggtgctgagaggctacgtgagctgcttcaggtgctgttatctaaagaatctctaagcaagcagtgtttgtga

SEQ ID NO: 77361 - DNA, 294 bp, Glycine max
  Peptide Sequence Number=SeqID_169046
tatgtgctagtgatgcagtatgccatgccaccagctatgaatattagtaccatggctcagctgtttgaagtaggaaatgaagagcattcagttatcctcttgtggacatatagtgctgcagccatagcactcactgcctggttaacattcctcttgtggctatttcttaagaagatgagttcagcacagagagcttggattgttgcagccagtgttggagttgttgaggccttgaaggaccaaggggctaagaaccttctttccttttcttcttctatggtttccacctcttag

SEQ ID NO: 77362 - DNA, 339 bp, Glycine max
  Peptide Sequence Number=SeqID_169047
atggagattgaggagtggttgaggaagccagcaatggaaagaggacaacaagaactggatcatcatcacaataacaagatgagttcaggaattagagcatggagtgtggcagctagtgttggagttgtggaggccttgaaagaccaaggcatatgcaggtggaatcatgctttaagatcagctcaacaccatctcaaaaaccatgttggctcattctctcaggctaacaagctttcttcttctgctatgatctccacaacactaaaacatgagaaggcaaagcaatcagaggagtccttcagaactgtcatgtacttaagctgctggggccccaactag

SEQ ID NO: 77363 - DNA, 117 bp, Glycine max
  Peptide Sequence Number=SeqID_169048
atggagatagtggaactaggctgtaaggtcaactcaaaattgtcttcaagtaaatgttattgggaccttgaggatggtcatgaacataagtttctgggattggggtattgtaattga

SEQ ID NO: 77364 - DNA, 153 bp, Glycine max
  Peptide Sequence Number=SeqID_169049
atgatatattggttcttaaccagttttccacctccatttgttggaaccctccttgtaacagtcaatataaactgtactggttcggtcaagcttaattcaagccaagcagttgctgatgatggtgtctttcgagaccacaagggttctgtttaa

SEQ ID NO: 77365 - DNA, 516 bp, Glycine max
  Peptide Sequence Number=SeqID_169050
atgtcgcgagactttgcgaattacctaacgatggatgttaagtacctcgaggcggtcaagcgaaggttgcaggccatcaaacaatggtccccgaacgaaattagggctcatgaattaggtcattgcattcccattaaagagcacactcaagaagttcattacatgggaaatcaacagagacaaggatacaaccaaggaggattttcggggttccagcaaggtccctataatcagcaagggcaatggagatcacaccctggcaatcaattcaataaggaccagggtggactttccaacaggccacctcaacaagggccaaatatttttcagatgaccaccaaactagaggagacactagctcagtttatgcaactgaccatgtccaaccataagagtattgagtcagccctgaaaaatcttgagatccaggtgggtcaactggccaagcagttagctgagaagtcatccagcagctttggagcaaatatcgagaagaatcccaaggaagagtgcaaa

SEQ ID NO: 77366 - DNA, 408 bp, Glycine max
  Peptide Sequence Number=SeqID_169051
atgagtacgaccgggcgtgggaggcactcggtcctccggattttcaagggccgccgggggcgcaccggacaccacgcgacgtgcgaaaagataactctttccggggcccccgccgacgtctccggactccctaacgttgccgtcagccgccacgtcccgatctgcaccgacgaccgctccgcccgggctcgcgccctgggttttgcagcgaccgccgcgccctcctactcatcggggcttggtccttgccccgacggccgggttagcgcgcagttgggcaccgtaacccagcttccggttcatcccgcatcgccagttctgcttaccaaaaatggcccacttggagctctcgattccatggcgcggctcaacagagcagccgcaccgtcctacctatttaaagtttga

SEQ ID NO: 77367 - DNA, 279 bp, Glycine max
  Peptide Sequence Number=SeqID_169052
atgccaatctccccctgcaaaagtatcagttggtctatgtcgtcccgacatggggatcgcacccacaagacacccagtggacccggaaaagtccaacagggccctggggtttccagcagagcctctatcagtcctacagggtgcccgtacccccccccccccgggaagttctacggagtacctgtcacctccagcaagggcatcaggccccctactaatcaagctttcatcaagaagtactgcgcccccagacgggcgcacggcgagacaccacagtag

SEQ ID NO: 77368 - DNA, 380 bp, Glycine max
  Peptide Sequence Number=SeqID_169053
atggctgaacctcgttttatacatctgcgcgtacacagcgattactccatggtcgatggtctggccaagaccgggccgctggtaaaaaaggcggccgcgctcggcatgccagccattgccatcaccgactacatcaacctgtgcgggctggtgcgcttttatggcagcgcgcacagcgccggtattaaaccgatcgtcggggccgacttccaggtggccagcgatttgatgggcgatgagctgacgcagctcaccgtgctggccgctaataacaccggttaccagaatctgacgctgctgatttcgcgcgcttaccagcgcggttacggtatcgccggaccgattatcgatcgcgactggctcctggagctgggcgaccg

SEQ ID NO: 77369 - DNA, 1355 bp, Glycine max
  Peptide Sequence Number=SeqID_169054
ggcattccggccgcgctggtggcgaaattcctcgaccagcgtggcatcgtggtggaaaagaccggaccgtacaatttgctgttcctgttcagcattggcatcgataaaaccaaagcgatgagcgtgctgcgcggactgacggagttcaaacgcgcctacgatctcaacctgcgggtaaaaaacatgctgccggatctgtatgctgaagatcctgacttctaccgtaatatgcgcatccagacgctggcgcagggcattcatcagctgatcctgcagcacgatttgccgcgtctgatgctgcgggcatttgacgttctgccggagatgaagatgacgccgcaccaggcgtttcagcggcaggtgcagggacaggtggaaaccgtggacattcgcgagctggtcgggcggatttcagccaacatgatcctgccttatccgccaggcgtgccgctggtgatgccgggcgagatgattaccgaacagagccgggcggtgctggatttcctgctgatgctctgtaccatcgggcggcactatcccggctttgaaacggatattcacggtgccacgctcaccgacgacggtcgctatctggtgcgcgtgctgcgcgacgagcctgtcgcgctaacttcagataattgcctcttttcagcgtcgcgccgggcactaaggcgttttactgcgacgtgctgggctttgagctactgggtgaatactatcgcgctgagcgcgattcatggaaaggcgaccttggccttaatggcgtctataccattgagctgttctcagtttcctgcgccgccgccgcgcgtcagcgggccggaagcgtgcgggctgcgccatctggcgttttgtgtggatgatgtcgaacagtcggttgccgcgctggcagacaagggcgtggtgtgcgagccgatccgcatcgatgctctcaccggtaaagcctgcaccttcttccctgatccggatggtttgccgctggagctgtatcaggcccgatgcccgctgcgtgctggcattcagcggcgggctcgattccagcgtcctgctgcatcagttagtgagctggcaacgccagcagccgcagctgcgcgtgcgcgcattacatgtgcatcatggtttaagccccaacgccgatcgctgggcggcgcactgccagcagcagtggacgctcgcgccggcggtatcgaagccgcagcccgcacggcgcgctatcaggcgttattcactcacctgcaacccggtgagtacttacttactgctcagcacctcgatgaccaggctgaaacgctgctgctggcgctgaacgcggcagtggtccggctggtctggcggcgatgccgcagcagcggcag

SEQ ID NO: 77370 - DNA, 933 bp, Glycine max
  Peptide Sequence Number=SeqID_169055
atgataggaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacggttcgtattcgtactggaaatcagaatcaaacgagcttttacccttttgttccacacgagatttctgttctcgttgagctcatcttaggacacctgcgttatcttttaacagatgtgccgccccagccaaactccccacctgacaatgtcttccgcccggatcgaccggccgaagccgaccttgggtccaaaaagaggggcagtgccccgcttccgattcacggaataagtaaaataacgttaaaagtagtgtatttcactttcgctgtttccagctcccacttatcctacactctcaagtcatttcacaaagtcggactagagtcaagctcaacagggtcttctttcccgctgattccgccaagcccgttcccttggctgtgtcggattccccttgtccgtaccagttctgagttgactgttcgacgcccggggaagaggccccgaagggcccgttcccaatccgtcccccgaccggcacgcgacgacccgctctcgccgcggaagcagctcgagcagtccaccgacagccgacgggttcgggactgggacccccgtgcccagccctcagagccaatccttttcccgagaggctgttcaccttggagacctgatgcggttatgagtacgaccgggcgtgggaggcactcggtcctccggattttcaagggccgccgggggcgcaccggacaccacgcgacgtgcggtgctcttccagccgctggaccctacctccggctgagccgtttccagggtgggcaggctgttaaacagaaaagataa

SEQ ID NO: 77371 - DNA, 384 bp, Glycine max
  Peptide Sequence Number=SeqID_169056
atggcaagagctggtgacaatggtggtatatatcatcaactggacgaatatcagcgcttatttctggacgcgtggactacacaaatgcaacgtttgttaaaccgtaacaaagaagagccctacagacgaatagccaaatcttcctcgtttgctcttaaacctctatcccctagagaagtgtgtgatggccaaatcagaatgagagaaaagagagaacaagagaaagaaaatagtgaggcaccacaaaggaatatgaaaaagaagagtgatacacccgaggaaaagagtgatacacaagagagagagagtgataattctaatcagactttaaagatgtctttcccaacgagattcctcatggactgccaccttcaagaagcatag

SEQ ID NO: 77372 - DNA, 444 bp, Glycine max
  Peptide Sequence Number=SeqID_169057
atggaatcaagaaaaagagctagaacagaggacatcccttcgtcatccactccaactcctctccggcaagagttagctcacaataggccaatcatatctatggagcattttcttgagcaagtagcctggcctgaagctcaacttccattggtgagacccaatgaggctgctctgcctgagcccacacctgtgcaggtgaattcagagccagctaacccacaatctccagtggtgaatccacctttttcgcctgagcttgaagcagttcccccatctcctcctctgattgtcatttttgatgcatcatcagatgaagcagctgcccctcctgattcaccagctgcagaaatagttgacccctctgtttccccaattggaggaattgctaatctttctaattcatcatcaggaaaagctattgctctcaccgattccccattttaa

SEQ ID NO: 77373 - DNA, 162 bp, Glycine max
  Peptide Sequence Number=SeqID_169058
atgggtcgtaggcaacacactaacttttttatggatgagctgaggggctttggaggtggaggcggtgcgtttgttgcccgctgccggccattcccaggctactatggtgtctcgccctgcgcctgcctgggggcgcagtacttcttgatgaaagctcgatta

SEQ ID NO: 77374 - DNA, 183 bp, Glycine max
  Peptide Sequence Number=SeqID_169059
atgtctcttgatacggcctccagtgagcgcaaaatagatgacctttctgctggcaggcgcttcgctgcgccttccggcttaagtggccaattaacagggaacagtgttggccacaccgcaatgtgtccgcgagcgaccataatgaaatcacaacaatgtcgccgtgctgtttgtcccggataa

SEQ ID NO: 77375 - DNA, 396 bp, Glycine max
  misc_feature (5)..(5): n is a, c, g, or t
  Peptide Sequence Number=SeqID_169060
ggggncggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcactggcacgacaggtttcccgactggaaagcgggcagtgagcgcaacgcaattaatgaaacagctatgaccatgattacgaattcgagctcggtacccgaactcgctaagcgagcattcgacgctaaccgagttcatcaatactcattgtatataagcgcactgactgcgctaacgagttcatcctttaaggatgaacattcatcctcttgctga

SEQ ID NO: 77376 - DNA, 117 bp, Glycine max
  Peptide Sequence Number=SeqID_169061
atggccagtgagggctttacaatgagaaggaaggtgaaagaaagaaagggagcgcgctcagcgcgacatcccctcgctcagcgtgcatgttgcaggcttagcacgtgcttatgttag

SEQ ID NO: 77377 - DNA, 405 bp, Glycine max
  Peptide Sequence Number=SeqID_169062
atggctttggtgaaagagttctatgcaaacctatacagctttgagggtccttcaccaaagcaagccaggatcagaggccatctagtgaagatcgatgctgacagcctcaacacattcctagagacacctatggtgttggcagagggtgagactttgcccacatactccagatactacaggctgccttcagatcctagggagattgaggctgccctatgcataccaggccaagggttcatcttgaacgctgagggccatcctgggaggatcctgaggaaggacttgacgactttagcccagcccaagtctaactcttctagacttgggtttcctgctctgatcaccgccctatgtcgagccagaggggttgtctctaacagcctcacttttgaacgtctgagcccg

SEQ ID NO: 77378 - DNA, 243 bp, Glycine max
  Peptide Sequence Number=SeqID_169063
atgactatgtctatgatgctgcgacgatgtcccacatggccgatcccaattcctagctgccctatcagggtttcttcttctaagattccccctttcatccacttcgtgaatgaaggagtcccccctgaaggaggagaggatccaaatatgcctgtcatactgtaccctggttggaaatcatgtgggtatgaatacatcggcgccatctgcgatggttcttgggtgaataccggcggtgtgtaa

SEQ ID NO: 77379 - DNA, 360 bp, Glycine max
  Peptide Sequence Number=SeqID_169064
atggaggtcatgaaagagcaaatggccacaatgatggaggccatgatgagcatgaagaagataatggaagccaatgcggttgcagttgccgctactagcgctgttgctaaggtgaacccaatgcccccatctggcctcaaccaaatgaatcatccaacctcagctagggtaggcaaagatttggaaagtacgagcgacccccattatgtgcaaattcaaaacaagcatgccttcccaccatatggctggcctcccaactatacaccactcaatgtggcatacattccccatgaggatgtcaataactccactcccatactcattgaaagccgacaaactcatcatgcacatgtctcttaa

SEQ ID NO: 77380 - DNA, 630 bp, Glycine max
  Peptide Sequence Number=SeqID_169065
atgaggaacagaggaagacgaagaggtgttgcccttaggacagaactcaagcaagctcaaacagtcaaagaaaggttcaaatcagcagctcttaaaatccgaaaggagaatgccgaactgagagatgtaaatatggctaccaccaaggaattggaacaagagaccaaaagggcctgtagggaagaacatggtcggaacaagttccgaggggctctgtggggcagtaacagcgagcttaaacttcgaagagaagaaagggaccaatcgtccaaaagaagtttgtctcagcggttgtgcgagacagagaccaacatgttagctatcatcaccaagtatcaagaagaactaagcctagccacagcccatgagcatagggtggcggatgagtatgcccaactgtacgcagaaaaggaggctagaggaagggtgatcgactcgttacaccaagaggtaaccatgtggatggaccgatttgcttttaccttgaacgggagtcaagaacttccccgattgctagccaaggccaaagcaatggcggacatctactccgcccctgaggagattcacggacttctcagctattgtcagcatatgatagacctaatggcccatataattaggaaccgatag

SEQ ID NO: 77381 - DNA, 339 bp, Glycine max
  Peptide Sequence Number=SeqID_169066
atgcacaacattcttgacagattggatggactccacaccttcattggtgagcgttttgattcgttggacagccgcattgatgccattgatgcacggtttgcaggaatggatactcacatcactcagcttgaggaggatatgagttatgattgtcatcatcaaaaagggggagattgtggaagcaatgctttccaagtttattttgatgatgccaaagactcaagtcaagaatcaagagtcaagcaagtttcaagaatcaaagagtcgttcaatcaaagcaagtttcaagaatcaaagtcgttcaatcaaagcaagtttcaagaatcaagattaaagtga

SEQ ID NO: 77382 - DNA, 1343 bp, Glycine max
  Peptide Sequence Number=SeqID_169067
ccgtacaacacgtcgtatgtgttgaacgaggacagctactactgctcggacttcatcgaacgcgccttccgtgcgcaccacgttttcgcattgcagccgatgaatttccgtaacccgcagaccggggagatttcccagcactggattgacctgtaccgcggcatgggcatggacgtgccgcaggcctatcggcatgctggaataagcaaagccccgcacagggcggggcttcgccggtcacgttgcacgcgcaacgcggtcattcttcttcgtcgtggccgccctgctgctggttctggttgcgcttctgctgttcctgctgctgttgctgctgctggtcgcggccacggccctgctgctgatcctgctggttctgctggccctgctgcttctggttcgggttctggatctgctgagccatgtccgatctccaaagccactcgcggaatgcggattcatgcgggttcggcatgtgctcatgccgtcatcggcgttgcacgcattcatggcgctcgcagccggaaacacgcgctgaacgaggctggcttcccggctcacgcagggaagccaacgctgcattcagggcatcaccggcggcacgtacgccagggtcatccccagcagccacaacaggcccagcaccagcggaatgtgcaccagcagctggatgaaggtgaagccgacgatgtcgcgtgccttcagccccagcacgcccagcagcggcagcatccagaacggattgatcaggttcggcagcgcttcggcggcgttgtagacctgcaccgcccagcccaggtgcgccttcagttcgttggcggcctgcatcacgtacggcgcctcgatgatccacttgccaccaccggagggcacgaagaagcccagcacggccgaatagacacccatcaccagcgcgaaggtatcggtgctggccacgtgcacgaacaggctcgacagccggtgcgccagcgtctgcccatcgccgccagcggcgtgggtgaggatcatcgcgatgccgccgtacagcgggaactggatcagcacgccggtggtgctgggcaccgccttggccaccgcgttaaggaagctgcgcggtcgccagtgcagcagcaggcccagcgaaatgaacaggaagttgtaggtgttgaggttggcgatggcggtgaccaccggcttgttggcgaactcgttgaacagccagccgaacgccagcagcgagagcagcacggtcagcagcgggctgtattccaaccactcgcccgggcgcgtgcgctgctgcagtggctccggctcggcctgcgcggcgccggggaagtcttcagcggtgcgggcactgccggcggccg

SEQ ID NO: 77383 - DNA, 360 bp, Glycine max
  Peptide Sequence Number=SeqID_169068
atggataaatttgatatctttgtccctcatcctctcacaaacgcatctttgcttattcaactttcaccgaaatgtgggtgcaagccattggtctgtttgcttaagcgacctgcgctcctaagtttggacttccaagaccgttcaatcaaaaattactcatgctacacatttgatgagggtgccgtaaaacgacaaggacaacccttcccttgtgttcaagaatcccctacaacaagagacccacagtctcttaatcccttttcagaaataagaagaagagaagaagaaatctctcttaaaagagatagattgtacaatgaagatcaatcaaaattccttattgaatatgcaagtggttga

SEQ ID NO: 77384 - DNA, 204 bp, Glycine max
  Peptide Sequence Number=SeqID_169069
atgactgaatggattgtcatcatcaaaaagggggagattgtccaagcaatgtcttccaaggttattttgatgatgccaaagaatcaagagttaagaaaagtttcaagcaaagattcaagaatcaagttccaagattcaagattcaagaataatcaagatcaagattcaagaatcaaaagaagactcaatcaagataagtattaa

SEQ ID NO: 77385 - DNA, 654 bp, Glycine max
  Peptide Sequence Number=SeqID_169070
atgaaggaaggcataggtcacatcttagacctcactcccataggagagaaaaggaaagaaagcctcaagaggctaacattaacctccccatacttccatgggaaggacaatgtagaggctaatatagtttgggaaataagggtagagcaacaacttaaaaggaagtccacttcaaaatcttatggctctcactcttatcaaagaaagtaccaaggtcaaggaatcttaggggtgagctcttctaagcccaaagatgataaggggaagacaatagaaaagcaaccccttaaggctagtatgcaagagaagactagctccatgaagtgctttaaatgtcttggaagaggacacattacttctcaatgccccaccaagaaaaccatgattatgaggggccaagacatttataaagcaaaaggggaagaatctagtgaagagatctacccccaagaagaaggacaatctttaatggttaaggaggagtgtaaggaggtaagtgtctcctccaagaggttagctaagaaggaaagacattttgaaataaagacaaatattaaagaaatttcccttcttagacaacctccacattttctcctttgtaaaaagacacttgttagcattgccacatctcttaggcttgagtttattcctcaa

SEQ ID NO: 77386 - DNA, 48 bp, Glycine max
  Peptide Sequence Number=SeqID_169071
atggttgaaactagccaaaataacactaaaagaggggtgaaagataag

SEQ ID NO: 77387 - DNA, 303 bp, Glycine max
  Peptide Sequence Number=SeqID_169072
atgggggagagaaacggggtggaattaaattgtcatcatcaaaaagggagagattgtagaagcaaagactttgactttgatgttttgatgatgccatatgatcatgatgttttgatgccttatgaaaatgcgcttctcaagtttaattcaagacaaaaatccaagaatacaagatacaacatcaagaacatctctagtgatttaggaagggaattccaaattgaaacagcaaaaggtttggccaagaaatttaaactaaaatgtctttttcaagagatttactctctggtaaccgattactag

SEQ ID NO: 77388 - DNA, 201 bp, Glycine max
  Peptide Sequence Number=SeqID_169073
atgacagatcttgtgagcgcggaagatgatgtaaatctccgcgtgtcaacgggcttgtcggctgcgattgacgaaaggcgcataatgaccataatttgtctctgcgtgccatcggacacaactgtgtctaaatggcaaaaaggtgtgcggaatgacaataatttgtctccgcatgtcatcgggcccgccgcctctggatga

SEQ ID NO: 77389 - DNA, 244 bp, Glycine max
  Peptide Sequence Number=SeqID_169074
atgatgaaggaagtgatccacagtcacaactctgcagcgcctcggctccgattttcctcttcttcttcttcttctacatttttctatctggtttcaggggaaactcgcccaagcgagctagagctcgcccaggcgagttgcttgcttagggctgatgagcaattagaggaaaaaattgaggaatctcaggaacttgctagagatgccgttatcactgtcagaagacacatgagcccgcttagag

SEQ ID NO: 77390 - DNA, 1064 bp, Glycine max
  Peptide Sequence Number=SeqID_169075
atggctttaaagaagcttctatctaagagggcaaggaaagatgctgctggagaaggatccagtgcgaccccacaagtaggtatggagtttgatggacatcggttccgaagcgaggaacaccaatgccattttgaagtaatcaagggttggtttttcctcaaggagagacgggtccagttgagggaaggggaatatgctgaattccaggaggaaggtgtcagggataagcgctcctgggtgcggggtcaatggatcccctttgatgaagatgccatcaataagttcttggggcatccgctggtcttggaagaggggcaacactgcgaattcagtcagaggaggagccaggccttggggtttgatgaggaggcgattagttggcagttgtgtgttccggggcaagactttacccgaagcgtgacagggagacgggtgcagatcatgcgcactagcatgaccaccctgacacagattttgatgacattgctactcaacaacatcctccccagcgatcataattccaacttgcccctgcggatgtgccagctggtctatgccatttttacccaggtgaatgttcacgtggctcagttgatcttagatgccatttatcaatttgcagggatcacgccccagacacccagtggaccaggagaagtccaacagagcactggggtttccagccttgatcacgaacctctaccagaggaccagcagcagccagccgtagatgcaccgtcgctacctctacggcagccaccatctctagagtccatctctgctcacctgtggaggatggagctcttgatgcacgcatatatgcagcatgtgaccgaccagcaagcggttaatcataggggtcaagtgcagctgaatgagagcttctaccaatacaccctgcatcagcagagccaagatccaagccctttcccatggcctacccccgagcagtttggggccacagttgcatggcatggaaagaggcctagttttcaggcaggggcaggacccgcaggatccccgaagatgaagatggagctcaagaagatgatgacatggctgat

SEQ ID NO: 77391 - DNA, 195 bp, Glycine max
  Peptide Sequence Number=SeqID_169076
atggaggggaaaaggttatttgggagttttttttctgacccctggctcgtccaggctagcctctggcttgcttggacccccaaaagacttaggggtgaagtattagctcgcttgggcgagcaaggtctgagtttctcatcgcacttgaggatacgtaggagcaaggacaatgctcttgtcgaccccgaaaagtaa

SEQ ID NO: 77392 - DNA, 174 bp, Glycine max
  Peptide Sequence Number=SeqID_169077
atggacacccttgattttgcaaatgtttgtcgagaaaaaaacacactcgaaaggatgacaaaggaaagggatcaggcgcttaatgctaacattgagtcgatattcgacaactctaacttgaaggccgatataaagaaatttgaggatcaggaagctttgaggggccaaaaatga

SEQ ID NO: 77393 - DNA, 966 bp, Glycine max
  Peptide Sequence Number=SeqID_169078
atggagggtagagttaacctagggttaaaaagtgagaatggtggtgagatgagtggaaaacttggagggattgatggggacccggtgttgagaggaacgaggataagggctacatgggagtacgtgagctcagttgaaggtgggcaactggggatggtggatttatgtgtgatttgtggatgtggagagtcgacttgcaccatcgctcgatcgccacctagtaccacatatgacggagtggtacctggagatatgtcgcgggggtcaggagaccttggggacgtcaggcgagctcctggcagtcaaccaataaaagaacaaagaccacaaagcaaggaggcttgtgtggtggctggccagctatggatcttgagtgatatctggaatatggcctctgataatcgattaccaagagaagttgagatggcctctggtttccatgttctgaagctgtgtaactcgagtttggcctctggtaatcgattaccaatgttgtgtaatcgattaccagaggagaaaacccttgagatcgcgatggcagcgcaattaatccatgaccgagtggagatggagtgcctagagggagtttgggagaccctcgaaggcaatgtgaggtgccgattctggggcacgattcggttcacggctacttcattggtacgtccagaggaacccgcacgcatgcttcagcgcactgtggagtggatattacctacacctactccatatcgactagtggagcccgtccaagtgatagaggtgtcgtcatctgaagaagaccctgaggaggacccagaggagttacctcctgagcctgttgtgtatgccattgactttccagagggtgatgaggacccacttcctgatgtggattctccagaggacgtcaagtcagcatctgaggcagactctacggaggagagcggccctggagggatagtgactaatggagactcttcatcatag

SEQ ID NO: 77394 - DNA, 393 bp, Glycine max
  Peptide Sequence Number=SeqID_169079
atggatatactacgtcggttgaagaccgtcgttgtctgcgacgacgacaggctgctggtcagccccgtcttagaacttacgagagactacgacggccatggggacagaaccgtcgtagacataatcttgttctacgacggttgtctcctaaggatcgtcgtagaatggtccacaattctaacacggttgccagacagccccgtcgtagaagtaacaaaagactacgacggccatggggacagcaccgtcgtagacataatcttgttctacgacggttgtcttctgagaaccgtcgtagaatggtcctattactacaacggtgttttgttgcggacgaccgtcgtaagagacggtgttaataatactacggtcacgatacagcaccgccgttga

SEQ ID NO: 77395 - DNA, 930 bp, Glycine max
  Peptide Sequence Number=SeqID_169080
atggaggttatcctgtgcattcctggcaagggctttgttctgaacattgagggccaaccatggaagctcctcataaaggatcttactaccttggcccaaacatggagtgtcttctcttactccaacctagctcctacctcccacacctcgaacttgaatattgacagagctaggttagtttatggcttagtcacagggataaccattatggcccagttcaactcttcttgcctaggcttcccagctttaatcaaagtcttgtgtaggtcaaggggagttggatctgatgctcttactgcttacaagagcctgaggctggtcattatcttggcctatattaaaaggaaatgttggaatgtgaatgaccaaatagttaattttccaagggcaaggaaaaccaggtccagagcagctggtgttccctcttcgccagtatcaacaaccccatctgctcaaagctcccagacttcagatgctaagttgcagagtttgtttgagggacagattctcattatgcaaagcttgcaagaattggcccaccaaaggccaatcatgagtgtcgagcagttcattgagcaggtggcctggcctagagctcaaccttcttttgttagtgattatggaagctatacagcccaggcacctcagcagcaaaagccagagccaaaagaccaccaatcctctaaagccactgttcctagagcttttgatgttgcagaagtaccagtaccagctaatccaccttctccaatggtggatccatcttctcccgcgccagaagcagctctcccatctacacctattcttatatttgatgaccctacagtgcgaacacctgaatggattcctactcctccacccacatcattcacaggaacggggacgccagtgttacatttggatgatgaggagcaggatcgagatgaatga

SEQ ID NO: 77396 - DNA, 429 bp, Glycine max
  Peptide Sequence Number=SeqID_169081
atgttttgtacagacacgtgcggcgtcattcaaagacggtctttgctaggacccgtcgttgtatcccaaattgtatcacgtttacggcacgtgcttgttactttctcttactttggcgcgtcgtatcacttctttgctccatttttcgactacttacccttactttggcgccctagctacacagagcttcttctccgacaaagagcttcatctccgacaaacagcatctcgtgtccattgcctcttgttccgtttgcagccgccgtcgacaaaggccctttgttgttgttggttgtcatcatcgtggtctatatcgtagtgtttaaggaagataagtggggtttaaaatccaaagacgagcttcgggaacggcctgctgccatccttcatcagtggtgtcatcctatgccacattatcaatttcgttga

SEQ ID NO: 77397 - DNA, 276 bp, Glycine max
  Peptide Sequence Number=SeqID_169082
atggacatggcactgaggccggaactaggaaggagttgtcaaaatctccaagtcaagaaagcagaagaacaaatgattaaatccatcactaaaacttgtgtgctagagaaggagaaaaatggccccaagcgactagaagatcagcattgtccaaaggactcgtacctattttctgacgtggataaacaactggatggatcctccagctacgaatatcaaagcttcatggatgcttattcagggtacaaccaaataccattacaccctaacgattag

SEQ ID NO: 77398 - DNA, 191 bp, Glycine max
  Peptide Sequence Number=SeqID_169083
atggcaggagctggtgacaatggtggtgtatatcatcaactggacggatctcagcgcttattactggacacgatgactacacaaatgcaacgtttgttgaaccgtaacaatgaagagctttataggcgaataaaaggactagagcaccaaatgaatccaaatgctgggagaccaaatggtggcaacagaag

SEQ ID NO: 77399 - DNA, 480 bp, Glycine max
  Peptide Sequence Number=SeqID_169084
atgaatcggctggaggaaactacctcaataaaaaccaccactcaagtgaacaccataattgaagatttggaggctagtgagagaatcgtagaaacaaactggtcaaattccccaaaaggtatgtatgaacttaatgctcaagataaccttttagctcttcaacaaaagatgcaggtgcaaatagaagcaatgactaagacaatccaacaattcctacaacaactccaaggggtcatctcaaataaaccccaacaagcattcatgtgtgaaaaatgcggaggagaccatcaaacatcaaaatgcaccgaggtaccaaccgaggaggagaacccaaagggctattgcaaggctattatctccaccatagagtgtgacatgggaggtgaagaagaaaaagaggtagaagaaagcaccttggtagaggaagagatgaaagcacaagccaaccccttcaacccaaggtatgaaaccctcacttaa

SEQ ID NO: 77400 - DNA, 759 bp, Glycine max
  Peptide Sequence Number=SeqID_169085
atggaagaaccttcgaagaagcaaaaaggcgttttgacttcatccgcagttatcggaactcgaagccaaggagcatccaaagcgcagacaacccaaattcctccctctatatcatctcccacgttgttttcttcggaagaacagcgtatccggtacaattctcttttctcttctcgttccatcatcgaccctaagttcatagacttagccttctttgatgatgaagtttttgattgttttcaagcatttcaaaattctggtttaattcaatttatctccatgaaacttcctttttatcctaaattagttagagctttttattctaacttggaaattcaagaagattccttgatttccgaagtatatggaattaagatggtcatagaccagtcctttttctttgaactcacccaattatccagtgatggtgtaccgtttgaagtcaagagatatttctctatcgatgcaaatgtggtctcctctttgggataccgcaaagagagggatggttctttggtgaagaaggacgctctcgcaccaccacctcctcagagagatgattcttcatctcttatgcacaacattcttgacagattggatggactccacaccttcgttggtaagtgttttgactcattggacagccgcattgatgccattgatgcacggtttgtaggaatggatacacgcatcactcagcttgagaaagatatgagttacgttcgtcagtgcttcgaccttccaccaccatcttcatag

SEQ ID NO: 77401 - DNA, 198 bp, Glycine max
  Peptide Sequence Number=SeqID_169086
atgaaggtagatggagaaatcactaatgaatctaaaatcagtgaagaagacgaagaggaagaagagcttgaggaggaagccatgttagtgtccaaactgaatttggatactaagccccatcctaggccatacagacttcagtggcttagtgaagatgaagagcctaaagtactaaacctcaatccctcattagtctag

SEQ ID NO: 77402 - DNA, 408 bp, Glycine max
  Peptide Sequence Number=SeqID_169087
atggctgaatcaatgaaaaagagaaaaggctcttcctccaccaccgcccctgctggccatcgtcgccacggaccatctaaagcacccacagcactggatggtattctttactctgaggtggaaaatatacccattgttattaatcagtctttattcttctcattgactaaattactcaatcaaggtgttccttttgagggcactattgttaatgactggaagttcgattactcgagtcatgatgcttgcagtatagtctgtaatgaccaggctgatatgattggcagattgcttgctgggtcattaacctttgactgtcgcatcatgcactacatcattgttcgcattttgttaccccattcatctaatcttgctcaagcctctgaggaggacttgattctcatgtga

SEQ ID NO: 77403 - DNA, 165 bp, Glycine max
  Peptide Sequence Number=SeqID_169088
atggaagtcaagcttactccattggagcttgtaggcctaggatcttcttcatcaatggatccctttgcttcttggaagatgaatggaagtggaatggagaaggaagagagagaggagatgccacttcaaggagaagatgagtctagaagaagctcaccaccatag

SEQ ID NO: 77404 - DNA, 360 bp, Glycine max
  Peptide Sequence Number=SeqID_169089
atgggcagcgagggcgtgccgtcgatggtggtggaggtcatgttggtggccgccgtcgagctcactgacgcctccagctggtggcacgaaatcgatgactctctagcgtggcaggattgtatttcctacactctcgtcgtactctacggtatcgtggccgccgtagctttgggattgtgcactctttttaattttgcagttcgaatgtggttagactcacacttatactcactcactgcgtttgcttgtgtttgtagattgttcaacacatcttgcttgacatgtcgagtcttgctttctttacaacatatgcacttttggtcctgttctaggctgagatttattaccaggctagtttga

SEQ ID NO: 77405 - DNA, 603 bp, Glycine max
  Peptide Sequence Number=SeqID_169090
atgcttttgatatcatcaatcttatcctatgcattgtacaaccctgttctcactgaagaggcagaaaagttggatatcccattccaattcaaccctatgctcagcaagtttgaaaatcttgatttctacaaacttcgcgttaaaaatggggaggcacgggcaataagctctatcctgcagttgcactcccttttggccttggatgaagatgcctcacggagaaaatcgtctcttttgtcaaaaaactcaaatgcaattcacctagagtgtaaacaacgtaccgcattgagcccggcgaagagcgtgttgagatttagcgacgactcgaggagcgtgtggagggggatcgtggcgatgaagcccaggtcgaagggcggcaccatgaggagcgtgtactccatggccatgaagaagagaagccctaatgcgaacaagcatgacatccaatggtgcgtcgccacatggattgcgtccgccatggtccatttcatgaacgacatgccgcaggagtgcttggaagaggatggctttgccatggctccgtttgctaccttcatgccgttagcaccgtcgacaggagttgcagggtcgagggcacactag

SEQ ID NO: 77406 - DNA, 396 bp, Glycine max
  Peptide Sequence Number=SeqID_169091
cccaacagtaatagttcaccaaaattgatcaactcagtctggatgcttcttgtcttgcaaattggacttccggaagtgatttttcaagttggtgttgagtcatttgacattgatctgaaggagcagaaggtgacagtgaaaggaaatgtggagccagatgaagttctgcaagccgtttccaaatctgggaagaagactgcattctgggtggatgaagcaccacaatctaaaaacaagcctttagaaagtgcacctgttgcctcagaaaacaagccttcagaagctgcaactgttgcctcagctgagcctgaaaacaagccttcagaagctgcaattgttgattcagctgagcctgaaaacaagccttcagatactgttgttgaaactgttgcttaa

SEQ ID NO: 77407 - DNA, 787 bp, Glycine max
  Peptide Sequence Number=SeqID_169092
gattgaggagttgatgcattggaggttgattaaaaacattgagggagaactagcagaagtaacaaacacagtggatggcgatgataccaccgaagaggaagcaggggtgccaagttcaaaagatgtggcaggacttgaagaaggaaacaagaaattcccagaaacaaaagttgcacttgctgcagggctggacttcaaagaacagatagaacagggcttaaagttgacatttgtcagaaccagagcacaatggaacttgaaggcagttggaaggggagccttgactacatacaaagacataccaaacttagcaactgcttttgaggaaggacctcaagtcaaagcaatggataccctctggcttggaccagaacatcccacagttctgaagacaaagatgaagggccaaaagaggaggtttgagcagacaacgatggtgactaacaatggagaagggaatgcaagggctggaactatcaagctgccaataccgaaaacagggactaaaatatgcccaaaggagactacaaagttgttaaaactgggactggccgatgaagtgactggaggtggtccggcgacgttccgacggctggaaggcaacgcgtggctttcacgcaccgagactggcgcgaacttgcggcggcacgtggaggcgcatggctgggattctggccaagcgacttgtaaggacggtgatggctggcggccggcggtggccaaagatggcggcgacgtcggagacaatcagaacgggatcgtacccactctgataccgtcgtgttga

SEQ ID NO: 77408 - DNA, 153 bp, Glycine max
  Peptide Sequence Number=SeqID_169093
atgggatgttacatgaaatgcccaaagtttcctatacactacttatatgcacttgacaccagttctctgaatgggatagaactagaagaaaggaatcatacatgcaaagcttttgatgcaaaagatcagagtggaggagtaaggcagttttaa

SEQ ID NO: 77409 - DNA, 252 bp, Glycine max
  Peptide Sequence Number=SeqID_169094
atgtaccctccacttgaactgatccacaagagatatgatgacaaaggtgatgacaaaaagcttaaagatcaatcaaagtcaactcaaataaatcaaagatcaatcaagaacaattcaagagttcaagataagaatcaagaagaattcaagactcaagaagaaagtctagagacaagaatcaagattcaaggttcaagatctcaagaatcaagatcaagattcaagaatgaagagaagactcaatcaagataa

SEQ ID NO: 77410 - DNA, 285 bp, Glycine max
  Peptide Sequence Number=SeqID_169095
atggctacaccacccagctctcctcctcctcctcctcctactggtgcagcatcacagtcgccctctagcttgaagcggacaagaaaagccacacgcctaagaccattgatgactagactagttggggcagagagactcttagtccatgtggatcttgcgaccaggaaagccgacgatccccacagaaagaagttaagaacatatttggggatcttcacttgtgataaggctgaatttgatatccctgaagcatctgatcagaggacaaaaaagataataatttag

SEQ ID NO: 77411 - DNA, 485 bp, Glycine max
  Peptide Sequence Number=SeqID_169096
atggcgcccactaggcaccctttggacccagataagtccaacagggccctgggattccccgcactgatcacaggactctgccagtcgttcggagtccccgtcgcacctaccaaggtgattcggccgcctatcacccgggcttttattgagaagtactgtacccagagacagggtcagggtgatgctccacaggccgcaggcgcgcccccaccacctcatcaggcgggccaggctggggcattcgacatggagcagtatttacgacatttggttcgccagcaggcagccaaccaccgagcacatggcttcgctcctttttcatgccctactccagaccagttcagggcagaggttgcatggcccggagattggcccgaggcccaagcaggagggacacccccagaagctcccggcgatggagaagaagcccacgaggatgaggagatggctgatttgcttgacttcttgggagggagtggagacac

SEQ ID NO: 77412 - DNA, 252 bp, Glycine max
  Peptide Sequence Number=SeqID_169097
atggcctcctatggtgtggcgtctcctctctctcttcctttctccattccgctgccattcatcttccaagaagcaaaggaatccattgatgaagaagatcctaggcctacaagctccaatggagcttgcatcacgtctacccagacttatcttccttcacgggaagtggcgtctaccctgacttatcttccttcaccggaaagtggcgtcatccaaatctttgtagcctgtatcaagcgatccaccccgtaa

SEQ ID NO: 77413 - DNA, 177 bp, Glycine max
  Peptide Sequence Number=SeqID_169098
atgataacaaaagatgatgacaaaggtgatgacaaaaagctcaaagatagaatcaagaacacttcaagattcaagaggaaagttgatttcaagaatcaagaatcaagattcaagagatcaagatttcaagaatcaagattcaagagatcaagattcaagactcaagagaaggcttaa

SEQ ID NO: 77414 - DNA, 258 bp, Glycine max
  Peptide Sequence Number=SeqID_169099
atggatttgaggcttttagtcctcacgttagtttcacaccttgcggggcaggatcaccttgggctaccttctggagtggagacaaaacacgaacggcagaaaccaatcaaggtacttaaggatgaacgcaatcggggatgggatcacgaccgaccgatcgttgcccttctctgtgcgaagcaagcagggaatgtcgctgcaaggcagccccgtatcctttgtattttgcagctttcttttactatttgtttgttttga
